United States Patent 9,254,311 (MODIFIED POLYNUCLEOTIDES FOR THE PRODUCTION OF PROTEINS) - sequence listing, part 15

SEQ ID NO: 30246 - DNA, 1377 bp, Artificial Sequence
  Description of Artificial Sequence: Synthetic coding sequence
atgtcgtccagccggcctgagccaggcccttgggcccccctgtctccccgactgcagcccctgtctcaaagttcttcttcccttttaggtgaaggacgcgagcagcgccccgagttgcgaaaaactgcgtcctccaccgtatggcaggcccagcttggcgaagcgtctacccgccctcaggccccggaggaagaaggtaacccacccgagtcaatgaagccagctagagctagtggtcccaaagcacgcccttctgctgggggacactggtggtcatccacagtgggcaatgtgtcaacgatggggggctctgatctgtgcagattgcgggcaccatcggctgctgctatgcagcgatcccactccgatttggtccgatccacgcagatgagggggcactccggcgctagaaaggcgtccctgtcctgttccgccctcggctcatctccagtgcatagggcacagctccagcctggaggaacgagcggccagggaggacaagccccagccgggttggagagggacctcgcaccagaggatgagacaagtaactccgcttggatgttaggagcgtcccaactgtccgttcctcctcttgacctcggggacactactgcgcactccagcagcgcacaggcagaacctaaagcagccgaacagctggcgactacaacatgccatgctctgcctcctgcagctttgctatgcggaatgcgggaagtgcgtgccggtgggtgctgccatgctcttcctgcaacggggatacttgcttttccaaagctagtggcatccgtgagcgagtccggtcttcaggctcagcacggagtaaaaattcactgtagactaagcggcggattacctggccacagccattgttgcgcccatctgtgggggccggcgggcttggttcccgaaccgggatcacgaactaaagatgtgtggacaatgacttctgccaacgaccttgcccccgccgaagcatcacctctaagtgctcaggacgcgggggtgcaggctgcacctgttgccgcctgtaaagctgtcgccacatctcccagtctggaagcccctgccgctctgcacgtattcccggaggtgactctgggctcttcgctggaagaagtcccgtcacccgttagggacgttcgttgggatgctgagggcatgacctgggaagtgtatggcgcagccgtagatcttgaggtcctgggcgtggctatccaaaagcacctcgagatgcaatttgaacagttacagagggcccctgcatccgaagattctctttccgtagagggcagacggggacccctgcgcgctgttatgcagtccctccggagaccctcctgctgtggatgcagtggagctgccccagaatag

SEQ ID NO: 30247 - DNA, 1377 bp, Artificial Sequence
  Description of Artificial Sequence: Synthetic coding sequence
atgtctagcagtcgcccagagcccggtccttgggctccccttagtccccgattacagccattgtcacaaagctctagcagtctattgggagaaggtcgggaacagcgccctgagctcaggaagactgcatccagcaccgtctggcaggcccagctcggtgaagcatcaacgagacctcaggcccccgaagaggaaggcaatcctcctgaatcgatgaaacctgcccgagcctcaggccccaaagcaagaccttctgctggcgggcactggtggtcctccaccgtgggaaatgtctctacgatgggcggaagtgacctgtgcaggctgcgcgccccctcagccgcggccatgcagagaagccacagcgatctggtgaggtctacccagatgagggggcactccggcgcaaggaaggctagcctgagttgctcagccctcgggagttcaccagttcatagggcacagctgcagcctggcggcacttctggacagggtggacaagctccagccggactcgaaagggatctcgctccagaagacgaaacatccaacagcgcctggatgctgggggcctcccaactgagtgtcccacccctggatttgggggatacgaccgctcacagcagcagtgctcaggccgaacccaaggccgcagagcaactagcaaccactacatgccatgcccttccccctgctgctctgctctgtggcatgagagaagtgcgtgccgggggatgctgccacgcactgccagctacgggcattttagccttcccaaaacttgtggcttccgtgagtgagtccggcctccaggctcagcatggggtgaagatccactgcagattgtctggtgggctaccaggacattctcactgctgtgcccatctgtggggacctgctggcctggtccccgaacccggaagccgtacaaaggacgtctggaccatgacatccgccaacgacttggccccagcggaggcctctcccctttctgcacaggatgctggtgtacaggccgctcctgtggccgcgtgcaaggcagtcgccacctcacctagcctggaggcgcctgccgcactgcacgtctttccagaagtgaccttaggatcttccctggaagaggtgccaagtcccgtgcgcgatgtccggtgggatgccgaaggaatgacatgggaagtctacggcgccgccgttgatctggaagtattgggcgtagccattcaaaaacatctggagatgcagtttgagcagctgcagcgggcccctgcttccgaagacagtctgagcgtcgagggacgccgcggccccctgcgggctgtgatgcaatccttgcgtaggccctcctgctgcggttgctctggagcagcacccgagtag

SEQ ID NO: 30248 - DNA, 1377 bp, Artificial Sequence
  Description of Artificial Sequence: Synthetic coding sequence
atgagctcctctcggccagagccagggccatgggcccccttaagcccgcgattacagccattaagtcagtcttcgtctagcctgctgggggaaggacgggagcagagaccggagttacgcaagaccgcttcttcaaccgtgtggcaagcacagttgggcgaggcgagcacccgccctcaggctccggaggaggaggggaatcccccggaatcaatgaagcccgccagggctagcgggcccaaggcaaggcctagcgcaggcggccattggtggagttcaaccgttggaaacgtgtccacaatgggaggatcggatctgtgcagacttagagcgccgtctgccgccgcgatgcagcgcagccattccgacctggtgcgctccacccagatgcgcggccacagcggcgcgaggaaagcttccctgtcttgctcagctctcggaagctctccagttcacagagctcagctccagcccggtggtacaagcggacaaggcggccaagcgcctgctggccttgagagggatctagctcctgaggacgagacctctaattcggcatggatgctgggtgcttctcagctgagcgttcctcctttggatctgggagacacaactgcccatagttcctctgctcaggccgaacctaaggccgcagaacagctggcaacgacgacctgccacgccttaccacccgctgcactgttatgcggtatgagagaggtcagggccgggggatgttgccacgccttgcccgccactggtatcctggctttccctaagctggtggcaagcgtctccgaatcaggcctccaggcgcaacacggagtgaaaattcactgccggctctcaggcggactgcctggacatagccactgctgcgctcatctgtgggggcctgcagggcttgtcccagaacctgggtctcgcacaaaagatgtgtggacaatgacctccgcgaatgacctcgcgccagccgaagccagtcctctcagcgctcaggatgccggagtacaggccgcgcctgttgctgcctgtaaggcagtagccacaagcccgtccttagaggcccccgcagcattacacgtcttccccgaagtgacccttggctctagtctcgaagaggtgccgtccccagttagggatgtccgatgggacgccgagggcatgacttgggaggtgtatggggctgcagtcgatctagaggtacttggtgtggctattcagaaacacctggaaatgcagttcgaacaactccagagagcgccggcttcagaagattcactgtctgtggaaggaagacgcggccccctcagggccgtgatgcagtccttaaggaggcccagctgctgtggctgttcgggggcagcacccgagtag

SEQ ID NO: 30249 - DNA, 1641 bp, Artificial Sequence
  Description of Artificial Sequence: Synthetic coding sequence
atggagctggagaacatagtggctaattcacttctcctgaaagcccgccaagagaaggattacagctctctttgcgacaagcagcccataggccggcggctcttccggcagttctgcgatacaaaacccaccctcaagaggcatatcgagttcctagacgcagtggctgagtacgaggtcgcagacgatgaagatcggtctgactgtggacttagcatccttgaccgcttcttcaacgataagttggcagccccactgcctgagatcccacccgacgtggttactgaatgccggcttggactgaaggaggagaaccctagcaagaaagcattcgaagaatgtactagagtcgcccacaattatttgaggggagaacccttcgaagagtaccaggagagttcttacttctctcagttcttgcagtggaaatggctcgaaagacaaccagtcacaaaaaatacctttcgacactaccgagttctggggaaagggggcttcggcgaggtctgcgcatgtcaggtacgcgctaccggtaagatgtatgcatgcaagaagttacaaaaaaaaagaatcaagaagcgtaagggagaagctatggctctaaatgagaaacgaatactggagaaggtgcagagcaggttcgtcgtcagtctggcctacgcttacgagaccaaagatgccctgtgcctcgtgctgacaataatgaacggaggagatctgaaatttcatatttataacctcggcaaccctggattcgatgagcaaagagctgtattctacgccgcagagctatgttgcggcctggaggatctccagcgcgaaagaatagtataccgggacctgaagcctgaaaatatcctgctggatgacagaggccatatccgcatcagcgacctgggcttggccactgagattccggagggccagagggttcggggtcgggtgggcaccgtaggatacatggctccggaggtagtgaataatgagaaatacaccttctctcccgactggtggggcctcggatgcctaatttatgagatgattcaggggcactcacccttcaagaaatacaaggagaaggtgaagtgggaggaagtggaccagcgaataaagaatgataccgaggagtactccgaaaaattttctgaggacgccaaaagcatctgcaggatgttgctaactaagaatccaagcaaacgcctcggatgtagaggtgagggcgcagctggagttaagcagcatcccgtgttcaaggatattaacttcaggaggcttgaagctaatatgctagagccccccttctgccccgacccacatgccgtgtattgcaaagacgttctcgacatcgagcagttttctgttgtcaaaggaatttacctggacaccgccgatgaggacttttacgcgcgctttgccacaggatgcgtatcaatcccatggcagaacgagatgatagaaagtggctgcttcaaggacatcaataagtctgagagtgaggaggctttgccattggacctggataagaacatacacactcccgtgtctaggcccaaccgcggctttttttacagactgttcagaagaggcggctgtctcaccatggtgccgagcgagaaggaggtggagcccaaacaatgttag

SEQ ID NO: 30250 - DNA, 1503 bp, Artificial Sequence
  Description of Artificial Sequence: Synthetic coding sequence
atggagctggagaacattgtggccaatagtttacttcttaaagctcgtcaggagaaggattactccagcctctgcgataagcagccaattggacgccgactgttcaggcagttttgtgatactaaacctaccctgaaaaggcatatagagttcctcgacgccgtggcagaatacgaggtcgcggacgacgaggacagatccgactgcgggctgtcaatccttgacagattcttcaatgataaactcgctgccccactccccgagataccccctgatgtagtgacggagtgtcggcttggacttaaggaggagaatcccagtaaaaaggccttcgaagaatgtactcgcgtggcgcacaattatcttcgcggggagccctttgaggagtatcaagaaagcagctacttcagccaatttcttcaatggaaatggctggagcggcagccagtgacgaaaaacacctttcgccactaccgcgtcctcggtaagggagggtttggtgaggtgtgtgcctgccaggtaagagcaacaggcaaaatgtacgcttgcaagaagctccaaaaaaagcgcattaagaagcgcaagggagaagccatggcgttgaacgaaaagagaatcctcgaaaaggtccagtctcgcttcgtcgttagtttggcctatgcatatgagacaaaggacgcactgtgtttggtgctgacgatcatgaatggcggagacttgaaattccacatttacaacctcggaaatccgggattcgacgaacagcgggccgtgttttacgccgccgaactttgttgtggcctggaagacctccaacgggagcgcattgtgtatagggacctgaaaccagagaatattctcttggatgaccgcggacatattcgaatttccgacttaggacttgccacagaaatccctgaaggacagcgagtccgcggtcgcgtgggcactgtgggctatatggctccggaagttgttaacaacgagaaatacacatttagccctgactggtggggtttaggctgtctgatctatgagatgatccagggccactcgccattcaagaaatataaagagaaggtgaagtgggaggaagtagatcaacggataaagaacgataccgaagagtattccgaaaagtttagcgaagacgccaagagcatctgtaggatgcttctgaccaagaatccaagcaagcgactgggatgtcgcggcgaaggagccgctggggtgaagcagcaccccgtgtttaaggatataaacttccgacggctggaggctaacatgctagaaccccccttttgtccagatccccacgccgtgtactgtaaagacgttcttgatatcgaacagtttagcgtagtgaagggaatttatttggataccgctgacgaagatttttatgcgcggtttgctactggttgtgtgtctattccttggcaaaatgagggctgcctgaccatggtcccctctgaaaaggaggtggaaccaaagcagtgttag

SEQ ID NO: 30251 - DNA, 405 bp, Artificial Sequence
  Description of Artificial Sequence: Synthetic coding sequence
atgcacggagggggtggagtgtcatcttgctccgcgagcagcgtcagttcagtttctcaaaatcctcccgcggctgctgcaccggggcacggggctagagaacaccggggccagctcgcagcagccgagtcagcttcttcaccattgcatccagccaccaaagcttccgtgggacctgcacttcagcgcgaaacacccaccatcctctgcgctattctttgcctcggaccacacgtgtctcttgcctgcgtctctcgagagctcgccactgaacccaggacatcaagcccttgtgcctcgcacggtagctctagtcatcccgtgacgctgaccgaattgttaatttcctccatttccctgcgagacggcgcggcccttttagggctctgcagcagaaccgtgtag

SEQ ID NO: 30252 - DNA, 1599 bp, Artificial Sequence
  Description of Artificial Sequence: Synthetic coding sequence
atggagctcgagaatatcgttgccaacagcctgctgcttaaagcgagacagggggggtatggtaagaagagtgggcgctcaaaaaagtggaaagaaatcctgacattacccccagtctctcaatgttccgagctgcgtcactcaatcgagaaagactatagcagcctgtgcgacaagcagcctatcggcaggagactgtttcgccaattctgtgacacgaagccgacactcaaaagacacatcgaatttctggatgccgtcgccgagtatgaggtcgcagatgatgaagaccgctccgattgcggcctgtcaatactcgaccgattctttaacgacaagctagccgccccgctgcctgaaatacccccggacgtggttacagagtgtcggctggggcttaaggaggagaatccttctaagaaagccttcgaagagtgtactcgggtggctcataattacctgcgcggggagccttttgaggagtaccaggaatcctcctatttcagtcagttcctccaatggaaatggttagagaggcagccagttacaaaaaacacatttcggcattaccgtgtgctgggaaagggaggctttggagaggtgtgcgcctgccaggtccgtgccacgggcaagatgtatgcatgcaaaaaactgcagaaaaaacggattaagaaacgtaagggcgaggcaatggcacttaacgaaaaaaggatcttggaaaaagtgcagagccgcttcgtcgtgtcactggcatacgcttacgagactaaagatgctctctgcctggtcctgacaatcatgaatggcggggacctcaaatttcatatatataatttgggtaaccctggattcgatgagcaacgtgccgtattctacgctgcagaattatgttgcggactcgaagacttacaacgtgagcggatcgtgtatagagatttgaagccagagaatatactcctggatgaccgcggccatattcgcatttccgatcttgggcttgctaccgaaattccagagggtcagagagtccggggacgcgtgggcaccgtgggctatatggcccctgaagtcgtaaacaacgaaaagtacactttctctccggactggtggggcctaggatgcctgatttatgagatgatacagggtcactctccgtttaaaaaatataaagaaaaggttaaatgggaggaggtagaccagcgaattaagaatgatactgaagaatattcagagaaatttagcgaggatgctaaatctatctgtagaatgctgctcactaaaaaccctagtaaacgcttaggttgtagaggagagggagccgcgggggtgaaacaacatcccgtcttcaaggacatcaatttccgccggctcgaggccaatatgctggaacccccattctgccccgacccccacgccgtgtactgtaaagacgttcttgacatagaacagttcagcgtagtcaaagggatttacctggacaccgcagatgaggatttctacgctcgctttgctactggttgcgtttccatcccctggcagaatgagggctgcctaacaatggtgccaagcgaaaaagaggtcgagcccaagcagtgctag

SEQ ID NO: 30253 - DNA, 942 bp, Artificial Sequence
  Description of Artificial Sequence: Synthetic coding sequence
atgaagagcccacctcttctttctccttgcctgtcctggaagaggatggccggtatcttttttctcccctttatatcgtcaggcttcgcccctaggtttaagcaggaggaaaactttatgctggggagagcacacccatcccagccccgatttaattggtcacatctcactcctttggagctgaagaataggtcagtaggactcggaacagaaagcacgggtcgggggaagccccactttacactcgagggacacaagtttttgatttttggtggtagtatccactactttagggtcccaagagagtactggagagatcgacttttgaagctgaaggcctgcggctttaatacggtgacaacttacgttccttggaatcttcacgaacctgaaaggggaaaatttgatttttcagggaatctggacctggaggctttcgtgctgatggcagccgagattggtctgtgggtgatcctgcgcccaggccgttacatttgcagcgaaatggaccttgggggtttgccttcatggttgctccaggaccccaggttgctgctccggaccacgaacaagagcttcatcgaggctgtggaaaaatactttgaccaccttataccacgggtgattcctcttcagtataggcaggccgggcccgtgattgccgttcaggtggaaaacgagtatggaagctttaataaagacaagacatacatgccgtaccttcacaaagcattgctgaggcgcgggatcgtagagcttttactgaccagcgacggggagaaacacgtcttaagcggccacacgaagggcgttctagccgcgattaatctgcaaaaattgcatcaggatacctttaatcaacttcacaaggtccagggggcgagcatcgacgcggggctcttgagcgacgcttcacaggctgccacttccagcagcctgtag

SEQ ID NO: 30254 - DNA, 1962 bp, Artificial Sequence
  Description of Artificial Sequence: Synthetic coding sequence
atgaagtctccacctctcctgagcccttgcctctcctggaagcggatggccggcatcttcttcctccccttcatttcaagtggatttgcaccacgctttaagcaagaagaaaactttatgctcggccgagcccacccctcgcagcccaggtttaattggtcgcacctgactcccctggagttgaagaacaggtcagttgggttaggaactgaatccaccggtcgtggaaagccgcattttaccttagagggtcataagtttcttatcttcggtggatctattcattactttagggttcctcgggagtattggcgggatcgactccttaaactcaaggcttgcggttttaacacagttaccacctatgtcccgtggaacctgcatgaacctgagcggggcaagttcgacttcagcggcaatctcgatttggaagcatttgtgctgatggccgcagaaatcggtctgtgggtcatattaaggcccggccgctatatttgttccgagatggatctcggtggcctccccagctggttactccaagaccccagactgctgctccgtactaccaataaaagtttcatcgaggccgtggagaaatactttgaccacctaattccacgagtcattccattacaatacagacaggctggccctgttatcgctgtgcaggtagaaaacgaatacggttccttcaataaagataaaacttatatgccttacctccacaaggctctgctgcgccggggaatcgtggaactgctgctaacctccgatggagagaaacacgtgctgtctggccataccaaaggtgtgctggcagcaattaatctacaaaagctacaccaggatacttttaatcagctgcataaagttcagagggacaaaccattgctcatcatggaatattgggtgggatggttcgacagatggggagacaagcaccatgtaaaggatgccaaggaggtggagcatgctgtctcagaattcattaaatacgaaatttctttcaatgtatatatgttccatgggggcactaacttcggatttatgaatggcgccacctacttcgggaagcactcaggcatcgtgacttcttatgactacgatgccgttctgactgaggcaggcgattacactgaaaaatatctcaagttgcagaagttgtttcagagcgtgtcagctacgccgctgccccgggtaccgaagctgcctcccaaggcagtctatcctcctgtgcgaccctccttatatctgcccctgtgggacgccctgtcttacctgaatgagcccgtaaggagtcggcagccagtgaatatggagaacttgccaattaacaacggcagtggccagagctacggtctggtgctgtacgagaagagtatctgttcaggcggccgcctgagggcccacgcacacgacgtggcacaggttttcctggatgagacaatgatcggtattctgaacgagaataacaaggatcttcatattccagagctgagagactgcaggtacctgcgcattctggtcgagaaccaaggccgagtgaacttttcttggcagatccaaaacgagcagaagggtataacaggcagtgtcagcattaataattcttctctggaggggttcactatctacagtctggaaatgaaaatgtcgttcttcgaacggctgaggagtgccacatggaagcctgtgccagacagccaccaggggcccgctttttattgtggtacactgaaagcgggcccctcacccaaggacacattcctttctctgcttaattggaattacgggtttgtcttcatcaatggacggaacctggggagatattggaatattggcccccagaagacactttatctgcccggtgtctggctgcatccagaagataatgaagtcatccttttcgaaaaaatgatgtcagggtcggatattaaatcgacagataaacccacgctctag

SEQ ID NO: 30255 - DNA, 447 bp, Artificial Sequence
  Description of Artificial Sequence: Synthetic coding sequence
atggagcccgaggccttcgagatctgcccctatgatccccatcaccggattcccttgagtaggttccagtatcacttggcatcctgtcgccgcaagaatcctaagaaggccaagaagatggctacatgtaaatataacgcatgtcatgtggtgcccataaaaaatttggaggagcatgaagccgtgtgtgtcaataggtcagccgttgaggaagaagatactgagaaccccctgaaggtatctccaccaagtagcgagcagaatgacgacactcagcaggtcagtccttgcctcccctcaccagatatttggaatgttgatggggcaaactgccagcatgtgtttgtgctaaagactttcttcccccagaaagtggtgtgcgaaaacgataccaaggaatctgccagagagacttcaccccagaaaattctgcgcccgggccagtag

SEQ ID NO: 30256 - DNA, 372 bp, Artificial Sequence
  Description of Artificial Sequence: Synthetic coding sequence
atggagccagaagccttcgagatctgtccttacgatccacatcaccggattcctctttccagatttcaataccacctcgcctcatgccgccggaagaacccgaagaaggctaaaaagatggcaacctgtaaatacaatgcctgtcacgttgttcccatcaaaaaccttgaagagcatgaggcggtctgtgtcaacaggtcggcagttgaggaggaggatactgagaaccccctcaaagtgtccccacccagctctgaacagaatgatgatacacagcagacttttttcccccagaaggtcgtctgcgaaaatgacaccaaggagagcgcgagggagaccagcccccagaaaattctgcggccagggcagtag

SEQ ID NO: 30257 - DNA, 1491 bp, Artificial Sequence
  Description of Artificial Sequence: Synthetic coding sequence
atggacccactcggggcccccagccaattcgtcgacgtggataccttgccaagctggggcgacagctgccaggacgagctgaattcttctgacacaacggctgaaattttccaagaggacactgtgaggtcaccctttctctacaataaggatgttaatggaaaggttgtactgtggaagggggatgtggcgctcctgaactgtacagcaatcgtgaatacctctaacgagagcctcactgataagaatcccgtgagtgagagcattttcatgcttgctggacccgacctcaaggaggatctgcaaaagctgaaagggtgtcgtacaggagaggcaaaactgaccaagggctttaacctggcagccagattcattattcacaccgtcggacccaaatacaagtcccgatatcgcaccgcagccgagagctcactgtatagttgctataggaacgtgctacagctcgcaaaagagcaaagcatgagcagtgtgggattttgcgtcattaacagcgcaaaaagaggataccccttagaggatgcaacacatatagccctgcggacagtgcgcagattcctcgaaattcacggcgagaccattgaaaaagtggtttttgctgtctccgatctcgaggaaggtacctaccagaagttacttccgttatacttcccgcgaagtttgaaggaagaaaaccgctctctgccatatttgcctgccgatataggaaatgccgagggcgagcctgtggttcccgaaagacagattcggatttccgagaagccaggggccccagaggataaccaagaggaagaagacgagggactgggagtggatctgtcctttattggatctcatgcctttgcccgaatggagggtgacattgacaaacagaggaaacttattctgcagggacagcttagtgaggccgcgctgcagaaacagcaccagcgaaactataatcgttggctctgccaggctcgtagtgaagatctcagcgacatcgctagccttaaggccctctaccagacaggggtggataattgcggcagaactgtgatggttgtggtcggcagaaatatccccgttaccttgattgacatggacaaagcgctgctttactttatccatgtcatggaccatatcgctgtcaaagagtacgtcttggtctacttccatacgctcacttctgaatataaccacttagactctgacttcctgaaaaagctgtacgatgtagtggatgtcaagtataaacgcaacttaaaggcagtgtatttcgtacatccaaccttccggtcaaaggtgtctacatggttcttcaccactttcagcgtgtctggcttgaaggacaagatccatcacgttgattccctgcatcaactgtttagcgccatcagtcctgagcagatcgacttccccccgttcgttctggagtacgacgcccgagttagatcaacacgctccagcccttcacccggaatggtctactag

SEQ ID NO: 30258 - DNA, 1494 bp, Artificial Sequence
  Description of Artificial Sequence: Synthetic coding sequence
atggaccccttgggcgccccttcccagttcgtggacgtagatacattgccatcgtggggcgatagttgccaggacgagctgaatagcagcgatacaaccgctgaaatctttcaggaagatacagttagatccccattcttgtacaacaaggacgttaatggtaaggtggtcttgtggaagggcgatgttgctttgctcaattgcactgccattgtgaacacctccaacgagagtctcacagacaagaatccagtgagcgaatcaatttttatgctggccggcccggacctgaaggaagatcttcaaaaactgaaggggtgccgcaccggagaggccaaactcacaaaaggattcaatctcgcggctagattcatcattcacacagtcggccctaaatataagagccggtaccgaactgccgccgaatcatcactgtacagttgttatagaaacgtgctccagctggctaaagagcagtctatgtctagcgtggggttctgcgtaataaattctgcgaagagagggtacccacttgaggatgcaacccatattgcgttgagaacggtacgcaggttcctggagattcatggcgagacgatagaaaaagttgtcttcgccgtcagcgaccttgaggagggcacatatcagaaattgcttccgttgtattttcctagatctttaaaggaggaaaatcgctccctgccttatctgcctgcagacattggaaatgctgaaggcgagcctgtggtgccagaaagacagatccgtatatccgagaagcccggcgccccagaggataatcaggaggaggaggatgagggactcggcgttgatctgtcttttatcggttcccatgcattcgcgagaatggagggggacattgacaagcaacggaaacttattctgcagggacagctgagcgaagccgctctgcagaagcagcatcagagaaattataacagatggctctgccaagctcggtcagaggacctttccgatattgcctcgctgaaggcgctctatcagacaggcgtcgataattgtggcaggaccgtaatggtggtggtgggccggaatattcccgtaacactcatcgacatggacaaggccttgctgtactttattcatgtgatggaccatatcgctgtcaaagagtacgtccttgtgtatttccacaccctaacttcagagtataaccaccttgatagcgacttcctaaaaaagctttacgacgtggtcgatgttaagtataagagaaaccttaaagcagtttacttcgtgcacccaaccttccgctcgaaagtgtccacctggttttttacaacttttagcgtgagcggacttaaagacaagattcaccacgtcgattccttacaccagctgttttctgcaatcagtccagaacagattgattttccaccttttgttctcgaatatgatgctagggagaacgggccctattacactagctatccacctagtcctgatctgtag

SEQ ID NO: 30259 - DNA, 384 bp, Artificial Sequence
  Description of Artificial Sequence: Synthetic coding sequence
atggccaagatcctggagcacgacgatgtatcatatttaaaaaaaattctcggcgagttagcgatggtcctggaccaaattgaagccgagcttgagaagaggaagctggagaacgaaggacagaaatgcgagctttggctctgcggttgcgccttcacactggcagacgttttattgggcgccacactccaccgcctgaaattcttaggtctgtcaaagaaatactgggaggatggcagcaggccaaacctgcagagctttttcgaaagagtgcagaggcgattcgcctttcggaaggtatcaagatggaactgcggcgattggctcggctcagagggcacactgccccaggacaaagcagatatcaaaacccaattgctgtag

SEQ ID NO: 30260 - DNA, 1104 bp, Artificial Sequence
  Description of Artificial Sequence: Synthetic coding sequence
atggctactccaaacaaccttacacctaccaattgttcttggtggcccatctccgctctggagtcagatgctgccaagcctgcagaggctccagacgcccccgaagctgcaagcccagcccattggccacgtgaatctttggtattgtatcactggacacaaagttttagctcccagaaggttcgcctggtgattgcagaaaaaggactggtttgcgaggagagggacgtctccctccctcaatccgagcacaaagagccctggtttatgcgacttaatctgggcgaggaggtgcccgttattatccaccgggacaacatcatatctgactatgatcaaattatagattatgtcgaaaggacttttactggggagcatgttgtggcgctaatgccagaggtggggagtctacaacacgcacgggtattgcaataccgcgagctgctggatgctctgccaatggatgcctatacacacggatgtatcctgcacccagagctgaccactgacagtatgattccaaagtacgctactgccgagattcgcaggcatctagcaaatgccaccactgaccttatgaaattggaccacgaagaggaaccccagctgtctgagccctacttgtctaagcagaaaaaactgatggcaaagatcttagaacatgacgatgtgagctacttaaaaaaaatcctaggggaacttgcgatggtactagaccagatcgaggcggagctcgagaaacgcaagctcgagaatgaaggtcagaaatgtgaactctggctatgcggctgcgcgtttaccctggcggacgtgctactgggagcaacactccatagactcaagttcttgggcctcagcaaaaagtattgggaagacggctcaagaccaaaccttcagagttttttcgagagagttcagcgccgctttgcattccgaaaagttctgggggatattcacacaactctgctttcagccgttattcccaatgcttttagactggtgaaacgcaaacccccatcgtttttcggggctagcttcctgatggggagccttgggggaatgggttacttcgcttattggtatctaaaaaaaaaatacatctag

SEQ ID NO: 30261 - DNA, 930 bp, Artificial Sequence
  Description of Artificial Sequence: Synthetic coding sequence
atggccacccctaataatctcactcccacgaactgttcctggtggccaataagcgccttggagagtgacgccgctaaacctgcggaagcacccgacgctcctgaagcagcctcacctgcacactggcccagagaatcactggtcctgtatcattggacgcaatcgttttcatcacagaaagtgagactggtcatcgcagagaagggactggtgtgcgaggagagggatgtctccctgccccagtctgagcacaaggagccttggttcatgaggctgaatcttggtgaggaagtacctgtgatcatacatcgcgacaatatcatcagtgattatgatcagatcatcgattatgtcgagcgaaccttcaccgggggccatctggctaatgctaccactgatctcatgaagctcgatcacgaagaagaaccccagctttccgaaccctaccttagcaaacaaaagaagttaatggccaaaatcctggagcacgacgatgtatcgtacctgaaaaaaattttgggtgagttggccatggtacttgatcagatcgaagcggaactggaaaagcgcaagcttgagaatgaagggcagaagtgtgaactgtggctgtgtgggtgtgccttcacactagctgatgttctgctgggggccacccttcaccgactgaaattcctgggcttatctaagaagtattgggaggacggaagtcgccctaaccttcagtctttttttgagcgggttcagcgacggtttgcgttcagaaaagttctgggagacatccatactactcttctctcggccgtcatccccaatgcgtttaggctggtaaagcgaaaacctccatcattctttggagcctcctttctgatgggaagtctcggcggcatgggatatttcgcttattggtacttaaaaaaaaagtacatttag

SEQ ID NO: 30262 - DNA, 1089 bp, Artificial Sequence
  Description of Artificial Sequence: Synthetic coding sequence
atggccactccgaacaatctgaccccaacgaactgtagctggtggccaataagcgctcttgagtcatgcggtcaggccagcgggggtccacgccgcagtaggggaggtcagccacactggccccgagaaagccttgtcttgtaccactggactcagtccttctcttctcagaaggtcagactggtgatcgccgagaagggactagtttgcgaggaacgagacgtgtctctcccccaaagcgaacataaagaaccgtggtttatgagacttaatctgggtgaggaggtccccgttattattcaccgcgacaatatcattagcgactatgatcaaatcatcgactacgttgaaaggacattcactggtgaacacgtggtggccctgatgcccgaggtcggcagccttgcaagaactggagccgcggttagggaactgctcgatgccctccctatggatgcctacacccacgggtgtattctccacccagagctcacaaccgactctatgatccctaagtacgccactgcagagatcagaagacatctcgcgaacgctaccaccgacctcatgaaactggaccacgaagaagagccccagctgagcgaaccctacctatctaaacagaagaaactgatggctaagattctggagcatgatgatgtgagttacctgaaaaagatcttgggggaactggctatggttctggatcaaatcgagggagctggagaggaggaggccggcgaaagaggtgcagaaatgagggccgtggcactgtggctgtgcctccatgccgatgtgttgctgggggcaacattacacagactcaaatttcttggcttgtccaagaaatactgggaggatggctctcgccctaaccttcagtctttcttcgaacgggtgcagagaaggttcgccttccgcaaggtgctcggggatatacacaccacattgctgtcagcagtaatccccaatgcctttagactcgtgaaacgaaagccgccgtcttttttcggcgcgtccttcctgatgggtagcctggggggcatgggttattttgcgtactggtacttgaagaaaaaatacatctag

SEQ ID NO: 30263 - DNA, 444 bp, Artificial Sequence
  Description of Artificial Sequence: Synthetic coding sequence
atggccacacctaacaaccttacccccacaaactgctcttggtggccgatatccgcactcgagtcagatgcggccaagcccgctgaagctccagacgcacccgaggcagcttctccggctcactggcctcgggaatcgctggttctttaccattggactcagtctttcagcagccagaaggtccgcctagtgatagcagaaaaagggctggtctgcgaggaaagagacgtgagtcttccacagagcgagcacaaggagccgtggtttatgcgcttgaacctgggtgaggaggttcccgttataatacatagggacaatattatctccgactacgatcaaatcatagattatgtggagaggacattcaccggggggccacgactcgctgcaagtctcgagctgcgcggcgcaaatcctaggggccaactcggacgggcccagtag

SEQ ID NO: 30264 - DNA, 867 bp, Artificial Sequence
  Description of Artificial Sequence: Synthetic coding sequence
atggcaacccccaataaccttacacccactaactgcagctggtggcctatctccgcactcgagtcggacgcagctaagccggccgaagcaccggacgctccggaagcggccagccctgctcactggcctagagagtccctagtgctataccactggacccagtctttctcaagtcagaaagtacgcctggtgatcgcagagaagggtctcgtttgtgaagagcgggatgtttcacttccacaatctgagcacaaagaaccttggttcatgcgtctgaacctcggcgaggaagtcccagtgattatacacagagacaatatcatctccgactatgatcagatcatcgattatgtggagaggacgtttaccggtggacatctcgcgaacgccacaacagacttgatgaagctggatcatgaggaggaaccccagctgagcgagccttatctgtcaaaacagaagaagcttatggccaagattctggaacatgacgatgtgtcctatttaaagaagatacttggcgaactagccatggtcctggatcagattgaagctgagttagaaaagaggaaattggagaacgaaggacaaaaatgcgaattgtggctttgcggttgcgcctttaccctagccgacgtgttattaggtgctaccctgcacagactgaaattcctgggactttcaaagaaatattgggaggatggctcaagacctaacttacagtccttcttcgaaagggttcagcgtcggttcgcgttcagaaaagtcctgggcgacattcacaccacccttctgtccgccgttatcccaaatgcttttaggctggtgaaacgaaagccaccatcattcttcggagcaagcttctag

SEQ ID NO: 30265 - DNA, 756 bp, Artificial Sequence
  Description of Artificial Sequence: Synthetic coding sequence
tagagtttctcaagtcagaaagtccgactggtgatcgccgagaagggcctggtgtgcgaggaaagagatgtctctctgccacagtcagagcataaagaaccctggttcatgcggctgaatttaggtgaggaagtccctgtgatcatccatcgggacaacatcattagtgattatgaccaaatcatcgactacgttgaacgaacttttacaggggaacatgtggtggcgttgatgcctgaagtgggctccttacaacatgctcgagtcctccagtacagagagctgctcgacgcacttccaatggatgcatacacccacggatgcatactacaccctgagctgacgacagatagcatgatccccaagtatgctacagccgaaattagaaggcacttagctaacgccacgaccgacttgatgaagctggaccatgaagaggagcctcagttatccgagccttacctgtcaaaacagaagaagctgatggcaaaaatattggaacacgatgatgttagttaccttaagaagatcttaggggagctcgccatggtgctcgaccaaatcgaggccgaacttgagaaacggaaacttgaaaacgaaggcggatgccagccttggggcaggtggggcttgcagccaacccagcccacattacccctaccgagcttatctctcttctttccccagaagtcgcaacggaccagtcaggtggtaaagcgaatgggttatggcgtgcgtttgagatttaagtcctag

SEQ ID NO: 30266 - DNA, 372 bp, Artificial Sequence
  Description of Artificial Sequence: Synthetic coding sequence
ctggagcatgatgatgtgtcgtatctgaaaaagatactcggagaactggccatggtgctggatcaaatcgaggcggaacttgaaaagagaaaattggagaacgaggggcagaagtgtgagttgtggttgtgcggctgtgctttcactcttgccgatgtgctgcttggagctaccctgcatcgcctgaagttcctcggactgtccaaaaagtactgggaagatggtagtagacccaatctgcagtcgttcttcgagcgcgttcagaggcgttttgccttccggaaggtatccaggtggaattgcggggattggcttggttccgaggggacgctgccccaggataaagccgatataaagacacagttactttag

SEQ ID NO: 30267 - DNA, 528 bp, Artificial Sequence
  Description of Artificial Sequence: Synthetic coding sequence
atgaagcttgaccacgaggaggagccacaactgtctgagccttatctctctaaacaaaagaagctcatggccaagatccttgagcacgatgatgtcagttatttaaaaaagatcctgggcgagctcgcgatggtcctcgaccagattgaagccgagctcgaaaagcggaaacttgaaaacgaaggtcagaaatgcgaactgtggttgtgcggatgtgcgttcactctggctgatgtgctgctgggtgcaactttgcatcgcctgaaatttctgggcttgtcaaagaagtactgggaagacgggtcccggcctaacctccaatcctttttcgaaagagtgcagcgcaggttcgctttcaggaaggtactgggggacattcacaccactttgctgagtgccgtgatccccaacgcatttaggctggttaaaagaaagcctccttccttttttggggcatcctttctgatggggagcctcggaggtatggggtacttcgcctactggtatctgaaaaagaagtatatctag

SEQ ID NO: 30268 - DNA, 1002 bp, Artificial Sequence
  Description of Artificial Sequence: Synthetic coding sequence
ccacgccgatctcgcggcgggcagcctcactggcctagagagtccttggtgttataccactggacccagtctttcagcagtcagaaagtccgccttgtgatcgctgagaagggcctggtatgcgaggagagggacgtgtcactgccacaatcagagcataaggagccttggtttatgaggctgaacctcggcgaagaagtgcctgtgatcatccatcgcgataatatcatctccgattatgaccagattattgactatgtagagaggaccttcacaggggaacatgttgtcgccctgatgcctgaggtgggaagccttgctagaaccggcgctgcggtccgcgaactcttagacgcattacctatggatgcttatacacacggatgcatcctccaccccgaattaaccactgattccatgattccaaagtatgctaccgctgaaatccgccgccatctcgctaatgctacaaccgacctcatgaagttggatcacgaagaagagccacagctgagcgagccgtatctttcaaagcagaaaaaacttatggctaaaattctggaacacgacgatgtgagctatttgaaaaagatcctgggcgagttagccatggtgttggaccaaattgagggagccggggaggaggaggcaggcgagcggggtgcggagatgcgtgcggtcgccctctggttgtgtcttcatgccgacgtcctgctgggggccacactgcaccgactcaaatttttgggactcagtaagaaatactgggaagatggttcccggcccaacctgcaatcctttttcgagcgcgtccagcggagattcgcttttcggaaggtgctcggggacattcacacaactttactgagcgccgtgattcccaatgcgtttcgcttagtcaaaagaaagccgccttcattttttggcgcctcctttctgatggggtctctcggcgggatggggtattttgcttactggtacctcaaaaaaaagtacatctag

SEQ ID NO: 30269 - DNA, 1302 bp, Artificial Sequence
  Description of Artificial Sequence: Synthetic coding sequence
atgggcgattggtcctttctgggcaatattttggaggaggttaatgaacatagcactgtgatcggcagagtttggctgactgtgctgtttatctttcggattttaatcctcgggacagccgctgagttcgtgtggggagacgaacaaagtgactttgtctgtaacacccagcagccaggctgtgagaatgtgtgctatgatgaggcgtttccaatcagccatataagactctgggtgctgcagataatcttcgtaagcacccccagcctcatgtacgttggccacgcagtgcattatgttagaatggaggagaagcggaaatcaagggaagctgaggaactgggtcaacaagcaggtaccaatggtggccctgatcaaggaagcgtaaaaaaaagcagtggaagtaagggaactaaaaaatttcgattggaaggtacgctcctacgaacatacatttgtcatattattttcaagactttgtttgaagttggattcatcgtcggccactattttctgtacgggtttagaatcctcccattgtatcgttgctccagatggccctgcccaaacgtcgtcgactgtttcgtcagccgcccaaccgagaagactatatttatacttttcatgcttagcgtggcttcggtgagcttgttcctcaatgtgatggaattgggccacctgggcctgaaggggatacgtagcgccctcaaacgccctgtggagcaaccacttggtgaaattcccgaaaagtcattgcattcaattgcagtgtcttccatacagaaggcaaaaggttatcagctccttgaagaagagaagatcgtgtctcattactttcctctgaccgaggtaggaatggtggagacgagcccactccctgctaaaccttttaaccagtttgaagagaaaattagtacagggcccttgggagatttaagcagaggctatcaggagactctcccttcatacgcacaggtaggcgcccaggaggtggagggcgaagggccccccgcagaagagggagctgaacctgaggtgggagagaaaaaggaagaggcggagcgtctgacaacggaggagcaggaaaaggtggctgtgcccgaaggggagaaggtcgagactcctggtgtcgataaagagggagagaaagaggagccacagtcagagaaggtctctaagcagggcctgccagctgagaagacaccctccctgtgtcctgagttgacaacggatgacgcaagacccctgagtcgcttgagtaaggctagctcccgggcacgcagcgacgatcttacagtgtag

SEQ ID NO: 30270 - DNA, 1455 bp, Artificial Sequence
  Description of Artificial Sequence: Synthetic coding sequence
atgggttcagccttcgaaagagtggttaggcgggtagtccaggagctcgatcatggaggagagtttatcccagttacctccctccagtccagtacgggcttccagccttactgtctcgtggtccgtaaaccgtcttcaagctggttttggaagccccggtacaagtgtgtcaacctttcaatcaaggacatactagagcctgatgcggctgaacctgatgtgcagagaggaaggtcgttccatttttatgacgccatggatggccagattcaaggatcggttgaactggcagcaccagggcaagccaaaattgccggcggtgctgcagtaagcgactcttctagtacatccatgaacgtctacagcctttctgtagaccctaacacttggcagactcttcttcacgaaaggcaccttagacagcccgagcataaagtgttgcagcagctgcgttcccgtggggataatgtgtacgtagtgaccgaggtgctccagactcaaaaagaggtggaggtaaccagaacccataaacgggaagggtccggtcgcttttccttaccgggtgctacttgcctgcagggagaggggcagggtcaccttagtcagaagaagacagtaactatcccttcgggtagtaccttagcattcagggtggcccagctagtcattgactctgacctcgacgtgctgctgtttcccgacaagaaacaaagaacatttcagccgcctgcaacgggtcataaacgctctacatctgagggcgcctggccacaattgccaagcgggctgtcgatgatgagatgtttacataattttttgacggacggtgtacccgctgagggcgcttttacagaggacttccagggcctgagagcagaggtcgagaccattagtaaagaactcgagttgctggatagagagctgtgtcagctgctccttgagggactcgagggggttcttagagaccaactggctctcagagctctcgaagaggccttagaacaggggcagtccttggggccagtggagccattagacgggccagctggggccgtactggaatgcctagttttatcaagcggcatgcttgtgcctgagctcgccattcccgtggtgtatctgttaggggccctcacaatgctgagcgagacccagcacaaattgctcgccgaagcattggaatctcaaaccctgttagggcctttggagctggtaggcagtcttcttgaacagagtgccccctggcaggagagaagcaccatgtctctgcctcctggtctgctgggcaattcgtggggcgagggagcacccgcctgggttctcttagacgagtgtggcctcgaactgggagaagatactccacacgtgtgttgggagcctcaggctcagggacgaatgtgcgctctttacgcaagcttggcattgctctcaggcctctctcaggaaccccactag

SEQ ID NO: 30271 - DNA, 345 bp, Artificial Sequence
  Description of Artificial Sequence: Synthetic coding sequence
atgggcagcgcattcgagagagtggtgcgccgggttgttcaggaactggaccacgggggagagtttattcccgtgacaagcctgcagtctagcacaggattccaaccgtactgcctcgtcgttaggaaaccctcttcatcttggttttggaagcccaggtacaagtgtgtcaacctctccataaaggacattctagaacccgatgccgccgaaccagacgtacaacggggcagaagctttcacttttatgatgcaatggatgggcagatccagggatccgttgaattagcggctccgggccaggctaagatcgctggcggcgcagcggtgagcgacagcagctag

SEQ ID NO: 30272 - DNA, 1455 bp, Artificial Sequence
  Description of Artificial Sequence: Synthetic coding sequence
atgggaagcgcgtttgaacgagttgtgcgccgggtcgtgcaggaactggatcacggcggcgaatttattcccgtcaccagtctgcagtcaagcaccggcttccagccatactgtctcgtggttagaaagcccagctctagctggttctggaagcctcgatataagtgcgttaatctcagtatcaaggatatcctcgaacccgacgccgccgagccagatgtgcagcgagggaggtcttttcacttctatgatgccatggacggccaaatccaagggtcggtagagcttgcagctcctgggcaagcaaaaatcgctggtggcgctgctgtgtccgattcaagctcaacctcaatgaacgtgtacagcctatcagtcgaccccaacacgtggcagaccctgctacacgagcggcatctgagacagcccgagcataaggtgctacagcagctgcggagccggggagacaacgtctatgtcgttactgaggttttgcagactcagaaggaggttgaagtcacaagaacacacaaaagggagggttccggccgattctcactgcctggggctacttgcctacagggtgagggacaagggcacctttcgcaaaaaaaaacagtgacaattcctagtgggagcacactggccttcagagtggcacaattagtcatagatagcgacctggacgtcctattattccctgacaaaaaacagagaactttccagcctccggctacaggccataaacgtagtacaagcgagggcgcctggccacaactcccctccggcttgtctatgatgcgatgtctccataacttcctgaccgacggcgtgcccgccgaaggtgctttcaccgaagactttcagggtctacgggcagaggtggagactatctctaaggagttggagttgctggatagggaactttgtcaattactcctcgaggggttagaaggcgtgctgagggatcagttagccctgcgggcgctggaggaagcgctcgaacaggggcaaagcctgggacctgttgagccgctagacgggcctgcaggcgccgtgctggagtgcctggtgctgtcctccggtatgctggtccccgaactcgccatccctgtcgtctatctacttggagctctcacaatgcttagcgagacacagcacaaacttctggccgaggcactggagtcccagactctcctgggtccgctggagctcgtgggatccctgcttgagcaaagtgccccttggcaggaaaggagcacgatgtccttgccccctggcctgctaggcaatagttggggcgagggggccccagcttgggtcctcttagatgagtgtggcctcgagctgggggaggatacaccacacgtttgctgggaaccccaggcccagggcagaatgtgcgctctttacgcgtctctcgcgttactgtcaggactgtcacaggagccccattag

SEQ ID NO: 30273 - DNA, 147 bp, Artificial Sequence
  Description of Artificial Sequence: Synthetic coding sequence
atgggatcggcctttgaaagagtggtgcggagggtggtgcaggaacttgatcacgggggtgagtttatccccgtgaccagccttcaatcaagcactgggtttcaaccttactgcttggtcgtgcgaaaaccatcctcctcctggtag

SEQ ID NO: 30274 - DNA, 495 bp, Artificial Sequence
  Description of Artificial Sequence: Synthetic coding sequence
atgggctctgccttcgaacgggtagtccggcgagttgtccaggagttggaccatggaggcgagttcattcccgtaaccagtcttcagagcagtaccggtttccagccctattgcctcgtggtccgtaagccgagctcgagctggttttggaaaccgcggtacaaatgtgtcaacttgtccataaaggatattcttgaaccagacgctgccgagcctgatgtgcagcgggggagaagtttccatttctacgatgcgatggatgggcaaatccaaggctccgtagagctggctgctcccggtcaggctaagatcgcaggcggcgccgctgtgtccgactcctccagtacatcaatgaacgtatactccctcagtgtagatcccaatacttggcaaaccttactccacgaacggcatttgagacagcccgaacataaagtgctccaacagcttcgaagcagaggagacaatgtgtacgtcgttaccgaggtcctctag

SEQ ID NO: 30275 - DNA, 465 bp, Artificial Sequence
  Description of Artificial Sequence: Synthetic coding sequence
atgggaagcgcattcgagagagtagtacgacgtgttgtccaggaacttgatcacgggggggagttcattcccgtgacgtctttacagagcagcactggctttcaaccgtattgtctggtagtgagaaagccttcttcctcatggttttggaagccccggtacaaatgtgtaaacctctcaattaaagatatcctggagccagatgcagccgagccagatgtgcagcggggcaggtctttccatttctacgacgcgatggatggccagattcaaggtagcgtggagctggctgccccaggtcaagcaaagattgcgggtggagccgccgtctccgattctagttctacatccatgaacgtttactctctatctgttgaccccaatacctggcagaccctactgcacgagagacatctgagacagccagaacataaggtgctgcagcagcttagatctaggggctag

SEQ ID NO: 30276 - DNA, 810 bp, Artificial Sequence
  Description of Artificial Sequence: Synthetic coding sequence
atgcctctggggctcaaaccaacgtgttctgtctgcaaaacgacaagttcctccatgtggaagaaaggcgcccagggcgagattctgtgtcatcactgcacaggacgagggggggccggctccggaggggctggaagcggggctgcgggggggactggtggatccgggggcggcggatttggagctgccaccttcgcctccacttcagccactccacctcagtcgaatggcggggggggcgggaaacagagtaaacaggagatacacaggagaagcgctcggctgaggaacaccaaatataagtccgcccccgctgcagagaagaaggtctcaaccaaaggcaagggacgaagacacattttcaagttgaagaacccaatcaaggccccagagagcgtcagcaccatcatcactgccgaatctatcttctataagggcgtgtattatcaaatcggagacgttgttagcgtcattgatgaacaagacggcaagccatattacgcgcagatcagaggtttcatacaggatcagtactgcgaaaaatccgcagccctaacatggctgattcctactttgagctcgcctagggaccagtttgatcctgcctcctacattattgggcctgaagaagacttgccaaggaaaatggagtatctggaattcgtttgccatgctccaagcgaatattttaagtcccgtagcagcccgttccccaccgtgcccacaaggccagaaaagggttacatttggactcacgtgggacctacacctgcaatcactatcaaagagagcgtggccaaccatctttag

SEQ ID NO: 30277 - DNA, 990 bp, Artificial Sequence
  Description of Artificial Sequence: Synthetic coding sequence
atggagttgcacatccttgagcacagactgcaagtcgcctccgtcgctaacgaatccattcctttgtttacttacggtttgatcaagcttgccttccttagtagcaaaactcgttgcaagtttttctctctgacagagacccccgaggactacaccatcatcgtggatgaagaaggtttcctggaactccctagctctgagcacctgtccgtggcggatgcgacctggctggcactgaacgtcgtgtcaggcggtggttccttcagctcatcccagccaattggcgtgaccaaaatcgccaaaagtgtgattgcccccctggctgatcagaacatttctgtgtttatgttaagcacataccaaaccgactttatcttggtcagggagagagacttacccttcgtcacccataccctgtccagtgaatttactattctaagggtggtgaatggcgagaccgtggccgctgaaaaccttggaatcacaaacggcttcgtaaagcctaagctggtgcagcgtcccgtcatccatcccctgtctagtccttcaaatcgcttttgcgtcacgagcttggacccggacacactgcccgctgtggccaccctccttatggatgttatgttttactccaacggcgtaaaagaccctatggccaccggcgacgattgtgggcatattcggtttttctcattctcactaatagagggttacattagcttagtaatggatgtgcagacgcagcagaggttccccagtaacctactttttacctctgcttctggcgagctgtggaagatggtgcgcattggaggccagcctctgggctttgatgagtgtggtattgtggcccagatttctgagcccctcgcggccgccgacatccccgcctattatatatcaacattcaagttcgatcatgcccttgttccagaagaaaacattaatggggttatcagtgctctcaaggtgtcacaggcagaaaaacattag

SEQ ID NO: 30278 - DNA, 990 bp, Artificial Sequence
  Description of Artificial Sequence: Synthetic coding sequence
atggagcttcacatcctggagcaccgccttcaagtggcatctgtggccaaagagagtataccactctttacttacggattaatcaaattagctttcctgtccagtaagactcggtgcaagttcttctctctgacggaaacaccggaagactacactattatcgtagatgaggagggatttctagagcttccctctagcgagcatctctctgttgccgacgccacgtggctggccctgaatgtggtgtccggtggggggtccttcagctcctctcagcctatcggagtgaccaaaatcgcaaaatcagtgatcgcccctctggcagaccagaatattagtgtctttatgttatctacctaccagacagattttattttggtgcgagaaagggacctaccttttgtcacccatacgctgagctcagaattcacaattctaagagtggtgaacggcgagactgtggccgcagaaaatctcggaatcacaaatggtttcgtgaaacctaaattggtacagaggccagtgatacaccctctttcctcccctagtaacagattctgcgttacatcactcgatcctgacacactccctgccgtggccactctgctcatggatgtaatgttctattctaacggggtcaaagaccccatggccacaggcgatgactgcggccatatccggttctttagcttttctctaatagagggctatatttcccttgtgatggatgtccagacacagcagcgctttccaagcaacctcctcttcacaagcgcctccggggagttgtggaaaatggtgagaattggcggacagccccttggcttcgatgagtgtggcatcgtagcacaaattagcgagcctctggctgcagccgacattccggcatattacatctccaccttcaaattcgatcatgctctggttcctgaggaaaacatcaacggcgtgatttctgccctaaaagtgtctcaggcagagaagcactag

SEQ ID NO: 30279 - DNA, 990 bp, Artificial Sequence
  Description of Artificial Sequence: Synthetic coding sequence
atggagctgcacatactggagcatcgggtgagggtacttagcgtagcgcgacctggtctgtggctgtacacccatcccctaattaagctgctctttctgccccgtaggtctcgctgtaaattcttcagcttgacagagacccctgaagattacacactcatggtagatgaggaaggcttcaaagagttgcccccgtcagagtttctgcaggtagccgaagcaacctggctggttctgaacgtgtcctcgcatagcggcgccgcggtacaagctgccggggttaccaagatcgctagatcggttatagcaccactggccgagcatcacgtgagtgtgctcatgttatcaacataccagaccgattttattctggtgagggaacaggatctgtccgttgtgatacatacactagctcaagagttcgatatttatcgtgaagtgggaggggagcctgttcctgtgacaagagatgattcatccaatggctttcctaggacccaacacggcccaagccctacagttcatcccattcagtcacctcagaatcgcttttgtgtgttaacgcttgatccagaaacgctcccagccattgccacgacgctgattgacgttcttttctattcgcattcaacccccaaggaggcagcaagcagtagtccagaaccgtccagcattacttttttcgccttctctctgatcgagggttatatctccatcgtaatggacgccgagacccagaagaaattccctagtgacttgctactgacatcctctagtggggagctgtggcgcatggtgagaatcggagggcagcctttaggctttgatgagtgcggtatagtggcccagattgccggccctctggctgctgccgatatctccgcttattatattagcacattcaactttgatcacgcactggtccccgaggacggcattggctcggtgatcgaggttctgcaacggagacaagaaggcttggcatcttag

SEQ ID NO: 30280 - DNA, 492 bp, Artificial Sequence
  Description of Artificial Sequence: Synthetic coding sequence
atgagctgtcgcggcaggggggctggcggaagatggaactcgacctcgtggagcaccggctgtaagctgccagcttcacctagacgagtcagccgctgttcgccaacaggccttatcaagctcgcttttctgtttagcaagaccagatgtaaatttttttcccttaccgagaccccagaggactatactattattgtggacgaggaaggtttcttggaactcccttcctccgagcatctgtccgtggccgacgccacctggttggcgctcaacgtcgtgtctggcggtggcagcttctcgtctagccagcccatagggatgactaagattgcaaaatccgttatagccccattagccgaccagaacatttctgtgtttatgctgtcaacctatcaaaccgatttcatattggtcttgaagcgcgacctgccattcgtcacccacaccttgagtagcgaatttacaatactgtggtctgtggcacgcctatag

SEQ ID NO: 30281 - DNA, 1164 bp, Artificial Sequence
  Description of Artificial Sequence: Synthetic coding sequence
atgaaggccctcatcctcgtcggcggctatggaactcgcttacggcccctcactttatcaactcccaagcctctggtggacttctgtaacaagcccatactgctacaccaagtcgaagcactggctgccgccggtgtcgatcatgtaattttagccgtatcatatatgtcgcaggtgttagagaaagagatgaaagcccaggaacagcgcctgggcattcgcatttctatgtctcatgaagaggaaccactcggaacagccggccctctggctctggccagagacttgctgagcgagacggctgatccattctttgtactaaattccgatgtgatttgtgacttcccatttcaggctatggtacagttccaccgacatcacggccaggagggcagcattctcgtgaccaaggttgaggagcctagtaaatacggagtggtggtgtgcgaggccgacactgggagaatccaccgctttgttgaaaagcctcaggtttttgtcagcaataagatcaacgccggcatgtacatcctgtctcctgccgtcctgcaacgcatccagctccaacctactagcattgagaaagaagtgtttcctatcatggcaaaagaaggccagctctatgcaatggagctgcagggcttttggatggatattggccagccaaaggactttctgaccgggatgtgtttgttcctccagagccttcgccagaaacagccggagaggctctgttcagggcctggcatcgtgggcaatgttttggtggacccaagcgctaggatcggccagaactgctcaatcggacctaacgtgagcttggggcccggtgttgttgtcgaagacggcgtctgtattagaaggtgcactgtgctgagggatgcacgaataaggagccactcctggctggaaagttgtatcgtggggtggaggtgtagggtaggacagtgggtgagtttatgggcggggcttggcggtgagaggggcggggagtgtgcttgtctgcccgataaagcttatcccttgctggaagtacgcatggagaatgtgaccgtcctgggagaggacgtgatagtgaacgatgagttatatctgaatggggcatccgtgctcccccacaagtccatcggcgagagtgtgcccgaacctcgcattattatgtag

SEQ ID NO: 30282 - DNA, 1083 bp, Artificial Sequence
  Description of Artificial Sequence: Synthetic coding sequence
atgaaggcactaattctggtcggtggctacggcacaagactccgccctctgactctttcaacacctaagccattagtggatttctgcaacaaacccattctccttcaccaggtggaagcccttgccgctgctggggtggatcatgttattttagctgtgtcctatatgagccaggtattagagaaagaaatgaaggcgcaggaacagcgcttaggaatacggatctccatgtcccacgaggaagagccattgggaaccgccggccctctggcactggcccgggacctgctttccgaaaccgcagatccttttttcgtactgaattccgacgtcatttgtgattttccgttccaggcaatggtccaatttcaccgacaccacggtcaagaaggtagtattcttgtaacgaaggttgaggagccttccaagtacggcgtagttgtgtgcgaagccgacactggccggattcatcgctttgtggaaaagccgcaggtttttgtgtctaataagattaacgcagggatgtacattctgtcaccagccgtgcttcagaggatacagctgcagcccacgtccattgagaaagaagtttttccaatcatggccaaggagggccagctctatgccatggagctgcagggattttggatggatatcgggcagccgaaggatttcttgacagggatgtgtctgttcctgcaaagtttacgacagaagcagcccgagcggctctgtagcggaccgggaatcgtcggcaatgttctggtcgacccaagcgcccgcatcggccaaaactgcagcattggacccaatgtgtctctgggccccggagtcgtcgtggaagacggagtttgcatcagaaggtgtactgtgctgagagacgctagaatcagatcacattcttggttagagtcctgcatcgtgggctggaggtgtagagtcggccaatgggtcaggatggagaatgtgactgtgcttggtgaggacgtcatcgttaatgacgaactgtatttgaacggcgcctccgtgttgccgcataagagcataggggagagtgtaccagagccacgaatcattatgtag

SEQ ID NO: 30283 - DNA, 1083 bp, Artificial Sequence
  Description of Artificial Sequence: Synthetic coding sequence
atgaaagccctcatactggttggcgggtacggaacgaggctccggccgttaaccctgagtactccaaaaccgctggtggatttctgtaataagccgatcctgctccatcaggttgaggccttagcggcagccggcgttgatcacgttatattggcagtgtcttatatgtcacaggtattggagaaggagatgaaggcacaggaacagagacttggcatccggatctccatgagccacgaggaggaacctctaggcactgcagggccacttgccctggcacgtgacctgctgagcgaaacagccgatcccttcttcgtcctgaatagcgatgttatttgtgatttccccttccaggctatggtccagtttcaccgccaccatggacaagagggatccattctggttacgaaggtggaggagccttctaaatacggggtcgtggtgtgtgaggcagatacaggccgtatccatcgtttcgtggagaagccacaggtctttgtctcaaacaagatcaatgccgggatgtacatcctctccccagctgtgttgcagagaatccagttacagccaacttcaattgagaaagaagtcttccccatcatggcaaaggaagggcagctatacgcgatggagctgcagggcttttggatggacattggccaaccaaaggatttcctcacaggcatgtgcttgttcctgcaaagccttaggcagaaacagccagaaagactgtgttccggtcccggcatcgttggaaatgtgctggtagatcctagcgctcgcattggccagaattgtagcatcggtccgaacgtgagcctcggacccggagtggtggtggaagatggcgtatgtatccgccgatgcactgtcctacgggatgctcggatcagatcacactcctggcttgaaagttgcattgtgggctggcgctgcagggtgggccagtgggtccggatggagaacgtgactgtgcttggtgaggacgttattgtgaacgatgagctgtatttgaacggagcatcagttctgccccacaaatctattggcgagtcagtccctgaacccaggattattatgtag

SEQ ID NO: 30284 - DNA, 555 bp, Artificial Sequence
  Description of Artificial Sequence: Synthetic coding sequence
atggacttggggccactgaatatctgcgaggaaatgaccattctgcacggcgggttcttgctggccgagcaattgtttcaccccaaggctcttgccgaactaacaaagagcgactgggagagagtaggcaggcctatcgtggaggctcttagggagattagctcagcggcggcccatagtcaaccattcgcttggaagaaaaaggctcttatcatcatttgggccaaagtgctccagcctcacccagtcactcccagcgacacagagactcgctggcaggaggatttgttctttagcgtgggtaacatgattccaactatcaatcacacaattctattcgagctgctgaagagcctggaggcttccgggctcttcattcagctgctaatggcattgcccacaaccatctgtcacgcagagttagagcgatttctggagcacgtgacagttgatacatcagcagaagatgttgctttcttcctcgatgtgtggtgggagcgcactactccccgtaggtgtctgcaaccctgtatatggacaaattggcctcgttag

SEQ ID NO: 30285 - DNA, 1188 bp, Artificial Sequence
  Description of Artificial Sequence: Synthetic coding sequence
atggatgaggagcctgagaggacaaagcgttgggagggaggctatgaaagaacatgggagatcttaaaagaggatgagtccggttcacttaaggccacaattgaagatatactctttaaggctaagaggaaaagggtcttcgagcaccacgggcaggtgaggcttggaatgatgcggcatctttatgtagttgtggacggatcacgcaccatggaggaccaggatttaaagccgaatcgcctgacctgtaccttgaagcttctcgaatactttgtggaagagtattttgaccaaaacccgatttcccaaatcggtattattgtcactaaaagcaaacgcgccgaaaagttgaccgaactctcggggaatccccgaaaacacattacctccttgaagaaagctgtggatatgacctgccatggcgagccctccctctacaacagcctgagcattgctatgcagactctcaagcacatgccgggccatacatcaagggaggtactgataatcttctcgtcgttgactacctgtgatccctcaaatatttacgatctgatcaagacattgaaggccgccaagattagagtgagcgtgatcggcctgagtgcagaggtccgagtttgcactgtgctggccagagagacagggggaacgtatcatgtcatcttggatgagagccattataaggagctgctgactcatcatgtctcgcccccccccgctagtagttcctccgagtgttccttgattagaatggggttcccccagcacaccatcgcgagtctcagtgatcaggacgcgaaaccctcattttctatggctcatctggatgggaacactgagccagggcttacactcggaggctacttctgtccacaatgccgcgccaaatattgtgagctgcctgtagagtgcaagatctgcggcctaacactggtctccgcacctcacctggctcggagctatcaccacctgttcccactcgatgcctttcaggaaattcccctcgaggagtacaacggggaacgcttttgttacggatgccagggagaattgaaagatcagcacgtgtacgtgtgtgctgtttgccagaacgtcttttgcgtggactgtgacgtatttgtgcacgactcgctgcattgctgtccggggtgcatccataagatcccggccccaagcggggtctag

SEQ ID NO: 30286 - DNA, 1188 bp, Artificial Sequence
  Description of Artificial Sequence: Synthetic coding sequence
atggatgaggagcctgaacgcacaaagcgttgggagggcgggtatgagcggacgtgggagattcttaaagaagatgagtcgggcagcctgaaggctacgattgaagatatcctatttaaagctaaacgcaagcgggtgttcgagcaccacgggcaggtccgccttggtatgatgagacacttgtatgtagtagtcgacggttctagaaccatggaagaccaggatcttaagcctaataggttaacctgcaccctcaagctcctggagtacttcgtggaggaatattttgatcaaaacccaataagccagatcggcataatcgtaacaaagtctaaaagggccgagaagttaaccgaactgtccgggaatccacgtaaacacatcacttccctcaaggaagccgtagatatgacctgtcacggagagccaagcctctataattcactgagtatggccatgcagacacttaagcatatgcccgggcatacaagccgggaggtcctcatcattttctcctcactcactacctgtgatccatccaacatttatgacctcattaaaactcttaaggcagctaagatacgcgtcagcgtaattgggctaagcgcagaggttcgcgtgtgcaccgtgttggcccgagagaccggaggcacatatcacgtcatcctggacgaatcccattacaaggaactcctaacacatcacctgtctcctcctccggcatcaagtagctctgagtgctctctgattcgcatggggtttccacagcataccattgcctccctgtcagatcaagacgccaaaccttccttcagtatggcccatctggatggtaacactgagccagggctcacattggggggttatttctgccctcaatgcagagctaagtactgtgaacttcccgtagagtgcaaaatctgtggtcttactcttgtgagcgccccgcacctggcccgaagctatcatcatttgttcccactcgacgcatttcaggagatccccctggaggaatacaatggcgagcggttttgctacggctgccaaggcgagctgaaagaccagcacgtatacgtttgcgccgtttgccagaatgtgttttgcgtggactgtgatgtatttgtgcatgattcccttcactgttgtcccggatgtattcataagatccccgcgccctctggggtgtag

SEQ ID NO: 30287 - DNA, 537 bp, Artificial Sequence
  Description of Artificial Sequence: Synthetic coding sequence
cagtatatctgtagcttcgaggactgcaagaaaacctttaagaagcaccaacagctgaaaatccaccagtgccagcacaccaatgaaccattatttaagtgtacccaggaaggttgtggtaaacactttgcctcccccagtaagctcaagagacatgctaaagcccatgaaggatacgtctgccagaaaggatgttctttcgtggcaaaaacgtggaccgagctgctcaaacacgtacgagaaacccataaggaggagtcaaggccgtttgtgtgtgagcacgcggggtgtggtaaaacattcgccatgaaacagtcactgacaaggcacgctgtggtccacgaccccgataaaaagaagatgaagttgaaggttaagaagagcagggaaaagaggagcctggcatctcacttatcaggatatattcctccaaaacgaaagcaagggcaaggattatcactatgccagaacggcgaatcgcctaactgcgtggaggacaagatgttgtctacagtcgctgttctcaccctggggtag

SEQ ID NO: 30288 - DNA, 1098 bp, Artificial Sequence
  Description of Artificial Sequence: Synthetic coding sequence
ctggacccccccgccgtcgtcgctgagagcgtctcaagtttaacaattgcagatgcctttatcgccgccggcgagagctccgccccaacgccccccagacctgcccttccccgtcgatttatttgttcatttccggactgctcagccaactatagcaaggcttggaaactggacgctcatctctgtaagcacaccggagaaaggccattcgtgtgtgactatgaggggtgcgggaaagcatttattcgcgattaccatctgtcgcggcatattctgacgcataccggcgagaagccatttgtctgcgctgcgaatgggtgtgaccagaagtttaacacaaagagtaacctgaaaaaacactttgaacgaaagcacgaaaatcagcagaaacagtatatttgctcttttgaagattgcaaaaagacgttcaaaaagcaccagcagctgaaaatccatcagtgccagcataccaacgagcccctcttcaaatgtacacaggaggggtgtggcaaacatttcgcgtcaccctcaaaacttaaacgccacgctaaagcccatgagggatacgtttgccaaaagggctgttcttttgtagctaaaacctggaccgaactgctcaaacacgttagagagacccataaagaggagattttgtgcgaggtttgtaggaaaacattcaagagaaaggactacctcaagcagcacatgaaaacccatgccccagagcgggacgtttgccgatgcccacgggaggggtgcggccggacctacaccacagttttcaatctgcagtcgcatatcctctcatttcacgaggagtccaggccatttgtgtgtgaacatgcaggctgcggcaaaacgttcgccatgaaacagtcacttacgaggcatgccgtggtgcatgaccctgataagaaaaaaatgaagttgaaagtgaagaaaagcagagagaaacgttctttggctagtcacctttctggatatatcccaccaaagaggaagcagggtcagggcctcagcttatgtcaaaacggggagagccccaactgcgtagaggataagatgctctctactgttgccgtgctgacattggggtag

SEQ ID NO: 30289 - DNA, 1089 bp, Artificial Sequence
  Description of Artificial Sequence: Synthetic coding sequence
atgtctgaccctagtcaactgacccagaacgtgtgcctgacccaggaaatggagctgtcaaaggccttttctggacagcggactcttctgagtgcaatactgtccatgctatcactttccttcagcacaacgagcctgctgtccaactattggtttgtgggcacccagaaagtccctaagcctctgtgcgagaagggattggcagccaaatgtttcgacatgccagtgtctctggacggggatactaacacttctacgcaggaagtggtccaatacaactgggagaccggagatgatagatttagcttccgctctttccggagcggcatgtggcttagctgtgaagagacagtcgaggagcccgcactactgcatccccagtcctggaaacagttcagggccctcagaagcagcgggaccgctgcggctaagggggagcgatgtcggtcttttatagagctgaccccccccgcaaaaagagagatcttatggttatcgctcgggactcagattacctatatcgggttacagttcatcagcttcctccttctgctgacagacctgctgctgactggcaatccagcctgtggcctgaagctcagtgcttttgcggccgtgtcaagcgtgctaagtggtctgctcggtatggtagctcatatgatgtattcccaggtttttcaagccaccgtcaatctcgggcctgaagattggaggccccacgtgtggaactatggttgggcattctacatggcatggctgtcctttacctgttgcatggcctccgcagtgacaaccttcaacacatatacacgcatggttctggagttcaagtgcaagcattctaagtccttcaaagaaaatccaaattgtttgccgcatcaccaccaatgtttcccacgccggctctcaagcgcggccccaacagtgggcccactgacaagctatcaccagtaccacaaccagcctattcattccgtttccgagggagttgacttctatagcgagttgagaaataagggctttcagcgaggagcctctcaggagctgaaagaggcagttagatcctcagtggaagaggagcagtgttag

SEQ ID NO: 30290 - DNA, 981 bp, Artificial Sequence
  Description of Artificial Sequence: Synthetic coding sequence
atggccaaaatggaattgtctaaggccttcagtggacagcgaactctgctatcagccattctctcaatgctctctctgtctttctctacaacctccctgctgtcgaattactggttcgttggaacccaaaaggtgccgaagccgctttgtgagaaggggctggccgccaagtgcttcgacatgcccgtaagtttggacggggacaccaacaccagcacgcaggaagtcgtgcagtataattgggagactggcgatgaccggttttctttcaggagcttcaggtctggaatgtggttatcttgcgaggagacagtggaggaacccggtgaaaggtgtcgaagttttatcgagttgactcctcctgccaagcgagaaattctgtggctgtcactcggcacccaaatcacctacatcggcctgcaattcatcagctttctgttgctgctgacagatctgctcctcaccgggaatcccgcatgcgggctaaagctgagcgcctttgccgctgttagtagtgtcctaagcggtcttctgggcatggtggctcacatgatgtactcccaggtctttcaggccactgtcaatctaggaccagaagattggaggccacacgtttggaactacggctgggctttctacatggcttggttatcatttacatgttgcatggcgtctgccgttacaactttcaatacctacacaaggatggtcctggagtttaaatgcaaacactctaagtctttcaaggaaaaccctaactgtttgccccaccaccatcagtgctttcctcgcagattgtcctcagcagcgccgacagtgggaccactgaccagctatcaccaatatcataatcaacctattcattcagttagcgaaggcgtggatttctatagtgaacttcgaaacaaaggctttcagaggggtgccagtcaggaactcaaggaggcggtgagaagctcggttgaagaggaacaatgttag

SEQ ID NO: 30291 - DNA, 966 bp, Artificial Sequence
  Description of Artificial Sequence: Synthetic coding sequence
atgtccgatccctcccaactcacccaaaacgtctgcctgacacaggagatggaactgtccaaagctttttctggacagcgaaccctcctgtccgcaattctgtctatgttgagcctgagcttttccactacaagcctgctcagcaactactggtttgtcggtacccagaaagtccccaagcccctgtgtgaaaagggcctcgccgcaaagtgtttcgacatgccagtcagcttggacggagacacgaacactagtacgcaggaagtcgtgcagtataattgggagacaggggatgaccggttttcctttaggtcctttcggtcgggcatgtggctcagctgcgaggaaactgttgaggagccggccctgctgcacccccaatcatggaagcagtttagggcactgagatcctctgggacggctgccgcaaagggcgagagatgtaggtccttcatagagctgacaccacccgccaaacggggcgagaaaggtttgctggagtttgctactctgcaaggaccatgccatcccaccctgcgattcggtggtaaacgccttatggaaaaggcgagcttacctagtcctcctctggggttgtgtgggaaaaaccccatggtgattcctgggaatgccgatcacttacacaggacctctattcaccaactacctccagctacaaatcgattagccactcactgggagccctgtctatgggcccaaacggagagattatgctgttgttttctctgtccagtcaggtcccctggtgacggtgggccccacgacgtgttcactagcctgccatcggactgccagttgggtagtcgcagactcgaaactacttgccttgaattgtggcttggtcttttgcatgggctggcccttctgcacctgcttcacggggtcggctgccatcatcttcagcacgttcaccaggacggagccggcgtccaggtgcaagcctag

SEQ ID NO: 30292 - DNA, 858 bp, Artificial Sequence
  Description of Artificial Sequence: Synthetic coding sequence
atggccaagatggagctgtctaaagccttcagtggacagcgaactctgctttctgccatcctgtccatgctgagtttgtccttttccacgacttccctgctatcgaactattggttcgtcggcacccagaaagtgcctaaacctttgtgcgagaaaggtctggccgccaagtgctttgacatgcctgtctccctggacggggacaccaacacaagtacccaggaagttgttcagtacaattgggaaactggcgacgaccgattctctttccgatcctttagatctggaatgtggctctcctgcgaagaaaccgtggaggagcctggagagcgctgcagatcatttatagagctcaccccacctgctaagcgaggagagaaaggcctcttagaatttgccacccttcagggaccttgtcatcccactctccggttcggcggaaagcgattgatggaaaaagcctccctgccctctcctcctttggggttatgtggcaagaatccaatggtgataccaggtaatgccgatcacctccacaggacatctattcaccaactgcctcctgctaccaataggctggccacacattgggaaccctgcttgtgggcccagactgaaagattgtgttgctgcttcctgtgcccagtcagaagtcccggcgacgggggaccccatgacgtcttcaccagcttgcccagtgactgccagttaggcagtaggcgtctggaaactacctgccttgaactttggctggggcttcttcacggcctggctctactgcacctgctgcatggtgtcggctgtcatcacctccagcatgtgcaccaagacggcgccggagttcaggtgcaggcgtag

SEQ ID NO: 30293 - DNA, 888 bp, Artificial Sequence
  Description of Artificial Sequence: Synthetic coding sequence
atggagttgtcaaaagctttttccggacaaaggacgctgctgtctgcaattttgagcatgctgagcttatcctttagcaccacttctctcttatccaattattggttcgtcgggactcaaaaggtgccaaaacctctgtgtgagaaggggttggccgcaaaatgctttgacatgccagtgtcgctggatggtgacaccaacacctcaactcaggaagtcgttcagtataattgggagactggtgatgacaggttttcttttcgctccttcagatcgggaatgtggctttcttgtgaagagacggttgaagagcccgctctccttcatcctcagtcctggaagcaatttcgggctctccgcagctccgggaccgccgccgcgaagggcgaaaggtgtaggagtttcatcgagctaacacctcctgccaagcggggattgctgggtatggtcgcccacatgatgtattcccaggtctttcaggcgaccgtaaatctagggcccgaagattggagacctcatgtgtggaactacggctgggccttttacatggcatggctgagctttacatgttgcatggcatctgccgtgactacattcaacacttacacacgcatggtgctggaatttaagtgtaaacatagcaaatcctttaaggagaaccccaactgcctcccccatcatcatcagtgtttccccaggaggctaagttccgcagcccccactgtgggcccactaacaagttaccatcaatatcacaatcagcccatccacagtgtgagcgaaggagtcgatttttacagcgagctgagaaataaaggcttccagcgtggcgctagccaggagctaaaagaggctgtaaggtcatcagtggaagaggaacagtgttag

SEQ ID NO: 30294 - DNA, 1023 bp, Artificial Sequence
  Description of Artificial Sequence: Synthetic coding sequence
atggagctctccaaagcctttagtgggcagagaacccttctgtcagccatcctgtctatgctctctctgtccttttccactacctctctgctctctaattactggttcgtcgggactcagaaagttcccaagccactgtgcgagaagggactcgccgcaaaatgcttcgacatgccggtgtccttggacggcgacaccaatacatcaacacaggaggtggtgcaatacaactgggaaacgggcgacgatcgtttttccttcagaagtttcaggtctggcatgtggctgagttgtgaagagaccgtggaggaacccggcgaaaggtgtcggagttttatcgagttgacacccccagccaagcgcggggaaaaaggcctgctggagtttgctactctgcagggaccatgccatccaacactgcggtttggcggaaagcgtctgatggaaaaggctagcctcccttctcctcccttagggctgtgcggcaagaaccccatggtgatcccaggcaacgccgatcacctgcataggaccagcattcaccaactgccacccgccacaaaccggttggcaacacactgggagccttgcttgtgggcccagaccgagaggctgtgctgttgcttcttatgccctgtcaggtcaccaggagacggaggtccccatgatgtttttaccagcctgccttccgattgtcagctgggctccagaaggctcgaaaccacatgcctcgaactgtggctaggattgcttcatggcctcgcgttactgcacctgctgcatggagttggatgccatcatttgcagcacgatcaccaccagtgcttccccagacgcctgtcctctgcagccccgacagtgggcccacttacatcctatcatcaataccacaatcagcctattcactcggtgagcgagggtgtcgatttctactcagagttgaggaacaaagggttccagaggggcgcctcccaggagcttaaagaagcagtcaggtcttcagtcgaagaggagcagtgttag

SEQ ID NO: 30295 - DNA, 1020 bp, Artificial Sequence
  Description of Artificial Sequence: Synthetic coding sequence
atgtcggaccctagccagctaacccaaaatgtctgcttgacccaggaaatggagttgagtaaggctttcagtggtcagcggacccttctctccgccatcctttccatgttgagtctttctttttccacaacaagcctcctctcaaactattggttcgtcggtacgcaaaaggtcccaaaacctctgtgcgaaaagggtctcgccgcaaagtgcttcgacatgccagtgagcctcgatggtgatacgaacacatcaacacaggaggtggtgcagtacaactgggagactggagacgacaggtttagtttccgctctttccggtccgggatgtggctatcctgtgaggaaacagtggaagaacccggcgaacgctgccgaagttttatcgaattaaccccgccagctaagcgagaaatcctgtggctctctttgggcacacaaattacctatatcggcctgcagtttatctcttttttgctgctgctcactgatttgttgctgacaggtaatcctgcctgtggcctcaaactgtctgcctttgccgccgtgtctagtgtgctgtcagggctcctgggcatggtggcccatatgatgtatagccaggtgttccaggccactgtgaatctgggaccagaagactggcgtccacatgtgtggaattatggctgggccttctatatggcttggttgtcctttacttgttgcatggcatcggccgtcacaacttttaatacttacacccgcatggtgctggaatttaagtgcaagcactcgaagagtttcaaggagaatccaaattgtctcccccaccaccaccagtgcttccctaggcgcctgagtagcgcggccccaaccgtgggccccctcaccagctatcaccagtatcacaatcagcccatacactcggtttctgaaggtgtggatttttattcagagttgagaaataagggcttccagcggggagcttctcaggagctgaaagaggcagtccgctctagcgtggaggaggaacagtgttag

SEQ ID NO: 30296 - DNA, 828 bp, Artificial Sequence
  Description of Artificial Sequence: Synthetic coding sequence
atggcgaaaatggaactgtctaaagcgttcagcggccagcgcacgcttctaagtgcgatcttgtccatgctgtcactgtccttctctacaacatccctgctgtctaattactggtttgtggggacccagaaagtgccaaagccactatgcgagaaaggcctggccgctaagtgcttcgatatgcctgtttctctggatggggacacaaatacgtcaacccaggaggtggttcagtacaactgggaaacaggcgacgatcggttctcttttagaagtttccgttcaggaatgtggctgtcgtgtgaggaaaccgtggaggagccgggcgaacggtgtaggtcatttatcgagttaactcctccagccaagcgaggtttgttaggtatggtggctcacatgatgtattcccaagtatttcaagctaccgtgaacctcggtccggaagattggcgtccccatgtgtggaactatggctgggccttttacatggcatggctatcctttacttgttgcatggccagcgcggtgactaccttcaacacctacactcgtatggtcttggagttcaaatgcaagcatagcaagtctttcaaggaaaaccccaactgtctcccccatcatcaccaatgctttcccagacggctatcaagcgccgcccccactgttggaccactcacgagttatcaccagtatcataaccagccgatccattcagtctctgagggagtagacttttatagtgaactgcggaataagggatttcagaggggcgcctcacaagaactgaaagaagccgtcagatcaagcgtggaagaagaacagtgctag

SEQ ID NO: 30297 - DNA, 897 bp, Artificial Sequence
  Description of Artificial Sequence: Synthetic coding sequence
atggcaaagatggaactctccaaagctttcagtgggcagaggacccttctgtctgctatcttgtccatgctcagcctgagcttctccaccacatctctgctgtccaactattggttcgtcggtacacagaaggtaccgaaaccgctgtgcgagaaaggcctagctgccaagtgcttcgatatgcctgtctcgctggatggcgatactaacacatcaacacaggaagtggtgcagtacaactgggagacgggcgacgacagattttcttttagatcttttcgctcggggatgtggctcagctgtgaagaaactgtcgaagaacctgctctgctgcatccgcaaagctggaagcagttccgggctttgagatcatcaggaacagccgccgcaaagggtgagagatgtcgcagctttatcgaattaaccccccctgctaagcgcggtctgctgggaatggtagcccacatgatgtattcccaggttttccaagccacagttaacttaggcccagaggactggcgacctcatgtctggaattacgggtgggctttctacatggcttggcttagctttacctgttgcatggcttccgcagttacgacctttaacacctacaccaggatggtgctggaatttaaatgcaaacactccaagtcattcaaggaaaatccaaactgtctaccacatcaccaccagtgcttcccacgccggctatcttcggcagcccccactgtgggcccactcacaagttatcatcaataccataatcagcctattcattcagtcagtgagggagtcgacttctacagtgaactgcggaacaagggttttcagcgaggagcatcacaagagctcaaggaggccgttcgatctagcgtggaggaggagcagtgttag

SEQ ID NO: 30298 - DNA, 462 bp, Artificial Sequence
  Description of Artificial Sequence: Synthetic coding sequence
atgtctgaaagcctggtagtgtgcgatgtggcagaagatctggtagagaagctacggaaatttagattccggaaggagaccaacaacgctgcgataattatgaaaatcgacaaggataaaagactcgtggtcctggatgaagagttggaagggattagccccgatgagctcaaagatgaactacctgaacggcagccccgctttatcgtgtacagctacaaatatcagcacgatgatggccgcgtgagttatccgctgtgttttattttttcatctcccgtcggctgtaagcctgagcagcagatgatgtatgctggcagcaaaaataaactcgtccagaccgccgagcttaccaaagtttttgagatacggaacaccgaagatctgaccgaggaatggctaagagagaaactgttcttcacaaatgtgaatttctgcgtgtcgaaagtattcatgtactag

SEQ ID NO: 30299 - DNA, 429 bp, Artificial Sequence
  Description of Artificial Sequence: Synthetic coding sequence
atgagcgagagtctcgttgtgtgtgacgtggccgaggacttggttgagaagcttcgcaagtttaggtttcggaaggaaacgaataatgccgccattattatgaagattgataaagataagcggctcgtggtgcttgatgaggagcttgaagggataagccccgacgaactcaaggatgagttacccgaaaggcaaccacgattcattgtttattcttataagtaccaacatgatgacggacgagtgagctaccccctatgcttcattttttcctccccagtggggtgtaaaccagaacagcagatgatgtacgccgggagcaagaacaagctggtgcagactgctgagctgaccaaagtcttcgaaatccgaaacacagaggatttgaccgaagagtggttgcgggaaaagctgggctttttccactag

SEQ ID NO: 30300 - DNA, 1785 bp, Artificial Sequence
  Description of Artificial Sequence: Synthetic coding sequence
atggcagtggaagagctgcagtccatcattaagcgctgccagattctggaggaacaggatttcaaggaagaggactttggcctgtttcagctggcgggccaaaggtgtatcgaggagggccatacggaccaacttttggagatcatccaaaacgaaaagaataaagtaattattaagaacatgggctggaaccttgtcggaccggtggtgaggtgcctgctgtgtaaagacaaggaagacagcaagcgcaaggtgtatttcctcattttcgacctcctcgtcaagttatgcaacccgaaagagctattattgggcctcctggaacttatcgaagaaccttcaggcaaacagatcagccagtccatattgctgttgctacagccattgcaaacagtgattcagaaactgcataacaaggcttattccatcggtctggccctgagtacactatggaatcagttgagtctgctccctgtgccctactccaaagagcaaattcagatggatgattacggactgtgtcagtgctgtaaggcgttgattgagttcaccaagcccttcgtggaggaggtgattgacaacaaggaaaattctttagagaatgaaaaacttaaagatgagctcctgaaattttgttttaagtctcttaaatgtcctctcctgaccgcacagttctttgagcagtcagaagaaggtggcaatgacccattcaggtacttcgcttcagagataatcggcttcctctccgccattggccacccattcccaaagatgatatttaatcatggcagaaaaaagagaacatggaactatctggaatttgaagaggaggagaacaagcagctcgccgactccatggccagcctggcctatctggtcttcgtgcagggaatccatattgatcagctgcctatggttctgtctcctctgtatctccttcaattcaatatgggacacatagaggtgttcctgcagagaaccgaagagtcagtgatctctaaaggcctggagcttcttgagaacagcctcctgaggattgaggataactcgctgctttatcaataccttgagatcaaatcttttcttacagtgccccaggggcttgttaaggtaatgacactctgtcctatcgagaccctccgaaaaaaatctctggcaatgcttcagctgtatatcaataaactggactcacaaggcaaatacacgttgtttcgttgtctcttaaacacgagcaaccacagtggagtggaggcgttcatcatacaaaatatcaaaaatcagatcgacatgagtctgaagcggacacggaacaataaatggtttaccggccctcagttgatttcacttctggacctggtcctgttccttcccgaaggggccgaaacggatctgctgcagaactctgaccgcatcatggcttcattaaacttgctacgatatctggtcatcaaggacaatgagaatgacaatcaaactggcctttggactgagctcgggaacatcgaaaataacttccttaagccgttgcacataggcttgaatatgtctaaagcccactacgaagcagaaatcaagaatagtcaggaggcccagaagtccaaggacctgtgctctatcactgtgtccggcgaggagatccccaacatgcctcccgaaatgcagttgaaagtgttgcacagcgccttgtttaccttcgacttgatcgagagtgtactggcccgggttgaagaactgatcgagatcaaaaccaagagtacttcagaggaaaatatcggcattaaatag

SEQ ID NO: 30301 - DNA, 1743 bp, Artificial Sequence
  Description of Artificial Sequence: Synthetic coding sequence
atggccgtcgaagagctgcagtccattataaaaagatgccagatactggaggaacaggacttcaaggaagaggattttgggttatttcaactggcaggccaaaggtgcatcgaagaaggacacactgaccagttactcgagattatacaaaatgaaaagaataaggtcataatcaagaatatgggatggaatctggtgggcccagtcgtgaggtgtctcttgtgcaaggataaggaagatagcaagcggaaagtctacttcctcattttcgaccttctagtaaagttatgcaaccctaaggagttactgctgggactcctggaattgattgaagagccgagtggaaaacagatttctcagtctatactgttgttgcttcagcccctccaaactgtaatccagaagctccacaataaagcttattccattggcctggccctttcaaccctgtggaatcagttgtctctgctgcccgtgccatattcaaaggagcaaatccaaatggatgattacgggctgtgccagtgttgtaaggccctcatcgaatttactaaaccattcgttgaggaggtcattgacaataaagaaaatagcctagaaaatgaaaaattgaaagacgagctactgaagttctgttttaagtctcttaagtgccctctgctgacggcacaattctttgaacagtcagaggaaggcgggaacgatccgttccggtacttcgcatcagagataatcgggttcctgagcgccatcggtcatcccttccccaagatgatcttcaaccacggaaggaagaagaggacatggaactatctggaattcgaagaggaagaaaataagcagcttgctgattcgatggccagtcttgcatatttggtctttgtgcagggcatacatatcgatcagctgcctatggtgctcagtccactgtacctattgcagttcaacatgggccatatcgaggttttccttcagcgtacagaagaatctgtgatctccaaggggctcgagctactcgaaaattccctgttgaggattgaagataattctctgctataccaatacctggagattaaatcctttcttacagtgccccagagaaagaagtcgctagcaatgttacagctttatatcaacaaattggactcccagggaaaatatactttgtttcgctgtctgcttaacacaagcaaccacagtggggtcgaggcattcatcatacagaacattaagaaccagattgatatgtctttgaagagaaccagaaacaacaagtggtttaccggtccacaactcatttcactgctggatctggtcctgttcctgccagagggcgccgagacggatctgctccagaactcagataggattatggccagcctcaacctcctgagatatttggttataaaggataatgagaacgacaaccagacgggcctatggaccgaacttggaaacatagagaacaacttcctgaaacctctacatataggcttaaatatgagtaaggcgcactacgaggcagagattaagaactcacaagaggctcagaaatccaaagatttatgctcaatcaccgtgagtggcgaggagattcccaatatgccacccgagatgcagctgaaggtgttgcacagcgccctcttcactttcgatttgatcgaaagtgtcctagcccgcgtggaggaattgattgagattaaaaccaaatcaacgtctgaagagaatatcgggattaagtag

SEQ ID NO: 30302 - DNA, 768 bp, Artificial Sequence
  Description of Artificial Sequence: Synthetic coding sequence
aacggtaagactgtacaggttctcccgagcgctttgagcacgatgttcggcatagattcatgcccttactatgtccttgagaatcattatattaccacaccactcagtacggaagaggccgccttccctttggcgtacgtcatgacgatcagccaggatttcgacacctttgagtggctcttttgggccatctacatgcctcagaacgtgtactgtatccacgtggataaggcagccaccatcgatttcaaaatagccgtttctgagctgcttgaatgcttctcaaatgcctttatcagctcacagagcgaatacattatctacgggggaaaaagccgactgcaggcagacctggcttgtatgagagaccttattgcgtccacggttcagtggcgttacgtgaccaatacaggagatcacgattttccgctcaaaacaaaccgcgagattgtgcagtacctcaagaccatgaactggaccaatatcactccaaatctggtgagcgtgttgaaaagcacagaaagaattaaatacacacaccgcgaatacagaaccagggcacatgcctttgtgctgaagaagcacaagaaaaaaagccctccaccccggcagctgaaaatccattttggcagttcctatgtagcgctcactcgggagttcgtccatttcgccctgtataataaaatagctatcgagctgcttcaacggagtcaggatacctactcaccagacaagcacttttggatcaccctgaacaacatcccatag

SEQ ID NO: 30303 - DNA, 1176 bp, Artificial Sequence
  Description of Artificial Sequence: Synthetic coding sequence
atgaaggtgtggtcatgttacctctgtattatcacgctccagattattattatcgttaccgtcctttataacgtgcatgtttcccagcccgacagtggacagatcgacgacgttggcggagagtaccaggccctgagcaggctgcacatctgcgatgccgctctaaatggcaagacagttcaggtactaccgtctgctttgtcaaccatgtttgggattgattcttgcccctactatgtcctggaaaatcattacataactactcctttaagtacggaggaggctgcctttcctttagcttacgtgatgactatcagccaggactttgatacatttgaatggctcttctgggcgatatacatgccacagaatgtctattgtatccatgttgataaggccgcaacaatcgacttcaaaatcgctgtgagcgaactgctggaatgcttctctaacgctttcattagctctcagtctgagtacataatttatggcggcaaatccaggttacaggcagatctggcttgtatgagagatctcattgcgagcactgtgcagtggagatacgtgactaacactggggaccatgatttccctctcaaaaccaatagagagatcgtgcagtacctgaagaccatgaattggactaacatcacccctaacctggtttcggttttaaagagcactgagcggatcaagtacacccaccgcgagtatcgcacaagagcccacgcctttgttttgaaaaaacataagaaaaagagcccacctccacggcagctgaagattcacttcggctcttcctatgtcgccctgactagagaattcgtgcacttcgcattgtacaataagatcgccatcgagctgctccagcgcagtcaggacacttacagtccagataaacatttttggattacattgaacaatattcctgtcgagtgtacaggaccttggattctggctgtgaattctggtagctgccagaatcgccacatatgcccccggggcctggaatttcagcagcagtatcccgtcaatagctttggcggcaataactgttcaattgccgcaggcacagccgccccgcgcgaggccctcggaccattccatctcaaggccgcctgtagcgcccatcagaacaagtgggggttttggaattgctatttgcacctcaaatag

SEQ ID NO: 30304 - DNA, 909 bp, Artificial Sequence
  Description of Artificial Sequence: Synthetic coding sequence
atgtgcctccagccgctccaggaacagaagcagtgggccctggacggggctgaatatcggactattcaggccaattgcacagggactggaatagggtacaacatcatttgggtccctatggcgagctgcgactttagcatccgaacttacacatatgctgacacacctgatgacttccagctccacaacttttcactgcctgaggaggatacaaagctgaaaatcccactcatccatcgggccctgcagctggctcagagacccgtttcactactcgctagcccctggacatcccccacccggctgaagacaaagggggcagggaacggcaagggccccctcaaaggccaaccccgggacatctaccaccagacttgggcccgatacattgtgaagttcctcgacgcctacgctgagcacaagctgcagttctgggccgtgaccgctgagaatgaaccctctgccggcctgctgagcgggtaccctttccagtgtctggggtttactcccgagcaccagcgggacttcattgccagggatctaggccctacattagcaaacggcactcaccacaatgtgaggctcctgatgctcgacgaccagcggctcctattgccacactgggccaaagtggtgctgactgatcctgaggccgccaagtatgtccatggcatagccgtgcactggtatctcgacttccttgcccccgctaaagctaccctgcgcgagactcatcacctgttccccaatactatgctctttgcgagtgaggcttgtgtcggctctaagttttgggagcagtccgtgagactgggatcctgggatcgcggcatgcagtattcccattcaattattactaatttactgtaccatgtcgtaggctggactgattggaacccatcactgtag

SEQ ID NO: 30305 - DNA, 1080 bp, Artificial Sequence
  Description of Artificial Sequence: Synthetic coding sequence
atgtgtctgcaaccactacaagagcagaaacaatgggctttggatggagctgagtaccgtactatccaagcaaattgtacgggcactggtatcggctataatattatttgggttccgatggcaagttgcgatttctccatcagaacatatacatacgccgataccccagatgatttccaactgcacaatttctctcttcccgaggaagacaccaagctgaagatacctcttattcatagagcactgcagttagcacagcggccagtttcgctgctggccagtccctggacgagccctacacgacttaaaacaaaaggcgccgggaatggaaaaggcccactgaaaggacaacccagagacatctatcatcagacctgggctcggtatattgtgaagtttcttgatgcttatgcagagcataaactgcagttctgggccgtcactgccgagaacgagccctctgccggcctgctgagcggttacccattccagtgcctcggattcaccccagagcatcagcgggatttcatcgctagggatttgggtcctacccttgcaaacggcacccaccacaacgtgcgacttctcatgctggatgatcagcgcttgcttcttcctcactgggctaaggtggtgctcactgaccccgaggccgctaaaggactgtgcggtttccaggtgctgggcgcagaatgcgccgctcgtcttcttgggtcacgtgacgcagtgcagccccaacaccaccacaaacccccagtgccatgcggacggctggaccggctggagccaatcatcgtcgacataaccaaacatactttctacaaacagccaatgttctatcacttaggtcattttagcaaatttattcccgaggggtcccagagagtgggccttgtagcttcacaaaagaatgaccctgacgctgtggcccttatgcacccggatggctccccagtcgtggtcgtcctgaatagaagctccaaggatgtccctttgaccataaaagaccctgcagtggggttcctcgagaccattagccccggttattcgattcacacatatctgtggaggcgccagtag

SEQ ID NO: 30306 - DNA, 1566 bp, Artificial Sequence
  Description of Artificial Sequence: Synthetic coding sequence
atgagcagtgactcagaccgccagtgtccagtggatggggacattgaccagcaggagatgattccctccaagaaaaatgccgtgctggttgacggcgtagtcctgaacggccccaccacagatgccaaggcaggggagaaattcgtggaggaggcatgcagattaattatggaggaggtcgtactcaaggctacggatgtgaacgagaaagtttgtgagtggaggccgccggagcagctcaagcagctgctggacttagaaatgagggatagcggggagccaccccataaattgctggaactctgtagagacgtgatccattattcagtaaaaactaatcacccaagattcttcaaccagctgtacgccgggctggactactacagcctggtggctcggttcatgactgaggcgctgaacccctcagtgtatacatatgaggtctcgcctgtgttcctgctcgttgaggaggccgtgctcaaaaagatgattgagtttataggatggaaagagggcgatggaattttcaaccccggggggtccgtgagcaatatgtatgccatgaatttagcacgatacaaatattgccccgatattaaggaaaagggcctatcaggaagtcctcgcctcattctgttcacttccgcggagtgtcattatagcatgaagaaagcagccagctttctgggcattgggaccgaaaacgtgtgcttcgtggagacagatgggagagggaagatgattccagaggagctcgaaaagcaggtgtggcaggcgcggaaggagggcgctgccccctttctcgtgtgtgcaacatcagggacaacggtcctaggcgccttcgatcctctagacgagattgccgatatttgcgaacggcactcactttggctgcacgtggacgccagctggggagggagcgctctaatgagccggaagcatcgaaagctattgcatggcattcatcgcgcagacagcgttgcctggaacccgcacaagatgctaatggccggcatacaatgttgcgctctgctcgttaaggataagagcgatctacttaagaagtgttatagtgccaaggcctcctatctgttccagcaggacaaattctatgacgtgtcatacgacacaggggataaatctattcagtgttctaggaggcctgatgcctttaaattctggatgacatggaaggctctgggcaccctggggctcgaggaaagggtcaacagggctctggccctgtcccggtacctggttgacgagataaagaagcgagaggggttcaaactgttaatggaaccggagtatgccaacatatgtttctggtatattccaccaagtttaagagagatggaagaagggcccgagttttgggccaaactcaaccttgtcgctcctgctattaaggaaagaatgatgaaaaaaggctccctgatgcttggctaccagcctcaccggggcaaagtgaatttcttccgccaggtggtgatttctccccaagtctcgcgggaagacatggattttttgctggatgaaattgatctcttggggaaagacatgtag

SEQ ID NO: 30307 - DNA, 1116 bp, Artificial Sequence
  Description of Artificial Sequence: Synthetic coding sequence
atgtcgcatgagaaaagctttctagtgagcggcgacaactatcctccccccaaccccgggtatcccggcggaccccagccccccatgcctccttacgcacagccgccgtacccaggcgccccataccctcaaccaccatttcagccttcaccttatggacagcccggatatccacacggcccgtccccatacccacaaggcggctacccacagggaccctatccacaaggaggctatccacaggggccctatccgcaggaaggatacccccagggaccctaccctcaggggggatacccccagggcccgtatcctcagagcccattccctcccaacccttatggccaacctcaggtctttccaggccaggacccagacagcccacaacatggaaattatcaagaggaggggccgccaagttactatgataatcaagactttccggctacaaactgggatgacaaatccattagacaggcatttatcagaaaagtgtttttagtcttaactttgcagctgagcgtaacattaagtacggtgagtgtgttcacctttgtggccgaggtgaagggcttcgtcagggagaatgtctggacttactacgtgagctacgccgtgttttttattagcctcatcgttctcagttgttgcggggacttccggcggaagcacccctggaacctggtggccctctcagttttaacagcgagcctgagctacatggtcggtatgatcgcctctttttataacactgaggctgtgatcatggcggtggggataaccaccgctgtttgtttcacagtcgtgatcttctcgatgcagaccaggtatgacttcaccagctgcatgggggtcctgctggttagcatggtcgtgctattcatttttgcaattctttgcatattcatccgcaatagaatcctagagatcgtgtatgcttcgttgggtgccctgctgttcacctgttttctggccgttgacacgcaactgctgttgggtaataaacaattatcgctgtctcccgaagaatacgtgttcgccgcactcaacttgtatactgacattattaacatcttcctctacatactcaccataatcggtcgagcgaaagagtag

SEQ ID NO: 30308 - DNA, 1332 bp, Artificial Sequence
  Description of Artificial Sequence: Synthetic coding sequence
atggctgcccaccgaaaacacgtgttcgtcgagaaagtcctccaaagactattcccacctgtcccatcaggccagggaaaacgggaaccccaaacgctggccgttcagaacccccctaaaaaagttacttccgaaaaagtctcccagaaacacgcagaacctctaaccgataccgggagcgaaacaccaactgcacggagattatataccgcttcaggcccacccgaggggtacgttccctgctggcctgaaccctccagctgcggatcccctgagaacgcgtcatctggcgacgatactgaggatcaagaccctcacgaccagcctaaaaggcgccggatcaggaaacacaagtctaagaaaaagtttaaaaatccaaacaatgtcctgatcgagcaggctgagttagagaagcagcaaagcctcctccaggaaaaatcacagcgtcagcacacagacggcactaccatctcaaaaaataagaagcgcaagcttaagaagaaacagcagatcaaaagaaagaaagcagccggcctcgcggcaaaggccgctggggtgagttttatgtaccagccagaggactccagcaacgagggcgaaggcgtaggagaagcttgtgaggaagatggagtggataccagcgaggaggatccaactctcgcgggagaagaggacgtgaaggatacacgagaagaggatggcgctgacgcgagcgaggaagacctgacacgggctagacaggaagaaggggcagacgcttccgaggaagacccgactcctgcgggtgaagaggatgttaaagacgccagggaagaggatggcgtggacaccatcgaagaggacctcacaagagctggcgaggaagatggtaaggacacgcgcgaggaagatggtgccgacgcctccgaggaagatcctacatgggcgggggaagaggagggtgccgactcaggcgaagaagacggagccgacgcctccgaggaggacgatacaatcacaaatgaaaaagcccactctattctgaattttttgaaatctacacaggaaatgtatttctacgacggtgtgtcccgtgacgcagcatccgctgcactcgcagacgccgccgaggagctgttggacagattagccagtcactccatgctgcctagcgacgtttcgattctgtatcacatgaagactttgctgttattgcaggatacagagagactcaagcacgctctcgagatgttccccgaacattgtactatgccaccggatcacgctagggtcatatccgcctttttcagctactggatcacgcatattctgcccgagaagtcatctgactag

SEQ ID NO: 30309 - DNA, 1269 bp, Artificial Sequence
  Description of Artificial Sequence: Synthetic coding sequence
atggccgcccaccggaagcatgtgttcgttgagaaagtcctgcagcgcctctttccacctgtgccatctggccagggaaaacgagaaccccaaacactagccgttcagaacccacccaagaaggttaccagcgagaaagtctcccagaagcatgcagagccactcaccgacacgggcagcgaaacccctactgcgcgtaggctctataccgcctcaggcccgccagaaggatacgtgccctgctggcccgaaccaagctcctgtggcagccctgagaatgcctctagtggcgacgatactgaagaccaggacccgcacgatcagcccaagcgccgcagaataaggaagcacaaaagcaagaaaaaattcaagaaccctaataatgtgttaattgaacaggcagagctggagaaacaacaaagtctactccaggaaaaaagccagaggcagcacactgatggaacaaccatttctaagaacaagaaacgaaagctcaaaaagaagcaacagataaaacggaaaaaggccgcagggctcgctgccaaggccgcaggagtcagcttcatgtatcagccagaggactcaagcaatgaaggggagggcgtgggagaagcctgtgaggaggatggcgtggatacttccgaggaagatccaactcttgcgggcgaagaggatgtgaaagacactcgcgaggaggacggtgctgacgcctccgaagaagatctaactagagctcggcaggaagaaggtgcagacgccagtgaagaggacccgacaccagccggtgaggaagacgtgaaagatgctagagaagaagacggggtagacacaattgaggaggatctgacacgcgcgggcgaagaggacggcaaggacacaagggaagaagatggtgcggatgcttccgaggaggatcctacatgggccggggaggaggaaggggcggattctggagaagaagatggagcagacgcctcagaggaagacgacaccattaccaacgagaaggcccactccatcctgaactttctgaaaagcacacaggaaatgtacttttacgacggcgtatcgcgcgatgcagcgtccgccgctctcgctgacgccgcggaggaactgctcgatcgtttggcctctcacagcatgttgccttcggacgtgagcatactgtaccacatgaagaccctgttgctgcttcaggatacagaaagacttaagcacgccctcgagatgttccctgagcactgtacgatgccgcctgcccttacctag

SEQ ID NO: 30310 - DNA, 3948 bp, Artificial Sequence
  Description of Artificial Sequence: Synthetic coding sequence
atgaactttctgagtaccgccgagtccagaactgcacaggctgcagcttcaggaaccacgctcttgccacagtttcgtgccccgagttggcaaaccggcatgcatagtagtgccgcgaccgagctttttgccaccgggccgctgccaagtaccgggactctgccgccctcactttccgcttaccagcacccgacgaccttcagtaataggaactttgcaacaacttcaccgctggtgctccaagactctactttcaacacaacgtccaacgggatcctgtcccatcacgaccctctgttgcaaataaagactagccagggcaccgttccgacagctttggcttttgaacggttgggaagcagcgtgctttccaatagcattccccctcaatccagcacctatcggtccgcccaagagtctgcaccacatctgttgcagccccagttttcactattgcccagtgcccttggggggtcccagcagactccccaggcatactcctctactttattcacgtcgtccactgcttccatcgaacgggcccttctccgagaatgttctgtgattaaacatcaccaacggccttccggaactcaaagcatccaagcgcagcttaccggatcccagcattccctccactcctaccttagcaattcttccgtagtgaactttcaggagactactaggcaatcctctctgtcttgctcacccattggggatagtactcagaatctgcccgattcaagccctacacagaattacatctccatgcattcaagtcagaacgttcagacacaagaaagttcatctcctcagagtcagaagttcctgccagctgtccagtccagtagttttgctagctcaactcactgccagaccctgcagaacaatattacttcacctgatccgaagagctacgccgagcggaagctcgactctgatgtctaccccagctcaaaacaggaggatgggtttccaatgcaagagctgcaagtactccagccacaggcttctcttgaatccagtacccagcgcctgtccgatggcgaaattaacgcccaggagtctacatacaaagtgtctaaggcagatgatcgttactcccagtccgttatacggtccaatagccggctagaggaccaggtgattggggtcgcgctccaagcatctaagaaagaagagagtgtggtaggaagcgtgacccaactgaatcagcagatcgggcaagtaaacaacgcagccacgctagatctcaaaaatagcacaaatctgatacagacacctcagattcgtttgaacacaaaggacctgaagcagcagcaccccctgattctgaaggtgcatgagagtaaggttcaggaacaacacgaccagatcattaacgccagctcacagatccagataccaaatcacgccctggggcacgggcaccaggcctctctgcctaacactcaggtgctgctggattccgcctgcgacctccaaattctacagcaatccatcctacaggccgggctcggccaggtgaaagccagtctccaagcgcagcgcgttcagtctcctcagcaaatcgtgcatcccttcttacagatggaagggcacgtgatccagagcaacggtgatcactcccaacagcagttgcaccctcagaattctgaggttatgaagatggatttaagcgagagcagtaaaccgttacaacagcaccttacaaccaaaggccactttagcgagactaaccagcatgattcgaaaaaccagttcgttagcctggggagcatgtgctttcctgaagcagtgctgctgagcgatgaaaggaacatcttgtcaaatgtggacgatatccttgcagctacggccgccgcatgtggagtgacacctactgatttcagtaaaagtaccagtaacgagactatgcaggcagtggaagacggagattcgaagagtcacttccaacagtccctggatgtgcggcacgtgacctctgacttcaactcaatgaccgcaacagtaggtaaaccacagaatattaatgacacgtcactcaacggcaaccaggtcacggtgaacctgtcccccgttcctgccctccagtctaaaatgacgttggaccagcaacacatcgagacgcctgggcagaacattcctacaaaggtcaccagcgccgtggtaggaccctcgcatgaagtacaggaacagtcatccggacctttcaaaaagcaaagtgctaccaatctggaatctgaggaagactctgaagcacctgtggatagtaccctgaacaacaatcggaaccaggagtttgtatctagctccagaagtatcagcggagaaaatgcaacttccgagtctgaattcaccttaggcggcgacgactccggagtatcaatgaaccctgctcgctccgctctggcactgttggccatggcacagtcaggcgacgctgttagcgtgaaaatcgaggaggaaaatcaagacctcatgcatttcaatttgcagaaaaagcgcgccaaggggaagggacaagtgaaggaagaggacaattctaaccagaagcaacttaaaagacccgcacagggcaagaggcagaacccgaggggcacagacatttatctgccttacaccccgcctagttcagagagttgccatgatggatatcagcatcaagaaaagatgagacaaaaaatcaaagaagttgaggagaaacagcccgaggtcaaaactggctttatcgcttcttttttggactttttgaagtctggtcccaagcaacagttcagcacattggctgttcggatgcccaacagaactagaaggcctggaactcagatggtcaggactttttgcccccccccattgcccaagccgagcagcacaacccctactcctctcgtctcagaaaccggggggaactctccttccgataaggtggataacgaactaaagaacctggagcacctgagttctttttcttctgatgaggacgaccccggatactcccaagacgcctacaaaagtgtcagcaccccgctgacaacactcgatgcaacctctgacaagaagaaaaaaaccgaggccttgcaggtggcaaccacatctcctacagccaatacaactggcacagctaccactagcagcaccacagttggcgcagtgaagcaagaacccctgcattccaccagctacgctgtgaacatccttgaaaacatctctagcagtgagtctagcaagcctattgagctcgatggccttcccagcgaccaattcgcaaaaggccaggataccgtagcaatcgaaggtttcacggatgaggaagatacagaaagcggaggtgagggccagtatagggaaagagacgagttcgtggtcaagattgaggatattgagacctttaaagaagctctgaagacaggtaaggaacctcctgccatttggaaagtgcagaaggctctgctgcagaagttcgttcccgaaattagagacgggcagagagagttcgctgcgaccaactcttacctgggctactttggagatgctaaatcaaaatacaagaggatttacgtgaagttcatcgaaaatgctaataagaaggagtacgtgcgggtctgctccaaaaaaccgaggaacaagccctcacagactatacggaccgtgcaggcaaaaccttctagcagttccaaaaccagcgaccccctggcatccaaaacaacaaccacaaaggcgccctcagtgaagccaaaggtgaagcagcccaaagtcaaagccgagcctcccccaaaaaagaggaagaagtggaaagaggagtttagctcgagccagtcagacagctcacccgaaattcacacgagctctagcgacgacgaggaatttgagcctcctgctccatttgttacccgtttcctcaatactcgagccatgaaagagacttttaagagctacatggaatag

SEQ ID NO: 30311 - DNA, 5208 bp, Artificial Sequence
  Description of Artificial Sequence: Synthetic coding sequence
atgaactttttatctaccgctgagagccgtacagctcaagcagccgccagcgggactactttattacctcaattccgagcgccttcatggcaaactggaatgcactcatcagcggccacagaacttttcgcgactgggcccctgcccagcacaggaacccttcctcccagcttatcagcctatcagcatcccaccaccttcagcaatcgcaatttcgccacaacatcgccccttgtgctgcaggacagtacgttcaatacaacttctaatggtattctttctcatcacgatccactgctccaaatcaaaaccagccaaggcacagtgcccacggccttggcatttgaacgcctcggttctagcgttttgtccaattcaatccccccccagtcatctacttataggagtgcgcaggagtcggcgcctcatctgctccagcctcaattttcactgctgccttctgccctaggggggagtcagcagacaccgcaagcttactcatcgactctctttacaagcagcacagcttcaatcgagcgtgctctactccgggaatgttcggtgattaaacaccaccaaagaccaagtggaacgcagtccatccaagctcaactcacaggttcacagcactccctgcacagctacctgtcaaattcctcagtggtgaacttccaggagacaacacgccagagttcgctctcatgctcgcccattggcgactcaacacaggtgtccaacggaggtttgcagcagaagacgtcgcaggtgtccgttgaactggcccagagctactctagcgctattccctcatctggctatccaccctctactacgaaaatcaagagctgcagtaccgaacagcccctgacaagcacaaaaacccctaaacctcagtcaatcatacctccggtacagaccctttcctactcgaagcctctgcataaccaatcctctgtgatatcaggccaggcacagatctacagcactgcccagctgccgtcactactctctgtatcacaatcccagaattatgggttggttcagccccacaatgttccctccattgtgcactctcaggtctatcgttcctcaaaagtagagaagcttcctccgctttataaaacccttactttttccggctccagtcagaccgtgacaccggaaaatcagacactgaattactcctcaaatcaacaggaagtgctaagtagtgtaacgaacgagaattatcccgcacaaacccgtgatctgtcatcagtgagtcagagccagagctattcttccgggcattcacagggattaagtccggtgagccaaacacaggtcagttactctagccagagccaagtattgagtgtggttagcctgagcgaatcctatgcatctggcgagtcactgaccctgactgctcctagtctcagctactcctccgcctccagagcccaaaatctccccgacagttccccgacccagaactatatttccatgcatagtagtcagaatgttcagacacaggaaagttctagtccccaaagccagaaattcctgcctgccgtacagagcagctcctttgccagctcaacacattgtcagacattacagaacaacataacaagccccgatcctaagagttacgcagagcgcaaactggactcggatgtataccccagctccaagcaggaagatggcttccccatgcaggagctccaggtcctccagccccaggcctccctcgaatcctcaacacaacgcctctcagatggcgagattaacgctcaggagtccacttacaaagtaagcaaagctgacgaccgctactcccagtctgtcatcaggagtaatagccgcctggaagaccaggttattggtgttgccctgcaggctagcaagaaggaggaaagcgtggtgggaagcgtaacgcaattgaaccagcagatcggacaagtgaacaacgccgcaaccttagatctaaagaactccaccaacctgattcagacaccgcagattaggttaaatacaaaggacctgaaacagcaacacccattgatcctcaaggtgcacgagtcgaaggtccaggaacagcacgaccagatcatcaatgcgagcagccagattcaaattcccaaccatgcattgggtcatggccatcaggcctcactgccaaatactcaggtgcttcttgattcggcctgcgacctgcagatcctccagcaaagcatcctgcaggctgggctgggacaggtgaaggcctcattacaggctcaacgagtccagtccccccagcaaattgtccacccatttctgcagatggaaggtcatgtgatacagtcaaacggggaccatagtcagcagcagctccatccgcagaatagtgaggtcatgaaaatggatctcagtgaatcatccaagcccctccagcagcatctaacgacgaagggacatttttccgaaaccaatcagcatgacagtaaaaaccagtttgtcagtttgggttcaatgtgttttcccgaggctgtgctcttgtcagacgagaggaatatcttgtcaaacgtggacgatatacttgccgccacagcagcagcctgtggagttacacctactgatttcagcaagagcacctccaatgagactatgcaagccgttgaggatggcgacagcaagagtcactttcagcagagcttggacgtgcggcatgtcacgtctgactttaacagcatgaccgcaaccgtgggcaaaccgcagaatatcaatgacacctctttgaacgggaaccaggtgacagtcaacctcagccccgtgccagcccttcaaagtaaaatgacactagaccagcaacacatcgagactcccggtcagaacattcccacaaaggtcacaagcgctgtggttggtccctcgcacgaggtgcaggagcagtcgtctggcccctttaaaaagcaatcagcaactaacttagaatctgaggaagatagcgaagcaccggtggactccaccttgaacaataatagaaatcaagaatttgtatcatcaagtcgctccataagcggcgagaacgctacctcagagtccgagtttacattaggcggtgatgattcaggagtctccatgaaccctgcaaggagcgccttagctctgctagccatggcacagtccggagacgctgtcagcgtgaaaattgaggaagagaatcaggatcttatgcattttaatcttcagaagaagcgggctaagggaaaaggtcaggttaaagaggaagacaacagcaatcaaaaacaactcaaacgccccgctcagggcaaacgacaaaaccctcgcggcactgatatctatttgccttacacacccccaagctcagagagctgtcacgacgggtaccagcaccaggaaaaaatgagacagaagattaaagaagttgaggagaagcagcctgaagttaaaacaggcttcatcgcaagttttctagacttcctgaagagtggacccaagcagcagttctccaccctagccgtccgtatgccgaataggaccaggagaccgggcacccaaatggtgagaactttttgcccaccacctttacccaaaccctcatccactaccccaacacccctggtttctgaaactggcggtaacagcccctccgataaagtggataacgaactgaaaaacctggagcacctctcttcattctcctcagacgaagatgatcccggctacagccaggacgcctataaaagtgtgtctacaccactgactaccctggacgcaacgtcagacaagaaaaagaaaaccgaagcattacaagtcgccactactagtcccacagcaaatacaacgggcaccgcaacaaccagctctacaactgtgggcgctgtgaaacaggagcctctgcactccacaagctacgctgtgaatattttagaaaacatcagtagttcagaatcctctaagcctattgagctcgatgggctcccatccgaccaatttgccaagggccaggacactgtcgccatagagggtttcacagatgaagaagacaccgaatcgggtggcgaagggcagtacagggaacgagacgagttcgtcgtgaaaatcgaggatatagagacattcaaggaggctctcaaaaccgggaaagagcctcccgcaatctggaaggtccagaaagcactgctgcaaaaattcgttcccgagatcagagatggccaacgcgagttcgctgccaccaactcatacctgggctactttggggacgccaaatccaaatacaaacgcatctatgtgaagtttatcgagaatgcaaataaaaaggagtacgtgagggtgtgcagcaaaaaaccaaggaataaaccctcccagacaatccgtacagtccaggccaaaccaagcagttcaagcaaaacttctgacccactagcgtctaagaccaccactacaaaggcgccctccgtgaagcctaaggtgaagcagcctaaagttaaggctgagcctccgccgaaaaagcgaaaaaaatggaaggaagagttttcttcgagccagtccgatagttctccagaaatacacacatcaagttcagacgacgaggaattcgagccccccgcgccattcgtgactcggttcctaaatacaagagctatgaaagagactttcaagagctatatggaacttcttgtgtccatcgcactcgaccccgacaccatgcaagctttagagaagtccaacgatgaattgcttctgccccacatgaaaaagatcgacgggatgctcaacgataatcgaaagagattgctcctgaatctccacctcgatcagtctttcaagaacgctctagagagcttccctgagcttactatcattactagggatagtaaagcaaaatccggggggacagccatttccaagattaagatgaatggcaaagcttacaataaaaaaacactgcgcaccagtaagactactaccaagtccgcccaggagttcgctgtagacccagagaagattcagctgtactcactgtaccattcccttcaccattacaaataccacgtgtaccttatatgtaaggatgagatctcctctgttcaaaagaaaaatgaagatcttggacaggaagagatcgtacagctgtgtatgaagaatgttaagtgggtggaagacctgttcgagaaatttggagagctcctgaaccacgtccagcagaaatgttcttag

SEQ ID NO: 30312 - DNA, 195 bp, Artificial Sequence
  Description of Artificial Sequence: Synthetic coding sequence
atgaacttcttaagcacagccgagtcccgaaccgcccaagcggcagcttctggaaccaccctgctccctcagttccgtgcgccctcttggcagactgggatgcatagctccgcagcaaccgagttgttcgctacgggacctctcccatccaccggaacactgcctccttcactgagtgcctaccagcacccatag

SEQ ID NO: 30313 - DNA, 4992 bp, Artificial Sequence
  Description of Artificial Sequence: Synthetic coding sequence
atgaaagatgccgccgaggagctttcatttgcaagagtgctgctgcagcgtgtagatgagttggagaagctcttcaaagatagggagcagtttctggagctcgttagccgcaagctgagcctcgtgcctggggccgaagaggtgaccatggtcacttgggaagagctcgaacaggccattaccgatggatggcgggcctcccaggccggctccgagaccctaatgggctttagtaaacacgggggctttacaagtctgactagccctgaggggaccctctccggagactccactaagcagccgtcgatagagcaggctctcgatagtgctagcggcttgggccccgatcgcacggcttccggctctggcggcacagcacaccctagcgacggtgtgtcctctcgtgagcagtctaaagttccatcgggcaccggccgccagcagcagccaagggccagagacgaggccggtgtccctagattgcatcagagctctacgttccagttcaagagcgacagcgaccggcacaggtcccgcgaaaaattgaccagtacacagcctaggcggaacgctcgacccgggccagtacagcaggacctgccccttgcacgagaccagcccagttcagtacctgctagccaatctcaggtacacctgcggcctgaccgcaggggtttggagcccaccggtatgaatcagcctgggctggtgcccgcctctacgtacccccacggcgtggtgccgttatccatgggacagttgggcgttccgccgcctgaaatggatgacagggaattaattcctttcgttgtggacgaacaaaggatgctaccacccagcgtccctgggagggaccagcagggattggagttgccctcaaccgatcagcacggtctggtctcagtgtccgcctatcaacatggaatgaccttccctggcaccgatcagagatctatggagcctctgggaatggatcagcgcggttgcgtgatctcggggatggggcagcaaggattagtcccccccgggatagaccagcaaggcctgaccttgccagtggtggatcagcacgggttggtgctgccattcacagatcagcacggcctagtgtctccaggcttaatgcctattagcgcagatcagcagggctttgtgcagccctctttggaggctacaggatttatccagccaggcaccgaacaacatgacttaatacaatctgggaggtttcagagggcactagtgcaacgaggcgcataccaacccggactggtccagccaggcgccgaccagagagggctagttagaccagggatggatcaaagtggactggcgcaacccggagctgaccagcgtggtctggtatggcccggaatggaccaaagtggtctcgctcaacccgggagagaccaacatggacttattcagcccgggacaggccagcacgacctcgtccagtccgggaccggtcagggagtgttggtacaacctggcgtcgaccaacccggaatggttcagccgggacgattccagcgggctctcgtccagccaggggcctaccagcctggcctggtacagcccggagctgaccagattgacgtagtacagcctggagctgatcagcacggcctggtccaaagcggagccgatcaaagcgatttggcgcagccgggagcagttcagcacggacttgtgcagccgggcgtcgatcagcgggggctggcccagcctagagctgaccaccagcgaggcctggttccgcccggggcagaccagcgtggcctggttcagccaggtgccgaccagcacggtctcgtccagcccggtgtggatcagcatggtttggcccaacctggggaagtccaacgatccctagtacagcccggcatcgtgcagcgtgggctggtccagcccggggcagtgcagcgaggcctggtgcaacccggggctgttcagcggggattagttcagccaggagtggatcagcgaggactggtgcagcctggagccgtgcagcggggcctggtgcagcccggagccgttcagcatggcctagtgcagcctggcgccgatcaacggggactcgtccagcccggggtcgatcaaagggggcttgtgcagccgggggtagaccagcgcggcttagtccagcctggtatggatcaaagaggactcattcagcccggcgccgatcaaccaggcttggtgcaacccggcgctggtcagctggggatggttcaacccggcattgggcagcagggaatggtccaaccgcaggccgacccgcacggcctggtacagcccggagcctatccactcgggttagtgcagccaggggcttacctgcatgatctgagtcagagcggcacataccctcgggggctagtccaaccggggatggaccagtacggactgagacagcctggagcctatcagccaggcctgatcgcacccgggactaagctgcgcggctcaagtacattccaggcagactcaaccggatttatatccgtgcgaccctaccaacatgggatggtgcctcctggacgggagcagtacggtcaggtttcacccttactggcttctcaaggactggcatcaccaggaatcgaccggcggtccctagtacccccagagacctaccagcaagggcttatgcatcccggcaccgaccagcactcccccattcccctatccaccggattgggttcgacccatccagaccagcagcacgtggcctctcctggaccaggtgaacacgatcaggtgtacccggacgcggcccagcacggacatgcattttccttgttcgacagccacgacagcatgtaccccggctaccgtggcccgggatacttgtctgcggaccagcacgggcaggaagggctggatccaaatcgaaccagagcttctgatagacacggcattccagcccaaaaagcaccgggtcaagatgtgacccttttcaggagtcccgattctgtggatagagtgttgagtgaagggagcgaggtgagttctgaggtgctgtctgagcgccggaactccttgcgtagaatgtctagttccttccctaccgccgtcgagacattccacttaatgggtgagctgtcatcactgtatgtcgggttgaaagaaagcatgaaagatctcgatgaggagcaggccggccagacagacctggagaagatccaattcctactagcacaaatggtgaaacgcacaattcctcccgagcttcaggagcagcttaagactgtcaagacactcgccaaagaagtatggcaagaaaaggctaaagtagaaagactccaacgaatccttgagggagagggcaatcaggaggctggcaaggaacttaaagcgggggagcttcggctgcagctcggcgttcttcgcgtgacagtcgccgatatcgaaaaggaactggcggagctgcgtgagagccaagaccgcggaaaagcggcaatggaaaactctgtttccgaggctagcctctatctgcaggaccaactcgacaaactgagaatgatcattgagtcaatgctcacctcgagcagcacattgctatctatgagtatggcgcctcataaggcccacactctagcacctggacagatcgaccctgaagcaacctgtcctgcctgcagcctggatgtgtcacatcaggtgagcacactggtgaggaggtatgagcaactacaggatatggtgaactccttggcagtttcccgcccctccaaaaaggctaagttacagcgccaggacgaggagctcctgggtagggtccagtccgcaatactccaggtccagggagactgtgaaaaactgaacatcacaaccagcaatctgatcgaggaccaccgccagaaacagaaagacattgccatgctgtatcagggattggagaaacttgagaaggaaaaggccaatagggagcacctcgagatggagattgatgtaaaagctgacaaatctgctctggctacgaaggtaagtagggtgcagtttgacgctaccaccgagcagctcaaccacatgatgcaggagctggttgccaaaatgagcggccaggagcaggattggcaaaaaatgctggatcgtctgcttacagagatggataacaaattagacaggctagaactagaccccgtgaaacagctgcttgaagacaggtggaagtccttgcgccagcagctccgggagcgaccacctctctatcaggccgatgaggctgcagcaatgcggagacagctgctggctcacttccactgcctctcatgtgatcgtcctctggagactcctgtgacggggcacgctatcccggtcaccccggctggtcccggcttacctggtcaccactccatccgaccatacaccgtttttgagcttgagcaagtccggcagcacagtagaaacctgaaactggggagcgccttccccaggggtgacctggctcagatggagcagtccgtcggcaggttgagatctatgcactctaagatgctcatgaacattgagaaggttcagattcattttgggggctcaactaaggctagctcacagatcatacgcgagctgctgcatgcccagtgcttaggatcaccctgctataagcgcgtcaccgatatggcggattacacctattccaccgtgcctcgccgctgcggggggagccacacactgacatatccctaccaccgtagccgcccccagcacctgccccgtggcctgtatcccaccgaagagattcaaatcgccatgaaacacgacgaagtggatattttgggactagatgggcacatatacaagggacgcatggatacacggctccctggaatcctgcgaaaagactccagcggcacttccaagcgaaaaagccagcaaccgcgtccccatgtccaccgccctccctcactctctagcaatgggcaactgccctccagaccacaatccgcacagatctctgccggaaacacctcagaaagatag

SEQ ID NO: 30314 - DNA, 4290 bp, Artificial Sequence
  Description of Artificial Sequence: Synthetic coding sequence
atgaaggatgctgctgaggaattgtcctttgcccgtgtcctgctgcagcgcgtagacgaattggagaagctcttcaaagaccgtgagcagtttttagaactcgttagccggaaactcagcctggtgcccggcgctgaggaagtcacaatggttacctgggaggaacttgagcaggcaattactgacggttggcgcgcctcccaggcaggttccgagactctgatgggcttttctaagcatgggggttttacctctctaacctcccccgaaggtacactctcaggcgattcgaccaaacagccctcaattgagcaggccctcgacagtgccagtgggctgggccctgaccggactgcatccgggagtggcggaactgcccaccccagcgatggtgtatcttctagggagcagtccaaggtcccaagtggtaccgggagacagcagcaacccagagctcgcgatgaagcgggggttccacggctccatcaaagttcgacgtttcagtttaaatccgacagtgataggcaccggtccagagaaaagcttaccagtactcaacccaggcgcaacgcccgccctgggccagtgcaacaggacctgcccctcgccagagatcagcctagcagcgtgcctgcgagccaatcccaggttcatctgcggcctgaccgacgcggcctggagccaaccgggatgaatcaaccgggattagtgcccgctagcacttatcctcacggcgtcgtgcctctttcgatgggccagctcggtgtgccccctcctgagatggacgatcgtgaactgatacctttcgtagttgacgaacagaggatgcttccgccatctgtgccaggacgcgatcagcagggactggagttaccctctacagatcagcatggtctggtgtcagtgagtgcgtaccagcacggtatgaccttccccgggaccgaccaacgctccatggaaccccttggcatggatcaacgagggtgcgtcatttcgggcatgggccaacaggggctagtccccccaggtattgatcagcagggactgacccttccggtcgtagaccagcatggactggtcctgccattcacagaccaacatgggctggtctcccccggcctgatgcctatatccgcagatcagcagggcttcgttcagccgtctcttgaagcaactggcttcatccagcctggaacggaacaacatgacctaattcaatctggccggtttcagagggctctagtgcaaaggggggcctaccagcccggactggtccaacccggggccgaccagcgtggcctggtgcgccctggtatggatcagtctggactggcccagcctggtgcagatcagcgcgggcttgtgtggcctgggatggaccagtcgggcctcgcacagcctgggagggatcaacacggtctgattcagcccggtactgggcaacacgatttggtgcagagtgggactgggcagggagttctcgtccaaccaggagtggaccagccgggtatggtccaacccgggagatttcagcgcgccctggtccagcctggtgcatatcagcctggcctcgttcagcccggagctgaccagatcgatgtcgtgcagccaggagccgaccagcacggcctggtccagagtggagccgaccagagcgacctggcccagcccggcgcagtccagcacggcctcgtccagcctggggtcgaccaaagagggttggctcagccgcgggctgaccatcaacgcggccttgtgccccccggagccgatcagcggggcctcgtgcagcccggcgccgatcaacacgggctagtgcagccaggagtcgatcagcatggtctggcacagcctggggaggtgcagagatcattagtacaacctggtatcgttcagcggggtctggttcaacccggagccgtgcaaaggggcctggtccagccgggcgccgtgcagcggggcctggtgcagcccggcgtagaccagcgcggccttgtgcaacctggcgccgttcagcgcggactggtgcagcctggtgctgtccagcatggcctcgtgcaaccaggggccgaccagcgcggacttgtgcagccaggagtcgaccagcgaggcctcgtgcaaccaggtgtggaccagcggggcctagtacagcctggcatggaccagcgcggacttattcagcccggagctgaccagcccggcctggtccaaccaggagccggacaactaggcatggtgcagcctggaattgggcagcagggaatggtgcagccccaagccgaccctcacggactggtgcagcctggcgcttacccccttggccttgtccaacccggggcataccttcacgaccttagccagagcgggacctacccccgcggcttagtacagcctgggatggatcagtatggcctgaggcagccaggagcttatcagccggggttgatcgctccagggaccaagctcagaggatcaagcaccttccaagctgattccactggcttcatttctgtaaggccgtaccagcatgggatggtaccacccgggcgagaacagtatggccaggtgagtcctctgcttgcttctcaaggcctcgcttcccccgggattgatcggcgaagcctggtgccgccagagacgtatcaacaggggcttatgcatccagggaccgaccagcactctccgatcccactgagcaccggactgggatcaacccatcccgatcaacagcacgtcgccagcccaggcccaggcgagcacgatcaagtgtacccggacgcagcccaacatggccacgctttcagcttgttcgacagccatgactcgatgtaccccgggtaccgagggccaggttatttatccgccgatcagcacgggcaagaaggcctggatccaaacaggacaagggccagcgaccgtcacgggatacctgcccagaaggcacctggacaagatgtaaccctgttccggagtcccgacagcgtggaccgtgtgctgtctgagggctccgaggtctcaagcgaggtgttatctgagaggcggaacagcctccgaaggatgagttcctcctttcctacagccgttgagacattccatcttatgggcgaactgtcctccctgtacgtgggattgaaagagagcatgaaagatcttgacgaagagcaggccggacaaacagatcttgagaagatccaatttctgctggctcagatggtgaaacgcactatccctcccgagctgcaagagcagttgaaaaccgttaaaactctggcaaaggaagtttggcaggagaaagcaaaggtggagaggttacaacgcattcttgagggagaaggtaatcaggaagcaggaaaggagctgaaagccggggaactcagactgcagttgggtgtactgcgcgtcaccgtggcagatatcgagaaagaacttgccgagttgcgagagagtcaagacaggggcaaggccgccatggagaattcagtgtctgaagccagtctgtaccttcaggatcagcttgataaactgcgaatgataattgaaagtatgctgactagtagctctactctactgtccatgtcaatggccccgcacaaggcccacacactggctcccggccagattgaccctgaagctacctgtccagcgtgcagtctggatgtgtcccaccaagtcagcacattagtgcgtcgatatgagcaactgcaagatatggtaaattccctcgccgtcagccgaccttctaagaaggctaagttgcagcgccaagacgaagaattgctcggaagagtccagagtgccatcctccaagtccagggggactgcgagaaactgaacatcacaacgagtaacctgattgaggatcaccggcagaaacagaaggatatagccatgctttaccagggactggaaaagctcgagaaagaaaaggccaacagggagcaccttgaaatggagatagacgtaaaggccgacaagagtgccctagctacaaaggtttcccgagttcagttcgacgccaccacagagcaactaaatcacatgatgcaagaactggtcgccaagatgagtgggcaggaacaagactggcagaagatgctggatcgattgttgacagaaatggacaacaaactccccggaattctgcgtaaagattcctctggtacaagtaagaggaaaagccagcaacctagaccccacgtgcaccgcccaccgtcactgtcctcaaacggtcagttaccatcccgcccccaaagtgcccagattagcgcaggcaatacaagtgagagatag

SEQ ID NO: 30315 - DNA, 2331 bp, Artificial Sequence
  Description of Artificial Sequence: Synthetic coding sequence
atgaacaactctctggagaatactatctcttttgaggagtatattcgcgtgaaggcaaggtctgtcccccagcaccgaatgaaggaattcctggacagcctcgcgagtaaaggccctgaagctctgcaggagttccagcagaccgctacaacaaccatggtgtatcaacaggggggcaattgcatctacacagatagcaccgaggtggctgggtccctgctcgaactggcttgtccggtgactacaagcgtgcagcctcagactcaacaagagcaacaaattcaggttcagcaaccccagcaagtacaagtacaggtccaggtgcagcagtctccccaacaggtgtccgctcagctgagcccccagctcacagtgcatcagccaaccgagcagccaattcaggttcaagtgcagattcagggccaggccccacagagcgccgctccaagcatacagacaccctcactgcagtctcccagcccgtcacagctgcaggccgcccagatccaggtgcaacacgttcaggcagcacagcagatccaagccgccgaaattccagaagaacacatcccacatcagcaaatacaagcacagttagtggctggccagagcctcgctgggggtcagcagatccagatccagaccgtgggcgctctttcgcccccaccttctcagcagggctctccccgcgaaggtgaaagacgcgtggggaccgcgagtgtgctccagcccgtcaagaaacgcaaggtggacatgcctattaccgttagttatgccatttctggtcagccagtcgcaaccgttctggcgatcccgcagggccagcagcaatcctatgtcagccttcgtcctgatcttttgaccgtcgatagtgctcatctgtacagtgctacaggaacaattactagtcctactggagagacctggacgatacctgtttattctgcccaaccacgcggcgacccacaacagcaaagtataacacatattgccattccccaagaggcttataatgccgtccacgtgagtggctcccccaccgcacttgccgccgtcaaactggaagatgacaaagaaaagatggtagggaccacatccgttgtcaagaactctcacgaggaggtcgtccaaacattggcaaacagcctgtttcccgcgcagtttatgaacggcaatattcacattcctgtggctgttcaggcagtcgccggaacataccagaataccgctcagaccgtgcatatctgggatccacaacagcaaccccagcagcagacaccacaggagcagacacccccaccacagcagcaacaacagcaactccaggttacatgttcggctcaaacagtgcaagtcgccgaagtcgagccccagagccaaccccagccctcccctgaattgctgctaccaaatagcttgaagccagaggaaggtctggaagtatggaagaactgggctcagaccaaaaacgctgagctcgaaaaggacgcccagaaccgccttgcacccatcggcaggaggcagctcctccggttccaggaggacctcattagctcagccgtggctgagttgaactatggcctgtgccttatgaccagagaagcacggaacggagaaggcgaaccttatgaccctgatgtgctctattacatcttcctgtgcattcagaaatatttgttcgagaatggaagagtagacgacattttttctgatctctactatgtgaggtttaccgaatggctccacgaggttttaaaggatgtgcaaccacgagtgacacctctgggatatgtcttaccttcacatgtcacagaagagatgctgtgggaatgtaagcaacttggcgcgcactcaccttcgactctcttgacaacattaatgttttttaacaccaagtattttctgcttaagacagtggatcaacacatgaagttggccttttccaaagtcttgcgccagaccaagaagaacccctccaatccgaaagacaagagcaccagcatccggtacctgaaggctctgggaatccaccagacaggtcagaaggttacagatgacatgtacgcggagcagactgaaaaccctgaaaaccctctgcgttgtccaatcaagctttacgacttttacctgttcaagtgtccccagtcagtcaaggggagaaatgacacattctacttgactcctgagcccgttgtggctcctaactcccccatatggtattccgtgcagcctatctcgagagaacagatgggacaaatgcttactaggatcctcgtcatccgcgagatccaggaggccatcgctgtagccaacgcatccaccatgcactag

SEQ ID NO: 30316 - DNA, 2331 bp, Artificial Sequence
  Description of Artificial Sequence: Synthetic coding sequence
atgaataatagcctggagaataccatctcattcgaagagtacatccgagttaaagcacgttcagtgccccagcacagaatgaaggaatttttagactctctcgctagtaaaggaccagaggccttgcaggagttccagcagacagctaccactaccatggtatatcagcagggcggcaactgtatctatacagactctaccgaagtggctgggagcctcctggagctggcctgccccgtaacaacctcagtccagccccaaacccagcaggagcaacaaattcaggtgcagcagccccagcaagtccaggtgcaagtgcaggtgcaacagagcccccaacaggtcagcgcgcagctgagcccacagcttacagtgcatcagcctaccgagcaaccgattcaagtccaggtccagatacagggacaggctcctcagtccgccgccccctcaatccagacgcctagtttacaatctccctcccctagccagctgcaggcggcccagatccaggtccagcacgtgcaggctgctcaacagattcaagcagctgaaattccagaagagcacattccccatcagcaaatccaggcccagcttgtggcgggacagagtctggccggcgggcaacagattcagatacaaacagtaggcgcactgagccccccccccagtcagcaagggagtccgcgggagggtgaaagaagagttgggaccgcgagcgtgctgcaacctgtgaagaaacggaaagtggatatgcccatcactgttagctatgcgatcagcggtcaacctgtagcaaccgtgcttgcgatccctcaggggcagcagcagagctatgtgtctttgagacccgatctgctgaccgtggattcagcacatttgtatagtgctaccgggaccattacctctccgacaggggaaacatggaccatcccagtctactctgcccaaccacgaggggacccccagcagcagagcattacacacattgccataccccaggaagcctacaacgcggtgcatgtgtcaggttctcccacagcactcgcagctgtgaagttggaggacgacaaggaaaaaatggttggcacgacaagcgtcgtcaagaattctcatgaagaggtggtacagacgctggctaactcattgttcccagctcaatttatgaacggcaacatacacatccccgtcgcagtgcaagcagtagctgggacctaccagaatacagcacagaccgtgcacatctgggacccccagcagcaaccccagcagcagacccctcaggagcaaaccccccccccccaacagcaacagcaacagcttcaggtgacctgttcagcccagactgtccaggttgccgaagtagagccacagtctcagccccaaccgtccccagagttactgctacctaactcactcaagcctgaagagggcctggaggtgtggaaaaactgggcccagacaaagaacgccgagcttgagaaagatgcgcagaatcgcctggcccccattgggcggcgtcagcttctcaggttccaagaggatctgatatcgagcgctgtagctgagctgaattatggactgtgtttgatgaccagagaagcaaggaacggcgaaggcgagccttatgatcccgacgtcctgtactatatctttctctgcatacagaaatacctcttcgaaaacggccgcgtggatgacatcttttccgatctgtactacgttcgctttaccgagtggttgcacgaggttctcaaagacgtccagcctagggttactcccctcggatacgtcttgccaagccacgtgactgaggaaatgttatgggagtgcaagcaattgggggcacactcaccctccaccctgttgaccacacttatgttttttaatactaaatatttcctgctcaaaactgttgaccagcatatgaagttggcatttagtaaagtgctaagacagacaaagaagaacccatccaatccaaaagataagagcaccagtattcgttacctcaaagctctcgggatccaccagaccggacagaaagtcacagacgacatgtatgcagaacagactgagaacccggagaacccactgcggtgtcctattaaactctatgatttttacctgttcaaatgcccgcagtctgtgaagggaaggaacgatactttctatcttacccctgagcccgtggtggctcccaacagccccatttggtatagtgttcagcctatttcccgagaacaaatggggcagatgctaacaagaattttggtgattcgagaaatacaggaggccatagctgtggccaatgctagtacaatgcactag

SEQ ID NO: 30317 - DNA, 2331 bp, Artificial Sequence
  Description of Artificial Sequence: Synthetic coding sequence
atgaacaactccttggaaaacactatttccttcgaagagtatatccgtgtgaaggctaggtcggtgccccagcatcgaatgaaggaatttctcgattcactggcatccaagggtccagaagctctgcaggaatttcagcaaactgctaccactaccatggtgtaccagcagggaggcaactgcatctacacagactctaccgaggtcgccggctccctgctagagctggcatgtcctgtcaccacctctgtgcagccacagacacagcaggagcagcagatccaggtgcagcaaccacagcaggtacaggttcaggttcaggttcagcaaagccctcagcaggtttctgcccagctatccccacagttaaccgtccaccagcctacagagcagcccattcaggtgcaagtccagatccagggacaggcacctcaatcggccgctccatctatacagaccccttcgcttcaatccccttcacccagtcagttgcaggcggctcagatccaagtgcaacacgtgcaagccgctcaacagattcaggcggccgaaattccagaggagcacattccacaccaacaaatacaagcccagttagtggctggccaatctctagcagggggtcagcaaattcagattcagaccgtgggtgcgttgagcccccctccaagccagcagggctctccgagagagggagaaaggagggtagggaccgccagtgtcctgcaacccgttaaaaaacgaaaggtggacatgccaatcacagtcagttacgccattagtggacagcccgtcgctactgtgctggcgattcctcaaggacagcagcagtcttacgtatctctgagaccagatctgctgactgtggactcggcacacctgtacagcgccaccggaaccatcacaagccctactggggaaacctggaccattcccgtgtacagcgcgcaacctcgcggagacccgcagcagcaaagcattacccacatcgcaattccacaggaggcatacaacgcagtacacgtgtcgggcagtcccacagcgctggcggccgtgaaactggaggacgacaaggaaaaaatggtgggtacaacctcagttgtcaaaaatagccatgaagaggtggtgcagactctggccaattcgcttttcccagcacagttcatgaatgggaacattcacatacctgtagctgtgcaggccgtggcagggacctatcagaacacagcgcagactgttcatatctgggatccccaacaacagccccaacaacagactccccaggaacagacaccccctccccagcagcaacaacagcagctccaggtgacctgcagcgcccagacagtacaggtcgccgaagtggaacctcagtcccagcctcagcccagccccgaactgcttctgcccaatagcctaaagcctgaagagggtctggaagtctggaagaattgggcccaaaccaagaacgcagagctagaaaaggacgcccaaaatcgccttgccccaattggccgacgacaactgctgaggtttcaggaggatctgatctctagtgcagtggcggagctaaactacggactatgcctgatgacgagagaagctcggaatggagagggtgagccgtacgaccccgatgtgctttactacatcttcctttgtattcagaaatacctctttgagaatggccgcgtcgacgacatcttttcagacctgtactacgtccgctttaccgaatggttgcacgaagtgcttaaagacgtgcaaccgagggtaaccccactgggctatgtgctgccctcccacgtcactgaggagatgctgtgggaatgcaagcagctgggagcccattctcctagtactcttttaacaactttaatgtttttcaatacaaagtacttcctcctgaaaacggtagatcagcacatgaaacttgcattcagcaaagttctgaggcagacaaaaaagaatccctccaaccctaaggacaaatcaacctcaattcggtacctaaaggcattgggaatacaccagaccggccagaaagtgactgatgatatgtatgcagagcagacagagaatcccgaaaatcctttaaggtgtcccattaagctttacgacttctacttgtttaagtgccctcagagcgttaaagggaggaatgacacattctacctcacaccagagccggtggtggccccaaactcgcctatctggtactctgttcagccaatctcgcgtgaacaaatggggcagatgctgacgcgaatcctggtgatccgggaaattcaggaggcaattgcagttgccaatgcaagtaccatgcattag

SEQ ID NO: 30318 - DNA, 747 bp, Artificial Sequence
  Description of Artificial Sequence: Synthetic coding sequence
atggaggatcccgagaaaaaattgaaccagaagtccgatgggaagcctaggaaggtgcgtttcaagatctccagcagctattccgggagggtcctgaagcaggtattcgaggacggccaagaactcgagtcccccaaggaggagtaccctcactcatttctccaggagtcattagaaaccatggatggggtctatgggtctggggaggtgcctcggccccagatgtgctcacccaagctgacggctcaaagaatatccgtgtttcgggagggcaacgcttataccctagctggaggtcagccccggtttaatgactacaaagctaacgaccataaacccctccccatcatcgacttcgggaagattattatttacacgaataacctgaaaataatccggacaccaatggataaacgcgacttcgtgcgtaaaatcctgcagaaggaagaagaagctgaggaggaaagcctgatgaacaaggaggagtcctacggggggagagaccagcacgatcgccctttggtggaagccgagtctacactgccacagaatagatatacccaggagggagatattcccgaagacagctgctttcactgccggggatcagggtctgctacatgtagcttatgccacggtagcaagtttagcatgctagccaatagattcaaagaatcttacagagccctcaggtgtcctgcgtgcaacgagaacgggctccagccgtgccagatttgcaaccagtag

SEQ ID NO: 30319 - DNA, 666 bp, Artificial Sequence
  Description of Artificial Sequence: Synthetic coding sequence
  Description of Combined DNA/RNA Molecule: Synthetic coding sequence
atgtttcaacagttccaagcaagctgcctggtcctttttttccttgtagggttcgcgcagcagacgctcaagccccagaatcgtaaggtagattgtaacaaaggggtgacagggactatttatgagtacggggccctaacacttaacggagaagagtatatacagttcaagcagtttgccggtaagcatgtcctgttcgtgaatgtggctgcttacugaggccttgccgcgcagtaccctgagctcaatgcgctgcaggaagagttgaagaacttcggagtgatcgtgttagcattcccttgcaaccagttcggcaagcaagaaccagggactaattcagagattttactaggtctgaagtacgtctgcccaggcagtggatttgtgccttcatttcagttatttgagaagggggatgtgaacggggaaaaggaacagaaggtgttcaccttcctgaagaacagctgcccacccactagtgatctattgggaagctcctcacagctcttctgggaacctatgaaagtccatgacatacggtggaattttgagaagttcctcgtaggcccggatggtgtgccggtcatgcactggttccaccaagcacctgttagtactgtgaaaagcgacatcctcgagtacttaaagcagtttaatacacactag

SEQ ID NO: 30320 - DNA, 216 bp, Artificial Sequence
  Description of Artificial Sequence: Synthetic coding sequence
ctcactagctttagggtcgtacacacaattccaatgatcaaaagctttttcaattacctgagccccaagcacctgaaatttcaagtcgattgtaacaagggggtgaccggtacaatatatgagtatggggcccttaccttaaacggagaggagtacattcagttcaagcagtttgccggcaaacatgttctgtttgtcaatgttgccgcctattag

SEQ ID NO: 30321 - DNA, 1590 bp, Artificial Sequence
  Description of Artificial Sequence: Synthetic coding sequence
atgtctggattgctgacagatccggaacagcgggcacaggaacctcgttaccccggctttgtgctgggactggacgtggggtcgtccgtgattagatgtcatgtgtatgacagggccgctcgagtgtgcggaagcagcgtgcaaaaagtggagaacctttacccccagataggctgggtcgagatcgacccagatgtcctgtggatccagttcgtcgccgtaattaaagaggcagtcaaagcagctggcatccaaatgaaccagatcgtgggcctgggaattagcacgcagagggcgacgtttatcacctggaataagaagacgggtaatcatttccacaactttatctcctggcaagatttaagggcagtggagttggttaagagttggaacaactctttacttatgaagatcttccactcttcatgtagggttctacacttttttacccgaagtaagagattgtttaccgcttctctctttacatttaccacacaacagacttctctgaggctcgtctggattctgcaaaatctcacagaagtccaaaaagccgtggaagaggaaaattgttgtttcgggacaatcgacacctggctgctgtataagttgaccaagggaagtgtatacgccaccgacttttcaaacgctagcactacagggctgttcgacccatataagatgtgttggagcggcatgatcacttccttaatttccattccgctctcccttctcccacctgtacgcgatacctcccataacttcggaagtgtcgacgaagaaattttcggggtacccatcccaattgtcgcccttgtcgccgaccagcaatcagctatgtttggcgagtgctgtttccagaccggggacgtgaagctcacgatgggaaccggtacatttctggatataaacaccggcaattcactgcagcagactacgggcggattttacccgctgatcgggtggaagataggccaggaggtggtgtgtttagcggagtccaatgccggggacacgggaaccgctattaagtgggcccagcagctggatctcttcaccgacgcagcagaaactgagaaaatggccaagtcgttggaggactctgagggggtatgctttgttcccagtttctccggcctgcaagccccactcaacgatccatgggcctgtgcatcctttatgggcctgaaaccatcaacatcaaaatatcatctggtgagagccatcctggaatcaatcgcctttagaaacaagcaactgtacgaaatgatgaaaaaggagatccacattcccgtccgcaagatccgtgcggatggaggggtatgcaagaacggcttcgtgatgcagatgacatcggatctcattaatgagaatatcgatcgcccagccgatattgacatgtcatgtttaggtgccgcttctcttgccggcctggccgtgggattttggaccgataaggaggagctaaaaaagctccgacagtccgaagttgtgttcaagcctcaaaagaagtgccaagaatacgaaatgagtctggaaaactgggccaaggccgtcaagaggtccatgaactggtataacaaaacctag

SEQ ID NO: 30322 - DNA, 906 bp, Artificial Sequence
  Description of Artificial Sequence: Synthetic coding sequence
atgtccggcctgctaactgatcccgagcagagagctcaagagcctcgttaccctggattcgtgctaggcctcgatgtgggctccagcgtcatcaggtgccatgtatacgatcgcgccgccagagtgtgtggcagcagtgtccagaaggtagagaatctgtacccccagattggttgggtcgagatagatcccgacgttctctggattcaatttgtggcagtcatcaaggaggccgtgaaggcggcaggcatccagatgaatcagattgttggcttagggattagtacccagcgtgctacgttcataacttggaacaagaagactggtaaccactttcacaattttatctcctggcaggacctgcgcgccgtcgaattggtgaagtcttggaataacagtcttctcatgaagatcttccactcatcttgtagggtgcttcatttctttaccaggagcaagcgcctcttcacagcgtctttgtttacttttactacccagcaaacaagcctgcggctggtgtggattttgcagaacttgactgaggttcagaaagccgtggaggaggaaaactgttgtttcggcactattgatacctggctgctctacaagcttaccaagggctctgtatacgcgacagattttagcaacgctagtacaacagggctcttcgatccctacaagatgtgttggtctgggatgattacttccctcatctctattcccctgagtctgctgcctccagtgagagatacatcacataattttggcagtgtcgatgaggaaatcttcggcgtgccaatccctattgtagccctgctgaaggtgcctggttacgaccagaatatctgctatatctttggaaagggcaccattgaacctgtgttttaccacggttctaccctgtag

SEQ ID NO: 30323 - DNA, 360 bp, Artificial Sequence
  Description of Artificial Sequence: Synthetic coding sequence
atgtccgtgacagatcaggctttcgtaaccctggcgaccgacgacatttactgccagggagccctagtactcggccaaagtttgagacgtcataggctgacacgcaaacttgtcgtcctcattacaccccaagtgagcagcttactgcgcgacatggatgaagccggtaaccatgatagcgagcaaaccatcgccggcatcgagaatcagactttacatgttctaactcatcggtgggagctgaacaatgagaatacatggacccagggcggagaacaccacaccttagagccagtggtgggcagaggagagggcggaggtatcgctctgggggacatacctaacgtcaatgatgaatag

SEQ ID NO: 30324 - DNA, 291 bp, Artificial Sequence
  Description of Artificial Sequence: Synthetic coding sequence
atgtctggtagccattctgtgacgcaggcgggtgttgaatggtacaaccacagctctttacagccacagacccccagactcaagtatcctccaacgtccgcgagccaagttgctgtaaccactgtgacagatcaggcatttgtgaccttggcaacggatgacatttactgtcagggagccctcgtccttggccagagtctgagaaggcatcggcttaccagaaaacttgtagtactgataacacctcaggtgagctcgttgctgcgggtgtctctggttgcccaggcctag

SEQ ID NO: 30325 - DNA, 195 bp, Artificial Sequence
  Description of Artificial Sequence: Synthetic coding sequence
atgtccgtgacagatcaggcatttgtaacattggctaccgatgacatttactgtcagggagctctcgtcctgggccaatcactgagacgccacaggctgaccagaaagctggtagtgctgattacgccgcaggtaagcagccttcttaggcccgccgcctcactagttttgagccgggtgtcatcccggccttag

SEQ ID NO: 30326 - DNA, 192 bp, Artificial Sequence
  Description of Artificial Sequence: Synthetic coding sequence
atgtccgtgaccgatcaggcgtttgttactctcgccaccgacgacatatactgccaaggagctctggttctggggcagtccttacggaggcaccgcctaaccagaaagctcgtggtcttgatcacaccccaggtatcctcactgttatctctctcaaaacgatgtaagatttcctcatcccacttagattag

SEQ ID NO: 30327 - DNA, 966 bp, Artificial Sequence
  Description of Artificial Sequence: Synthetic coding sequence
atgtcgccaagcccaaccgcattgttctgcctgggcctgtgtctgggcagagttccagcccagtctggaccactgccaaagccctctcttcaggcgctgccgtcctccctggtgcccctcgaaaagcccgtgaccctacggtgtcagggtccccctggagtggacctgtataggttagaaaagctgtcttccagtcggtaccaggatcaggcagttctgttcatcccagccatgaaacggtcactggcgggcagatatcgatgtagctaccagaatggcagcctgtggagcttaccatccgaccagttagagcttgttgccaccggtgttttcgcaaagccctccctgagtgctcaaccaggcccggcggtgagctctggcggtgacgtaacattgcaatgtcagactaggtatggcttcgatcaattcgcactctacaaggagggcgatcccgctccatataagaatcctgaacgttggtatagggcatccttccccattatcaccgtgacggcagcccactccgggacctataggtgttatagtttttcatcccgtgatccttatctctggtccgctcccagcgacccacttgagttggtggtgacagaatttagcgaggctaccgccgagctgactgtatcgttcacaaacgaagtgtttacgaccgaaacttcgagaagtatcaccgccagtcccaaggagtcagattcaccggccgggcccgctaggcagtactacaccaaaggcaatttggtccggatctgtctgggggcagtaatcctgatcatcttggccgggttcttggccgaggattggcacagtcgtagaaagcggttgagacacagaggccgggcggtgcagcggccactaccacctctgcctcccctgcccttaactcggaaaagcaatggcggccaggatgggggaaggcaggatgtccacagtcgtgggctctgttcctag

SEQ ID NO: 30328 - DNA, 966 bp, Artificial Sequence
  Description of Artificial Sequence: Synthetic coding sequence
atgtctcccagccccaccgccttgttctgcctcggcttgtgtttggggagggtgccagcccagtctgggcctttaccaaagccatcgctccaggcccttccatcctcacttgtgcctctggagaaaccagtgactcttcgatgccaaggcccccctggtgtagatctgtatcggttagagaagctctcctcaagcaggtatcaggaccaggctgtactctttatccctgctatgaaacggagtctcgctggtcgttataggtgctcatatcagaacgggagcctgtggtcactgccttctgaccaactggagcttgtggctacgggtgtgtttgctaaaccaagcctgtccgcccagcctggcccagccgtgtcatctggcggcgacgtgacactgcaatgccaaacccggtacggctttgatcagtttgcgctctataaggaaggtgatccggccccctacaagaatccagaaagatggtacagagcgtcctttcccatcattactgtgacagccgctcactccggaacctatcgctgctacagcttcagttctagagatccctatctgtggagtgctccgtcagatccactcgagctcgtggttaccgagttctcagaagccacagccgaattgactgtgagctttactaacgaggtatttactactgagacctcccggagtattaccgcctcgccgaaggagagcgattcccctgctgggccagctcgccagtactataccaagggcaacctggtacggatctgcctaggtgcggtcattctcattatcctggccggattcctggccgaggattggcactcccggcgcaagagactgcgccataggggccgagccgtgcagagacccttgcctccgctaccccctctgccactcacccggaaatcaaatggtggccaagacggcgggagacaggatgtgcactcacgcggcctttgttcgtag

SEQ ID NO: 30329 - DNA, 966 bp, Artificial Sequence
  Description of Artificial Sequence: Synthetic coding sequence
atgtccccgtcccccaccgctctgttctgcctagggctctgcctgggacgagttcccgcccagtccggtcccttacccaagccatctctgcaggcactgcccagctcgctcgtccccctggagaagcccgtgaccctgaggtgccagggtcctccaggtgtcgatttatatcgcctggaaaagctgtcttccagtcgttaccaggaccaggccgtgttatttattcccgccatgaagaggagtctcgcaggcaggtacaggtgcagctaccagaatgggagcctctggtctttgcccagcgaccaactcgaattggttgctaccggggtgttcgcaaagccttccctgtctgctcagcctgggccagctgtgagttccggaggcgacgtgaccctccaatgccaaacaaggtatggattcgatcagtttgcactctataaagagggcgatcccgctccttacaaaaatcccgagaggtggtacagagccagttttccaattataacagtgaccgccgcgcattccgggacgtaccgatgctattctttctccagcagggacccttatctgtggagcgcgcccagcgaccccctggagctcgtcgtgacagagttctctgaagccacagcagagctgacagtatcattcacaaatgaggtcttcacgaccgagacatcccgctcaattacagcttctccgaaggaaagtgactccccagccggcccggctaggcagtactacactaaggggaatctcgttagaatctgcctgggtgccgtgattctgatcatcctcgccggattcctggccgaagactggcacagcagacgcaagaggttgcggcaccgggggcgggccgtgcagcgaccattgccccctttaccacccctccccctcacccggaagtccaacggagggcaggatggaggtaggcaggacgtccattcacggggtttgtgcagctag

SEQ ID NO: 30330 - DNA, 966 bp, Artificial Sequence
  Description of Artificial Sequence: Synthetic coding sequence
atgtcaccgtctccgaccgcccttttttgtctgggcctctgcctcggcagagtccctgcacagtcaggtcccctccccaagcccagtctgcaggcactgccgtccagcctggtgccgctggagaagcccgtcactctccgctgtcagggtccccctggcgtcgatctgtaccgattggagaaattgagctcatctcgctaccaggatcaggcagttttgttcatacccgccatgaagcggtccctggcaggaagataccggtgctcatatcaaaacggctccctgtggtctctccccagcgaccagcttgagttagtcgcaaccggcgtgttcgccaagccgtcgctgtcagcccagcccggcccagccgtttccagtgggggtgatgtcacgctccagtgccaaaccagatacggctttgaccaatttgcactctacaaggagggcgacccggctccttataaaaatcccgagcgttggtaccgggcaagctttccgatcataacggtgaccgctgcgcactcagggacctacaggtgctattccttttcttctcgggatccatatctttggtcagcaccctctgatccgctggaactagttgtgacagagttctctgaggccacagcagagctaaccgtctctttcacgaacgaagtgttcaccaccgagactagccgctcaatcaccgctagccctaaagagagcgattcacccgcaggacccgctagacagtattatactaaaggcaatctagtgcgaatttgcctcggtgccgtcattctgatcatcctggctgggtttctagctgaggactggcattccaggcgtaaaagactgcgccaccgaggccgggcagtgcaaaggccactgccaccactccctcccctgcccttaacccggaagagcaacggaggacaggacggaggaaggcaggatgtgcactctcgcggactatgtagctag

SEQ ID NO: 30331 - DNA, 966 bp, Artificial Sequence
  Description of Artificial Sequence: Synthetic coding sequence
atgtctcccagtcccacagcgctgttttgccttggcctgtgcttgggaagggtccccgctcaaagcggccccttacccaagccttccctgcaagccctcccatcatcattggtgccactggagaagcctgttacccttcgttgtcagggcccacctggagtagacctataccggctcgagaaactgtcctcctcaaggtatcaggaccaggctgtgctctttatccccgcgatgaagcgcagcctggccggacgatatcgctgctcataccagaatggatccttatggtcactgccttcagaccagctagagctggtagctaccggtgtgttcgccaagcccagcctgtctgcgcagcctgggccagctgtctctagtgggggagatgtgacactacagtgtcagacaagatacggatttgatcagttcgccctttataaggaaggggaccctgcaccatacaagaatccagaaagatggtacagggcatccttcccgatcattacagtgacagcagcccactctggaacatacaggtgctattccttcagttcacgagacccatacttgtggagcgcaccaagtgatccacttgaactggtggtgactgaattcagcgaagctacagcggaattgaccgtgtcgtttacaaatgaggtgttcacgaccgaaacttcccgttctattactgcaagccctaaggaaagtgactcacctgccgggcctgcgcgccagtactatacaaagggaaatctagtgagaatctgcttgggagcggtaatactgatcattctagctggattcctggccgaggattggcattcccggcgaaagagactgaggcacaggggacgcgcggtccagaggcctcttccgccgctccctcccctgcctctcacaaggaagtctaatggcggccaagacggcggcagacaagacgtccattccagaggtctctgttcctag

SEQ ID NO: 30332 - DNA, 966 bp, Artificial Sequence
  Description of Artificial Sequence: Synthetic coding sequence
atgtctccgtctccaacagccttgttctgtctgggtttatgtctggggagggtacccgctcaatcagggccgctgcccaagccaagcttgcaagcactgcctagcagcctcgtaccactagagaagccagtgacactgcgctgccagggcccccctggggtcgatttgtaccgacttgaaaaactgtcaagttcacgctatcaggaccaggctgtgctgtttatacccgccatgaagcggagcctcgcaggaagataccgatgctcctaccaaaacgggagtttgtggtctctcccaagcgaccagctggaactggtggctacaggggtgtttgctaaaccatctctgtcagcgcagcccggacccgctgttagtagcggaggggacgttactctgcagtgtcagactcggtatggctttgatcagttcgcactttacaaggaaggggaccctgcgccgtacaaaaaccccgagcggtggtacagagcatcattccccataataactgtgacagctgcacattccggcacctaccggtgttactcattttctagcagggatccctatctctggtcagcaccctccgatccacttgagctggtagtgaccgagtttagcgaggcgactgccgaattgacggtatcattcaccaacgaagtctttacaacggagacatccaggtcaatcaccgcctcccctaaagagtccgactcaccggctggccccgctcggcagtattatacaaaaggcaatctcgtccggatttgcctcggcgccgtgatcctgatcatccttgctggctttctggccgaagactggcatagccggagaaaaaggttgagacataggggtcgcgcagttcagcggccactgcctcccctgccccccctgcccctgacaagaaagtccaacggaggccaggacgggggcaggcaggatgtccattcgcggggcctttgttcttag

SEQ ID NO: 30333 - DNA, 966 bp, Artificial Sequence
  Description of Artificial Sequence: Synthetic coding sequence
atgtccccaagccccaccgctctattctgcctgggcctgtgcctcgggcgggtccctgcccaatctggacctctgcctaagcctagcctacaagcccttccttcctccctagtgcccctggaaaagcctgtgaccctccgctgtcaggggccccctggagtggatctgtatcgcctggagaaactgtccagcagccggtaccaggaccaggccgtgctgttcatcccggcaatgaaacggagcctggcaggacggtatcgatgcagttaccaaaatggttccctgtggtctctgccgagtgaccaactggagctagttgctaccggagtattcgccaaaccttccctcagcgcccagccaggacccgccgtgagctctggcggcgacgtcaccttgcaatgccagactaggtacggtttcgaccaattcgcactgtacaaggaaggggatcccgctccgtacaaaaacccagagcgctggtacagggccagctttcccataattaccgtgacggcagcgcattccggcacataccgatgttactctttcagttcccgggatccctacctgtggtctgcaccctccgatcctcttgagttggtggtaacggaattttcggaggctacagcggaactgacggtttcctttaccaatgaggttttcactacggaaacatcacgctctataacggccagccccaaggagtcagacagtccggcgggtcccgctcggcagtattacactaaggggaaccttgttaggatatgtctcggcgctgttatattgatcattctggccggctttctggccgaagattggcacagtcggagaaagagactgcgccatcgggggagagctgtccagaggcctttacccccccttccccccctcccacttactagaaaaagcaatggaggccaggatggaggacgtcaggatgtacactctcgcggattgtgtagttag

SEQ ID NO: 30334 - DNA, 966 bp, Artificial Sequence
  Description of Artificial Sequence: Synthetic coding sequence
atgagccctagccctaccgcactattttgcctggggctttgcctggggcgcgtgccggcgcagagcggaccgctgcccaagccctcgctccaagccctccccagctctctcgtccctctggaaaagcccgtgaccttaaggtgtcagggaccacccggcgtagacctctacagactcgagaagttgtcttctagccggtatcaagatcaggccgtgctcttcattccagccatgaaaagatctcttgccggaaggtatagatgtagctatcagaatgggtctctatggagcttaccttccgatcagctggaactggtagctaccggcgtgttcgccaaacctagcctgtccgcacagcccgggcctgcagtgagctctggcggggacgtcaccttgcagtgccagactcgctatggattcgatcaattcgctctctataaagagggagacccagctccctacaagaacccggagcgctggtaccgtgcgtcgttccccatcatcactgttaccgccgcccacagcgggacttatagatgctattcattcagcagtagagatccatacctttggagtgctccatccgatccactcgaactagtggttactgaattttcggaggcaactgcagagctgaccgtatcctttaccaatgaagtattcacaacggagacctctcgtagtattactgcgagccctaaggaaagcgactcacccgcaggcccagcccggcagtactacactaagggaaacctcgtgcgtatttgcctgggagccgtgattctgattatccttgccggcttcctggccgaagattggcatagtcggagaaagcggctcaggcaccggggccgcgcggtgcagcggcccctccctccattaccacccctgccattgacaaggaaatccaatggaggccaagacggagggcgccaggacgttcattcccgcgggctgtgcagctag

SEQ ID NO: 30335 - DNA, 1116 bp, Artificial Sequence
  Description of Artificial Sequence: Synthetic coding sequence
atgagcttccggaaagtcaacatcataatccttgtcctggccgtcgccctttttttactggtgctccatcataatttcctgtccctaagtagcctgctgcgaaacgaggttactgactcagggattgtcggacctcaaccaatagactttgtgccaaatgccttgcggcatgcggttgatggccgccaggaagagattccagtagtgatcgcagcatccgaagaccgattgggaggagctattgccgctataaattctatacagcacaatactcgctccaatgtgatcttctacattgtgacgctgaacaacaccgccgaccatctccggtcctggttgaattcagacagcctgaagagcatccgctacaagattgtgaatttcgaccctaaactcctggaaggcaaagtaaaggaggatcctgatcagggggaatcaatgaagccactcacgttcgcaagattttacctgccaatactggttccatcggcaaaaaaggcgatttacatggatgacgacgtaatagtgcagggagatatcctcgccctgtacaataccgcacttaagcccggccatgccgctgcctttagcgaagactgtgactccgcatctacaaaagttgtcatacgcggtgccggaaaccagtacaactatatcggatatttggactacaaaaaagaaaggatcagaaaactgtccatgaaggcaagcacctgcagcttcaatccaggcgtcttcgttgcaaatttgaccgaatggaagcggcaaaatatcacaaaccagctcgaaaagtggatgaagctgaatgtagaggaagggctgtactcacgcacacttgcaggctcgatcacaaccccccctctcctcatagtattctatcagcaacactccaccatcgacccgatgtggaatgtgcgccatcttgggagttctgcggggaagagatacagtccccagtttgtgaaagcagcaaagttgctccattggaacggtcacctcaaaccgtggggcagaactgcttcatataccgatgtctgggagaaatggtacatcccagatcctacaggcaagtttaacctcataagacggtatactgagatctccaacattaaatag

SEQ ID NO: 30336 - DNA, 1116 bp, Artificial Sequence
  Description of Artificial Sequence: Synthetic coding sequence
atgtcctttcggaaagtgaatattattattctggtgctggcagtggcactcttccttctggtgctgcatcataatttcctgagtctgagcagcttactaagaaatgaggtcacggatagcgggatagtgggccctcagccaattgatttcgtacccaatgctctcaggcatgccgtggatggcaggcaagaagagatccctgtagttattgcagcctctgaggaccgcctgggcggcgccatcgccgcaattaatagcattcagcataataccaggagtaatgtgattttctatatcgtaacgctgaataacactgctgaccacctgcggtcctggcttaactctgactctctgaaaagcatcaggtacaaaatcgtgaattttgatcccaagttgttagaaggaaaggtgaaagaagatccagaccaaggagaaagcatgaagccacttacctttgccagattctaccttcctatactggtgccctctgccaaaaaagccatttatatggacgatgatgtcatcgtgcagggtgacatactggcactgtacaatactgccctgaagcccggccatgccgccgcgttttctgaagattgtgattctgcgagtactaaagttgtgatcagaggtgccggcaatcaatacaactacattggatacctggattataagaaagagcgaattcgcaaactctctatgaaagcttcaacctgtagttttaaccctggagtattcgtggctaatctcactgagtggaaacggcaaaatattacaaatcaattagaaaagtggatgaagctgaacgtcgaggaggggctctactctaggacccttgcaggcagcataaccactccacccttacttatcgtattttaccagcaacatagtactatcgaccccatgtggaacgtccggcatctggggtcttcggcaggcaagcgctactcaccacagtttgtgaaagcagccaagctgttgcattggaatgggcatctcaagccatgggggagaactgcttcttacactgatgtgtgggagaagtggtacatccccgaccctacaggaaagttcaatttaatacgacgttatacagagatctcaaatatcaaatag

SEQ ID NO: 30337 - DNA, 681 bp, Artificial Sequence
  Description of Artificial Sequence: Synthetic coding sequence
atggacgacgacgtaatagtccagggagatatcctggctctgtacaatacggcactaaagcctggccacgccgctgcattcagcgaagattgcgactctgcgtcgactaaggtcgtgattcgcggtgccggcaatcaatataactacattggctacctggactataagaaagagagaattcggaagctgagcatgaaggcttctacctgttcctttaacccgggcgttttcgtagccaacctgacagagtggaagaggcagaatattacaaaccagttggagaaatggatgaaattgaacgtggaagaagggttatactctcgcactcttgctggttcaattaccaccccacccctgctgatcgttttctaccagcagcacagcaccatcgatcccatgtggaatccaccgccatggttccagtgttggaagaccatctttacgtctgtgtgcaagggttgccaggtcacccattggaatggacacctgaagccctgggggaggacagcctcttacacctgtctcggcaagatggtctactccagacctaatagacagatccagcctaatccaaaaatttacagagatttaaagcataaggtaaagcaaaatctgaactgtaagcaagctttcctgcgcaagagctggaaaattgcatgtgtcggatccaatagctgctag

SEQ ID NO: 30338 - DNA, 1116 bp, Artificial Sequence
  Description of Artificial Sequence: Synthetic coding sequence
atgtctttccgaaaggttaacatcatcatcttggtgctggccgtcgcgctcttcttgcttgtactgcaccataattttctaagtctgtcttcacttttgcgtaacgaggtgaccgattccggtatagtaggccctcagcccatcgacttcgtacccaatgcattgagacacgccgtagacggacgccaggaggagatccctgtggtcattgctgcctctgaggaccgcctgggaggtgccatcgctgcgatcaacagcatccagcacaatacccggtctaatgtgatcttctatattgtaaccctcaataacaccgcagatcacctaagaagttggcttaactcagatagtctaaaaagtatccgctacaagatcgtcaacttcgacccaaaactccttgagggaaaggtgaaggaagatccagatcagggtgaatccatgaagccacttacttttgccagattctatctgcccattttggtgcctagtgcaaaaaaggcaatctacatggacgacgatgtgatagtgcagggcgatattctcgccttatataacacggcccttaagccggggcacgccgcggccttttcagaggactgcgatagcgcaagcactaaggtcgtcatcaggggcgcaggaaaccagtacaactatattggatacttggactataaaaaggagcgcatccgaaaactgagcatgaaagcttctacgtgcagcttcaaccccggcgtcttcgttgctaatctgaccgaatggaaaaggcagaacatcacaaatcagcttgagaagtggatgaagctaaacgtggaagaaggcctgtatagcaggaccttggccggatctattacaacacctccccttctcattgttttctatcagcaacactcgactatagacccaatgtggaacgtgcgacaccttggatcctcagctgggaagaggtatagcccccagttcgtgaaagccgcaaagctcttgcattggaatggccatcttaaaccctggggaagaacagctagttacactgatgtttgggagaagtggtatattccagatcctacagggaagttcaacctaatacggaggtatacagagatttcgaacatcaagtag

SEQ ID NO: 30339 - DNA, 93 bp, Artificial Sequence
  Description of Artificial Sequence: Synthetic coding sequence
atgtctttcagaaaggtcaatatcataatcctggtcttggcagtggcattattcttgctcgttctccaccacaacttcttgagcctctcgtag

SEQ ID NO: 30340 - DNA, 1116 bp, Artificial Sequence
  Description of Artificial Sequence: Synthetic coding sequence
atgtcatttcgtaaagtgaacatcattattctggtcttagctgtcgccttgttcctccttgtcctgcaccataattttctgtcacttagtagtctgcttaggaatgaggtgacagattccggaatcgtgggcccccaaccaatcgactttgttcctaatgcactgcggcacgcagttgatgggcggcaggaagagatacccgtggtcatcgccgcctcagaggaccgtttggggggcgcaatcgcagcaattaatagcattcagcataacacccgctcaaatgtaatcttctatatcgtcacactaaataatacagctgatcatcttagaagctggttgaatagcgacagcttgaaaagtatacgttacaagatagtgaacttcgatccgaaactgctagaaggcaaagtcaaggaagacccagaccaaggtgaatcaatgaagccactaacctttgcccgcttctacctgcccatattggtgccgagcgcaaaaaaggcaatttatatggacgatgacgtcattgtgcagggggacatccttgctctgtataacaccgctctcaagccgggacacgccgccgctttcagcgaggactgtgacagcgcaagtacaaaggtggtgattcgcggagctggcaaccagtacaactacataggctacctggactacaaaaaggaacggatccggaaactgtcaatgaaggcctctacctgtagcttcaaccccggcgtgttcgtagctaacttaactgagtggaagcggcaaaacattactaaccaactcgagaagtggatgaaactgaacgttgaagagggactttactctcggacgctggctgggagtataacaacccctcctctgctcattgtattttaccagcagcatagtactatcgaccctatgtggaacgttcgacacctgggctcgtcagccggaaagcgttatagccctcagtttgttaaggcagccaagctgttacattggaacggacatttgaaaccttggggaagaacggcctcttacacagacgtgtgggagaagtggtacattcccgatcccacaggaaagttcaatctgattaggagatacaccgaaatctccaacatcaaatag

SEQ ID NO: 30341 - DNA, 525 bp, Artificial Sequence
  Description of Artificial Sequence: Synthetic coding sequence
atgagctttcggaaggtgaatataattatcttggttttagcagtcgccctgttcctgcttgtgctacatcacaacttcctgtccctgtccagtctcttacggaacgaggtgacggacagcgggatcgtggggccccagcccattgacttcgtaccaaacgcgctgcggcacgccgttgatggccggcaggaggaaataccagtggttattgccgccagtgaggatcggctcgggggcgcaattgcagccatcaattctatccagcataatacgaggtccaatgtcatattttatattgtcactcttaacaacacggccgaccacctgcgatcctggctgaacagtgactcgctgaaatcaattcggtacaaaattgtgaatttcgacccaaagctgttagaagggaaggttaaggaggaccccgaccagggggagtccatgaagccgctgaccttcgcacgattttacctccctattctggtgccatctgcaaaaaaagccatctatatggacgatgatgtgtag

SEQ ID NO: 30342 - DNA, 189 bp, Artificial Sequence
  Description of Artificial Sequence: Synthetic coding sequence
atgtcttttcggaaagttaacatcattatcttggtgctcgctgtggcgctcttcctgctggtgctccatcacaacttcctctccttatcatcactgcttcgaaatgaggtcacagattcagggattgtgggaccgcagccaatagattttgtaccgaacgccctgagacatgctgtggatggaaggtag

SEQ ID NO: 30343 - DNA, 333 bp, Artificial Sequence
  Description of Artificial Sequence: Synthetic coding sequence
atgtcatttcgaaaggtcaacatcattatcctggtgttggccgtcgcgttgtttctcttggtgctgcaccataatttcctgtcactcagctcccttctaagaaatgaagtgacggatagcggcattgttggccctcagccgatcgacttcgtcccgaacgcgctgagacacgcagttgacggccgccaggaagaaatcccagtggtcattgcggcatctgaggaccgccttggcggcgcgattgctgctatcaattctattcagcacaatacaaggtccaacgtaatcttttacattgttacacttaataacacagcagaccacctgcgctag

SEQ ID NO: 30344 - DNA, 1116 bp, Artificial Sequence
  Description of Artificial Sequence: Synthetic coding sequence
atgagtttcaggaaggtaaacattatcatactggtcttagcagtggccctgttcttgctcgttttgcatcataattttctttctctgtccagtctcctgagaaatgaagttaccgacagcggaatcgtcggccctcaaccaatcgacttcgtcccaaacgccttgcgacacgccgtcgacgggcgtcaggaggagatccccgtcgtgatcgctgcgagcgaagataggctgggtggtgctattgcagccatcaactccatacaacacaatacacgatctaatgtcatcttttacattgtgacgcttaataacacggctgatcacctgagatcttggctcaacagtgacagcctgaagtctatcaggtacaaaatcgtcaattttgaccctaaactccttgaagggaaggttaaggaggatcccgaccagggggaatcaatgaagccgctgacctttgctaggttttacctccctatcctcgtacctagcgccaagaaggcgatttacatggatgacgatgtcattgtacagggtgacatcttggccctttataacacagccctaaagcccggacatgcagctgccttttcggaggactgtgacagcgcttctactaaggtagttattcggggcgccgggaatcagtacaattacatcgggtacttggactacaagaaggagagaatcagaaaactctccatgaaagcaagcacctgttcgtttaatcccggcgtgttcgtggcgaatctgactgagtggaaacgccaaaacattaccaaccagctcgaaaaatggatgaagctgaacgtcgaggagggcctgtattctaggacgttggctgggagtatcactacccccccactgctcatcgtcttttaccagcaacacagtacaattgacccaatgtggaacgtgcgccacttgggcagttccgccggcaagagatatagtcctcagttcgtcaaggccgccaaacttctgcactggaacggccatctcaagccatggggccgaacagcttcgtacacagatgtatgggaaaaatggtatatccccgatcccactggcaagtttaatctgattagaagatacacagagatcagcaatatcaagtag

SEQ ID NO: 30345 - DNA, 270 bp, Artificial Sequence
  Description of Artificial Sequence: Synthetic coding sequence
atgtcttttcgtaaggttaacataattatactggttttagctgtagccctttttttgctggtcctgcaccacaacttcctgtctctgtctagcctgctcagaaatgaggttacagattcaggaattgttggccctcaacccattgatttcgtcccgaatgccctcagacatgcagtggatgggaggcaagaagagattcctgtggtgatagcagccagcgaagatagactgggaggggcgattgccgccatcaattccatccaacactag

SEQ ID NO: 30346 - DNA, 192 bp, Artificial Sequence
  Description of Artificial Sequence: Synthetic coding sequence
atgtctttcagaaaggtgaatatcatcattctggtccttgctgtggccctgtttctactcgttcttcaccacaatttcctaagcttatcttctttacttcgaaacgaggtgaccgactctggcattgtgggacctcagcccatcgatttcgtgcctaatgcgctacgtcacgccgtggatggacgccagtag

SEQ ID NO: 30347 - DNA, 483 bp, Artificial Sequence
  Description of Artificial Sequence: Synthetic coding sequence
atgttaaggcacctgccgtccaggctacccgttaaaatgtggggccggacgctggaaaagcagagctggagggactcttcgcagacccccccgccgtgcttgatcagacgcttggatcacatcgtgatgaccgtgaagagcattaaagataccacaatgttttattctaagattctgggaatggaggttatgaccttcaaggaggatcggaaagccctttgcttcggagaccagaagttcaatctgcacgaagttggcaaagaattcgagcccaaagccgcccatcctgtcccagggtctctggacatttgcctcatcacagaggtgccactagaggagatgatccagcatcttaaggcctgtgacgtgcctatcgaagaagggccagttccacggactggcgcgaagggacctataatgtcgatctatttccgggaccctgaccggaacctgattgaggtttcaaactacattagctcttag

SEQ ID NO: 30348 - DNA, 384 bp, Artificial Sequence
  Description of Artificial Sequence: Synthetic coding sequence
tgaataaggcggctcgatcacatagtgatgacggtgaagagcataaaggacactactatgttttacagcaagatcctgggcatggaggtgatgacctttaaggaggataggaaagccctgtgctttggcgaccagaagttcaatctgcacgaagtcggcaaagaattcgaaccgaaggcggcgcatccggttcccggtagcctcgacatttgcctaatcaccgaagtgccactggaggagatgattcagcacctgaaggcttgcgacgtcccaatcgaggagggccctgtgccacggacaggggccaaggggcctatcatgtcaatttactttagagacccggatcggaacctcatagaagtctccaattatatatccagctag

SEQ ID NO: 30349 - DNA, 2082 bp, Artificial Sequence
  Description of Artificial Sequence: Synthetic coding sequence
atgtggcctcagccatatctgcctccccaccccatgatgctggaagagtctaggcagaataagctggccgcagctaaaaagaaactgaaagagtatcagcaacgaaagtctccaggcatacccgccggggcaaaaaccaagaagaagaagactgacagcagccctgaaaccactaccagcggaggatgccacagccctggcgactcacagtatcaggagctagcagtagcgttggaaagtagctctgtcacaattagccagctgaatgaaaatatcgagtctctcaagcaacagaagaaacaggtggaacaccagcttgaggaagccaagaagacaaataacgaaatccacaaagcccaaatggagagactggagaccattaacatcctgacgctggagaaggccgacctcaagacaacattgtatcatacgaagcgcgccgcacgccactttgaagaagagtctaaagatctcgctggccgcctgcaatattccctgcaacggattcaagaacttgagagggctctgtgtgccgtttcaactcagcaacaagaggaagataggagtagctcttgccgagaggcagtactgcagaggtggcttcaacagaccatcaaggaacgcgctctgctgaatgcgcacgtgacccaagtgacggaatccttgaagcaggtgcagttagagcgggatgagtacgccaagcatatcaagggagaacgcgcgcggtggcaggaacgtatgtggaagatgtccgtcgaagctaggacattgaaagaagaaaagaaaagggacatccaccgcatccaggagctcgaaaggtctctctctgagctaaagaatcagatggcagagcctccgtccctcgcgccacccgcggtaacatcagtagtggagcaactacaagacgaagccaaacacctgcggcaggaggtggaggggctcgaaggcaaattacagtcacaggtcgaaaacaatcaggccctttcacttctcagtaaagagcagaaacagagactgcaggaacaggaagagatgctgagagagcaggaagcacaacgcgttcgcgaacaagagcgcctgtgtgagcagaacgagaggctgcgggagcagcagaagactctgcaggagcagggggagcggttacgaaaacaggaacagcggctccgaaaacaggaggagaggctacgcaaggaggaagagcgactccagaagcaggaaaagaggctctgggaccaggaggaaagattgtggaagaaggaggagcgcctgcagaagcaagaagaaagattggcactgtcacagaaccataaactcgacaagcaacttgcggagcctcagtgttcctttgaggacctaaacaacgagaaaaagagcgctcttcagcttgaacagcaggttaaagagctgcaagaaaaacttgacgaagaacatctggaggccgcaagccaccagaatcaacagctcgaaactcagttgagcctagtggctctccccggggaaggggatggcgggcagcacctggattccgaggaggaggaagccccacggccgactcccaacatccccgaggatctggagagtcgcgaagctacctcatctttcatggatctaccaaaagaaaaggcagatggcaccgagcaggttgaaagacgtgaactaggctttgtccagccctccggcgtgacagacgggatgcgcgaatcctttactgtatatgagtcccagggagcagtgcctaacacacgtcaccaggagatggaggacgtgatccggctggctcaaaaggaagaggagatgaaagtcaaacttctggaactgcaagagttggttctcccccttgtaggaaaccacgagggacatggaaaattcttaattgctgcacagaatcctgcggatgaacctacccctggggctcctgctccccaagaactgggggctgccggggagcaggacgttttctatgaagtctctcttgacaacaatgtcgaacctgcaccaggcgccgcgcgcgaggggtcaccacacgacaaccccactgtgcagcagatcgttcagctgagtccagttatgcaggatacatag

SEQ ID NO: 30350 - DNA, 2082 bp, Artificial Sequence
  Description of Artificial Sequence: Synthetic coding sequence
atgtggccacagccttacttgccgccacacccgatgatgctggaagagtctcgccagaataagctggccgccgcaaagaagaagctgaaggaataccagcagaggaagtcccccggcattccagcgggggcgaaaactaagaaaaagaaaactgatagttcacccgagaccactactagtgggggaggccattcccccggagatagtcaatatcaggaactagctgttgccctggaatcttccagtgttaccatttcccagttgaacgaaaacatcgagtccttgaaacaacaaaagaagcaggtcgagcatcagcttgaggaggctaaaaaaacgaacaacgagattcacaaggcccaaatggagagactggagactattaacattcttacactggaaaaagccgatctcaaaactaccttatatcacactaaaagagctgcaagacactttgaagaagagtcaaaggacctagccggtagactgcagtactcgctccaaaggattcaggagctggaaagggccctgtgcgctgtgagcacccagcaacaggaggaagataggagtagctcctgccgcgaggcggtgctgcaccgccgactgcagcagacaatcaaagaacgtgccctgctgaacgctcacgtaactcaggtcacagagagcctgaagcaagtgcagctcgaaagggacgagtatgctaaacacatcaagggggaacgggcccggtggcaggaaagaatgtggaagatgtcagtcgaagcaaggactctgaaagaggagaagaaacgcgacattcaccggattcaggaactcgaacggtccctgtctgaactaaagaaccagatggcgaagcccccatcactggccccaccagccgtgacctccgtcgttgaacaactccaggatgaggccaaacatctccggcaggaagtggagggccttgaaggcaaattgcagagccaggtggaaaacaaccaggccctgagcctgctgtctaaggagcagaaacaacgcctgcaagaacaggaagagatgctgagggaacaggaagtccagcgagtccgcgagcaggaaaggttatgcgaacagaacgagcgactacgagaacaacaaaagactttgcaggaacagggcgagagattgagaaagcaagagcaacgcttgaggaagcaagaagaacggctgagaaaagaggaggaacgtttgcagaagcaggaaaagcggctctgggatcaggaagaaaggctgtggaagaaagaagagaggctgcaaaagcaggaagagcggttagcactgagccagaaccataagttagacaaacagttagccgaaccccagtgctcctttgaggatctgaataatgaaaaaaagtcagcattgcagcttgagcagcaggtgaaggagcttcaagaaaaactcgatgaagaacatcttgaggcggcctctcagcaaaaccagcagctggagactcagctgtcactagtcgccctcccaggagaaggcgacggaggtcagcatctagacagcgaagaggaagaagcgcccagaccaacaccaaatatccctgaagatcttgaaagtagagaggctacatctagtttcatggatctgccgaaggaaaaggcggacgggaccgagcaggtggagcggagagagttgggatttgtccaaccctccggcgtgaccgacggcatgcgcgagtcatttaccgtgtacgagtcacagggggctgtgcctaacacacgccatcaggaaatggaagatgttatcaggctggcccagaaagaagaagagatgaaagtgaaactactggagctccaggagcttgtattgccgctcgtagggaaccacgaggggcacggcaaattcttgattgccgcacagaatcccgccgatgaacccacaccaggggcacccgcacctcaggaactaggggcagccggcgagcaggatgacttctacgaggtaagcctcgacaataacgtcgagcctgcccccggcgctgctcgggaggggtctcctcacgataaccctaccgtgcagcagatcgtgcagctcagcccagttatgcaggatacttag

SEQ ID NO: 30351 - DNA, 2082 bp, Artificial Sequence
  Description of Artificial Sequence: Synthetic coding sequence
atgtggcctcaaccctacttgcccccccaccccatgatgctggaggaatctaggcagaacaaactggccgcagcaaaaaagaaactgaaagagtaccagcagaggaagagccccggtatcccggccggcgccaaaaccaagaagaagaaaaccgatagtagccccgaaaccacaacgtcaggaggagggcacagtccaggtgactctcaatatcaggaactggctgtggcactggagtcatcttccgtcacaattaaccagttgaatgagaatatcgagagtctgaaacagcagaaaaaacaggtggaacatcagctggaagaagctaaaaagaccaacaatgaaatccacaaggcccagatggagcagctggagacgatcaacatcttaacactggagaaagccgacctcaagactaccctgtaccacactaaacgcgctgcgcggcacttcgaagaggaatccaaggacctggccggcaggctgcaatactctctccagaggatccaggaactggagagagcattgagcgccgtctctacccaacaacaggaggaggatcgttcttcgtcctgtagggaagcagtgctacagagacgccttcagcagacgatcaaagaacgcgcattgctcaacgctcatgtcacacaggtgaccgaatctctgaaacaggtgcaacttgaaagagacgagtacgccaaacacattaagggagagcgggcccgctggcaggaacgcatgtggaaaatgtccgtggaagctcgtacgctcaaggaagagaagaagcgggatatccacagaatccaagagctggaaagatctttgtctgaactgaagaaccagatggcagagccacccagtctcgcgcctccagccgtcacctctgtggtggaacagctgcaggatgaggcaaaacatctcagacaggaagtagaaggcctcgagggtaagttacaatcacaggtagagaacaatcaagccctgagtcttctgtcaaaagagcagaagcagagacttcaggagcaagaagagatgctccgtgagcaggaagcgcagagagtgagggagcaagagcgcttatgcgagcagaatgaacggctgagggaacaacagaaaaccctgcaggaacagggcgagaggctgaggaaacaggaacagcgattgaggaaacaggaggagagactgaggaaggaggaggagcgcctgcagaaacaggaaaagcggctctgggaccaggaggaacgcttgtggaagaaggaggagagactgcagaaacaggaagaaagactcgccctgtctcaaaaccataaactggacaagcaactggcagagcctcagtgctcttttgaagatcttaacaacgagaagaagagtgcattacaactagagcagcaggtgaaggagctccaggaaaagctcgatgaagaacacctagaagcagcatctcagagaaaccagcagctcgagacacagcttagcctggtggctctgcctggagaaggagacggcggtcagcacctggattctgaggaggaagaggcgccacgtcccacgccaaacattcctgaggatcttgaaagccgcgaggcaacttcaagctttatggatctgccaaaggagaaggccgacggaactgagcaagtcgagagacgcgaattaggtttcgttcagcccagtggggttaccgatggaatgcgcgaaagcttcacagtgtatgaaagccaaggggctgtgcctaatacacgacaccaggaaatggaagatgttatcagactcgcacagaaagaggaagagatgaaagttaagttactggagctgcaggagttagtgctgccactggtcggcaatcacgagggccacgggaagttccttatcgctgcccagaatccagccgacgaacccacacctggggcacctgccccccaggagctgggtgccgccggagaacaagacgatttctacgaggtgtctttagacaacaatgttgagcccgcacccggggccgcgcgggaggggtcgccacacgacaacccccctgtacagcagatagtgcagctgagtcccgtgatgcaggatacatag

SEQ ID NO: 30352 - DNA, 2082 bp, Artificial Sequence
  Description of Artificial Sequence: Synthetic coding sequence
atgtggcctcagccctacctgccaccacaccccatgatgctggaggaaagcaggcagaataagcttgccgcagctaagaaaaaacttaaagagtaccaacagaggaagtctccaggaatccctgcgggcgcaaaaaccaagaagaaaaagacagactcgtctcccgaaactaccaccagcggaggcggacacagtccaggggacagccagtaccaggaactggccgtggctctagagtcatcatcagtgactattaatcagctcaatgagaacatagaatccctcaagcagcaaaagaagcaagttgagcaccagctggaggaagctaaaaaaactaataatgagattcataaggcgcagatggaacagctggagacgattaacatcctgaccttggaaaaggctgacttaaagacaactctgtatcataccaagcgcgcagcaaggcatttcgaagaggagtcaaaagatcttgctggacgtcttcagtactctctgcagcacatccaagagctcgagagagcgctctgtgcagttagtacccagcaacaggaggaggaccgcagttcttcatgcagagaggccgtgctgcaacgccgactgcagcagaccatcaaggaaagggccctgctgaacgcccatgtgacacaagtaacagaaagtctgaagcaggtccaactggaaagagatgagtatgcgaaacatatcaagggcgaacgcgctcgatggcaagagagaatgtggaagatgtctgtggaagcccgaaccttaaaggaagagaaaaagcgggatatccataggattcaggagctggagaggtcactcagcgaattgaaaaaccagatggccgagccccctagcttggcacccccggcggtcacgtcagtggtcgagcaattgcaggacgaagccaaacacctaaggcaagaggtggaaggcctagaagggaagctccagtctcaggtggagaataaccaggctctcagccttctctccaaggaacaaaagcagagactacaggagcaagaagaaatgctgcgggagcaagaggcacagcgggttcgggaacaagagcgactgtgtgagcagaatgaacgactgagagagcagcagaaaactctgcaggaacagggagaacgccttcgcaaacaggaacagcggttaagaaagcaggaggagaggctccgaaaagaggaggaacgccttcagaaacaggagaagcgtctgtgggaccaggaagagcggttgtggaagaaggaagagcgtcttcagaaacaagaggagagactggctctgtcacaaaatcacaagttggataagcagttggcggagccccagtgtagctttgaggacctgaataatgaaaagaagtcggcccttcaactcgaacaacaggtgaaagagctccaggagaaactagacgaagagcacctcgaggccgcctcccaacgaaatcagcagctggaaacccagctgagtctggtagccctgcccggggagggcgacggaggccagcacctagatagcgaagaagaggaggcacctcggccgaccccgaacatccctgaagacttggagagccgagaagctactagcagttttatggacctgcccaaagagaaggcagatgggacagagcaagtcgagagaagagagttggggttcgtacagccgtcaggagtgactgatgggatgagagagagcttcacggtttatgagagccagggcgcggtgccgaatactcggcaccaggagatggaggacgttatccggctggctcagaaggaggaggaaatgaaagtcaagctccttgagctgcaggaattggtgctgcctctggtgggaaatcacgaaggccatggtaaatttctgatcgcagctcagaacccagctgacgagcctaccccaggagctccggccccccaagaactcggagcagccggggaacaggatgttttttacgaggtcagcttggacaacaatgtagagccggctcccggcgtcgctagagaggggtcccctcataataaccccaccgtccagcaaatagtacaactgtcaccggtcatgcaagacacatag

SEQ ID NO: 30353 - DNA, 2007 bp, Artificial Sequence
  Description of Artificial Sequence: Synthetic coding sequence
atgctcatgtggcctcaacctcatttgcctacccacccccacctccctacacatcctcacctgcccacacatccccacttgccaacccacccacacctgcccacccatccccatctccctactcatccccatctcccaacacaccccatgatgtccaaggaaacacgacagagcaagcttgctgaggctaaggagcaattaaccgaccaccatcctcagacaaacccttcagtgggcaccgcagcttccgacactaagaagaaaaagataaacaatggaaccaatcctgagacaaccacaagcggggggtgccactccccggaagatgagcagaaagcctctcatcagcatcaagaagcactgagaagggaactggaggctcaggtacacaccattcgtattcttacgtgccagaagactgaactacagatggcactgtactacagtcagcacgccgttaagcaactggaaggcgaagcccgcgatttaatatctcgactgcacgatagctggaagttcgcaggggaactcgagcaggccctttcagccgtggccacacagaaaaaaaaggccgacaggtacattgaagaattgacgaaggaaagggatgcgcttagtctggagctgtacaggaacactatcactgatgaggagctcaaggaaaagaacgcaaaactgcaggagaagctgcagcttgttgagtcagaaaaaagtgagatccaacttaacgtcaaagagctgaagagaaagctcgaaagggccaagctgttattaccccagcagcaactgcaggcagaggcagatcacttgggtaaggaactgcagagcgtatctgcaaaattgcaggctcaggtcgaggagaacgagctgtggaaccggctcaaccaacaacaagaggaaaaaatgtggcgccaggaggaaaaaatacaggagtgggaagagaagattcaggaacaggaagaaaagatcagggagcaagaagaaaaaatccgggagcaggaggagaaaatgcggcgacaggaggaaatgatgtgggagaaagaggagaagatgaggagacaggaggaaatgatgtgggagaaagaagagaagatgcgcaggctggaagagatgatgtgggaaaaagaggagaaaattcgggagctggaagagaagatgcatgaacaggagaagattcgcgaacaggaggagaaacgccaggaagaggagaaaatcagggagcaggaaaagagacaggagcaggaggctaagatgtggagacaggaggaaaagatcagggaacaggaagagaagatccgggagcaggaaaagaagatgtggcgccaagaggaaaagatccacgagcaagagaagattagagaggaagagaaacgccaagaacaagaagagatgtggcgccaggaagagaagattcgtgagcaggaagagatttggagacagaaagaaaagatgcatgaacaggaaaagattagaaagcaggaggagaaggtttggagacaggaggagaagatgcacgaccaggaggaaaagatcagggaacaggaagagaagatgtggaggcaggaggaaaagattagggaacaagaggagaaaatccgtgaacaggaggaaaaaattagggaacaggaagaaatgatgcaagagcaggaagaaaaaatgggggagcaggaggaaaaaatgcaagaacaggagaagatgcgcaggcaagaggagaagatcagagaacaggaagagaaaatccgcgagcagaaggagaagattcgagagcaggaagagaagatttgggagcaggaggagaagatcagggagcaggaggagatgatgcaagagcaggaagagaagatgtgggagcaagaagaaaaaatgtgcgaacaggaagagaaaatgcaggagcaggaggaaaagatgcgacgtcaggaagaaaaaatgtgggaacaggaagtgcgactccggcaacaggaggagaaaatgcaggagcatcaggaacatctggaagccgccatttag

SEQ ID NO: 30354 - DNA, 1857 bp, Artificial Sequence
  Description of Artificial Sequence: Synthetic coding sequence
atgatgagcaaagagacacggcagagcaaacttgctgaagccaaagagcagcttacggaccaccacccccagactaatccttccgtggggacagcagcttcggatactaaaaagaagaagataaacaacggcacaaaccccgagacaacaactagcggggggtgccatagcccagaggatgaacagaaagcaagccaccagcaccaggaggccctgaggcgggaactcgaagcacaagttcatactatcagaatactgacctgtcagaagacagaactgcagatggctctatactactcgcagcacgctgtaaagcaattggagggtgaggcccgggatctaatatctcgattgcacgactcctggaagttcgcgggggaacttgaacaagccctcagcgctgtggccacccagaaaaaaaaagccgatcgttacatagaggagttgaccaaggaacgcgacgccctgtcactggagttgtacaggaacaccattaccgacgaagagttgaaggagaagaacgccaagctgcaggaaaagcttcagctcgtggagtcagaaaaatcagaaatccagctgaatgttaaggagcttaagaggaaactggagagggctaaactcctgttgccacaacaactacaggcagaagcagaccacctgggaaaagagcttcagtcagtcagcgctaaactccaggctcaggttgaagagaatgagctctggaatcgcctaaaccagcagcaggaagaaaaaatgtggcggcaggaggagaaaatacaggagtgggaggagaaaatccaagagcaagaggaaaagattagagaacaggaggaaaaaatcagggagcaggaagaaaaaatgcgtcgtcaggaagaaatgatgtgggagaaagaggagaagatgcgacggcaggaggagatgatgtgggagaaagaagaaaagatgcggcgactggaggaaatgatgtgggaaaaggaggaaaagatccgcgaactcgaggagaagatgcacgagcaggaaaagattcgggaacaggaggaaaaacggcaggaagaagagaaaattcgtgagcaggagaagcgccaagagcaagaggccaaaatgtggcggcaggaggagaagatcagggagcaggaggaaaaaattcgggagcaggagaaaaaaatgtggcgacaggaggagaaaatccacgagcaggagaaaatacgggaagaggagaagcggcaagagcaagaggagatgtggaggcaagaggagaagatccgagaacaagaggaaatctggcgccagaaagagaagatgcatgagcaggagaagatccggaagcaggaggagaaggtctggcgccaggaagaaaagatgcatgatcaggaggagaaaattcgcgaacaagaggaaaagatgtggaggcaagaggaaaaaatacgagaacaggaagaaaagattcgggagcaagaggagaagatcagggaacaggaggagatgatgcaggaacaggaagaaaagatgggggaacaggaagaaaagatgcaggaacaggagaagatgcgacggcaggaggaaaaaatacgcgagcaggaagaaaagatcagagaacagaaggaaaagatcagggagcaggaagagaaaatctgggagcaggaagagaaaatcagagagcaggaggaaatgatgcaggaacaggaggagaagatgtgggaacaggaagagaagatgtgcgagcaagaggagaagatgcaagagcaggaggaaaagatgaggagacaagaagagaagatgtgggaacaagaagttcggttacgacagcaggaagagaaaatgcaggagcaccaggagcacttagaggctgcaatatag

SEQ ID NO: 30355 - DNA, 1143 bp, Artificial Sequence
  Description of Artificial Sequence: Synthetic coding sequence
atgtggccccagccgcgcctgccaccccacccggctatgagtgaaaagacgcagcagggcaagttagcagccgcgaagaaaaaattaaaggcctattggcagcgaaagtccccaggcattcctgcaggcgcgaatcgcaaaaaaaaagtgaacggtagctcaccagacaccgctacatcaggcggataccacagtccaggagatagcgctacagggatctacggggagggaagggcttcttcaaccacacttcaggacctggagtctcagtaccaagaacttgctgttgctctggactctagcagcgccattatttcacagctcacagaaaacataaattctctggtccgaaccagcaaggaggagaaaaagcatgaaatccaccttgtgcagaaactggggaggtcattgttcaagcttaagaaccaaacggccgagccccttgccccagaacctcccgctgggccaagcaaagttgaacagcttcaggacgaaactaaccacctgcgaaaagagttggagagtgtcggccgacagctccaggctgaggtcgagaataaccagatgctttcattgcttaatcgacgacaggaagaaagacttcgggagcaggaggagagacttcatgaacaggaagaacggctgcacgaacaagaggagagactgtgcgagcaggaggagagactttgcgagcaagaagagagactcagagaacaggaggaaagactgcgcgaacaggaggaacgcctccacgaacaggaagagcggctttgcgaacaggaggagaggctgtgcgaacaggaagagaggctgtgcgagcaggaaaagctgcctgggcaggagcggctcctcgaggaagtggaaaaactgctggagcaggagcggcgccaagaagagcaagagcgactactggagcgtgaacgcttgtggacccgctggcgtagctcttggagtcgccggggattcggaaatcgaatgaggggatgtgggagcagaaggctctgcgggtcatggaggggatgcggatcttggcgaggatgcggctcttggagaggatgtggctcatggcggggctgctggtcttggggaggcaagccatgcactagctccggtccgagtcatgccgcagctagtagatcctag

SEQ ID NO: 30356 - DNA, 1440 bp, Artificial Sequence
  Description of Artificial Sequence: Synthetic coding sequence
atgtggccgcagccccgactgccaccccaccccgcgatgtccgaaaaaacgcaacaggggaaacttgccgcagctaagaaaaagctcaaagcctattggcagaggaaatcccctgggattcctgctggtgccaatcgtaagaagaaagttaatggatcgagccctgatacagccacatcgggcggctaccacagcccaggtgactccgccaccggcatctatggagaggggcgggcctcctccacaactttgcaggacttagaaagccaatatcaggagctggctgtcgcactggattcgagtagcgcgatcatttcccaacttacagagaacataaactccctggtgcggaccagtaaagaggagaagaaacacgagattcacctggtgcagaaactgggacggtccctctttaaattgaagaatcaaactgccgagcccttagctcccgaaccacctgcgggaccctctaaggtggaacagctccaggacgaaacaaaccacctgaggaaggagctggagagtgttggtagacaacttcaggccgaagtggagaataaccagatgctgtctctgttgaatcgaagacaggaggaaagactgcgcgagcaggaagagcgcctccacgaacaggaagagcggctgcacgaacaagaggaacgactctgcgaacaggaggagcgcctgtgtgaacaggaggaaagactgagggaacaggaggagagactgcgtgagcaggaagaacgactccacgagcaggaagaacgcctctgcgaacaggaggaacggctttgtgaacaggaggaacgactctgcgagcaggaaaaattacctggacaggagcgcctcctggaagaagtcgagaagctactggaacaggaaagacgccaagaggaacaggagcgattgctggaaagggaacgcctgttagacgaagtagaagagttactggagcaggaaagattaaggcagcaagacgaaagactgtggcaacaggaaacactcagggagctcgagcgccttcgggaactagagagactccgcgaactcgagaggcttcgcgagttggagagaatgctggagctggggtgggaggcactatacgagcagcgtgccgaaccccgcagcgggttcgaggaattaaataatgaaaataagtctactctgcagctcgaacagcaagtgaaagagttagaaaagagcgggggcgccgaggagccccgcgggtctgaatccgcagccgccgcccgaccagtgcccggagcccccgtgccacagggcgcttggatgtgcgggcaggcagggtggacaccccaggagcaccccggcttgagtggagaggccgttggaactggagaggccgccgggggcgccgaggaggcagcttgccacagtttccgggctgccgagaatagagaactgaatatcacaatcatttag

SEQ ID NO: 30357 - DNA, 1953 bp, Artificial Sequence
  Description of Artificial Sequence: Synthetic coding sequence
atgtggccccagccacatcttcctccgcaccccatgatgagcgagaaaacccggcagaacaaactggccgaggcgaagaagaaattcactgattacagacagtggaatattgccggggtcggcacccgagcaaccgacaccaagaaaaagaaaataaataatggaaccaaccccgaaactaccacaagtgaaggctgccactctccagaagacacacagcagaaccgagcccagttgaaggaagagaagaaggcttcccaccagcaccaggaggccttgcggagggagattgaagcccaggaccatacaatccgcatcctcacttgccagaagaccgaactggagacagctctgtactactcacaagacgcggcccggaaattcgaggacggcaacctgggcacaccctcctccttcaacctggccttatcccaagcctttcgcggcagcccactgggctgcgtgtctacgtcactgatcccaggtgaatctaaggacctagccgggaggctgcatcattcctggcacttcgcaggtgaactccagagggcgctgtctgctgtcagcacatggcacaaaaaggcagaccgttacatcgaggaactgacaaaagaacgggacgcgctaagtctggaactgtaccggaataccatcacaaacgaggaactgaaaaagaagaatgctgaactccaggagaagctgcgcttggctgaatccgaaaagtcggaaattcagcttaacgtgaaggagcttaagcgcaaactggaacgggcaaagttcctgcttccccaggtgcagacaaacactcttcaggaggagatgtggcggcaggaagaagagctcagggagcaagagaagaagattagaaaacaagaggagaagatgtggcgacaagaggaaaggctccgggagcaggagggcaagatgcgtgagcaggaggaaaagatgcgtcgtcaggagaaaaggctcagagaacaagagaaggagttacgcgaacaggaaaaggaattgagagaacaaaaaaagttaagggagcaggaagaacagatgcaggagcaggaagagaaaatgtgggaacaggaagagaagatgagggaacaggaggaaaaaatgtggagacaggaagagcggttatgggaacaagaaaaacagatgagagagcaggagcagaagatgagagaccaggaggaaaggatgtgggaacaggacgaacgattgcgggagaaagaggagagaatgagggagcaggaaaaaatgtgggaacaggtggaaaaaatgagggaggagaagaagatgcaggagcaggagaaaaaaacccgggaccaggaagagaagatgcaggaggaggagaggatccgagagcgtgaaaagaaaatgcgggaggaagaagagaccatgcgggaacaggaggagaaaatgcagaagcaagaggaaaatatgtgggagcaggaagagaaggagtggcaacagcagaggctccccgagcagaaggaaaagttgtgggagcaggagaagatgcaggagcaggaggagaagatctgggaacaggaagagaagatccgcgatcaggaagagatgtggggccaggaaaagaagatgtggagacaggagaagatgagagaacaggaggatgaaatgcgtgaaaaagaggagcgaattagggaccagaaagagaaaatgcaagagcgtttgcccgagcacgaagaaagatgctcagagccctgcctcccgccttcaaaggtactgtgtaacatgagtcataccggtagtgtagagcctgcaggaggcgaggcgggcgagggctctccccaggataaccctaccgctcaagagattatgcagttattctgcgggatgaaaaacgcccagcagtgtccaggtctcggctccacctcttgtatacctttcttttatcgaggcgataagcgaaagatgaaaattattaacatttag

SEQ ID NO: 30358 - DNA, 945 bp, Artificial Sequence
  Description of Artificial Sequence: Synthetic coding sequence
atgtggcgtcaagaggaagaactccgggagcaggaaaaaaagatcagaaaacaggaggaaaagatgtggaggcaggaagagcgacttagggagcaggagggcaaaatgagagaacaggaggagaagatgagaagacaggagaagaggttgagagaacaggagaaggaattacgggaacaggaaaaggaacttcgtgaacagaaaaagcttagagaacaggaagagcagatgcaggagcaggaggaaaagatgtgggaacaggaggaaaaaatgcgcgagcaggaggagaagatgtggcgacaagaggaacgcctatgggaacaagaaaaacagatgcgggagcaagagcagaagatgcgtgaccaggaagagagaatgtgggagcaggacgaaaggcttcgagagaaagaggagcgcatgagagagcaggaaaaaatgtgggagcaggtggagaaaatgagggaggagaaaaagatgcaggagcaggagaagaagaccagagaccaggaagaaaagatgcaggaggaggagcggattagggaacgggagaaaaaaatgcgggaggaagaggaaactatgcgggagcaggaagaaaagatgcaaaaacaagaggagaacatgtgggaacaggaagaaaaagagtggcagcagcagaggcttcctgagcagaaggagaagttgtgggagcaagaaaaaatgcaggagcaggaggaaaaaatttgggagcaagaagagaagatccgagatcaagaggaaatgtggggacaggagaaaaagatgtggagacaagagaaaatgcgagaacaggaagacgtcggagctggcggtgatgctagagaaggtggagaagatactcggtccgaaagggaggatgccggcgaagctgcacgagccaggggggccgtactgcgcgcgctccctcccagtcttcaaagtagtctatag

SEQ ID NO: 30359 - DNA, 753 bp, Artificial Sequence
  Description of Artificial Sequence: Synthetic coding sequence
atgttgagtctgctgaatcgccgacaagaggaacgtctgagggagcaggaggagaggctgcgtgaacaggaggagcggctccgcgaacaggaggaacgtctatgcgagcaggaagagaggttgcgagagcaggaagaacgcttgtgcgaacaggagaagctgccgggccaggagaggcttctcgaggaagtggagaaacttctggaacaagagcggaggcaagaggaacaggagcgcctgttagagcgcgaacggctgctcgaagaggtggaaaaattgctggagcaggagcggctgaggcagcaggacgagcgactttggcaacaagaaacactccaggaactggagcgactgagagaattggagcgccttagggagcttgaaaggatgctcgaacttggttgggaggcattgtacgaacagcgcgccgagcctcgttccggattcgaagagctgaataacgaaaataagagtacgctccagctggagcaacaggtgaaggaactaaagaagtccggcggagcagaggaaccacgtggaagcgagagtgctgccgcggcccgccctgtcgcaggcgcaccagtgccgcagggggcttggatgtgtgggcaggccgggtggaccccgcaggaacatcccggacttagcggcgaggccgtgggcacgggcgaggccgccggcggggcaggcgaggccgcttgccactcgttcagggccgccgaaaacagagaacttaacattacgataatctag

SEQ ID NO: 30360 - DNA, 348 bp, Artificial Sequence
  Description of Artificial Sequence: Synthetic coding sequence
catcttagactgcgacaacaagatgaaagactctggcaacaagagacattgcaggaactggagcgactgagggagcttgaacgactgcgcgaattggaaaggatgctcgagcttggatgggaagccctttatgaacagagagctgagccacgaagtgggttcgaggaactgaataatgaaaacaaatccacactgcagcttgagcagcaggttaaggagttgaagaagtccggcgagttaaaggagaccgtgacgagcgacccgagtaaaaagatgtgggaagcgggcacatccctatgggggggagaagtgccaggccatcgtcagctgcagccgggggacagatag

SEQ ID NO: 30361 - DNA, 2253 bp, Artificial Sequence
  Description of Artificial Sequence: Synthetic coding sequence
atgctgatgtggccacagccacatcttcctacccacccccacctgcccacacatcctcatttacctacccacccccacctcccgacccatccacacctcccgacccaccctcacttgccaacacacccccacttgcccacgcatccaatgatgtccaaagagactagacagagtaagttggcagaagctaaggagcaactgaccgaccatcacccccagacaaatccctctgtcggtaccgctgcctctgacactaagaaaaagaaaataaacaacggtaccaaccctgagacgacaaccagcggtggctgccactccccagaagatgagcagaaggctagtcaccagcatcaggaagcactgcgtcgagaattggaggcacaggtccacacaatccgtatcttaacatgtcaaaagaccgaactacagatggctctctactactcacagcacgcagtcaaacagcttgaaggagaggcaagggacttaatatcgcggcttcatgactcctggaaattcgcaggagaactggagcaggcgctttccgctgtagcaacacagaagaagaaggccgatcgctacatcgaggaactgactaaggaacgcgacgccttgtcccttgagctgtacaggaacacaattactgatgaggaactcaaagagaagaatgctaagctccaggagaaactccagttagttgaatccgaaaaatcagagatccaattgaacgtgaaggagctgaaacggaaattggagcgggcaaagctgctccttcctcagcagcagttgcaggcggaagcagaccacttgggtaaggagttgcagtcagtgagtgctaagttgcaagctcaggtggaggagaacgagctgtggaaccgacttaatcaacagcaggaggagaagatgtggaggcaagaggaaaagattcaggagtgggaggaaaaaattcaggagcaggaagagaagattcgcgagcaggaggagaagatcagagaacaggaggaaaaaatgcggaggcaggaggaaatgatgtgggaaaaggaagaaaaaatgcggcggcaagaagagatgatgtgggaaaaagaggaaaaaatgcggcgccaggaggaaatgatgtgggagaaggaagagaaaatgcgaaggcaggaggagatgatgtgggaaaaagaagagaagatacgagaactcgaagagaagatgcatgaacaggaaaaaatccgggagcaagaggaaaagcgtcaagaggaggaaaagattagggaacaagagaaaagacaggagcaggaggcaaagatgtggagacaggaggagaaaatcagggaacaggaagagaagatccgtgaacaagaaaaaaaaatgtggagacaagaggagaaaatccatgaacaagagaaaatccgagaggaagaaaagcgccaagagcaagaagaaatgtggagacaagaggaaaaaatccatgagcaggaggagatctggaggcagaaggagaagatgcacgagcaggaggaaaagatcaggaaacaggaagaaaaggtgtggagacaggaggaaaagatcagggagcaggaggagaaaattagagaacaggaggagaagatgtggagacaggaagaaaagatccgcgaacaagaagagatgtggagggaggaggagaagatgcacgagcaggagaaaatctgggaagaagagaagcggcaggagcaggaggacaaaatgtggaggcaagaggagaaaatccgtgagcaggaggagaaagtgtggcggcaagaagagaaaatcagagagcaagaagaaaagcgtcaggaacaggaggagaaaatgtggaaacaggaggaaaaaatacgggagcaggaagagaaaatccaggaacaggaggaaaagattagagagcaggaggaaaaaatccgcgagcaagaggagatgacccaagagcaagaggagaagatgggcgaacaagaggagaaaatgtgcgaacaagaagagaagatgcaggaacaagaggagacaatgtggagacaggaggaaaagattcgggagcaggagaagaagattcgagaacaggaagaaaaaatcagggaacaggaagaaatgatgcaggaacaagaggaaaaaatgtgggaacaggaggagaagatgtgtgagcaggaggagaaaatgcaagagcaggaggagaagatgaggcgccaggaggagaagatgtgggagcaagaggttcgccttcgacagcaggaagaaaagatgcaagaacactag

SEQ ID NO: 30362 - DNA, 1299 bp, Artificial Sequence
  Description of Artificial Sequence: Synthetic coding sequence
atgtggccccagccccgcctgcccccccatcctgccatgtccgaaaagacacagcagggcaaactcgcagcagccaagaaaaaactgaaggcgtattggcagagaaaatctcctggcatccctgctggggcaaatagaaaaaagaaggtgaacggctcctccccagacacagccacttccggcggctatcactctcctggcgactccgcgaccggaatctatggagaaggtagggccagtagtactacattgcaggaccttgagtcgcagtaccaagagctggccgtggcactagactcttcctcagctataataagccagctcacggagaacattaactcattggtgcgtacctccaaagaagagaaaaagcacgagatccatctggtccagaaactggggcgatctctgttcaaactcaaaaaccagacggccgagcccctcgccccacagccgcctgccggaccatcgaaggtggagcagctacaggatgagactaaccatctccgaaaagaactggagtccgtgggcaggcaactgcaggcagaagtagagaataatcagatgctaagtttactgaatcggcggcaggaagagcgcctgcgcgaacaggaagaacggctgcgggaacaggaggagagattgtgcgagcaggaggagcgcctgtgcgagcaggaggagaggttgagagagcaggaggaaagactgtgcgagcaggagaaactacctgggcaggagcggctcttagaggaggtggaaaagctcctgaagcaggagagaaggcaagaagagcaagaaagattgctcgagagggaacgactgttggatgaggtggaagagctcttggaacaggaacgactgcgtcagcaagacgagcgcctgtggcagcaggagacactgcgggagctagaacgcctgcgcgagctggagcgcatgctggagctcggctgggaggctttgtatgaacagagagctgaaccccggagcggatttgaggaactgaacaatgaaaataagtcaaccctgcaacttgaacagcaagtcaaggagctggaaaaatcaggaggagcagaggaaccccgcgggtctgaatccgctgctgccgcccgtccagttccaggggcaccagtcccccaaggcgcctggatgtgtggccaggcaggatggacaccacaggagcaccctggattgtcaggggaagccgtgggaacaggagaggccgcagggggcgccggggaagccgcttgtcattcattcagagcggcggagaatagagagctaaatatcacaatcatttag

SEQ ID NO: 30363 - DNA, 1812 bp, Artificial Sequence
  Description of Artificial Sequence: Synthetic coding sequence
atggccgaggagaccgggcaaagcaaactcgcagcagcaaagaagaagtttaaagagtattggcaacggaatcggccaggtgttcctgccgctgcaaagcgcaataccaaggcgaacggttctagcccagaaaccgctgccagcggcggttgccacagctccgaggcctcttcgtccgcatcctcttcactccacgcccgccagtcgccatgtcaggagcaggctgccgtgctcaacagtagaagtatcaaaatttccagactgaacgacaccattaagagtctgaaacaacagaagaagcaagtagaacaccagctggaggaggagaaaaaggccaataatgaaaaacagaaggccgagcgtgaactggaaggtcagatccagagactgaataccgagaagaagaaattgaatacagatctttatcacatgaaacactcactccgctattttgaggaggaaagcaaggatctcgccggccgtcttcagaggtccagccagaggatcggagagttggagtggagtctttgcgcagtggcagctactcaaaagaaaaagcctgatggcttctcatctcgctctaaggcccttctcaagcggcagctagagcagagtatcagggagcagattttactgaaggggcatgtcacccagctgaaggaatccctgaaagaagttcaactggaacgagaccagtacgccgagcagatcaaaggggaacgtgcgcagtggcagcagcgaatgagaaaaatgagccaggaggtctgtacgttaaaggaagaaaagaagcatgacacacatcgggtggaggaacttgaaaggtcactgtcccgactgaaaaaccagatggcggaacctctaccacccgacgccccagctgtcagcagcgaagttgagttacaagatctgcgtaaggagcttgagcgggttgctggagagttacaggcccaggtcgagaataatcagtgtatctccttactcaacagaggccagaaggaaaggctgagagaacaggaagaacgcctgcaggagcaacaggagcggctgcgcgagagggaaaagagacttcagcagttggctgagcctcaaagcgacctcgaagagttaaaacatgagaataagtcggctctacagttggaacagcaggtgaaagagcttcaagaaaagctgggccaggtcatggaaactctaacctcagcagaaaaggagcccgaagctgccgtgcctgccagcggcacaggcggcgagagtagtgggctgatggatcttttggaggagaaggccgacctccgcgaacacgtggagaaattagaattgggattcatccaataccggcgtgagcgctgccaccagaaagtacacaggctcctgaccgaaccaggagactccgcgaaggatgcttcgcctgggggaggtcaccatcaagcaggtcccggacagggaggcgaagagggggaggcggctggcgccgctggcgatggcgtcgcagcctgcgggtcatatagcgaaggtcacggcaaattcctggcagcagctaggaaccccgcagcggagccgtctccaggagcaccggccccacaggaacttggtgccgcggataaacatggcgacctgtgcgaagcctcactgacaaacagcgttgaacctgcccaaggggaagcccgggaggggagctctcaggataatcccaccgcacagcccgtagtccagcttctgggcgagatgcaggatcatcaagaacatcccggcctgggaagcaattgctgtgtgccctgtttctgctgggcctggctcccaaggagacgaaggtag

SEQ ID NO: 30364 - DNA, 1812 bp, Artificial Sequence
  Description of Artificial Sequence: Synthetic coding sequence
atggctgaggaaacagggcagagcaaactcgcagccgcgaaaaaaaagttcaaggagtactggcaaaggaaccgtccaggagttccagctgcagcaaagcggaacacgaaagcgaatgggtcttctccagagaccgcagcaagcggcggttgccactcaagcgaagcgtcttctagcgcttcttcctctcttcacgcaagacagagcccctgtcaggagcaggccgcggtcctcaatagcagatcaattaagatcagccgcttgaacgacaccatcaaatcgcttaagcagcaaaaaaaacaggtcgaacaccagcttgaggaggaaaaaaaagcgaataatgagaaacagaaggcagagcgcgaactggagggacagatccaaagactgaacaccgagaagaagaagctgaacacagatctgtaccatatgaaacactccctgagatatttcgaggaagaaagtaaagatttagccggtcggctgcaaaggagtagtcagcggattggtgagctggagtggtcactgtgcgcagtggcagctactcagaagaaaaagcccgacggattttcctcgcgttccaaggctctgttgaagcgccagcttgagcaatcgatcagggagcaaatactgctgaaagggcatgtcactcaactgaaagagagcctgaaggaggtccagcttgaacgggatcagtatgccgagcagataaagggtgaaagggctcaatggcagcaacgaatgcgcaagatgagccaggaagtgtgcacactgaaggaggaaaaaaaacatgatactcatagggtagaggagctggaacggagcctgagtcgtctcaaaaaccagatggcagagccactgccacctgacgcccccgccgtaagttctgaagtggagctacaagacttgcggaaagagctggaacgagtggctggggagctccaggctcaggtggagaataaccaatgcatctcactgcttaatcggggccaaaaagagaggttacgtgagcaggaggagcggctgcaggaacaacaggagcgattacgggaaagggagaagcggctccaacagctcgcagaaccacagtctgatctggaggaactgaagcatgaaaacaaatctgccctccagctcgaacaacaggtcaaagagctgcaggagaagctaggccaggtgatggagactctgactagcgcagagaaggaacccgaagccgctgtaccagcttccggtaccggaggcgaatcctccggtctgatggatctgttagaggagaaagctgacttgagggagcatgtagaaaagctggaactgggcttcatccagtacagacgggagcggtgccatcaaaaggtccacaggctgctcaccgagcccggggatagtgcgaaggacgcatcccccggcggaggacaccaccaggccgggcccggccagggcggggaggagggtgaagccgccggtgccgcaggggatggcgtcgccgcttgtggttcgtatagcgaaggccacggcaaatttctggctgccgcccggaacccagcagcagaaccttctccgggcgcccccgctcctcaagagttaggcgccgcagataaacacggcgacctgtgtgaagcatctctaaccaacagcgtggagcccgcacagggtgaggccagagaaggatccagccaggacaatcctaccgcccagccagtcgtgcagctgctgggagagatgcaggatcaccaagagcacccgggcctggggtcgaactgttgtgtcccttgcttctgttgggcatggcttccacggcggagaaggtag

SEQ ID NO: 30365 - DNA, 1902 bp, Artificial Sequence
  Description of Artificial Sequence: Synthetic coding sequence
atgttaccggtggacggggaggaaaggaagtcagaggggtcagacacagagggcgaccgaacctctccttgcgctggccccacctctagtgccacattgaaagacctggaagttggcggtagtgggcgacggtgctccgacccggctggccagccctcaaaccttctgccacagaggggattgggggcccctcttccagccgagaccgcacatacccagccctcccccaacgacagatctctctacctgagccctaagtcgtcttcagcaagttcttccctgcacgcccgtcagagcccctgccaggaacaggccgctgttctcaacagccgcagcataaagattagtcggctgaacgatacgatcaagagccttaaacagcaaaagaagcaggttgagcaccagctagaagaagaaaagaaagccaataatgagaagcaaaaagctgagcgcgagctcgaagggcagatacaaaggctgaacaccgaaaaaaaaaagctgaataccgatctgtatcatatgaaacatagcctgagatatttcgaagaggagagcaaggatctggcaggacggcttcagagaagcagccaacgcatcggagagctggaatggtctctgtgcgccgtggccgcgacacagaagaaaaaacccgatggattttcatcacgctcaaaagccttactgaaacggcagctggaacaatctattagggaacaaatcctgctgaagggacacgtgacccagctcaaagagagcctcaaggaggtgcagcttgaaagggatcagtacgccgaacagattaagggcgaacgagcccagtggcagcagcgcatgaggaagatgtctcaggaagtctgcactctgaaggaggagaaaaagcacgacacacacagagtggaggagctggaacggtcgctaagccgcctcaagaatcagatggctgaacctctaccaccagatgcgcccgccgtgtcctctgaggtcgagctgcaggacctcagaaaggagctggagcgcgtcgctggagagttacaggcacaggttgaaaataaccagtgtatttcactgcttaataggggacagaaggagcgcttgcgggagcaagaggagcggctgcaagagcagcaggagcgcttaagggagcgcgagaaacgcctccagcagctggccgaaccacagtccgatctagaagaactgaaacacgaaaacaaatccgcgcttcagttagagcagcaagtgaaagaactccaggaaaaactcggacaggtcatggaaaccctcacgagtgcggaaaaggagcccgaggccgcagtgcctgccagcggtaccggcggggaatcaagtggtctcatggatctgctcgaagagaaagcagacctccgcgaacacgttgaaaaattggagctgggattcatacagtaccggcgggagcgttgccatcagaaagtccacaggttgctgacggaacccggggactctgcgaaggatgcaagccctgggggaggtcatcaccaggccggaccgggccaaggcggagaagaaggtgaagcggccggtgcggcgggggatggggtcgcggcatgtggcagttacagcgaagggcacggcaaattccttgcggccgcaagaaatcctgctgcagagccaagtccaggagccccggctcctcaggagctcggtgctgcagataaacatggcgatctgtgtgaggcctcactgacaaattccgtagagccggcacagggcgaagcacgtgaaggatcgagtcaggataatccaaccgcacagcccgtggtgcagttgctgggggaaatgcaggatcaccaggagcacccaggcctgggaagcaattgctgtgttccatgcttttgctgggcctggctgcctaggagacgtagatag

SEQ ID NO: 30366 - DNA, 1383 bp, Artificial Sequence
  Description of Artificial Sequence: Synthetic coding sequence
atgaaacacagtctgcggtactttgaggaggagtccaaggatcttgctggccgcctgcagcgatcgagccagaggatcggagagctggaatggtcactgtgtgccgtcgcagccacccagaagaaaaagcccgatggcttctcttcaagaagtaaggccttgctgaaaaggcagttggaacaatcaatccgcgaacaaatactgttgaaagggcacgtgacccaactgaaggaaagcctcaaggaggtccagttggaacgagatcagtacgccgagcagattaagggcgagagggcccagtggcagcagagaatgcgtaagatgtcacaggaggtctgcactcttaaggaagagaagaagcacgatacacaccgcgtcgaggagctggagaggagcctgagtcgattgaaaaaccagatggctgagcccttaccacccgatgcaccagctgtttctagcgaagtcgagctccaggatctgcgcaaggagctggagcgtgtcgccggtgaactgcaggctcaggtggaaaacaaccagtgcattagcctcctcaaccgagggcagaaagagcgcctgagagaacaggaggagcgactccaggaacagcaggagcgattgcgagagagagagaagcgacttcaacaattagccgagcctcagtccgatctggaagagctgaagcacgaaaataagtcggctctccagcttgaacaacaggtcaaggagctgcaggagaagctgggtcaggttatggagaccctgactagcgcagagaaggagcccgaagcagctgtccccgcatccggcaccggtggcgaatcatcaggacttatggatctgctggaagagaaggcggacctgcgggaacacgtggaaaaattagagctgggttttatccagtatcgacgcgagcggtgtcaccaaaaagtacaccgtctcctgactgaacccggggattcagccaaggatgcttcacccggaggcggccaccatcaggccgggcccggccagggaggcgaagaaggcgaagcggctggcgctgccggagacggggtggcagcatgtggttcgtattcagagggacacggtaagttcctggccgccgcacgaaatcccgccgctgagcctagccctggcgctccggctccccaggagctgggggctgcagacaaacacggagatctgtgtgaagctagcctgaccaacagtgtggagccagcccagggcgaggcgcgcgagggaagtagccaggataatccaaccgcacaacccgtggtacagcttttgggtgagatgcaggaccatcaggaacatccagggcttggttctaattgctgtgtcccatgcttctgttgggcatggttgccacgacggagacgttag

SEQ ID NO: 30367 - DNA, 1899 bp, Artificial Sequence
  Description of Artificial Sequence: Synthetic coding sequence
atggctgaggaaacccagcataacaaactggctgctgccaaaaagaagctaaaggaatactggcaaaagaactccccaagagtacctgctggcgcaaaccgcaataggaagaccaatgggagcattccccagacagccactagcggaggttgccagccccctggagactcagcaaccggctttcatcgcgagggaccaacgtcttctgccactttaaaagacttagagtccccatgccaagagagagcagttgtactggatagccgctcagtggagatctcccagctgaaaaataccatcaagtctctaaaacagcagaaaaaacaggttgagcaccaattagaggaagagaaaaaagccaatattaaaaagcagaaggcaaaacgggttctggaggttcagatccagactctaaacattcagaaagaggaactgaacaccgatctctatcatatgaagcggagcctgcggtattttgaggaaaagtccaaggacctagccgtccgccttcagcactccctccagcgaaaaggtgagttagaatccgtcctgtctgacgttatggccacacagaaaaaaaaggctaaccaattgagcagcccgagtaaggccgggaccgaatggaaactcgagcagagtatgagggaggaagctctgttaaaagtgcagttaactcagctcaaagagtctttccagcagcttcagctggaaagacatgagtacgcagagcaccttaaaggggaacgggcccgatggcagcagcgtatgcgtaaaatgtctcaggaaatatgtacactgaagaaggagaagcagcaagacatgcgacgggtggagaagttggagcgctcgctctccaagctgaagaaccagatggcagaacccctcccacccgaaccaccagctgttccatccgaggtcgagctgcagcacctacgaaaagagctcgaacgcgtggcaggcgcattacaggcacaagtcaagaacaaccaacggatatcactgttgaacagagggcaggaggagcggattagggaacaagaggagcggctacgaaagcaggaggaacggatccaggagcaacacaagagccttcagcaactggcaaaaccacaaagtgtcttcgaggaaccaaataacgagaacaagtcagctcttcagctcgaacagcaagtcaaggaattacaagagaagctgggcgaagaacacctcgaagccgcctctcagcaaaatcagcagctgactgcgcagttatcactgatggcactacccggggagggccacggcggggaacacctcgactccgagggagaggaggctccccagcctatgccgtctgtccccgaggatctcgaaagccgagaagccatgtcttcctttatggatcaccttgaggagaaagccgaccttagcgagctggtaaaaaaaaaggaactttgctttatacaccattggcgcgagcgctgtcatcagaaaacacatcatttactctcagaaccgggtggcagagccaaagatgcagctctgggcggaggacatcatcaggccggagcccagggtggcgatgaaggggaggcagcaggcgctgcagctgacggcatcgcggcgtacagcaactataacaatggccaccgaaaatttctggccgccgctcacaaccctgcagatgaacccggtccaggcgcccctgctccacaggaacttggagctgccgataaacacggcgacctatgcgaagtcagcttaacctcctccgctcagggtgaagcgcgggaagaccccctgctggacaaaccaactgcccagcccattgtgcaggaccaccaggagcatcctggcctgggctccaactgttgtgtgccctttttctgctgggcttggttacctaggcggcggaggtag

SEQ ID NO: 30368 - DNA, 1338 bp, Artificial Sequence
  Description of Artificial Sequence: Synthetic coding sequence
atggccacacaaaaaaagaaggccaaccagctgtcctcacggtcaaaagccaggacagagtggaaactggagcagtccatgagagaagaagcattgctgaaagtgcaattgacacagtttaaagaatcattccagcaggtccaactagaacgtgatgaatattctgagcacctaaagggcgaaagagctagatggcagcagaggatgcggaagatgagccaggaaatctgcacacttaaaaaggagaagcaacaggatatgcgccgtgtcgaaaaactggaacgctccctgtcaaaactgaagaaccagatggcagaacctcttcctccagagccgcctgctgtccccagtgaagttgaactgcaacatctgagaaaggaattggagagagtcgctggggaactgcaggcccaggtgaagaacaaccagaggatatcattgctgaaccagcgtcaggaagaacgaattagagaacaggaggagcgattacgcaagcaagaggaaagaattcaggagcaacacaaatctcttcagcagctagcaaaaccgcaatcggtttttaaagagcctaataacgagaacaaaaacgctctccaactcgaacagcaagtcaaagagcttcaggaaaaattgggcgaggagcacttggaagctgccagtcagcagaatcagcaattgactgcccagctttcgctgatggcactcccaggagagggacatggaggcgagcatcttgattctgagggcgaagaagccccacgtcctatgccttctgttcctgaggaccccgagtctcgggaggccatgtcaagtttcatggaccacttggaggagaaggcagatctgtcggagctggttaagaaaaaagaactgtgttttatacatcactggagagagagatgtcatcagaagacccatcatctgctgtccgagcccggtggaagagccaaagacgccgctctcggtggagggcaccaccaggccggcgctcagggtggtgacgaaggcgaggctgcgggcgccgctgcagatgggatcgcagcttactccaattataataatgggcataggaagttcttagcagcggcacacaatagtgcggacgaaccgggccccggggctcctgcgccacaggagctcggggctgcggacaagcacggtcacttgtgcgaggtgagcttgacatccagcgctcaaggagaagcacgagaggaccccctgctcgataagcccacagcacaaccaattgtacaggatcatcaggagcatccaggtctgggctccaactgctgcgtgccgttcctgtgttgggcatggctccctcggcggagacgctag

SEQ ID NO: 30369 - DNA, 1299 bp, Artificial Sequence
  Description of Artificial Sequence: Synthetic coding sequence
atgtggccacaaccgcggcttcccccgcatcccgccatgagtgaaaagactcagcagggcaagctcgccgcagccaagaaaaagctgaaggcctactggcagaggaagagtccaggaatacctgccggcgccaatagaaaaaaaaaggtcaacggctcatccccagatacggccacatctggtggctaccatagcccgggcgattctgcaacggggatctatggtgagggcagggcctcatcaaccactctgcaggatttggagtcacagtaccaggagctcgcagtggccttggacagctcttcagctataatatctcagctgactgagaacataaactccctcgtccgcaccagcaaagaggagaaaaagcatgagatacacctcgtgcagaagctgggacggagtctgtttaaactgaaaaaccagaccgccgagcctctcgcaccacagccaccagcggggccaagtaaagtggagcaattacaggacgagactaaccatcttcggaaggagctcgagtctgtcggccggcaactgcaggctgaagttgagaacaatcagatgctctccctgctgaaccgacgccaagaagaaagattacgggagcaggaagaacggctcagagaacaggaagagcggctctgtgagcaggaagagcgcttgtgcgaacaggaagagaggcttagggagcaggaagagaggctatgcgagcaggagaaacttcccggtcaagaacgcctcctggaggaagtagaaaagctgctgaaacaggagcgacggcaggaggaacaggagagactgcttgagcgcgagaggctgttggatgaggtggaggaactgctcgaacaggagcgcctgagacaacaggacgagcggctgtggcaacaagagactctcagagaactcgaacgcctgagggagctggaacggatgctggagctgggttgggaggccctgtacgagcagcgggccgagccacgttccgggtttgaagagctgaacaacgagaacaaaagcacacttcagctggaacagcaggtcaaagagttagaaaaaagcggcggcgctgaggagcctcgaggatccgagtcagccgctgctgctagacctgtacccggcgcacccgtgccccagggggcttggatgtgcggccaggccggctggactccacaagagcacccgggtctcagcggcgaagcagtgggaacaggcgaagccgcgggtggagcaggagaggcagcctgtcactcctttcgagcggccgaaaacagggaactcaatatcaccatcatttag

SEQ ID NO: 30370 - DNA, 1896 bp, Artificial Sequence
  Description of Artificial Sequence: Synthetic coding sequence
atggctgaggaaacacagcacaataagctggcagcggctaagaagaaactgaaggagtattggcagaagaatcgtcctcgtgtacccgcaggcgttaaccggaataggaagactaatgggtccattccggagacggcaacgagtggaggctgtcaaccacctggcgatagcgcaactggcttccacagagaaggaccaaccagctcagcaaccttgaaggatctggagagcccatgccaggagcgtgcagtcgtcctggactccacttcagtgaaaatttcccgcttgaaaaatacgattaagtcacttaagcagcagaagaaacaggttgagcaccagctggaagaggaaaaaaaggccaacaatgagcgccagaaagccgagagggttctggaagtccagattcagaccttgatcatccaaaaggaggagctaaacacagacttgtatcatatggagcggtctttgcggtattttgaagaggagtctaaggatctggctgtgcggctacaacatagcttacagtgtaaaggcgagcttgagagagctctgagcgctgttattgccaccgaaaaaaagaaggccaaccaactgagttcctgctccaaggcacataccgagtgggagctggagcagtctttgcaggaccaggctctgctgaaagcccaactgactcagctgaaagagagcttccaacagcttcaactcgagcgggatgagtgcgccgagcacattgaaggtgaacgggcccggtggcaccaacgcatgagtaagatgtcacaagaaatttgcacattgaaaaaagaaaagcaagacatgcgctgggtcgaacaattagagtggtcccttagtaagttgaaaaaccagaccgccgagcctttacctcccgagcctccagcggtgcctagtgaggtcgaactgcaacatttacgaaaagagctggagcgcgtggccggagaactccaatcacaggttaagaataatcaacacatctctcttttgaaccgccgccaggaggagaggattcgtgagcaagaggagcgccttcgcaagcaggaagaaagactgcaagaacaacacgagaagctgagacagcttgccaagccccagagcgtctttgaggagctgaataatgagaataaaagtactctccagttggagcaacaggtgaaggagcttcaggagaagctgggagaagagcacttagaagtcgcctctcagcagaaccagcagctgacagcccagctctcactcatggctctgcctggagaaggccatggcggagaacatctggactccgagggggaagaggctccacaaccgatgcctagtgtgcccgaagaccccgaatctagagaagctatgagcagcttcatggatcacctaaaagagaaggctgatctaagcgagctgcttaagaaacaagagctgagatttatccagtactggcaggagcgttgtcaccaaaagatccatcacctgctcagtgaaccaggcggacgggcgaaagatgcggctctaggtggggggcaccaccaagctggcgcccagggcggtgacgaaggggaggccgcaggtgccgcggccgatggcatagccgcctatagcaactataataacggacataggaagttccttgcagccgcccacaactccgcagacgagcccggcccaggagccccagcccctcaggaactaggagctgccgataaacatggtgatctcagagaggtgactctaaccagctccgcccaaggggaagcaagagaagatcccctgttggacaagcctaccgcccaacccatagtgcaagatcaccaggagcatcctgggcttggctccaattgttgcgtgcctttattttgttgggcttggttacctaggaggagaagatag

SEQ ID NO: 30371 - DNA, 885 bp, Artificial Sequence
  Description of Artificial Sequence: Synthetic coding sequence
atggccgaagaaactcagcacaacaagctcgccgctgcaaaaaaaaagctcaaagaatattggcagaagaacagacccagggtgccggctggggtgaacagaaacagaaaaactaacggcagcattcccgagaccgcaaccagcggaggctgccagccccctggcgacagtgccactgggtttcaccgggaaggccccacctcgagcgcaacccttaaagatctagagagcccctgccaggagcgcgctgtcgtgttagactccacaagcgttaaaattagccgcttgaaaaacacaattaagagtttgatttgtaccttgaagaaagagaagcaggacatgaggtgggtggaacagctcgaatggtctctctctaagctgaaaaatcagactgccgagcctctcccccccgagccacccgcagtcccgagcgaggtggagctgcagcatcttcggaaggagctcgagagagtggcaggcgaactccagtctcaggtgaagaacaaccaacatatatctctcctaaataggaggcaagaggaacgtatcagggaacaggaggaaagactgcgtaagcaggaggagcgcctgcaggaacagcacgagaagctgaggcaactagccaaaccgcagagtgtgttcgaggaactaaataacgagaataagtccactctgcagctagagcaacaggtgaaagaattgcaagaaaaactgggtgaagtaaaagagaccgaaacatccactcccagcaaaaaggggtgggaggccggatcttcattgcttggaggggaagtgccaggccagagacaacttcctgcctggggtctggtgactacggccccgagacgagccgtgttacggttgtttcttacttcatgtctctag

SEQ ID NO: 30372 - DNA, 519 bp, Artificial Sequence
  Description of Artificial Sequence: Synthetic coding sequence
atggctggtgccgcacccactacagcctttgggcaggcagtgattggtccaccaggatcaggaaagaccacctactgcctaggaatgagtgaattcctgcgagccctgggcagacgtgtggcggtagtcaacctggatccagctaacgagggcctgccttatgatatttttagtcagatggctcagtgggacttacgattaaccgcagtccacttggtcgattctcactattgtactgatccggcaaaatttatttctgtgctgtgtacaagcctggccactatgttacacgtagaacttcctcatattaatttgctttcaaagatggacttgattgagcactacgggaagctggcattcaatctcgattactataccgaggtgctcgacctctcatacctcctggaccatttggcctccgaccccttctttcgccactaccggcagctgaacgagaaactggtccaactgatcgaagattactcactagtgagctttattccgctcaacatccaatag

SEQ ID NO: 30373 - DNA, 396 bp, Artificial Sequence
  Description of Artificial Sequence: Synthetic coding sequence
atgctggctggtctggaactcttgacatcagcgtttaatctggattactataccgaagtgctcgacctgtcctatcttctagatcatctggcttctgatcccttcttcaggcattaccgtcagctcaatgaaaagttggtccaattgattgaggactactctctcgtgagtttcatccctctgaacattcaggataaagaatccatccagagagtccttcaggcagtggataaagctaacggctattgctttcgcgcccaagaacagcgatctcttgaagcaatgatgtccgcggctatgggggctgacttccacttttcctctacactggggatccaggagaaatacctggcaccttctaatcaatctgtcgagcaagaagcgatgcagttatag

SEQ ID NO: 30374 - DNA, 933 bp, Artificial Sequence
  Description of Artificial Sequence: Synthetic coding sequence
atggccggagccgctccaacaacagcattcgggcaagccgttatcggaccccccggctctgggaaaactacatattgtcttggcatgagcgaatttctgcgcgcactgggccgtcgcgtggcagtggtgaatctggacccggccaatgaagggctgccttacgaatgtgctgtggatgtgggggaacttgtgggcctgggagatgtcatggatgccttaagactcgggcctaacggtggactgctctactgtatggaatacttagaagccaatctggattggctgcgcgcaaagcttgatcccctccgaggacattattttctgtttgattgtccgggacaggtggagttgtgcacgcaccatggagcactgagatcaattttcagccaaatggcccaatgggatctgcgactcacagccgtgcacctggtcgattctcattattgcactgatcctgccaagttcatcagtgtactgtgcacctctctggcgacaatgttacatgtggaacttccacacatcaatctgctgtccaagatggacctaattgaacactatggcaaactggctttcaacctcgattattatacggaagtcctcgatctgagctatctcctcgatcacctggctagcgatcccttcttcagacactacaggcagcttaacgaaaagctcgttcaacttatcgaagattatagcctagtcagttttataccgctgaatatacaggacaaggagtctatacagcgggtgctgcaagccgtagacaaagctaacggctattgcttccgcgcgcaggagcagcgctctttagaggccatgatgtctgctgccatgggtgcagattttcatttttcatccactcttggcatccaggagaaatacctcgcgccaagcaaccaatcagtggaacaggaagctatgcagctgtag

SEQ ID NO: 30375 - DNA, 519 bp, Artificial Sequence
  Description of Artificial Sequence: Synthetic coding sequence
atggccggtgccgcacccacaacagccttcggacaggccgtgattgggccccctggtagcggtaagaccacctactgcttgggcatgtctgagttcctgagggctcttggaaggcgggtggcagtggtgaacctggaccccgcaaacgaaggtctaccctacgacatatttagccaaatggcccagtgggatcttcggctgacggcagtgcatctggtggacagccattactgtaccgatcccgccaaattcatttcggtactgtgtacaagcctggccaccatgctgcacgtggaattgccacatattaatttactgagtaaaatggatcttatcgagcattacggcaaattagcctttaatttagactactacacagaggtcctggatttatcctatctgctggatcaccttgcgtccgaccctttttttagacactatcggcagctgaacgagaagctcgttcaactgatcgaagactactcgcttgtgtcatttatccctctgaacattcagtag

SEQ ID NO: 30376 - DNA, 537 bp, Artificial Sequence
  Description of Artificial Sequence: Synthetic coding sequence
atgccagcataccactcttctttgatggatcctgatacaaagctaataggtaacatggctctactacctatcagatcacagttcaaaggacccgccccccgggaaacaaaagacaccgacatcgtcgatgaagctatatactacttcaaagctaacgttttttttaagaattatgagataaaaaacgaggctgatagaaccctcatttatataaccctctatatctccgaatgtctgaaaaaactgcaaaaatgcaactccaaatcccagggcgaaaaggaaatgtatacattagggatcaccaatttccctatcccaggcgaaccgggatttccattgaacgctatttatgccaagccagccaacaagcaggaagacgaagtcatgcgcgcatacctgcaacagctgcgccaggaaaccggcttaaggctgtgcgaaaaggtgttcgatccacaaaacgacaagccctctaaatggtggacctgcttcgtaaagagacagttcatgaataaatctctgtctggacccggacagtag

SEQ ID NO: 30377 - DNA, 885 bp, Artificial Sequence
  Description of Artificial Sequence: Synthetic coding sequence
atgcctagatacgcccaactggtgatgggtcccgcgggtagtggaaaagtgcgcatttgtggtgacaaggaacgcaagtcgacctattgtgcgacaatggtgcagcattgcgaagcacttaaccggtccgtgcaggtggtcaatctcgacccagccgctgaacacttcaactacagcgtcatggcagacatccgagaattaattgaagtcgatgacgtgatggaggatgattcactccgcttcggcccaaatggaggccttgtcttttgcatggagtatttcgccaataacttcgactggctggagaactgcctgggccacgttgaagatgactacatcctcttcgactgtcccggacagattgagttgtacactcatctccccgtcatgaaacagctcgtgcagcaactggagcagtgggagttccgggtctgtggcgtgttcctggtagactctcagtttatggtggaatctttcaagtttatcagcggcattctggctgcattatccgcgatgattagcctcgaaatcccccaagttaacatcatgaccaagatggacctactcagcaagaaggccaaaaaagaaatagaaaaatttcttgatccggacatgtatagcttgctggaggatagcaccagcgacctcagatctaagaagtttaagaaattaacaaaagccatatgtgggctgatagacgactatagcatggtgaggttccttccttatgaccagagtgacgaggagtctatgaacattgtgttacagcatatcgacttcgccattcagtacggcgaagacttggaattcaaggagccaaaagagcgagaggatgaaagttcctctatgttcgacgaatattttcaggagtgtcaggatgaatag

SEQ ID NO: 30378 - DNA, 972 bp, Artificial Sequence
  Description of Artificial Sequence: Synthetic coding sequence
atgttgcctaaaacaaggggagcttttcatttttcgatccccgacccccagcatatttgtaagtcccggggcagcccctataggtctaacgtctgcacacagacaaccgaccgttcaacgtggcggaaggatgccgagctgtatctgctgagtgtcattacacagagtacctactgcgccaccatggtccagcactgtgaagcccttaatagatccgtgcaagttgtcaatctagatcctgcagcggaacacttcaactactcagtcatggcggacatcagagaacttatcgaggtggatgatgtgatggaggatgactctctgaggtttgggcctaacggtggactggtgttttgcatggagtatttcgcaaataacttcgattggctggagaactgtttgggacatgtcgaggacgactacatcctcttcgattgcccaggccaaattgagttatatacacacctgcctgtgatgaaacagctcgtgcagcagcttgagcaatgggagttccgcgtgtgcggcgtgttcctggtggacagccaattcatggtcgaatcttttaagtttatcagcgggatactggctgcgctctcagccatgatctcattagagatccctcaggtgaacatcatgacaaagatggatcttctgtctaagaaagccaaaaaggaaattgagaagtttttagatcccgacatgtactccttactcgaggattctacatccgatctccggtctaaaaagttcaagaagctgaccaaggccatatgtgggttaattgacgattactcaatggtgcgcttcctcccatacgaccagagtgacgaggagtccatgaacatagtactacagcacatagactttgcaattcagtacggagaagatcttgaattcaaagagccgaaggagcgggaagacgaaagctccagcatgtttgacgagtactttcaagaatgtcaggatgagtag

SEQ ID NO: 30379 - DNA, 2331 bp, Artificial Sequence
  Description of Artificial Sequence: Synthetic coding sequence
atgggcacagtgcccgatccactcagaagtgccaagactagtctgatcgccgcttctggcaaggaggatgatctgggtgaaccacaggccgctagcccacgacacaggccagctctgctgtgtaaaaacgctaatggattctccggagctcctgccgagcccgacctaagccctcgggctgcagccgaggcattaatgcaggtttgtgaacatgaaactacacagcccgatatgagtagtccgggagtcttcaacgaagtgcagaaggctcccgccacgtttaattccccagggaatccacagttgccagggtcaagccagccggccgccagcgccccttcaagtgccgcaggacgggacctgattcacaccccgctaaccatgcccgccaaccagcacacctgccagagcatcccaggcgatcagcccaacgccattactagctcaatgcctgaagattctctgatgagaagccagagaactagcaaccgggaacagcccgagaagcctagctgcccagtgggcggcgtcctgtcctcaagcaaagatcaggtatcttgcgaattcccatcccccgagacgatccaggggacagtgcagaccccagttactgcagcacgcgtcgtgtctcacagtagtagtccagtcgggggacctgagggcgaacggcaaggggccatttgtgatagcgagatgcggtcatgcaagcctttgactagggagtctggatgttctgaaaataagcagccaagcgtgaccgccagtggcccccaggggaccacctcagtgaccccccaacccaccccattaactagtgagccttctgcttgtccaccaggtcctgagaaggttcccctgcctgctcagcggcagatgagccgttttaaggaggcctccaccatgacgaaccaagcagaaagcgaaatcaaggaggtacccagtcgtgcgtggcaggatgctgaggtgcaagccgtcgcctccgtcgaaagccgttcggtgagcacctctccaagtatactcaccgccttcctgaaagagagcagggccccagagcacttcgaacaagagcaactgcgagtcatctgtcacagctccggaagccatacactcgaactgtcagactcaacgctagcaccccaggaaagctcacagtgtccaggaataatgcctcaagttcacattcaagccgccgcagctgaatccaccgcctttcaacgtgagaacaagctggccagcctaccaggcggcgtccttaagacgtcctcaattaacctggtgagctcaaacgctcagcacacatgcaaggaggatggaaggctggccggaatgacgcccgttcgtgaagagtctaccgctaaaaaactcgccggcacgaactcaagtagtctgaaggcgacggccatagatcagatctctatatccgcatgctctcaggctgaaacctcctacgggttaggaaaattcgaaacccgaccttccgaattcgcggagaaaacaaccaatgggcacaaaaccgatccagactgtaagctcagtgacagctgcggctcaatctcaaaggccgaccactccggttccctcgaccctaccaataaaggcgacgcgagagaaaagaagccagcttcaccccaggttgtgaaagaaaaggaatcaacagggactgatacatccgacgccaagaccctcctcctgaatccaaaaagccaggaaagcggggggaccgaatctgctgctaaccccacaccaagcccgattagaaagaaccaggaaagtacactggaagagaaccggcaaacaaagacagccactagtcttagcctgccatccgatccaatgggtgatagctctcccggatctggcaagaagactccctcgcggtctgtcaaggcttccccccgccgcccatcacgcgtgagcgaatttctcaaagaacagaagctgaacgtgacagcggcagcggcccaggtgggactgactcccggggacaaaaagaagcagctcggggctgattccaagcttcagttaaagcaaagcaagagggtgagggacgtcgtgtgggatgaacagggtatgacctgggaggtttatggagcttccttggatgccgagtctctgggtatagctattcagaaccacctgcagaggcagatcagagaacatgagaagctgattaaaactcagaattcccaaactcggaggagtatttcgtcggacaccagtagcaacaagaaactcaggggcagacaacactccgtgttccagtctatgcttcaaaacttccggcgcccgaactgttgtgtgaggccagccccctcctctgtgttggattag

SEQ ID NO: 30380 - DNA, 1299 bp, Artificial Sequence
  Description of Artificial Sequence: Synthetic coding sequence
atgaccgagctgcagcaggatgtggaggatacaaagcccgccaaggtcctcgggaaaagagaatccaaacttggatcagcccactccgaggccgaaaacggcgtggaggaaaaaaaaaaggcgtgtcgcagccccactgcccagagcccaacaccttcagtggaggctgacagtcctgaccagaaaaagataatcagcctatggagcaaaagcagtttcgacggggctagcctggctagcgacaagaatgactgtaagacagagtcaaagaatgatcctaaaacggaaagaaagaagagttcatcctcttcgcagtataaggcgaacatgcattttcacaagttgttcctgagtgtgcctactgaggagcctcttaagcagagctttacatgcgctctacagaaggaaatactgtaccagggtaaattgtttgtgtccgagaattggatctgctttcacagcaaagtgttcgggaaggacacgaaaatcagcatccccgcattctctgtgacactaattaagaaaaccaaaacggctctactcgtaccaaatgccctgatcatagccacagtcacagacaggtacattttcgtcagtttactgagtagagattcaacttacaagctgttgaaaagcgtgtgcgggcacctcgagaacacttccgtcggtaactccccaaacccctcttcggccgaaaattcctttagggctgaccgcccatcatcactgccattggattttaatgacgagtttagcgatctggatggtgtggtgcaacaacgtcggcaggacatggaggggtattcctcgtcagggtcccagaccccggaaagcgagaactcccgggactttcatgctacagagagccagaccgtgctgaatgtgtcgaaaggtgaagccaaaccaactcgggcggatgcccatgtcaaccgcgttcccgagggcaaagccaaatcactccccgtgcagggcctctctgagaccgtcggcatactgcataaagtgaagtcccaaaagtgtcctatgctgcatcacattctcatcttctacgccattgtggtgtgcgcgcttataatcagcacgttctacatgcgttataggatcaacactctggaggagcagctaggactgctgaccagcatcgtggatacacataataccgaacaagccgcaccctccgggctgagaagccaagtgcagttcaatgtggaggtcctctgtcaggaactgacggcaaacatagtcaagctcgaaaaaatccagaacaatttacagaaactgctggagaatggagactag

SEQ ID NO: 30381 - DNA, 1323 bp, Artificial Sequence
  Description of Artificial Sequence: Synthetic coding sequence
atgtggaagacccaatctctgcgcaaatgctccggccgaggccgcgctaatctggctcagcctactcaaaggctgcgaatggtgtggcgccgcaaacgcaagcctgctggtagacagcagcccaacccactgccacacttatggcgtaggacccctcagactcggaggaaatctctggcttacgctcacatcttcagccctaatctctgttttatccaagaccaggaatcaaagagcagcttcgacggggcctcattggcctcggacaaaaacgattgtaaaacagagagtaaaaacgaccccaagaccgaaaggaagaaaagttcctcgtcttcacagtataaagcgaacatgcactttcacaagttgttcctttccgtccctacggaggaacccctgaagcagagctttacctgcgcactccagaaagaaatcctctatcaaggtaagctgtttgtgtctgaaaattggatctgtttccacagtaaggtcttcggtaaggacacaaagatttctatccccgccttttccgtaactctgatcaaaaaaactaagaccgcacttcttgtgcccaacgccctgattatcgccactgtgaccgacagatacatcttcgtgtctctcctctcccgagattctacgtataagctgctcaagtccgtctgcggtcatctggaaaacacgtccgtgggaaactctccaaatcctagttctgccgaaaactcgtttcgggctgatagacccagcagcctacccctcgatttcaatgatgaattttcggacctggacggagtggtgcaacagaggagacaggatatggaaggctacagttcctccggcagccagactcctgaatccgagaattcccgcgattttcatgcaactgagtctcagacagtgctcaacgtaagtaagggagaggccaaacccacacgggctgacgcccacgtcaatcgcgttcccgagggcaaagcaaagtctttgccagtccagggcctaagtgaaactgtcgggatccttcacaaggtgaagtcgcagaagtgcccgatgcttcaccatatcctgatcttctacgccatcgtggtgtgcgccttgatcatcagtactttttatatgcggtataggatcaacaccctggaggagcagctgggtcttctgacttctatagtggatacgcataacacagaacaggctgccccctcagggttgcgatctcaagttcagttcaacgtagaggtgctctgtcaggaactgacagccaatattgtgaaacttgagaaaatccaaaacaaccttcagaagctgctggaaaatggggattag

SEQ ID NO: 30382 - DNA, 1116 bp, Artificial Sequence
  Description of Artificial Sequence: Synthetic coding sequence
atgaccgagctgcagcaggatgtggaggatacgaagccagcaaaagtcctcgggaagcgagaaagtaaactaggctcagctcacagtgaggccgagaacggagttgaagaaaaaaagaaagcgtgccgatctccgaccgcccaatctccgaccccttccgtcgaagccgactcaccggaccagaagaaaataatttcattatgcccttatctcctatccaaaagtatgctgcacagcggtccacgttacaaagctaacatgcactttcataaactcttcctgagcgttcccacagaagaaccactaaagcagagctttacgtgcgccctgcaaaaagagatcctgtaccaggggaagctgtttgtcagtgagaattggatttgcttccactccaaggtgtttgggaaggatacaaagatatctattcccgccttttcagtgaccctgatcaagaaaacaaagacagcactgttggtgcccaacgctcttatcatcgcaaccgttaccgatagatatatattcgtcagtctgctaagccgggatagtacatacaaattgctgaaatcggtctgcggccacttagaaaataccagcgttggaaacagtcccaatcctagtagcgccgaaaactcctttagagccgatagaccatccagtctcccgctggatttcaatgacgaatttagtgacctggatggagtcgtccagcaaaggcggcaggatatggaaggctattcttcatcgggctcccagacacctgaaagcgaaaactcccgggttgacttccatgcgacggaaagtcagacagtgttgaacgttagcaaaggggaggccaaacctactagggccgacgcacatgtgaaccgtgttccagaaggcaaggctaagtctcttcccgtgcagggtctgagcgaaacagtgggaatcctccacaaagtcaagtcacagaagtgtccaatgctgcaccacatcctcatcttttatgccattgtggtgtgcgcgcttatcatcagcaccttttacatgcggtacagaatcaacactcttgaggaacagctagggctcctgaccagcatcgtggacacacataacacggaacagcaccatttggcctag

SEQ ID NO: 30383 - DNA, 879 bp, Artificial Sequence
  Description of Artificial Sequence: Synthetic coding sequence
atgtccaaggttaagcggtttccctttttcttcagcagcgaggcggaaaatggagtagaggaaaaaaaaaaagcgtgccggtctccaacggctcagtctccaacaccgagtgtcgaggcagactctccagaccagaagaagataattagtttgtggtcgaagagcagcttcgatggagcctcattggccagcgacaaaaacgattgtaaaacagaaagtaaaaatgatccaaagacggaacggaaaaaatcttctagtagcagtcaatacaaagctaacatgcacttccataagcttttcctgtctgtgccgacagaggaacctctcaagcagagcttcacttgtgcactgcaaaaagagatcctgtatcaggggaaactgtttgtctccgagaactggatttgcttccacagcaaagtattcggcaaggacacaaaaatctccatccctgcctttagtgtgactcttattaaaaagaccaaaactgcgcttctagttcctaatgctttaatcatcgcaaccgtaactgacagatatattttcgtctctctgctctctcgggatagcacatacaaattactcaaaagtgtttgtgggcatttagagaacacgtcagtcgggaattctcccaacccctcatcagcggagaattctttcagggccgatagaccaagctccctccccctggatttcaacgacgagttctccgacctagatggagtcgtgcaacaaaggcgtcaggatatggagggatatagtagttccggctcccagacacccgagtccgaaaacagcagagactttcacgccaccgagagtcagaccgtacttaatgtaagtatcttcttgtactctatgcagctcctgagtgtccattag

SEQ ID NO: 30384 - DNA, 987 bp, Artificial Sequence
  Description of Artificial Sequence: Synthetic coding sequence
atgtacaaggctaatatgcacttccacaaattgtttctcagcgtgcccaccgaggaacctctcaagcagtcattcacttgtgctctccagaaagaaattttatatcagggcaagctattcgtgtccgagaactggatatgctttcattccaaagtatttggcaaagacaccaagatctccataccggcgttttcagtaacgctgatcaaaaaaactaagacagcgctgctcgtacccaatgccttaattattgccacagtcacggatcggtacatcttcgtaagcctgctgtcccgggacagcacttacaaactgctaaagtctgtgtgcggacacttggagaacaccagcgtaggaaattccccgaacccttcatccgccgagaacagcttcagggccgatagaccctcatcattaccgctcgactttaacgacgagttcagtgacctggatggggtggtgcaacagcgacgtcaggacatggaggggtattctagtagcggctcccagacacctgagtcagaaaattctcgtgattttcacgcaacagaatcccagacagtccttaacgtgtccaagggagaagcaaaaccgactcgagcagatgctcacgtgaaccgagttccagagggcaaggcaaaatcattacctgtccagggtttaagcgaaacagtggggatcttgcacaaggtgaaatcacaaaagtgtcccatgttgcaccatatcttgattttttatgcaatcgtagtgtgcgccctgatcatttccacgttttatatgaggtacagaattaacacattagaggagcagctcggactgctgacgtccattgtggacacccataataccgaacaggcagcaccatccgggctaagatcccaggtgcagtttaacgtggaggttctctgccaggagctcactgcaaatatcgtaaagctagaaaagatccagaataacctgcagaagctgctcgagaatggggattag

SEQ ID NO: 30385 - DNA, 1251 bp, Artificial Sequence
  Description of Artificial Sequence: Synthetic coding sequence
atgagcaaggttaagagatttcctttctttttctcatccgaagccgaaaatggtgtcgaagagaaaaagaaggcgtgtaggtctcctacagcgcaatctccaacacctagtgtggaagcagatagccccgaccagaagaagattatctctctctggagtaaatccagtttcgatggggccagccttgcctccgataaaaacgactgcaagacagagagcaagaacgatcctaagacagaacgtaagaagagttccagttcatcccagtataaagccaatatgcactttcataaattgttcttaagtgttcctacggaagaacctttgaaacagagcttcacatgtgcattgcagaaagaaatcctttaccagggtaagctgttcgtgagcgagaattggatctgtttccacagtaaggtcttcggtaaggacacaaaaataagcatccccgctttttctgtcaccttgattaagaagactaagactgctcttctggtgcccaatgctcttataattgccaccgtcacagatcgatacattttcgtgagtctcctctcaagagattccacttacaagctgctcaagagcgtttgtggccatctggagaataccagcgtggggaacagccctaacccaagctctgctgagaacagttttcgagctgacaggccatcctctctcccactggattttaacgatgagttctctgatctggacggggtggtccagcagaggcgtcaagacatggaaggatattcctctagcggcagccaaacccctgagtccgagaattctagagacttccatgccaccgaaagccagacggtgctaaatgtctcgaagggagaggcgaagcctactcgggcagacgcccacgtgaaccgagtccccgaaggcaaggctaaatcgttgccagtccaaggactgtccgagacagtcgggatcctgcacaaagtgaagagccagaaatgtccaatgctccatcacattctgatcttctacgccattgttgtttgcgcattaatcatatctaccttctacatgcgatatcggattaatacccttgaggaacagctcggtctgcttacgtcaatcgttgatactcacaatacagagcaggccgcaccaagtggcctgaggtcccaggtccaattcaacgtggaggtgctgtgccaagagctgacagcaaatatagtgaagctcgagaaaattcagaacaatctccagaagctgctagaaaatggcgattag

SEQ ID NO: 30386 - DNA, 1344 bp, Artificial Sequence
  Description of Artificial Sequence: Synthetic coding sequence
atgacgcggaggcagcaggtccttcaagcgaaaagaagtattcagcagacttttcaggctcaattgatgccatggaagagtatgttccacggccgcgaggtcaagccagtgggtcccgacctggagctgtccgaggcagaaaatggcgttgaagaaaaaaaaaaggcatgtcgaagccccaccgcccagtctccaaccccgtcggtggaagcagactctcctgatcagaagaaaatcattagcttatggtccaaaagctcttttgacggagcgagtctggcttcagacaagaacgattgtaagaccgagagtaagaatgatccaaagacggagcgcaaaaagtcgtcctcttccagtcaatataaagccaacatgcattttcataaactgttcttatctgttcctacggaagagccactgaaacagtcctttacctgcgccctccaaaaagaaatactgtatcagggaaagctgtttgtgtctgagaattggatctgtttccactcaaaagtgttcggcaaagacaccaagatctctattcccgctttctccgtgacgctgataaagaagacgaagacagcccttctcgtccccaacgcgctgattatcgcaacagtaaccgacaggtacatcttcgttagcctgctgtcccgggatagtacctacaagctgctgaaatcagtctgtggacatctggaaaatacatccgtcggcaacagcccaaacccctctagtgcggaaaatagtttccgtgccgaccgcccctcttccctgcctcttgatttcaatgacgaatttagtgacctagatggcgtggtgcaacagcggcggcaggatatggaaggatatagcagctccggctctcagacaccggaaagcgaaaactcaagagactttcatgcgaccgagagccaaactgtcctgaatgtttcaaaaggagaagcaaaacctacaagagctgacgcgcacgtcaatcgcgtccccgagggtaaagctaagtcacttcctgttcagggactgtctgagactgtgggcatactgcacaaggttaaatcgcagaagtgtcccatgctgcatcatatcctgatattctacgccatcgtggtatgcgccctcataatttctactttctatatgcgatatcgcattaataccctagaagagcagcttggattgctgacctccatcgtggacacacacaacacagagcaagcggctccctctggattgcgaagccaggttcagtttaacgttgaggttttgtgtcaggagctgacagctaatattgtcaagcttgagaaaattcaaaacaatctccaaaagctgttggagaatggtgactag

SEQ ID NO: 30387 - DNA, 1761 bp, Artificial Sequence
  Description of Artificial Sequence: Synthetic coding sequence
atgtccgcaggcgatgctgtgtgcacaggctggctggtaaagtctccacccgaaagaaaactgcagagatacgcctggcgaaagcggtggttcgtactgagaagagggcggatgtccggcaaccctgatgtccttgaatattatcggaataaacatagctcgaaaccaatcagggtgatcgatctgtccgaatgtgctgtctggaagcacgttggaccttcattcgttagaaaagagtttcagaacaactttgtcttcattgtgaagactacctcaaggacattttacctggtcgcaaaaaccgaacaggagatgcaggtttgggtgcactccatttcacaggtctgcaatttgggacaccttgaggatggagccgattccatggagtccctgagctacaccccttcttcactgcagcctagctcagcatcaagcctgctcaccgcacacgccgcaagcagcagtttgcccagggacgaccctaacaccaatgctgtcgcaaccgaggaaacacggagcgaatccgaactgctgttcctgccggactatctggtactgtcgaattgcgaaaccgggcgcctccatcatacatcccttcctactaggtgcgatagctggtcaaacagcgacagaagtctcgaacaggcttcattcgacgatgtgtttgtggactgcctgcagcccttgccctcgtcacacctggtccacccttcttgccacggatcgggcgcccaggaagtgcccagcagccgtccccaggccgcattaatctggtcacgggaaattaacggcccaccacgggatcatctgagttcttccccactgctcgaatcctcccttagtagtactatccaggtggacaaaaaccagggctccctgccgtgcggagccaaagagctcgatatcatgagcaacacccctccaccccggcctcctaagccctcacacctgagtgagcgtcgccaagaggaatggtccacccatagtggaagtaaaaaacccgaatgcacattagtgccccggagaatctctctgtccggtttggacaatatgcgcacgtggaaagcagacgtcgagggtcaatcccttcgacaccgtgataagaggctgtccctcaacctcccatgtcgcttctctcccatgtacccaacagcgtcggccagtatcgaggattcctacgtccccatgtcccctcaggccggcgctagcggcctcgggcctcattgttctcctgatgactatatcccaatgaacagcggtagcattagctccccacttcctgaactgcccgccaacctcgaaccccccccagtcaacagagacctgaaacctcagcgtaagtctagacctccacccttagatctcagaaaccttagtatcatcagagagcatgcaagcctaacaagaaccaggaccgtcccatgcagtaggacaagtttcctatctccggaacgaaacggcatcaatagcgcacgattttttgcgaaccctgtctcccgggaagatgaagagagctacattgagatggaggagcaccggaccgcttcctccctgtccagcggtgctttaacctggacgaaaaagtttagccttgactaccttgccttagatttcaactccgcatcacccgcgcccatgcagcagaaacttctcctctccgaggagcaacgggtcgactacgtgcaggtcgacgagcagaaaacacaggcccttcaatccacgaagcaggagtggacggatgagcggcagtccaaggtctag

SEQ ID NO: 30388 - DNA, 1764 bp, Artificial Sequence
  Description of Artificial Sequence: Synthetic coding sequence
atgtccgcaggagatgccgtttgtacaggatggctcgtgaagagtccccctgagcgcaagctgcagagatacgcatggagaaagagatggttcgtgttgcggagagggcgcatgtccggaaaccccgatgtcctcgagtactatagaaataaacactctagcaagcccattcgcgtcatcgatctgtcagagtgcgctgtatggaagcatgtcggaccctcgtttgttcgaaaagagttccagaacaacttcgtgttcatcgttaaaacgacgtcaagaaccttctaccttgtggccaagaccgaacaggagatgcaggtgtgggttcatagtattagccaggtctgtaatttggggcatttagaggatggggccgcagactccatggagtccctatcttacacgccatctagtctgcagcccagtagcgcatcttccttgctgactgcccacgctgcctcctcatcactccctcgggacgatcctaatactaatgcagtcgcaacagaggagacacgtagtgaatccgaactgcttttcctacctgattacctggtgctgagtaactgcgagactggacgcctccatcatactagtctgcccaccaggtgcgacagctggtccaactcagataggtccttggagcaggcttccttcgatgatgtgtttgtggattgcctccagccgctgccttcttctcatcttgtccacccgagctgtcacggctctggtgcccaagaggttccatcctctaggccacaggccgctctaatctggtccagagagattaatggaccacctcgcgatcatctgtctagttccccactgcttgagagctccttgagttcgaccattcaggttgacaaaaaccaaggatccctcccgtgcggggcgaaggagctggatataatgtccaatacgccaccacctagacctcccaagcctagccacctgtctgagcggcgccaagaagagtggtccacacatagtggctctaaaaaacctgaatgcacactggtcccccggaggatctcactctctggactcgacaacatgcgcacctggaaggctgatgtagaaggccagagtctgcgtcatcgtgacaagagattatccttgaatctgccatgtcggttctccccaatgtatcccaccgctagcgccagcatcgaggatagctatgttccaatgtctcctcaggccggtgccagtggcctcggccctcactgctctccagatgactatattccgatgaactctggcagcatttcatcgccgctgcctgagctgcccgcaaatctagagcccccccccgtgaatcgtgatctgaaacctcagcgtaagagtaggccaccccctctggatctgcgaaacctctccatcatcagggagcacgcaagtcttaccagaactaggactgtgccttgttccaggacttcattcctgagccccgagcgaaacggaatcaatagtgctaggttctttgccaatccagtgtcaagagaggatgaggagtcctacattgagatggaggagcacaggactgcctcttccctgtctagcggagctcttacctggaccaaaaagttttctctggattacctggccctcgacttcaatagtgcctccccggcaccaatgcagcagaagttattgctcagtgaagaacaacgcgtagattatgtacaggtggacgaacagaagacacaggccctgcaatccaccaaacaggagtggactgatgagcgccagagcaaagtgtag

SEQ ID NO: 30389 - DNA, 1725 bp, Artificial Sequence
  Description of Artificial Sequence: Synthetic coding sequence
atgagtctgccaagtccatcaccatcacgagagctgtgccccccagatccagctttcgcacccctatcatcatggcccgggtccggcccagccggtggttctactcgcagcggacacgtgctgtacagcggctggttgcgaaagtcccctcctgaaaaaaaacttcgcctcttcgcctggagaaagcgctggttcatactgagaagaggtcagacgagctccgaccctgacgtactggaatattacaaaaatgatgggtccaagaagcctctaagaactatcaacttgaacctgtgtgaacagctcgatgtcgatgtgaccttgaatttcaataaaaaggagatccaaaagggttatatgttcgacatcaaaacgtctgagcggacattctatctggtcgcagaaacgagagaggacatgaacgaatgggtgcaaagcatctgtcaaatctgtggcttcaggcaggaggagagcacgggattcctgggcaatattagctccgcctcccatgggctgtgctctagcccagcggagccatcctgttcccatcaacacttacctcaggaacaggagcccacttccgagcccccagtttcccattgcgtgccccccacctggcccatcccggcaccgccaggctgtctgagatctcaccagcacgcaagccagagagcggaacatgcacgcagcgctagctttagtcaggggtctgaagctccgttcataatgaggcggaatacagcaatgcagaatctcgcccaacattctggctacagcgtggatggcgtatccggacacattcacggcttccatagcttgagcaaaccttcccagcacaatgcggaattccggggaagcactcaccgaatcccatggagtctcgcttcacacggccacacccggggctccctgaccggaagtgaggcggataatgaagccagtagtggcaagtacactcagcacggtgggggcaacgcttctcggcccgccgagtccatgcacgagggagtgtgctccttcttgcccggcagaacactcgtaggtctgtctgactccatcgcctctgagggaagctgtgtgccaatgaatcctggaagcccaactttgcccgcagttaagcaggcgggggatgacagccagggtgtctgtatccctgtaggatcctgcctggtacgctttgacttactcggatcgccactgacagagctatctatgcatcaagatctctcacagggccacgaagtacaactgcctccggttaataggtcactgaaacccaaccagaaagctaatcctaccccccccaatctgaggaacaaccgcgttatcaacgagctgagcttcaaaccgccagtcaccgaaccttggagcggcactagccacacattcgatagttcatccagccagcatcctatcagcacccagtctataacgaacaccgactccgaagattccggcgagcggtatctcttccccaaccctgcgagcgcgtttccggtgagcggaggaacctcttctagtgcccccccaagaagtacgggaaatatccactacgctgcgcttgactttcaaccatctaagccctccatcggatctgtgacctcgggaaagaaagtcgattacgttcaggtggacctggagaagacacaggctctgcagaaaacaatgcacgagcagatgtgtctgagacaaagtagtgagccccctcggggtgcaaagctttag

SEQ ID NO: 30390 - DNA, 357 bp, Artificial Sequence
  Description of Artificial Sequence: Synthetic coding sequence
atggagtccgtggccctgtactcattccaagctaccgagagcgatgagcttgccttcaacaagggagacaccctcaagattctaaatatggaggacgatcaaaactggtataaggccgagctccgtggtgtggaagggttcattcccaagaattacatcagagtgaagccacacccatggtattcgggaagaattagcagacagcttgccgaagaaattctgatgaagcggaaccacctgggagcttttctgataagagaatcagagtcgagccctggggaatttagcgtcagcgttaataaccgggctcagcggggcccatgcctcggccctaaaagtcacagccgactgggctag

SEQ ID NO: 30391 - DNA, 567 bp, Artificial Sequence
  Description of Artificial Sequence: Synthetic coding sequence
atggaggacgatcagaattggtacaaggctgaattacgcggtgtcgaggggtttatacccaagaactacattagggtgaaaccacatccatggtacagtggtagaatttcgaggcagctggccgaagagattctgatgaaacgaaaccatcttggtgcattccttattagggagagcgagtccagcccgggtgagttttcagtgtcggtgaattatggagaccaagtgcagcactttaaagtcctgcgagaagcctcgggaaagtattttctttgggaagagaagtttaactcattaaatgagctggtcgatttttacagaacaacgactatcgccaagaagcggcaaatctttttgcgggatgaagagccgctgttgaagtcccctggtgcctgttttgcccaagctcaatttgatttcagcgcccaagacccgagccaactgtcctttagaagaggagatataattgaggtgctagaaaggccggaccctcactggtggcgcgggcggtcatgcggcagggtcggatttttcccacgctcatacgtgcagccagtgcacctatag

SEQ ID NO: 30392 - DNA, 123 bp, Artificial Sequence
  Description of Artificial Sequence: Synthetic coding sequence
atgcttttacgggaaataacatactccattactcccctgagcctgcatggcacctccctgctgaattgcaattggagagccactggacttgtgacactggaagggcacaggccttttcagtag

SEQ ID NO: 30393 - DNA, 801 bp, Artificial Sequence
  Description of Artificial Sequence: Synthetic coding sequence
atggtcctgtctggcgcccaggcccaaatggaccaaaacccggggtattatcaccaactcttacaaggcgagcgcaacccccggctggaagatgccatccgtaccgacctaaatcggactttccccgacaacgtgaagtttagaaagaccaccgatccttgccttcagagaacattgtacaacgtgctcctggcctacggtcaccataatcagggcgtcgggtattgccagggcatgaactttatagcgggctacctgatccttattactaataatgaggaggaatccttttggctgcttgacgctctagtgggccggatcctccctgactactacagcccagccatgctgggtctcaagaccgatcaggaagtgctcggcgaattagtgcgcgcaaagctgccagctgtcggggcattaatggaaaggctcggggtgctttggactctgctagtgtccaggtggttcatatgtctctttgttgacatcctgcccgtcgagactgtcctacgcatatgggattgcctgttcaacgaaggatccaagattatctttagggtggccctgacacttattaagcagcatcaggaactgatcctcgaggcaacgtcagtgcccgacatctgcgataaattcaaacagattaccaagggtagttttgtcatggagtgtcacacctttatgcaggtgtgtggggctgcaagaggttctgtcccttcccaaggagccccacctcacttacagcctggcggctgctcagaccaccccgaaggggcacaggatgggcatcaatgggcttag

SEQ ID NO: 30394 - DNA, 1035 bp, Artificial Sequence
  Description of Artificial Sequence: Synthetic coding sequence
atgcaaccggcggaacgaagccgcgtgccccgaattgatccctacggattcgagcggccagaggactttgatgacgcagcatacgagaagttcttttcttcctacctcgtcactttgacaaggagagcaattaaatggtcccggcttttgcagggggggggcgtcccccgtagccggacagtgaagagatatgtcaggaaaggggtgcctttagaacacagggcgcgggtgtggatggtgctgtcgggggcccaggcacaaatggaccagaaccctggatattatcaccagctgctccagggggaacggaacccaagattggaggatgccatacggaccgatttgaatcgaacattccccgacaacgtcaagtttagaaagacgactgacccctgcctccagcggactctgtataacgtgcttctggcgtatggacaccataatcagggcgtaggttattgccaaggaatgaacttcatcgccggatatttgatcctcatcaccaacaatgaagaggaaagcttttggctcctggacgcactggtaggtcgcattttgcctgattattattctcctgcaatgttgggtctgaagaccgatcaggaagttctgggggagcttgttcgcgcgaaactacctgcagtaggtgctctcatggagaggttgggagtgctctggaccctcctcgtcagccgttggtttatctgtctgttcgtggacatactccctgtcgagaccgtgctcaggatatgggactgtctgtttaacgaggggagtaagatcatctttagagtagcattgacccttattaagcagcaccaggagctaatactggaggctacctccgtgcccgatatctgtgataaattcaaacagatcactaagggtagttttgtcatggaatgccataccttcatgcaggtgtgcggtgccgcaaggggttctgtgccctcccagggggcacctcctcacctccagcccggcggctgctctgatcatcctgagggagcacaggacggtcatcagtgggcatag

SEQ ID NO: 30395 - DNA, 1011 bp, Artificial Sequence
  Description of Artificial Sequence: Synthetic coding sequence
atgcagccggctgaacggagtcgcgtgcccagaatcgatccctacggttttgagagaccagaggatttcgacgacgctgcctacgagaaatttttcagttcttacctggtcactttaactcggcgggccattaaatggagtcgccttctacaaggtggaggcgtgccacggagtcgtacagtgaagaggtatgtgaggaaaggggttcctctggaacacagggcaagagtgtggatggttctcagcggagcacaggcccaaatggatcaaaatcctggttactaccatcaactattacagggagagcggaacccccgactggaggacgctattcggaccgacctgaatcggaccttcccagataacgtgaaattcagaaaaactacggatccttgtttacagcgtacgctgtataacgtgctattagcttacggccaccataatcagggagttggctattgccagggcatgaatttcatagccggttatctcatcctcattaccaacaacgaggaggagtccttttggcttctggatgccctagtcggccgcattcttccggactattactctccagctatgttgggactgaaaacggatcaagaggttctcggcgaactggtcagagccaaactgcccgccgtaggagccctgatggagcgattgggtgttctgtggactctgttagtttcccgatggttcatatgcctgttcgtagatattctccccgtggaaactgtgctgagaatctgggattgcctcttcaacgagggttcaaaaataatatttcgggtggcattaactctgatcaaacagcaccaggagctgatcctggaggccacgtccgtgccagatatctgcgacaagttcaaacaaattacaaaaggctcctttgtaatggaatgtcacaccttcatgcagaaaatcttttcagagcccggttctttatctatggccacagttgccaaattaagggagtcatgccgcgctcgcctccttgctcagggctag

SEQ ID NO: 30396 - DNA, 3654 bp, Artificial Sequence
  Description of Artificial Sequence: Synthetic coding sequence
atgaaaggtatgtcccacgagccgaagagcccctcgttgggcatgctgagtaccgctacccggacaactgccactgtaaaccccctcactccttcgcccttgaacggggccttagtgccatccggcagcccagcgactagcagtgctttatctgcccaggccgccccatcttccagtttcgcagcagccttacgaaaactggccaagcaggcagaggagccccgtgggtctagcctctcatccgaatcttcacctgtgtcttctcctgccacgaaccattcgtcaccagcaagcactccaaagcgcgttcctatgggacccattattgtcccccctgggggtcatagtgtgccgtcaactccccccgtcgtgactattgcccctacgaaaacagtgaacggcgtctggagaagcgaaagccgacaagacgccggatctcgttctagttccggaggaagagaacggctgattgtggagcccccactgccgcaggagaaggctggcggacctgcaattcctagccatctcctttccacgccatacccattcggcctgtcccccagttcagtggttcaggatagtcgcttccccccactcaatttgcaaaggccggttcaccatgtggtgcccccctctacagtcaccgaggactacctgcgatcttttagaccatatcatacaaccgacgatctgcgcatgtcttctctgcctcctcttgggctggaccctgctactgcagccgcctattaccacccatcctacctggcaccacacccattcccccatccagccttcagaatggatgactcatattgcttgagtgccctaagatcccccttctaccccattcccacccctgggtccctgccacccttacatccaagcgcaatgcacttacatttgtcaggcgtcaggtatccccccgagttgtctcacagctcactggctgccctccacagcgagaggatgagcggcttatctgcagagcgtttacagatggatgaggagctccggagagagcgggagagggaacgggaaagggaaagagagcgtgaagctgaccgagagcgcgagaaagaacgtgagagagagcgggaaaaggagcgcgaacaggaaaaagagcgagaacgagaaaaagaacgggagcgggaactggaaaggcagcgtgagcaaagagccagggaaaaggagctgctcgcggccaaagcactggagccatccttcttaccagtcgcggaactccatgggctgagaggtcacgctaccgaagaaagaggcaaaccttctgaacagcttacgcctacccgcgcggagaagctgaaggatgcagggttgcaggcccctaagcccgtgcaacatcctctgcatcctgtacctacaccacaccacactgtgccaagcttgatctccaaccacgggatattctctcttccttctagttctgctgccacggccctgctcattcagagaactaatgaagaagagaagtggttggccagacagagaagattgcgacaggagaaggaggaccggcagagtcaagtgagcgaattccgccaacaggtgctcgaacagcacctagacatgggcagacctcctgttcccgccgaagcggaacatcggcctgaatcaacaaccagacccggacctaaccgtcacgaaccgggtggcagagatccccctcagcacttcggtggaccgccacctttaatttcccccaaaccccagctgcacgcagcccccaccgcactatggaatccggtgtccctgatggataacaccctcgagacccggcgagctgaatcccactccctgcactctcatccagcagccttcgagccatctcgccaagctgcagtaccactagtaaaggtagaacgggtgttctgccccgagaaagccgaagaaggacccagaaagcgtgagcccgctccactcgacaagtaccaaccccctccacccccccctcgggaggggggctcgctggagcatcagccctttctaccaggccctggtccatttctcgctgagctcgagaaatccacccagaccatcttgggacaacagcgggctagtctgccccaagctgcaactttcggggaactgtccgggccgcttaagcctggcagcccgtacaggccccccgttccacgggcccctgaccccgcttacatctacgacgagtttctccagcagcggaggcgtcttgtcagcaaactcgatcttgaggagcgacgaagacgagaggctcaggaaaaaggctattattatgatctggatgactcttacgatgagagcgatgaagaagaggttcgtgcgcacctcagatgcgtcgcggagcaacccccactgaagctcgacacctcttctgaaaagctcgaatttttacagctcttcgggctgaccacacagcagcagaaagaagaacttgtcgctcagaaacgccggaagaggcggcgcatgctgcgcgaacggtctcccagtccccctacgatacagtcaaaaaggcaaactccttctccaaggctggctctcagtacaaggtatagtcctgacgagatgaataacagccctaatttcgaagagaagaaaaagttcctgacaattttcaatcttactcacatttcggccgagaaacgcaaagacaaggagcggttggtcgaaatgctgcgagccatgaagcagaaagccttgagtgcggcagtggccgatagcttgactaacagccccagagacagccctgccgtatcactatcggagccagcaacacagcaggcatctttagacgtcgagaaacccgtcggcgtcgcggccagcttatccgatatccccaaggctgcagagccaggcaagcttgagcaggtgagaccacaggagctttcgcgagtgcaggagttggctcccgcatccggggaaaaggctaggctctccgaggcccctggaggcaaaaaatcgttgagcatgctgcactatataagaggcgctgcaccgaaagatatccccgtgcccctgtcccacagcacaaatggcaaatccaagccttgggagccttttgtggccgaagagttcgcacaccaatttcatgagtccgtgttacagagcacccagaaagccctacagaaacacaaagggagtgtggctgtgctgagcgccgagcagaaccacaaggtggacacttctgtccactacaacattcctgaactgcagtcttcatcgagagccccaccgccccagcacaacggccaacaggagccacctaccgcaagaaaggggccgcccacacaagaactagaccgagactctgaagaggaagaagaagaagatgatgaagatggcgaagacgaagaagaggtaccaaagcggaagtggcaggggatagaggctgtgtttgaggcttaccaagagcatatagaggagcagaatttggagcgccaggtactccaaactcaatgtagacgtttagaggcacgacactactctctatcactgacagctgagcaactgtcgcattccgtggcagagttacgctcccaaaagcaaaaaatggtgagcgaaagagaacggctgcaggccgagctagatcaccttcgcaagtgcctggcactcccagcaatgcactggcccagagggtacttgaagggctatccccgatag

SEQ ID NO: 30397 - DNA, 3342 bp, Artificial Sequence
  Description of Artificial Sequence: Synthetic coding sequence
atgggcccgatcatcgttccccctgggggtcactcagtccccagtacaccacctgtggtaacgatcgcacccaccaagacggtgaatggagtgtggagaagcgagtctagacaggacgccgggtcccgctcctccagcgggggaagggaaagactgattgtcgagccacccctgccccaggaaaaagcgggagggccagcgatcccctcccacttgctgagtacaccttatcccttcggtctaagccctagctcagtcgtgcaggactcacgatttccacctcttaatttacagaggcccgtgcaccacgtggtgcccccctctaccgtaaccgaggactacctgcgctcattcagaccgtaccacacaaccgatgacctgcgaatgtctagtctgccgcccctcggcctggaccccgccactgctgcagcgtattatcacccttcttatctggcccctcatccgttcccgcacccagcgtttagaatggacgattcctattgcttgtcagctctgagatccccattctaccctattcccaccccaggttctctccccccacttcacccaagtgcgatgcatcttcatttgagcggcgtgcgttaccctcccgagttgtctcattcctccctggcggcccttcactccgagcgcatgagtggcctgtctgctgaacgactgcagatggatgaagagctgcgccgggaaagggagcgtgaaagggaaagggagcgcgagcgggaggcggaccgcgagagagagaaggagcgagaaagagagcgcgaaaaggagcgtgaacaggagaaagaaagggagagagaaaaagaacgcgagagggagctcgagcgtcagagggagcaacgggctcgagagaaagaactgctcgctgcgaaggcactggaacctagcttcctgccagtggcagaactccacggactgcggggccacgcaactgaggagaggggaaagcctagcgaacagctgactcctaccagggcagaaaaactaaaagatgctggactgcaagctcctaagcctgtccaacaccccctgcatcccgttcccacccctcaccatacggttccttcactgatcagcaatcacggaatttttagtctacccagttcgtcggctgcaacggctctcctgattcaacggactaacgaagaggagaagtggctggcaagacagcgacggctgcgtcaagagaaagaggacaggcagtcccaagtgtccgaattcaggcagcaggtcttggagcagcaccttgatatggggcgaccacccgtgccagccgaggccgaacatcggcccgagtcgacaacacgtccaggacccaatcgccacgagccgggaggacgggatccaccgcagcattttggtgggccccccccactcatctcccccaagccacagcttcatgccgctccaacggcgctatggaatcccgttagtttgatggacaacacactggaaaccagaagggcagagagccattctctacactcgcacccggcagctttcgagccttcccggcaagctgctgtgccattggtgaaggtggaacgggttttttgccctgagaaagccgaagaaggaccacgaaaacgcgagcccgctcctctcgacaagtaccagccacccccccccccccctagggagggaggaagtttagagcaccagccattcctgcccggaccaggaccattcctggccgagctcgagaagagtacccaaactattctgggacaacagagggcgtcactccctcaagccgcaacctttggggaattgtccggcccgcttaaacctggctctccttatagacctcctgttccacgggcacccgaccctgcctacatctacgacgagttcctgcagcagcgcagaagattagtgtcgaaactggacctagaggagagacggaggagggaggcgcaagaaaaaggctattattatgatctggacgactcttatgacgagagcgatgaggaggaggttagagcacatttacggtgcgtagccgaacagcctcccctgaaacttgatactagttccgaaaagttggagttcctgcaactgtttggacttaccacccagcagcagaaagaggagctggtcgctcaaaagagaagaaagcgcagacgtatgttgcgggaaaggagcccctctcctcctacaatccagagcaagagacagaccccctctcccagactagccctcagcacccgctactcgcctgatgagatgaacaatagccctaatttcgaggaaaaaaagaaatttctgactatctttaacctcacccacatctctgccgaaaaacgaaaagacaaggaaaggctggtagagatgctgagagctatgaagcagaaggccttgagcgcagccgtcgcggactctctaactaacagccctagagacagcccggccgtctctctgtctgagcctgctactcaacaggcatcactcgacgtggagaaacctgttggcgtggctgctagcctgagtgatatcccaaaagccgccgaaccggggaagctagagcaggtaaggcctcaggaactgtctagagtgcaggagctggcacccgcctcaggggagaaagctaggttatcggaggctcccgggggcaagaagagcctatctatgctccactatattcgaggcgcagcaccaaaggacatccccgtgccgttgtcacactcaacgaacgggaagagcaaaccttgggagccgtttgttgcagaggagttcgcccatcaattccacgaaagcgtgttacagtcaacccagaaggctctgcagaaacacaagggctctgttgcggttctcagcgccgaacagaaccacaaagtggatacgtccgtccactacaacatcccagagctccagagctcgtctagagcccctcctcctcagcataatggtcagcaggagcccccaaccgctagaaaagggccccccactcaggaactggaccgcgatagcgaagaagaggaagaagaagatgacgaggacggcgaggacgaagaggaggtgcctaaaaggaagtggcaaggcatcgaggctgttttcgaagcctatcaagagcacattgaagagcagaacctggaacgacaggtactccagacacaatgcagacgcctcgaggctcgtcactattcactttctctcacagctgagcagctcagtcactctgtggctgagctgcgctcccagaagcagaaaatggtgagtgaacgtgaacggttacaggccgagctcgatcatttgaggaagtgcctcgccctgcccgcgatgcactggcctcggggctatctgaaggggtacccccgatag

SEQ ID NO: 30398 - DNA, 2463 bp, Artificial Sequence
  Description of Artificial Sequence: Synthetic coding sequence
atggtggtggatttctgccgcagattcgtggctcgatccctttgtatcatcctgatgaagcacttctgctccagctctgtttcagaagacctgggctgtcgcaggggcgatttttcgcgcaagcattacggcagtgtggaactgttaatttcatcagacgccgatggagcaattcaacgagcaggcaggtttcgggtagagaatgggagctccgacgaaaatgccactgccttgcccggcacgtggcggaggacagacgtgcatctcgaaaatccagagtaccataccagatggtacttcaagtattttctgggccaagtgcaccaaaactacatcgggaatgacgccgaaaagtcccctttctttctttctgtcacactgagcgatcaaaataaccagcgggttccccaataccgtgcaatcttgtggagaaagaccggaactcagaagatttgtcttccctatagccctactaaaacattgagcgtaaagtccatcctaagcgcaatgaacctggataaattcgagaagggtccgcgtgagatattccatcccgagatacagaaagacctgctagtcttagaagagcaggaaggaagcgtaaactttaagtttggagtcctgtttgccaaggacggtcaactgaccgatgacgaaatgtttagcaatgagataggcagtgagccattccagaaatttcttaacttacttggcgacacaattaccctgaaagggtggacgggctatcgaggtggcctggatacaaaaaatgatactaccggcattcacagcgtctacactgtgtaccaagggcatgaaattatgtttcacgtttccacgatgctgccttattccaaggagaataagcagcaagtggagcggaaaaggcacatcggtaacgacatcgtcactatcgttttccaggaaggtgaagaatcatcaccagcgttcaaaccttcgatgattcgatctcattttacccacatctttgcacttgtaagatacaatcaacagaatgacaattacaggctaaagatcttctccgaagagtctgtccctctcttcgggcctccactccctaccccgcctgtctttaccgatcatcaggagtttagggattttttgctcgtgaaactgataaacggggaaaaggctaccctggagacccccacatttgctcagaagcgccgtcgaaccctggacatgcttatccggtcgctgcaccaagacctgatgccggacctacacaagaacatgctcaataggcgatcatttagcgacgtgctgccagaatcccccaagtctgcacgtaaaaaagaagaggctcgacaggctgagttcgtgcggatagggcaggctttgaagttgaagtctatcgtgaggggtgacgcgccatccagtctggcagctagcggtatctgtaagaaggagccgtgggagccgcaatgtttttgctccaactttccacacgaggcagtttgcgccgatccatggggtcaggcactgctggtgtccaccgacgccggggtgcttttggtggacgacgatctgccctccgtccccgtattcgaccgaactctgcccgtgaaacaaatgcacgtactggagacactggatctcttggttctccgggccgataaaggaaaggatgctaggctgttcgtgttccgcttaagcgccttgcagaaaggcctggaaggcaaacaggccgggaagtctaggtcagattgccgagaaaacaagctggagaagaccaaagggtgtcatctatatgccatcaacacccaccactccagggagctgcggattgtcgtagccattagaaacaagcttctcctgataacgcgcaaacataacaagccctctggcgtgacgagtacctcactcttaagccccctctctgaaagcccggtggaggagttccaatatatcagggagatatgcctcagcgattcacctatggttatgacattggtagacgggcctgccgaggaaagcgataatctgatttgtgtagcctacagacatcagttcgatgtcgtcaacgaaagcaccggcgaagcatttcgcctgcaccacgtagaggccaaccgcgtaaattttgtggccgctatcgatgtgtacgaggacggcgaggccggcctcttgctgtgttacaactatagctgcatttataagaaagtgtgcccttttaacggtggcagtttcctggtgcaacctagtgcatctgacttccagttctgttggaatcaagctccatatgccattgtgtgtgcttttccttacctgttggcttttacgaccgattcaatggagattaggttagtggtgaatggcaacctcgtgcatactgcggtggtgccacaactccagctggtggcgtccagagtcaaattcaaccagaagatatgtacaagattccacctggagacctcctgggccgaagctagtaatgatctatag

SEQ ID NO: 30399 - DNA, 3042 bp, Artificial Sequence
  Description of Artificial Sequence: Synthetic coding sequence
atggtcgtcgacttttgccgaaggttcgtcgcccgctcgctgtgcatcatcctgatgaaacatttctgttcatccagtgtttccgaagacttggggtgtaggcggggggacttctctagaaagcattacggcagtgtcgagctgctgatatcctcagatgctgatggtgccattcagagagcaggtagatttagggtggaaaacggttctagcgacgaaaatgctaccgctctcccaggcacctggagacggactgatgtgcatctcgagaatccggagtatcatacaagatggtattttaaatacttcctcgggcaagttcaccagaactacattggaaacgacgcggaaaaatcgccgttcttcctgagtgtcactctttccgaccagaacaaccagcgcgtccctcaatatcgagcaatactgtggcgcaagacaggcactcagaaaatatgcctaccttactctccaacaaaaaccctcagcgttaagtccatattatctgccatgaatctcgacaaattcgaaaagggaccgagagagatttttcaccctgaaatccaaaaagacctgctggtgttggaagaacaggaaggttccgtaaacttcaagttcggggttctgttcgccaaggacggccagctcacagatgatgaaatgttcagtaatgagattggcagtgaaccttttcagaagttcttgaacttacttggcgatactataacacttaaggggtggacagggtatagaggaggtctcgataccaagaatgataccacaggaattcacagcgtctacaccgtgtatcagggtcatgaaattatgtttcacgtgtccaccatgttaccctactctaaagaaaacaagcaacaggtggaacggaaacgtcacattggcaacgatatcgtgaccattgtctttcaggagggggaggaatcgtccccagccttcaagccctccatgatcagatctcatttcacccacattttcgccctagtaagatataaccaacagaacgacaattaccgactcaaaatattctccgaggagagcgtcccactcttcgggcctcctttgccaaccccacctgtattcaccgatcatcaagagttcagagacttcctcctggtgaaactcattaatggcgaaaaggcaactctagagacacccacatttgcccagaagcgaagaaggaccctcgacatgctgattaggtcacttcatcaggatttaatgcccgacctccacaagaacatgctcaaccggagaagcttttccgacgtcttacccgagtctcccaagagcgcaagaaaaaaggaggaagctaggcaggctgaatttgttcgcattggacaggccttgaaactgaaatctatcgtgcgcggggatgctccaagttccctggcagcaagcggaatttgtaagaaggaaccatgggagccacagtgcttttgttctaactttcctcacgaagctgtttgcgcagacccatggggccaggccctcctggtatcgacagatgccggggtgctcctggtcgatgatgacctgccttcggtccccgtgttcgacagaaccctccccgtgaaacagatgcacgtgctggaaacgctggatctactggttctgagagcagataagggcaaggacgcaagactttttgtgttccggctgagcgccctccagaaaggactagaagggaagcaggccgggaagagccgctccgattgccgagaaaacaagctggaaaaaaccaagggctgtcacctgtacgcgatcaacacccaccacagtagggaattgcgtatcgtcgtcgctattcgaaacaagcttttgctgattacgcgaaagcataacaagcccagcggcgtgactagcacttccctgttatccccgcttagtgagagccccgtggaagaatttcagtacattagggaaatttgcctgtcggactctcctatggttatgacgctggtggatggacccgctgaagagagcgataaccttatttgtgtggcctatcggcaccagttcgacgtcgttaatgaatccactggagaggccttcaggctgcatcatgtagaagctaatagggttaatttcgtcgccgcaatagatgtgtatgaagatggggaagccggcctgttgctgtgctataactactcctgcatctataaaaaggtatgcccattcaatggcgggtccttcctggtgcagccctcagctagcgatttccagttctgttggaatcaggccccttacgcgatagtatgtgcatttccctacttattggcgtttacgaccgactctatggaaattcgattggtagtaaacgggaacttggtgcacactgctgtggttcctcaactgcaactcgtggcctcccgaagcgatatctacttcactgctactgctgccgtaaacgaggtatcgagcggcgggtcatctaagggtgctagcgcccgaaacagtccacaaacaccacctgggcgcgataccccagtgtttccttccagtctgggggagggagagattcagtcaaagaacctatataagatacccctgcgaaatctcgtgggacgctcgatcgaacgcccactgaaaagccctctagttagtaaagtgatcactccacccacaccgatcagcgtgggcttggccgctattccagtgacccacagtctgtccctgagcaggatggaaataaaagagatcgctagcagaactcgccgcgagttgctgggactctcggacgagggcggacctaaatccgaaggagcacctaaggctaaaagcaagccacgtaaacggctcgaagaatctcaggggggcccaaaaccgggggccgtgcgaagctcatcaagcgatagaatcccctcagggtcgctggagtccgccagtacatccgaggccaatcctgagggccactctgcgtcttctgatcaggacccagttgccgacagagaaggctcgcctgtcagtgggtcctccccattccagcttacagctttctcagatgaggacatcatcgacctgaaatag

SEQ ID NO: 30400 - DNA, 807 bp, Artificial Sequence
  Description of Artificial Sequence: Synthetic coding sequence
atggatccccttacaaaggtcccctgcggtagtcaaattgctcagaccattctgtggaaagccaagtctagtctcagtttcggcatccagcctttacagacttggcccactaaggacccggaactggaaagccaggtgaatttatcagtatctgaggacttggggtgccggaggggggatttctcacgcaagcattatgggtctgttgaactgttgattagttccgacgcggacggggccatacagcgtgccggccgcttccgagtagaaaacggctcttctgacgagaacgccaccgccctcccagggacctggcgtagaacagatgtccacttagaaaacccagagtaccacactcgttggtatttcaagtacttcctgggccaggtccatcaaaattacattggaaacgacgcagagaaatcgccgttctttctgtcagtaacactgtcagaccaaaacaatcagcgggtgcctcaatacagggcgatcctttggcggaaaacagggacgcagaagatctgtctgccatactcgccaactaaaacactgtcagtgaaatctatcctgagcgcaatgaacttggataagtttgaaaaggggccgcgagaaatcttccaccccgagatccagaaggacctcctagtgctcgaggagcaagagggctccgtcaacttcaaattcggcgtgctgtttgccaaggacggacagctgactgacgacgagatgttttccaatgagattgggtctgagccgtttcagaaatttctgaatctgttaggagatacaattaccctgaagggctag

SEQ ID NO: 30401 - DNA, 2976 bp, Artificial Sequence
  Description of Artificial Sequence: Synthetic coding sequence
atgaagtctagcgtcagcgaggatctcggatgccgccggggcgacttttcaagaaagcactacggatccgtggaattgctgatctctagcgacgcagacggggcaatccagcgcgctggtcgatttagggtggaaaacgggagcagcgatgagaacgccaccgcactcccaggcacctggcgtcgcactgatgtgcacctggagaatccagaataccatacccggtggtacttcaaatacttcctgggccaagttcatcagaactatataggaaatgacgccgagaaatctccgttctttctatcagtgacactatccgatcagaataaccagcgcgtaccccagtatagggctattctgtggcgcaaaaccgggactcagaagatatgtctcccttattcccctaccaagaccctgagtgtgaaaagcattctttccgccatgaacctcgataaatttgaaaaaggaccccgtgagatctttcacccggagatacagaaggacctgctggtactggaggagcaagaaggtagtgtcaacttcaagtttggagtactttttgcgaaggacggccaactgaccgatgacgaaatgttctccaatgagatcggcagcgaacctttccagaagtttttgaacctcctgggcgatacgatcactcttaaggggtggacaggatacaggggtggattagatacaaaaaacgacactaccggtatacattcagtgtacaccgtatatcaaggtcacgaaatcatgttccatgtctcaaccatgttgccgtattccaaagagaataaacagcaggtagaacgcaagaggcatataggtaacgacatcgtgaccattgttttccaggagggggaagaaagcagcccggcttttaaaccaagtatgatcaggtctcattttacccatatctttgccctggtgcgctacaaccagcagaatgataattaccgtctgaagatattttcggaagagtctgtgccactgttcggaccgccgctccccacacctcctgtctttactgatcaccaggagttcagagacttcttgttagtaaagctgattaatggtgagaaggcaactctggagactcccactttcgctcagaagaggcgccgcactctcgatatgctcattcggagtttgcaccaggacttgatgcctgatctccataaaaacatgctgaaccggcggtcattcagcgacgttctgcctgagtcccctaagagcgctaggaaaaaagaggaggcccgccaggctgaatttgtacgcattggacaggcacttaaactgaaatccattgtgaggggggacgctccctcatctctcgccgccagcggcatatgcaaaaaagaaccgtgggagccccaatgcttttgttcgaactttccacacgaagctgtctgcgccgatccctggggacaggctttgcttgtgtccacagatgcaggggttctgctggtggacgatgatctgccttccgtgcccgtgtttgaccgcacgctacccgttaaacaaatgcatgttctggaaactctggacctactcgttctgagggcggataaaggaaaagacgcacggctgttcgtgttccgtctttctgcgttacaaaaaggtctggagggcaagcaggccgggaaatcaagatcggactgtcgggaaaataagctggagaaaacaaagggttgtcacctgtatgcaataaatacacatcactctcgggagctacggatagtggtggcaatacggaacaaactgcttctcattaccagaaaacataacaagccatctggggtgaccagtacttctctgctcagtccactctcggaaagccccgtggaagaattccagtacatcagggagatctgtctgtctgatagcccgatggtcatgaccttagtggacgggccagcagaagagtctgataatctgatttgcgtagcatatcgccaccagttcgatgtggttaatgagtccaccggggaagcattccgccttcaccacgtggaggctaatcgcgtgaactttgttgctgccatcgacgtgtatgaagacggtgaagcggggcttcttctttgttataactactcttgcatttacaagaaagtttgcccatttaatggaggctctttccttgtgcagccctccgccagtgactttcagttttgctggaatcaggctccctacgcaattgtttgtgcttttccatatttgctggctttcaccacagactcaatggaaatacgcctggtggtcaatggtaacctggtgcacacagctgtggtaccacagttgcaactggtggcctcacgctctgacatttacttcactgccactgccgcagtcaacgaggtgtcatctggcggctcctctaaaggcgcaagtgctcgtaatagcccccaaaccccgcccgggcgcgacactcctgtgttcccgagcagcctcggagaaggcgagatccagagtaagaacctgtataagattcctctaagaaatttggtggggcggtccatagagagacctttgaagagccccctagtttccaaggtcattacaccccctaccccaatctcggtcggtttagctgctatccctgtgacccattctctttcactgtcgcgtatggaaatcaaggaaatcgcttccaggacaaggcgagagctcctgggtcttagcgacgaagggggacccaagtcagagggagcacctaaagccaaatctaagccacgcaagcggctggaggagtctcaaggaggacctaagcccggggccgtccggtccagttcgtctgatcggattcctagcggcagtctcgagtccgcatccacgtctgaagctaatccagagggccacagcgcgtccagcgatcaggacccagtggccgatcgtgaagggagcccagtatctggctcctctccatttcagctgactgccttctctgatgaggacattattgatctcaagtag

SEQ ID NO: 30402 - DNA, 807 bp, Artificial Sequence
  Description of Artificial Sequence: Synthetic coding sequence
atggatcctttgactaaggtgccgtgtgggagtcaaatcgcccagaccatactgtggaaggctaagagcagccttagtttcggtattcagccgttacagacctggccgacaaaggaccccgaactcgaaagccaggtgaacctgtccgtctccgaggacttagggtgcaggcggggagacttttcacggaaacactacggtagtgtggagttgctgatctcatctgatgccgacggggccatccaaagggctggaaggttcagagtggagaacggctccagcgacgagaatgccacagccctccctgggacttggcggcggacggacgtgcatctggagaacccagagtatcatacccggtggtactttaagtatttcctgggccaggtgcatcagaactatatcggaaacgacgcggaaaagtccccctttttcctgtctgtgaccctcagcgatcagaacaaccagagagtacctcaatacagggccatactatggcggaagacaggcacgcaaaagatctgtttaccttacagccctactaagaccctctccgtgaaaagcattttatcagcaatgaacctcgataagtttgaaaagggacctcgggagatcttccacccagaaatacagaaagacttactcgtcctcgaagaacaagagggtagtgttaatttcaaattcggcgtgcttttcgccaaggatggacagctgaccgacgatgagatgtttagcaatgagatcggcagtgagccatttcagaaattcctcaatctgctgggcgacaccattacgcttaaaggctag

SEQ ID NO: 30403 - DNA, 903 bp, Artificial Sequence
  Description of Artificial Sequence: Synthetic coding sequence
atggctgaatcagaggatagatcactccgcatcgtgttggtggggaagacaggatctggaaagagtgcaacagccaatactatcctaggagaggaaatcttcgacagcagaattgccgctcaggctgtgacgaagaactgccagaaggcgtctagagagtggcagggacgggatttgttggtggttgatacccccggcttgttcgacaccaaagaatcactggacactacctgcaaggagatttccagatgtataatttcatcgtgtcccggcccacatgctattgtccttgtactactcctgggccgctacaccgaagaggagcagaaaaccgttgccctgattaaagccgtcttcggcaaatcagctatgaaacacatggtaatactgttcaccagaaaagaggagctggagggccaatcattccacgactttatcgctgacgccgatgtcggactcaaatccattgtgaaagaatgtgggaaccggtgctgcgctttcagtaactcgaaaaaaacttcgaaagccgagaaagaatcccaagtgcaggagttagtcgagctgatcgagaaaatggtgcagtgtaatgaaggcgcctacttttcggatgacatctacaaggataccgaggagcgactcaagcaacgggaagaagtcttacgaaagatatatactgaccaactgaatgaggagatcaagttagtggaggaagataagcacaagtccgaggaagagaaggagaaggagataaagttgctgaagctcaaatacgacgaaaaaattaagaatattagggaggaagcagaacgcaatatctttaaagatgtgttcaatcgaatctggaagatgctgagcgagatatggcatcggttcctcagtaagtgcaagttttacagtagttag

SEQ ID NO: 30404 - DNA, 207 bp, Artificial Sequence
  Description of Artificial Sequence: Synthetic coding sequence
atgagcgggttctcatccgtggccgccaccaaaaaggtcgtgcagcagctccagttagaggctggcctaaactctgtaaaagtgtcccaggctgctgccgatctaaaacaattttgtctgcagaatgctcagcacgatcctctcttaacgggagtttcttcatcaacaaatccctttagaccccagaaagtctgctcctttctctag

SEQ ID NO: 30405 - DNA, 1569 bp, Artificial Sequence
  Description of Artificial Sequence: Synthetic coding sequence
atggtgcggagcggtaagaatggagacctgcaccttaagcagattgcttattataagagaacaggggaatatcatagtaccactttgccctcggagagaagcggcattagaagggctgccaaaaaatttgtattcaaagaaaaaaagttgttctacgtaggaaaagaccgcaagcagaaccgcctggtaattgtttccgaagaggagaaaaagaaggtgctaagggagtgtcacgagaatgatagcggggcccatcatggtatttcacggacactgaccttggttgaaagcaactattattggacgagcgttaccaacgacgttaaacagtgggtatatgcgtgccagcattgtcaggttgcaaagaacaccgtgatcgttgcaccgaagcagcatctcttgaaagtggagaatccctggtcactcgtgaccgtcgacttgatgggaccgttccatacctccaatagatcccatgtttatgccatcatcatgactgacctgtttacgaaatggatcgtcattctgccattgtgcgacgtaagcgcctccgaggtatccaaggccatcattaatatcttcttcctctacggccctccacaaaagatcatcatggaccaaagagacgagttcatacagcagatcaacattgaactctataggctcttcgggatcaaacaaatagtaatcagtcacacgagcggcacagtgaatccgactgaaagcacacccaacacaatcaaggcctttctgagcaagcactgcgctgaccatccaaataattgggacgaccacttatctgcagttagcttcgccttcaatgtgacgcacctcgagcccacaaaaaacaccccttatttccagatgttcagtcggaacccttacatgcccgagacgtcagatagcctgcatgaggttgacggagataacacatccatgttcgcaaaaattctcgatgccatcaaggaggccgacaaaattatggaaaacaaaactacaagtctagggcaaatggaaaacaacaatttggatgagctcaacaagtcaaagatcatcgtgaagaaaaagccgaaacaactcaatccctttcacttgaaggtggggcacgaggtgttgagacagagaaaaaattggtggaaagacggtcggttccagagcgaatgggtcggtccctgtgtcattgactacataaccgaatcaggctgtgccgtgctgcgcgacaacacaggcgtccgcctcaaacggcctatcaagatgtctcacctaaagccttatatacgggagtctagcgagcaggaatccttatatctcctgcagggtagtgtcgtggccgatcatgattacattggtctgccggagatccctattggtgcctaccaggcgaatattctcgtggaggacgccactattggaattgtggacaatgagctcctcactagtagtaaagacagggaactgctggagtatcggaacacaaagattagcccactcattgacgatcactccagcttggagaaacagaccttttctcttcttgattcttccaatcaggtattagagtacctgagctag

SEQ ID NO: 30406 - DNA, 669 bp, Artificial Sequence
  Description of Artificial Sequence: Synthetic coding sequence
atggtgcgaagcgggaagaatggtgatcttcacttaaagcagattgcctactataaaaggactggtgaataccatagtactactctgccatccgaaaggtctgggattcgacgggcagctaagaaatttgtgtttaaagagaagaagctgttctatgtcgggaaagaccggaaacagaacagattggtcatcgtgagcgaggaggagaaaaaaaaggttctgcgggaatgtcacgagaacgattcaggcgctcaccacgggattagtagaactctcacactggtggagagcaactactattggaccagtgttacaaatgatgtgaagcagtgggtttatgcctgtcaacattgtcaggtcgccaagaatactgtgattgttgcacctaagcagcatctgctgaaagtggagaacccctggagtctggtgacagtggacttaatgggaccttttcatacatctaatagaagccatgtgtacgcaattattatgacggatctgtttacaaaatggatcgtgatactgccactgtgtgacgtatcagcttcggaagtgagcaaagctatcataaatatcttttttctgtacgggcctccccagaaaattattatggatcagagagatgaattcatccaacagaaggtctttatcagctgcaaggtccagtag

SEQ ID NO: 30407 - DNA, 687 bp, Artificial Sequence
  Description of Artificial Sequence: Synthetic coding sequence
atggcagcacctccacagcccgtgacacacctcatttttgatatggatgggttgctgctcgatacagaaagactgtattccgtagtgttccaggaaatctgtaaccggtatgacaagaagtactcatgggatgtcaagtcactcgtcatgggtaaaaaggctcttgaggccgcccaaatcatcattgacgtgctgcagctgccaatgagtaaagaggagctggttgaagaatcccagactaagctgaaggaagtatttcccacagctgccctcatgcccggcgcagagaaactgataatccacctgagaaaacacggcatcccttttgcgttggccacctcatcaggttccgcctcgtttgatatgaaaacttcccgtcataaggaatttttctcgctcttcagccacatcgtcctgggcgacgaccccgaggttcagcatgggaagcccgatcccgatattttcctggcttgcgctaagcggttcagtccccctcctgctatggaaaagtgcctggtctttgaagatgcaccaaacggcgttgaggccgcactcgccgccgggatgcaggtagttatggttccggacgggaatctgtctcgcgatcttactacaaaggctactcttgtgctgaattcgctgcaagactttcagccggagctgttcggactgccatcgtatgaatag

SEQ ID NO: 30408 - DNA, 756 bp, Artificial Sequence
  Description of Artificial Sequence: Synthetic coding sequence
atggccgcccctccgcaaccagtgacacacctgattttcgacatggatgggctgctgttaggttacaccgggtctatcgtggccgccgcctctggcgaaagctcacgcggccttcagtcccggtggacagatacagagcgcctctattcagttgtgttccaggaaatttgcaaccgctacgataaaaagtattcttgggatgtgaagtcactggtgatgggcaagaaggctttggaggccgcacagatcatcatcgacgtgctgcagttacccatgagtaaagaggagttggtcgaggagtcccagacgaaactgaaggaagtcttccctacggctgctctgatgcctggagctgaaaaactcattatccatctgcggaagcatggtattcctttcgcccttgccacgtcatccggtagcgccagctttgacatgaagacaagtagacacaaagaattcttctcccttttcagccacatcgttctcggtgacgaccccgaagtgcagcatggaaaaccagaccccgatatctttctggcctgtgcaaagcggttttcacctccaccagccatggaaaaatgtctggtgtttgaggacgcacccaatggcgtggaggccgccttggcagctgggatgcaggtggtgatggtacccgatggcaacctctcccgagacctcacaaccaaggcaacactggtcctcaactcactccaggactttcagcctgaactctttggtctgcctagctatgagtag

SEQ ID NO: 30409 - DNA, 627 bp, Artificial Sequence
  Description of Artificial Sequence: Synthetic coding sequence
atggctgcacccccgcaaccagtgacacacctgatcttcgatatggatggcctcttgcttgacacagaacggttatactctgtggtctttcaggagatatgcaatcggtacgacaagaaatattcatgggatgtgaaaagtctggtgatgggcaaaaaggcactggaggccgctcagattatcattgacgtgctccaactccccatgagtaaagaggagcttgttgaagaaagccagaccaagctcaaagaggtcttccctactgccgcattgatgcccggcgctgagaaactcataattcacctgcgcaaacacggaattccatttgccctggccacctctagcgggagcgctagtttcgatatgaagacttcaaggcacaaggagttcttttcgttattctctcatatagtccttggcgatgaccctgaagtgcagcatgggaagcccgatccagacatattcctcgcgtgcgctaagaggttctctccaccaccggcgatggaaaagtctagtattcatcgcccccggttattaacggcacaaaagtgtcaaggttgccgcgatcctttttccgcccttctgctgttgtgtaatcagttgctgttgtgctctgacgatacttag

SEQ ID NO: 30410 - DNA, 735 bp, Artificial Sequence
  Description of Artificial Sequence: Synthetic coding sequence
atggcggctccaccacagccagtgacccatctcatattcgacggacgcacaagctctgggtgggtcgtggctgcggcctcgggtcgttcctgtgttggtgttgggacagatacagaaaggctttactccgtagtcttccaggagatatgtaacaggtatgataaaaagtactcttgggacgtcaagtcactggtgatgggaaagaaggcactcgaagcagcacagatcatcattgatgtgcttcagctccccatgagcaaagaggagctggtggaagaaagccagactaagctcaaggaagtgttccccactgcggcgctgatgccaggtgccgagaaactaattatccacctgcggaaacacggtattccgtttgcgcttgcgacatcaagcggctctgcctcttttgacatgaaaacatctcgccacaaggagttttttagtctgttctctcatatcgtactcggggatgacccagaagtgcagcacggtaaacctgacccagacatcttcttggcatgtgccaaaaggttctctccccctccagccatggaaaaatgccttgtgttcgaggacgcccccaatggagtggaagccgccctcgccgcaggtatgcaggtagtgatggtgcctgacggaaatctcagtcgggacctgaccactaaggccaccctggttcttaatagtcttcaagactttcaacctgagttgtttggcttgccctcctacgaatag

SEQ ID NO: 30411 - DNA, 558 bp, Artificial Sequence
  Description of Artificial Sequence: Synthetic coding sequence
atggcggctcctccccagccagtgactcatctgatcttcgatatggatggcctgctgttggatactgagcggctgtactcagtggtgtttcaggagatctgtaaccggtatgataagaagtattcttgggatgtcaagtccttggtgatgggcgccgaaaaacttattatacacctgcgtaagcatgggattccttttgccctggctacctcatctggcagcgcttctttcgatatgaagacgtcccgccacaaagaatttttctccttgtttagtcacatagtgttgggcgatgacccagaagttcaacacggtaaacccgacccagatatcttcctggcctgtgcgaaaaggtttagtccaccgccagccatggaaaagtgcttagtgtttgaagatgctcccaacggagtggaagccgcgttagccgccggcatgcaggtggttatggtgcccgacggcaacctgagccgcgatctgacaactaaggctacactcgtcctcaattcgctccaagacttccagccagaattatttgggctcccgagctatgagtag

SEQ ID NO: 30412 - DNA, 780 bp, Artificial Sequence
  Description of Artificial Sequence: Synthetic coding sequence
atggcagcctgtcgggctcttaaggctgtcttggtcgatctttctgggaccctgcacatcgaagatgccgcagtgccaggcgcgcaggaggcacttaaaagactacgtggggcttccgtgatcatcagattcgttactaataccactaaggagtccaagcaggatttgctggagcgactgcgcaagctggagttcgacatcagtgaagacgaaatctttacctccctcaccgcagcaaggtcactgcttgagcgcaagcaggtgaggccgatgctgctcgttgatgacagagcactgcctgacttcaaggggatccagacctctgaccccaatgctgtcgtgatggggcttgctccagagcatttccactatcagattctgaaccaggctttcagactgttgttagatggggcccccctgatcgccatccacaaggctcggtactataaaagaaaggatgggttagctctgggcccgggcccctttgtaacagctctagaatatgctacagacaccaaagcaactgtggtgggaaagcctgagaagacattctttctcgaggccttaagggggacgggctgcgagccagaagaggcagtgatgattggggatgactgtagagatgatgtaggaggagctcaggatgtggggatgctgggaatcctggtaaagacaggaaagtacagagcttccgatgaagaaaagatcaacccccctccttacctgacctgcgaatccttcccacatgcagtagatcatattctccagcatctgctgtag

SEQ ID NO: 30413 - DNA, 132 bp, Artificial Sequence
  Description of Artificial Sequence: Synthetic coding sequence
atggctattccaattaccgtgttggactgcgacctcttactgtacgggagggggcaccggacactggaccggttcaagctggacgatgtgacggacgagtacctgatgagtatgtacggctttccaaggtag

SEQ ID NO: 30414 - DNA, 255 bp, Artificial Sequence
  Description of Artificial Sequence: Synthetic coding sequence
atgaaaagggagcccaaaaacctgagtagcgagcaggtgctgaagcctacgtactctcaatccaagcccaaccggatccgcttgtattactggggactggggctgaacctgagagcagctgctagtgaggcgaacaggatggaatcaaagaaggttggcaagcgtctgggtgcagggaaacagcagatgggggctgagctaaccgaacaacacatggctcggatctcgctgcctgcaaagattctgggatactag

SEQ ID NO: 30415 - DNA, 180 bp, Artificial Sequence
  Description of Artificial Sequence: Synthetic coding sequence
atgcagaccggcggctgcgagccaaagcacaggcggatgtgcccagatgatagcagtgagaatatcatgaaatggcgaacatttcttcctgaggaacgcaccgtgactcaagctggagacgtgacacatactctgggcagtaaagggcccaaggcgggcgtgccatttactggcccttag

SEQ ID NO: 30416 - DNA, 369 bp, Artificial Sequence
  Description of Artificial Sequence: Synthetic coding sequence
atggtggtggttgagaaaggggcgtccctgatgagtcgcgcgtcccttatgccggcccaggctcgagcaccgtttcagcggttgcgtgattgtcgcggccctgccgactcaagtcacgctttcaaactacagtgctttccgagccactgcagacggcccccctgggtgataagcaggaaggggagagcaattaacaagtactctatatgtataagctgcgtagcgctgcacctcgagattagcttcatatggcaacttctgcaaaacgagcccaatctcgagggcggcttaggacgatttatgcttgccagtttatcactccagcaggtgatttcaattctagccttcaccagagtgaagcagctgtag

SEQ ID NO: 30417 - DNA, 183 bp, Artificial Sequence
  Description of Artificial Sequence: Synthetic coding sequence
atggccctgccttgtggcatgggtacagcttggtacctggattccaccgagaacgcccttactgtgaacgtgccacgcgctcagaatcacaaggccagtcacaatagcatgtggaagctcggctctcatttttactgcatcctcctggtgactaaggaccccccgggcttcacgatggtgtag

SEQ ID NO: 30418 - DNA, 393 bp, Artificial Sequence
  Description of Artificial Sequence: Synthetic coding sequence
atgtccctgtgttccctcttgagcccccgatcaggctttcgttgctgctgtgccgccccccctcctcccgcccagccccatcaggaagcacaaggcggccttgtggaactcctgatgcacgccgcagcccgaaagaccctgtttaactttccgcctgccccttcacgcgccagccccggccatcgagtggcgtgccagccggaccgcgccagaaagagtggtagctgggctgtggcccaacgacgacgagagcaggaagaagccggcgctagggctggagccgtggaccctttggggctcccattagtgtcctccatcagttgcgtgcagcattgcaacttggctgcgggagtgcaaacaggacgcccccccgccagtagcacggattgttag

SEQ ID NO: 30419 - DNA, 162 bp, Artificial Sequence
  Description of Artificial Sequence: Synthetic coding sequence
gccacacaggaccttcagttccgcattcgaaggcctcggccgccagccagaggaaggggcggcgaaacccggagctgcgacctgggccgatgccatctcaagggcctagacctcctcgaagctcggacggcagaggaagatggcgaacggaacgcacgctag

SEQ ID NO: 30420 - DNA, 414 bp, Artificial Sequence
  Description of Artificial Sequence: Synthetic coding sequence
atgtttcattttttcaggaagccacccgaatctaaaaaaccctcagttccagagacagaggcagacgggtttgtgctgcttggcgacacgacggacgaacagcggatgaccgctcggggcaaaacctccgatatagaggctaaccagcccttggagacaaataaggaaaattcatcatctgtgacagtctcagatcctgagatggaaaataaagcgggacagacactggaaaatagctcactgatggcggaacttctgagtgatgtcccttttacactcgcaccccacgttctggcagtacagggcaccataacggacctgcccgatcatctcttaagttacgacggaagcgagaacctcagccggttttggtacgatttcacattggaaaactcagtcctgtgtgatagctag

SEQ ID NO: 30421 - DNA, 876 bp, Artificial Sequence
  Description of Artificial Sequence: Synthetic coding sequence
atgcctggaaaactgctcccagaaaagtgcgccctgatgtggttacatctcggcactcgcgctcctcaacgacctaaaagggaatctcgggggttccctggatggggttgcagaacaggacaggctctgccctgcagagcacgtccccccgctcctgcaccctctcatccctcctctagcctatctcttaccccaggacccggatctcctcgtcagacaggacctccctgtcagaccgtcgccgccctatacgggttgggtgcctggcaatctcactgtggcggtggcgtgggctgccacggacagggcagacagccattgggatgtcaaggctggtggtctacactcaacccttacttgttagagtcaccgggcctgttccatactagaagctgcggtaaactctgggatccaaaagccgtactaatatccggagtcacaagcagtcattcttccctggggagcccaggtacgcggcccggcgtatccctctgcaaggaacttcccgggtgctgggccgagctatgctgtaggcccagaaagatgaccaagaaggatagagcagagcctcatctcccactcctgggtggtccagagggggcccgagcccagcagagccccatcctgcattctctcgggagtaaacgtttgcctagatgtggatggcagttgctgacatccagcggcggcgcagcaggcggtttgtgccctatggggcaccgccgggaaaaagacggtggtagagtgtgcactttggggaggaccggaggccgtcataggcccgaacaagttgcttgggcacacgaaaaaggtgtctctgagacagggtgtctttctcagatgcccggagtggacgaagctgacgagtggcagtag

SEQ ID NO: 30422 - DNA, 234 bp, Artificial Sequence
  Description of Artificial Sequence: Synthetic coding sequence
atgaaagcccccggactagcccaggccgccgtggccgaggagacccccgattgggctcctgagctttgcccctcatccgaggcacgaagccctgaaccgccggccaaccggctgcaagatttcgataccctggttactgtgggaaagcagcttgaagcaatctgcgtgaagaaaaacgtggatctccttgctaggatgcagaggagagagaggttgctgatcaggtgctggtag

SEQ ID NO: 30423 - DNA, 414 bp, Artificial Sequence
  Description of Artificial Sequence: Synthetic coding sequence
atgactagccccttagtgtttgccagtctcagccctgacgctatggccaagatgctggaaatggccgctctaaatgtgggcacaatcaggatctccctgaatacagaaccgcggcctcccgttatcacgcagctagcgccatcacccgagaccctgccgttctgcccggaatggggggcggagaatcaatcgagacatcttaagctgccccccttctttatttgtcgatgtcggggcccgctgtaccaggaggagtcactgtctgaaattcattgccactcaggcttgtttcttgaccagctgagtttgccaacacccttttcaagtttgtccgtaagtctgatccattggacatttatttccactaaatacgtccccggtatcatgcttgcttttggtgggactaacaaatag

SEQ ID NO: 30424 - DNA, 141 bp, Artificial Sequence
  Description of Artificial Sequence: Synthetic coding sequence
cgggaaggccacgctgacggtaacatcccagccgggcctgggttatgcagcccgcaactcctcttgcctgggggtcagcttttctgggccccagaggtactgcgttccccttttccggggcctggtacaccatccgcgtag

SEQ ID NO: 30425 - DNA, 444 bp, Artificial Sequence
  Description of Artificial Sequence: Synthetic coding sequence
atgggactactgagtctaatcctttttctcggggcgaaggtgaccaccgcaaacaaaacagattctttcctcttttcgaccgggctgaccgtgctgagttctccgggactcaagatgagagttctgggatgcccccctacccctccccagctgacccaaggtcacacgtctggctatgtggacctgcataagggtccattcctttctccaatgcgtcatccaagagggcacaccggacctcagatcctgccccaggcttgggaaccgattggccgccgggtgcggcagtgtaggggacctcagactttcctgaagggacctgagtctaagtacttccgcctgtgccgaccggatgtactgtgttgcaaaacccagttttgttattgctcatcaaaggccgccatagacaacagcgaggtgaacgagtgtgtggtgtcacaatag

SEQ ID NO: 30426 - DNA, 84 bp, Artificial Sequence
  Description of Artificial Sequence: Synthetic coding sequence
gatatactgcagcacaatcatccagtggtgggcttacttcaggtaggcagtgaacacggatccgaggaggcagccctctcgtag

SEQ ID NO: 30427 - DNA, 555 bp, Artificial Sequence
  Description of Artificial Sequence: Synthetic coding sequence
atgcccgtgaaaggcgcctcgtctctcctgttcctgcccctaccaccttcggcttggcaactgtgcctcctatcaaagcggcgcgtgcaccccattcgcacaccgctccccttccattcttggattaaggccctggtgatctctaatcagaaagttccggaaagagagcggcccgagggtactggcgtcctcagcgacggctgccttgggcagtctcaagagggtgaaccattgctcagcccccctgcgctggcccattttccgctccacgctcgatgttgcggcagtagttgggcctggcccggatccgctggggaggccatcaggatggtcagcggcgcaccctttctgtgtttcctagacggcctcgacgggctgccatgcagtagcccaatggctgcactgcccgcccccatggcagccctgcccgcccggcgtcagaggcaggaacacatcgagggaggcagtcagggctgcggagtgcgatcgcccgccccctgtagaggcaagcccggatctgccacctcctcaacactgagactttgtccagcgtag

SEQ ID NO: 30428 - DNA, 417 bp, Artificial Sequence
  Description of Artificial Sequence: Synthetic coding sequence
atgttagagaaatggagagagaccgaggaagccaggggactgcttacacggactcagcctaccgcctcaggccccccctgttcccatgcccattctcagctgctgctggatcggctcaagggcaatctggcaaggagggggggggtagggcgcgcgtccctcgaaacagttctttggcggcccggcgagacagctttctacccacagcattggggcgaacaggcctccatcccagcctttgcctgtagaccttcatcttttcccctgaaagcataccctgccgcacccgccctgcgaaacgccctgctttcataccaattgtgggagagacaagaccgacttgcctcagggcggcgtggtaggcactgcctgcctagcgggccaggcccgcaccgatatccccagctacaggattag

SEQ ID NO: 30429 - DNA, 429 bp, Artificial Sequence
  Description of Artificial Sequence: Synthetic coding sequence
atgggcctctaccacgtcggccaggcaggcttagagctgctcacttcatctgatcctcctaccagcgcctcgcagaatgctgaaatcaccggagtctcacaccgggctcaatcaaaagcccacaacctgcagcggaagttaaggctgtctcataagagctcgcctccgtgtacttatactcagcatgccggtggcgtcgattcgcacccactgactcaggacatgtgtgtcattgttaacgtcatagcccggccgttcgataagtgcaactgtgatatttatttagggttagccagtgaactattcgtggtgagctgggtgcagctgaccgtcccataccattggattcaaactctggggaacgtgatcttgttttgccttgacacagctcaccgcggacactgtgacatcgctggccattgcacctag

SEQ ID NO: 30430 - DNA, 303 bp, Artificial Sequence
  Description of Artificial Sequence: Synthetic coding sequence
atgcggcctaagcatctgcaggggatcgctcccgaggtgttccgcactcccacagggagccatgggcagatgccagggcaaccactccagagggggcacgccctggacatccgcccacccctgcgacctcaccccctgattagcggacatgctttgagaggggacagatggcaaacccctgctctagcactggggcccgcactttgtggtttcgtgcccgcacactgggtactcaccgtgccccccccacagcggccgagcataccatcgagaagcgcggacacttgccctgcgtctaggtag

SEQ ID NO: 30431 - DNA, 246 bp, Artificial Sequence
  Description of Artificial Sequence: Synthetic coding sequence
atggtgtttctgaattataagtgcacaactcccctcattctattactccccagccagatccccaggagctacaagcaggactggttgctctattgctctaaactgatcagcctggcctaccatgcatttttgatttttatgcctagccttatgatgttctcccttttagagatctaccacatcctgctgcctcaattgttgctgcaggttaatttcttactgaaggccgagccggaccaaatttag

SEQ ID NO: 30432 - DNA, 435 bp, Artificial Sequence
  Description of Artificial Sequence: Synthetic coding sequence
atgaaagtcagcagtctaacccgacagcagcgaccaccccagggcacagaagcggggacacgcggtggagggcctggccggttgtcccctgaaagatgcaggcttctagactctcccttgcagttgcagggaccggctagtctccctcaacccggtggccgagagcgcgctgtggcaaccccgccccaggcaaccaggcgaggtggaagtgagcgaacccgcgattcattgctgggcgccgtcgggccctccggggctaagagaccattcttcagctctgcactgccaaaaggctgtagaagagttggagcaacctggggaccacggcagcgcggatgggggaacgcaactggaggtccgggagagggcgctaggcgttcccgcccagaccctcaagctctcttttggcatgcccctcacttgagggcacagtag

SEQ ID NO: 30433 - DNA, 318 bp, Artificial Sequence
  Description of Artificial Sequence: Synthetic coding sequence
atggctcattgcagccttgacctgtctgggtccggggatccacctactagtactagtcaagtcgctcggactattggggcatgccaccacgtgcagctgatctttgtgtttttcggagagactgggtttcaccatgtggcccccttggtcctagagctgctggattcaagcgacccccccaccctcgccagccagtccggtggcaatcggcacgagccaccacaccgtgctctgaagcacattttcctgaagcatatctggctgttttcgttctatttccaccagaacggccacgaagaaaccatggaccagatttag

SEQ ID NO: 30434 - DNA, 396 bp, Artificial Sequence
  Description of Artificial Sequence: Synthetic coding sequence
atgccattttggagactcgataagctgagtcctggaggagtcaaaaggctaagggttactcagccagcaaccgggaccggcgtcgtgcgctctcagtgccagaaatgggtcaaggagttgggcaacgtgccacgcctggccgcccgcaagcctgggttgggcgttccaggctcatcgggtgccgtgaagcgacagggacagaaatgggttaaggaactcggcaatatccctcggcttgccgtgggccgagaccagggcctggggtcactcgaccccgggtcagcgaccgaactgttgtgcgactgcagtgttcccctgttgccactgtccggaggctacagaaaggcggacgttgcccaccaccccgcctgcgcaattgtgtggttgcactattag

SEQ ID NO: 30435 - DNA, 444 bp, Artificial Sequence
  Description of Artificial Sequence: Synthetic coding sequence
atggtgaccggcccttgcctgacctgcgtatcctcactgatcgaacgcgcatcccctaatcatcctaccaacaagggactgactctcctcccttggctggagtgctccggccccataatcgcacattgtagcttggactttccagcgtctgtggaccccccaaccttgatttctcgcgttgcaggtacagctgggctacttatcctacggttctcgagcgctagtgccaaccctgagacagcccgtccaattccgcctctgccgtgtccccccccccggctgctgcacatgaagaccactcgcatgaaaaccttcatgatgatccatttccatttgatgaataagctacaggaaatcatacaggaagagcgacacggaggcatgctggagtccctcctttcactgaaggtgggtaatcctgggtcctgtagttgctctcactag

SEQ ID NO: 30436 - DNA, 204 bp, Artificial Sequence
  Description of Artificial Sequence: Synthetic coding sequence
atgtttcatttgtgtaaactcaatcccagctacctgaaaattacatgcggaaagcggtctaagcagatcactccgacatactaccctagtcgcttgccacccgtgaaacggaaatttagtgtttacgacgccaagctgaccattgtgcacttatctactttttctatcgaggatttcccgctctatctctccatggccggctag

SEQ ID NO: 30437 - DNA, 423 bp, Artificial Sequence
  Description of Artificial Sequence: Synthetic coding sequence
atgggttcagaagcggctcagctgctggaagcagctgattttgctgcccgaaaacatcgacagcagcggcggaaggaccccgaaggcaccccttacatcaaccatcctattggagtggccaggatcttaacacatgaggcaggtattacagatatcgttgtgctacaggcagcactgcttcacgacaccgtcgaagatacagacaccacgctggatgaagtcgagctgcattttggcgcccaggtcaggaggcttgtggaagaagtgaccgacgacaagaccctaccaaaactggagcggaagcgtctacaagtggagcaggcaccgcattcttcccccggtgctaaactggtgaagctggccgacaagctttataatctgcgcgatttgaatcggtgtacgccggaggtgaagatccagtag

SEQ ID NO: 30438 - DNA, 540 bp, Artificial Sequence
  Description of Artificial Sequence: Synthetic coding sequence
atgggcagtgaggctgcacagttgctggaagccgccgatttcgccgcccggaagcacagacagcaacggcgaaaggaccccgagggaaccccatacattaatcaccccataggggtggcacgcatcctgacacacgaggccggcattactgacatcgttgttcttcaggccgccttgctgcacgatacagtggaggatacggatacaacattggacgaagtggaactccacttcggggcccaagtacgacggctagtggaggaagtcacggatgataaaacgctgcccaaactggaaagaaagcgccttcaagtggaacaagctccacactcaagtccgggagccaaactcgtcaagttggctgataaactctacaacctgagagatctgaatagatgtacgccagagggatggagtgagcaccgtgtgcaggaatattttgaatgggccgctcaggtggtgaaagggctgcaaggcaccaaccgtcagttggaagaggctctcaagcatctctttaagcaacgcgggctgactatctag

SEQ ID NO: 30439 - DNA, 1632 bp, Artificial Sequence
  Description of Artificial Sequence: Synthetic coding sequence
atgccgaaccccaagaactcaaaggggggcagaaagaacaaaagagcgaattcgtctggggatgaacaggaaaacggagcgggggcactggctgctgcaggagctgccggcgctgctgcgggtggtgcattagctgccgcagcaggttgtggcgccgccgcggcgggtgcacctggcgcaggcggcgccgccggtgccgggggagccggaacgggggccgcgaacgccgctgcagctgctggcgccgccgcggccggcgatgccaagaatgaggccccctgtgccacgcctctgatatgttccttcggcaggcccgtcgacttagagaaagacgactaccagaaggtggtctgcaataacgaacattgcccatgctcaacgtggatgcatttgcagtgcttttacgaatgggagtcatccatattggtccaatttaactgtatcggccgcgcgcggtcatggaatgaaaaacaatgtcgacagaacatgtggaccaagaaaggttatgacctggcattcagattctgctcatgtcggtgcggacaaggtcacttaaaaaaggataccgactggtatcaggtaaagagaatgcaggacgaaaagaagaaaaaatccggcagtgagaagaacaccgggcgacccccaggcgaggccgcagaggaggcaaagaaatgccggcctcccaacaaacctcagaaaggcccatcccatgacctgccgagacgtcactctatggacaggcagaactcgcaggagaaggccgtgggcgctgccgcttacggggcacggagccctggtgggtcccctggccaatcccctccaacggggtattctatactgtctcctgcacacttttccggacctcggagttcaagatacctaggagaatttctcaaaaacgctattcacctggaaccccataagaaagccatggccggaggccatgtgttccgcaacgcacacttcgactactccccagcaggcttagctgtgcataggggtggtcatttcgatactccagttcaattccttcggcgcctggatttgagtgaactcctgacacatatccctcgtcataaactgaataccttccacgtgcgaatggaggacgacgcacaggttggtcagggcgaggatttgcggaaatttattttggccgccctttctgcctcccacagaaatgtagtgaattgcgctctctgtcatcgcgccctgccggtgttcgagcaattcccactagtcgacggcactctctttcttagcccaagccgacatgatgagatcgaatacgatgtgccctgtcacctacagggaagactgatgcacctctatgctgtgtgtgtggattgcctagagggagtgcataaaattatctgtattaaatgtaaaagtaggtgggacgggtcatggcatcaattaggcaccatgtatacttatgatatcctggccgccagcccgtgttgtcaggccagactcaattgcaaacactgcggcaaaccggtgattgatgttcgtatcggcatgcagtacttcagtgagtattccaatgtgcagcaatgcccgcactgtggcaacctcgactaccattttgtcaaaccattttcctcatttaaagtgttggaagcctactag

SEQ ID NO: 30440 - DNA, 2568 bp, Artificial Sequence
  Description of Artificial Sequence: Synthetic coding sequence
atggccgcgctgggagtggccgaagctgtggctgccccacaccccgcggagggagcagaaacagcagaagccgtggagctgtcgagggcactatcccgactgctaccaggtctcgaagccgactcaaaaccgggccgacggagggcattggaagcgcttaggagagcgttagaggagcctgggccagccgccgatccaacagcattccagggcccatgggccagactccttctcccccggctgctgaggtgtctatctgaccccgccgaagggtgcagggcgcttgctgtccatctgcttgacctcggactcaggagagccgcccggcccagggatgcactgccgagactcctgcccgccctggcagctagacttgctggcccggtgcctgcaaggcggcctcccgaggcgtgcgaagaactgcgcttagccctggtccagctgttaggactggccgtggatttgtgcggggcagcgctggcgccgcatctggacgatgctctcagggcactgagatgttccttgctggaccccttcgcagccgtcaggagggagagttgttcttgtgccgcagctctagctcaggctacccctgaccattttcacatgcagagtgaatccctgataggccccctcatgcagacgatcagccaccagcactggaaggtgagagtggctgcgatcgaagctactggggctgtgattcactttggaaacggcaaatccgtggatgacgtgctgtcccactttgctcaaagattgttcgacgacgtgccacaagtccgcagagcggtcgccagcgtagtaggcggatggttattgtgtttgagagatagatactccttctttcataagcttatcccactgctcctgagcagtctgaatgatgaggttcccgaagttaggcagctcgccgcgagcctgtgggaggatgtggggctgcaatggcaaaaagagaatgaggaggacctgaaggataaactggattttgcccctcccacccctcctcactatccgccacacgaacgcagacctgtgctcggatgtcgtgagctagtttttagaaacctcagcaagatactgcctgctctgtgccatgatatcaccgactgggttgtcggtactagagttaagagcgcccaactgcttcctgttttgttattgcacgcagaagatcacgccacacagcacctggaggttgtccttcgcaccctttttcaagcttgcactgatgaggaagctgccgtcgttcaatcctgcaccaggagcgctgagctggttggaacattcgtgtcccctgaggtttttctgaaactgatcctttccactcttaagaagacacctagcgccagcggtctgctggttctggcatcagccatgaggggctgccctcgtgaggctctgcagcctcatctagccgcgatcgctacagagctggcccaggcccatatatgtcaggcttctgaaaatgatctttatctcgaaaggctgcttctctgcgttcaggccctggtgtcggtgtgccatgaagactgtggcgtagcaagtttgcagctgctcgacgtgctgctcactatcgtcgcattagcaggagccacaggtctcagggacaaggcccaggaaacaatggacagcctggccatggtcgaaggagtgtcatcttgtcaggacttgtaccggaaacacataggacccttactcgagagggtgaccgctagccacctggactggacagcccactcaccagagcttttgcaattctccgttatcgtcgcacagtcggggcctgccctcggggaggcccttcctcatgtggtccctaccctgagagcatgcctgcaaccgtcacaagatccccagatgcggcttaaactgttctccatcctttcgacagtgttgctccgagccactgataccatcaactcccagggccagtttccttcttacctggagaccgttacaaaggatatactcgcgcccaacctgcagtggcatgctgggcgcactgccgccgctatccggaccgccgccgtttcgtgtctgtgggcacttacctcttccgaagtgctaagcgcggaacagatacgggacgtacaggagacccttatgccacaagtcctgactactctggaagaggattcaaagatgacacgcctgatctcatgccgaattatcaacacattcctaaaaacctcgggagggatgacagatccagaaaagcttatcaggatctatcctgagcttctgaaaagactggacgatgtcagtaacgatgtcaggatggcggcagcttccaccctagtaacgtggttgcagtgcgtgaagggggcgaatgccaagagctactatcagtcatccgtgcagtatttgtatagggagcttctggttcacctcgatgatcccgaaagggcgatccaggatgccatcttggaagtcttgaaggaagggagcgggttattcccagacctcctggtgagagaaaccgaggccgttatccacaaacaccgcagcgcaacttactgtgagcagctgttgcagcacgtgcaagctgtgcccgctacacagtag

SEQ ID NO: 30441 - DNA, 2532 bp, Artificial Sequence
  Description of Artificial Sequence: Synthetic coding sequence
atggcagcactgggcgtcgcggaggcagtggctgcccctcacccagcagagggcgccgagaccgccgaggcagtggagctttccagggcgctctccaggctgctgcctggcctcgaggccgatagcaaaccggggagacgcagggccttggaagccctaaggcgcgcattggaggagccaggcccggccgcagatccaactgccttccaggggccttgggcacgtctcctgctccctcgcctgctcaggtgtttgagcgaccccgccgagggatgtcgcgcactggcagtgcacctgttagatctcggcctccgcagagcagcacggccaagggacgccctgcctcggcttctccccgccctggccgccaggctggccgggcctgttccagcaagacgcccacccgaggcttgcgaagagctcaggctggctctggtgcaacttctgggcttggctgtcgacctgtgcggcgccgcacttgcacctcacctcgatgatgccctcagagctctcagatgttccctgctggaccccttcgcggccgtccggcgggagagctgtagttgtgccgctgccctagcccaagccactcccgaccatttccatatgcagtctgagagcttgatcggacccctgatgcaaacaatttctcatcaacactggaaggtcagggtggccgcgattgaggccacaggcgcagtgattcactttgggaacggaaagagtgtggatgacgtactgtcccacttcgcgcagagactgttcgacgacgtgcctcaggtgcgccgggccgtggcctctgtggtgggtgggtggctcctctgccttcgggataggtacagctttttccacaagcttattccactgttgttgagcagtctgaacgatgaggtccccgaagtgagacaactggccgcttctctctgggaggacgtcggcttgcaatggcaaaaagaaaatgaggaagatttgaaggacaagctggactttgcaccaccgacacccccccattaccctccccatgagaggcggccggtgttggggtgtagagaactggtcttcaggaacctgagtaaaattttaccagcgctgtgtcacgatattacagactgggtggtaggaaccagagtgaagagtgcccagttactcccagtgctgttgctgcacgcggaagaccatgcgacacaacaccttgaagttgttctgaggactctgtttcaggcctgtactgatgaggaggcagctgtggtacaatcctgcacgcgttctgcagagttagtaggtacatttgtgtccccagaagtgttccttaagttaatattgagcaccctgaaaaagacaccgtcagcttccggcctacttgtgttagctagcgcaatgcggggatgtccccgtgaggctcttcagccccatctggctgccatcgccaccgaactggctcaagctcacatttgtcaggcatccgagaacgacctgtatcttgagcgtctacttctgtgtgtccaggccctggtgtctgtctgccacgaggactgtggagttgcaagtctgcagctcctcgatgtgctcctcaccattgtagccctcgccggtgcaaccggacttcgagataaggctcaggaaaccatggatagcctagctatggtggaaggagtgagtagttgccaagatctgtataggaagcacattggtcctctcctggagagggtcaccgcttcccacctcgactggacagcgcactctccagaactgttgcaatttagcgtcattgtagcccaatcgggacctgccctgggagaagccctgcctcatgtcgtccctaccctgcgcgcctgcttacagccatcacaagacccacagatgcggctgaagctgtttagtattctgtctactgtgctgctacgggcaactgacacaatcaactcccagggccaattcccaagctatctggagacggtcacaaaggacattctagcccccaacctgcagtggcatgccggacgaacagcagccgcgattaggacagcagcagtctcttgtctctgggcactaaccagctctgaagtgctgtccgccgaacaaatcagagatgtccaggaaaccctgatgccgcaggtcctcaccacactcgaggaagatagcaagatgacacggttaatatcatgccgaatcatcaacacatttcttaagacaagtggcggtatgacggatccggagaagctgattcgcatctatcccgagctcctcaagcgactggacgatgtttccaacgacgtgcgcatggccgctgccagcacgctggtaacatggcttcagtgcgtgaaaggggcaaacgctaaaagctattatcagagcagcgtccagtacctgtacagggagctgctggtgcacctggatgaccctgagcgcgccatccaagacgctatcctggatgtgcccggctccccttctccctcagccatgataggctcgtttctgcgcccccctcatccgtggaggacagtctcccagctcaatttattttcgtcatag

SEQ ID NO: 30442 - DNA, 1806 bp, Artificial Sequence
  Description of Artificial Sequence: Synthetic coding sequence
atggacagcttctcagaggtccggagagccgtcgcctctgtggttggggggtggctgttgtgcctgagggatcgatatagtttctttcataagttaatacctctgcttctcagcagcttgaacgacgaggtgcccgaagtgcggcagctcgccgcatcactgtgggaagacgtcggcctgcagtggcaaaaagaaaacgaagaagacttaaaggataagctagattttgccccaccgacaccaccacattatcctcctcacgaacgccgccccgttctggggtgccgtgaattggtgtttagaaaccttagcaagattcttcccgccctgtgccatgacattactgactgggtggtggggacccgggtcaaatccgctcagctgctccccgtgctgcttctgcatgccgaggatcacgccacccagcacctcgaagtggttctgcgcacgctgtttcaagcatgcactgatgaggaggcagcagttgtccagagctgcacccgcagtgccgagctggtgggcacgttcgtgtcacccgaggtctttctcaagctgatcctttcaacactgaaaaaaactcccagcgcaagcgggctgttagtactcgcatcagccatgcgtggatgcccccgcgaagctctccagccccatctggctgcaatcgccaccgagttagcccaggcccatatttgccaagcctcagaaaacgacctttacctggaaaggctgctcctctgcgtgcaggctctggtcagcgtctgtcatgaggactgcggtgtagctagtttgcagcttctggatgttctacttactatagtggctctcgccggcgccacgggtcttcgagataaagcccaggaaaccatggatagtctcgccatggtagagggcgtctcctcctgtcaagatctctaccgaaagcatattggccccttgctggaacgggttactgctagccacctcgactggaccgcccattcccccgagctgctgcagtttagcgtaatcgtggcccagtccggtccagcactgggggaggctttgccacatgttgtgcccactctgcgggcttgccttcaacctagccaggatccccagatgaggctcaagcttttcagtatcctgagcaccgtgctactccgggcaactgatactatcaatagccagggccagttccccagctatctggagacagtcaccaaggatattttggcacccaacctgcagtggcacgcaggcagaactgctgctgccattaggactgcggccgtatcctgcttatgggctctgacctcatcagaggtgctgtccgcagagcagatacgagacgtgcaggagactctgatgccgcaagtcctgactacattggaagaggattcaaagatgactcggctaatctcctgccggataattaataccttcctgaagacgagcggaggcatgactgaccctgaaaagctaatcaggatctatcccgagctgttaaaaagactggacgatgtcagcaacgacgtgagaatggccgctgcctctactctcgtaacctggttacagtgcgtcaagggggctaatgcaaagtcttactatcagtcttccgtacaatatctctacagggagctgctagtccacttggacgacccggagcgagctattcaagatgccatcctcgaggtgctgaaggaggggtcaggcctgtttcccgatcttttggtgagggagactgaagcagtcatccataaacacaggtccgcaacctactgcgaacagctcttgcaacatgtgcaggccgtcccagccactcagtag

SEQ ID NO: 30443 - DNA, 2043 bp, Artificial Sequence
  Description of Artificial Sequence: Synthetic coding sequence
atgggaaaatctcgcactaagcgattcaagcggccccagttctcgcctactggcgattgtcaggcagaagctgccgctgcagccaatggtaccggtggagaagaagatgatggaccggctgctgagctgcttgagaagctgcagcatccaagcgctgaggtccgagaatgcgcatgcgcagggttggctaggctggtgcagcagaggcccgcactgccagggctggcacgtcgagatgctgtgaggcggttaggccctctgttattagacccctctttggccgtgcgggagacagccgcgggtgcgctccgaaatctgagtgcatgtgggggatttgaagtttgcgacgatatggtgacaaaggacattatgaccccactcgtggccctgcttaaagaatgttccgctgggctcgactcaaacgagatgagcttgcaggaaaaaaaggatcaaaaccgtaactcaatcgagaatattgcaaacgaaaccgttaacgtgctatggaacatctgtgagtgtagcagccgggctgtgagtatttttaataaagaaggatgtctggaaatagtcctgaagtacctttcaaggttccctaccaatgtggacctggcaattagtgtggcttactgtctccaaaccgtgaccgaggataatcccgagcttctaaagagcttttccgcgacagctctgaatatgctggaatcagctttactgagtccagtcagcagcatggagtctttgctgttgaagacacttgtggcaggtacaatttggaatctgaaggacatcattccctgcaaaagtcaggcggagataatcaatgcactcctaaaaatactgtcagaggtgctgggaatggacgccggcgagatggtcatccagatgaaggaagcggagacacagcgactaaagaccgcagccgaggccgaggagattctcgaaaacaccaatggcgatgatctcattgaagacgatgaaatggaaggaatcagtcataagagacgtgtgcggagaaagactttcgtgtctgacctgctgccccccacagacaaggagctgcgggagactatagccctattaacagcacaacagaccgcgctggaaatcatcgtgaatatgtgctgcaacgaagatccctctgacgacgagtgggaggagctgtcttcatctgacgagtccgacgcttttatggagaactcattttcagagtgcggcggacaactgttctcaccactatgcttgagccatgaggtacatacggcgttgacaaactacttgattcctaagaagatcttcgagaaaacagcattccccaacagcatcgcagttgatctttgcagtcgaaacccgacctggaagccactcatcagaaagatgaacaccatccagtgccgggctctgttttgtttgcagtctctggtatccctgctcgacgtcgagcatctgggtggcgcagccgcccttcagactctggcacagcacctcagccagcttttattctctcagccggactttgccaagcacgtggatttcctggaagccatatcttctgcccttcgcgcgctcttgcagacgatggcctctaagaacatatcccagtgcatgacccctgaccagctgatgactctgtgcaaggcgggaatccacagcagtaatgtgggcgtgcgcgtgaacgtggtgtcaatcctggggatcacagggtcagttctcgccaaagaggacggcactcttgagaccctcaagaacatcggctgcttcctcctcgaggtgaccaccaaggaccctagtctcgtggtggctggcgaagctctcgacgccttattcgatgtatttgcagacggtaaagaagccgaacgcgcttcaatccagataaagctgctctccgcactgaaggaatttcagccagtttttaaaatgaagatacgtaaggaggggcgcgggaactacagtaccgatcagctctgtgtcctcgataatgtgaagatgaacttgaggagatttatcgcctatcaggaaaccgtggagaagcgtttgacaagctag

SEQ ID NO: 30444 - DNA, 3081 bp, Artificial Sequence
  Description of Artificial Sequence: Synthetic coding sequence
atgacccggacacagaaagggaaaactttcctcccgcattgtttctaccagtcgctgccgccccggctgggctgggggatgattctgaattattcaaagctcaagggcaaagaagagtgcgcaagtgtgtcttcagttcccatggtgttctttagttcacagtatcgcttacacaggaagtctcagtatcttaagatggccgcagcgaatctgactttttcccaagaggtggtatggcagagaggactgcctagtattccatactctcaatacagtttcgaccacctgtataatacgaatgacattatccacactcctcagatccggaaagccaggccccagaagcccgtgtcatttaagttcctgggtagttcctccccactaacgggggatacctcgctcgcagtcaaaaccgagtcgtcggctaaccccgagaagaaattgaagaaaagtaagcctgccagcaccgtgcgagaagctccgcgacctctcattcaccacccttgtatgcatcctgatatgttgggccgcccgcctagcctggatgttaatttagaggaacgtgaggcatggctgctaccccctgaaaaggaagcacgtgcctgggaggctactgtgttggagaagttaaatgagcgcactgcccgttggatccagtccaaaaggccgcgacgcccaggcgcgagccctaataagtggcagtccttcctcagacaacagtacgactggtcccacatccgggacgaattgaccagcgcaagtgatcttgagctcctgaaacaacttgaagctgaggaaaccgccgagtttgaagaccagtcagtgattctgccgcctcaggagaagaagaagcctgaactgttgcttccagtctactataggcttcctagctattttcagcaggctgaaaccgtggagataatgcccggcaacaagagcaccgaggacatccacgagaagacaagtctctcccagcctcagactcagtcttattttcgacaggtgactcctagggcgggtaagttcgcatactccactgataacactttcgaacaagaaatttacttcgacgaggttcaaatcatccatcagatcggagctaagagggatcagatcgtgctcgaaaacctcaacaggtataacaaacagctgagcaaggtgtttccagaaaccccggagaagtggtccgcacaggcgatccctgaagctagctaccggcccgttcagggtgctttaaggtggactgctttgccaactcccgcgaaggatatgctgctccaggtcggagagaaagatgtgccaatcaaaaccaggcgcctgaagaagcaagccaaatccctgcaggaggatgtcacttgggagctggtggtgctacggagaatgctcaaggagtggaaaaccgcatgggctctcatcatcgaatggcatcacgagactgtggaaaacttgttacagtcgttgggagatctgcatgacgatgtcaggataaaagctatcactacctgcgcaacggctgcacttgagcgccctcgaattgctacaagccagcgcgacagcgacaaaacgatccaggacctgccagaggttcttctgccagccctcgaagccgcgctctgcgataaaaatgcccatgtgagaatggccgcagccatttgtcagtacgcgatccaatcgcataaccccttagcaagaaacatcatgcagacggccttgctaaaaggaaactctgtcgattcttgggccgctgcgcagtgcctggccttagaagggacagccacctatccagtcatcaaaaggatcctccaccagctttttacaaagaaaaacgaggacacagaggagcagtcctatatcctgctctcttacctgtctgagaagacaacgctgattcacactatgctagccgtggaattaaacagctgccagtggaagaacagaatcgtggcatgccaggcttttagcaggattagcggcaatgtgtgtctggatatgaagcacaaactgatccaactcatgtggaacgattggaacaaagaggtccggcgcgctgcggcacaggccctaggacagatgtctttggggaaagaagttcacgatattatccgtgtgaaactcggccagggcaactcacaagagagagttgaggccttgtatcttatcggagaattgaagctgatgacggccaaactcctgccttcgttcctccactgtttcagtgatgacttcactgctgtccgcagagctgcttgcttagctgcaggggccctccagatacgggataagatggttctggagtgcctgctgaacctcatgcagcgggacccctattggaaaatcaaggctttcgccattagggcgcttggtcagatcggtcaggtttcgccggagcttaccgacttactcctgtgggccatccattacgaagaatcccctggtgtgcgtctggaggcgtgtcggagtatcctcgcattaaagctccagggcgatcgggttagggatacgtttctggacgttctgctactagagaatcatgacgctgtgttgaaagagatgtatcaaaccatgaaaattcttaatttaggaaacgaaggcaatcaggagatgctgcaggaaattaaaaataggattaagaccttgtctcagaaggatctgttgactcataagatcctgaagctggagatggttatgggcaaggtgagggaggaggccaaaagggtgtatttgaaacccaagggcgaacaggggcctcttacattgcagacactgctccaggagacgtttcaggacgaaatggtgctgcctcgtagacccagtgaggtgtgtgacaccgaggcagtcattaagcctgttaagcctagagcccccaatccctggctgcagtcgtcagtccccggcctgaccacgcgcagcaaagtgagatcctccttagtgaaagacctgcgcacctcacctgagaaaagaatcgctgtaggacccttcaggtcagactaccctgctctctacctgggcaaattttccgagcgaactttcttctctcccattatgtcatcaccttcaggcaaaaagggagctcacttatag

SEQ ID NO: 30445 - DNA, 3081 bp, Artificial Sequence
  Description of Artificial Sequence: Synthetic coding sequence
atgacccgcacacagaagggtaagacattcctgccacactgcttctaccagagcttaccaccaagacttgggtggggtatgatattgaattactccaagcttaagggcaaagaagagtgtgcaagtgtgagtagtgtgcccatggtcttcttctccagccagtatcggctgcacagaaagtctcagtatttgaagatggctgctgctaatctgacattttctcaggaggtggtctggcagagaggattgccgagtatcccctactctcagtacagtttcgaccatctatataacaccaatgacatcatccatacaccacagatccggaaagcgaggccacagaagccggtgagttttaagtttttagggagctcatcccctctcacgggggatacgagcctggccgttaagaccgagtcatctgccaaccctgagaaaaagctcaaaaaatcaaagcctgccagcaccgtcagggaggcacctagacccctgatccatcatccctgcatgcaccccgatatgttgggacggcctccatccctggacgtaaacttggaggagagggaggcgtggctcctgcctccagagaaagaggcgcgagcctgggaggctaccgtcctggaaaagctcaacgagaggactgcgaggtggatacaatccaagagacctagaagaccaggggcatcaccaaataagtggcaaagtttcctccggcagcagtatgactggagccacatccgggacgaattgactagtgcatctgatctggagctacttaagcaacttgaagcagaagagacagccgagttcgaagatcagtccgtgattttacctccgcaggagaagaagaagcctgagttgctactacccgtgtactacagactgcctagttacttccagcaggcagagactgttgaaatcatgccaggcaataagagtacagaggatattcacgaaaagactagtctgtctcagccgcagactcagtcttactttcggcaagtgactccccgcgccggcaaatttgcttacagcaccgacaatacattcgagcaggaaatctactttgacgaggtgcagatcatccatcagataggggccaagagagatcagattgtgctagaaaatctcaatcgttataataagcaactctccaaggtcttccctgaaactcctgaaaaatggtctgcacaggccatcccagaggcctcttacagaccagtccaaggagcccttaggtggacagcgctgcctacccccgccaaggatatgttactgcaggttggagaaaaggacgtgcccatcaagactcgtagactgaagaaacaagccaagagcttacaggaggacgtcacctgggagctcgtcgtgttgagaagaatgctgaaggagtggaagactgcatgggctctcattattgaatggcatcatgagacagttgaaaatctcctccagtcactgggggatttgcacgatgatgttcggataaaggcaattaccacatgcgctacagctgcgctggagagaccgcgcatcgccacaagccagcgagactcagacaaaacgattcaggatctacccgaggtactcctgcctgccttagaggccgcgctctgcgataagaacgcccacgtaagaatggcagcggctatctgccagtacgccatccagtcccataacccactcgcccgaaatatcatgcagacagcactgctgaagggaaactccgttgactcttgggcggctgcccagtgtctggcgttggagggcaccgctacttaccccgtgatcaagagaattctgcaccagctgttcactaaaaaaaatgaggacactgaagagcagtcttacattctcctgagttatctttcagaaaaaaccactctcatccacaccatgttggcagtggagctaaattcctgccaatggaaaaaccgtattgttgcgtgtcaagccttcagccggatctcaggcaatgtgtgcctggatatgaagcacaagctgatccagctgatgtggaacgactggaataaagaggttcgcagggccgccgctcaggcgcttggacaaatgagtctgggtaaggaagttcatgacattattagggtgaagttgggccagggtaacagccaggagagagtggaggcactgtatctcattggtgagctcaaacttatgaccgccaagctgcttcccagttttctgcactgcttcagcgatgacttcaccgccgtgcgacgagcagcttgtctggcagcaggagcacttcagatcagggacaaaatggtgctcgagtgcctcttgaatttaatgcagcgcgacccctactggaagattaaggcgttcgcgatacgcgccttgggccagattggccaagtgagcccggaactgacggatctgctcctgtgggctattcactacgaggaatcacccggggtccgcctagaggcctgtagatcgattctggcgttgaaattgcagggagacagagtccgggatacattcctggatgtccttctcctggagaatcacgatgcagttttaaaggaaatgtatcagaccatgaagatccttaatctggggaacgagggtaatcaggagatgctgcaagagattaagaatagaatcaaaacactgtctcagaaagacctgctgactcacaagattctgaaattggagatggttatgggtaaagttcgcgaggaggctaagagagtgtacctcaaacctaagggggagcagggcccactgacactgcagaccctgttgcaggaaacctttcaggatgaaatggttcttcccaggcgtccgtctgaagtttgtgacactgaagccgtgatcaagcccgtgaagccaagggcacccaacccgtggctccagtctagcgtgccaggattgactacccgtagtaaggtgagaagtagtctggtcaaggacctcaggactagtcctgaaaaaagaattgcagtaggaccttttagatccgattaccccgcattgtacctagggaagttttcagagagaacatttttctctcccattatgtcttctcccagcggcaaaaagggtgctcacctgtag

SEQ ID NO: 30446 - DNA, 576 bp, Artificial Sequence
  Description of Artificial Sequence: Synthetic coding sequence
atgactaggactcagaagggtaagacattcctcccccattgtttttaccagagtctgcccccaaggcttggatggggcatgatattaaactactccaaattgaagggaaaagaggaatgcgccagcgtatcaagcgtgccaatggtgtttttcagcagccaatatcgtctccacaggaaaagtcagtacttgaaaatggcagccgccaaccttactttttcgcaggaggtcgtctggcaacgggggctcccatctattccttactcacaatacagtttcgatcacttatacaacacaaatgatattatccatacgccccaaatccgaaaagcaagaccccagaagcccgttagtttcaagtttctggggtcctccagccccctgactggcgatacctcactagcagtcaaaaccgagtcatccgcgaatcctgaaaagaagctgaaaaaatctaagccggcgagtaccgtgcgggaagccccccgtcccctgatccaccatccctgcatgcatccagacatgctcgggaggcccccctctctcgacgtaaacctggaggaaagagaggcttggtag

SEQ ID NO: 30447 - DNA, 120 bp, Artificial Sequence
  Description of Artificial Sequence: Synthetic coding sequence
atgacaagaacacagaagggaaagacatttcttcctcactgtttttatcaatctttgcctccacgcctcggctgggggatgattctaaactactcaaaacttaaaggtaaagaagagtag

SEQ ID NO: 30448 - DNA, 2940 bp, Artificial Sequence
  Description of Artificial Sequence: Synthetic coding sequence
atggtgttcttctcatcccagtaccgcttgcacaggaagtcccagtacctgaaaatggcagctgcaaacctgaccttcagccaggaagtcgtgtggcaaagaggcctcccttcgatcccttatagccagtactcattcgatcatctgtataacacaaacgatatcatacatacaccgcaaatcagaaaagcaaggccgcaaaaacccgtgagttttaaattccttggcagctctagccctcttaccggagataccagcctcgctgtaaagacggaatcttctgctaaccctgagaaaaagctgaaaaagagtaagcccgcctcaaccgtccgtgaagcaccacgcccattgatacaccacccatgcatgcatccggatatgttaggcagaccacctagcctggacgtgaacctggaagaacgtgaagcctggctgcttccccccgaaaaagaagctcgcgcttgggaggcaacagtgttggaaaaactgaatgagaggactgcaagatggatccagtcaaagagacctcggaggcccggtgcgagccccaacaagtggcaaagctttctgagacagcagtacgattggagtcatattcgtgatgaattaacgagtgcctcggacttggagctactgaagcaactcgaagccgaggaaactgctgagttcgaagaccagtcagttatcctccccccacaggaaaaaaagaagcctgaactactgctgcctgtctattacagactgccatcctactttcagcaggctgagaccgttgaaattatgccagggaacaagagcacagaggatatacacgagaagacttccctaagccaaccgcagacacagtcatacttccgacaggtgaccccccgtgcaggcaaattcgcctactcgaccgacaatacctttgagcaggaaatatattttgatgaagtgcagattatccatcagatcggtgcaaaaagggaccagatcgtgctggagaacctaaacaggtacaacaagcagctgtcaaaggtctttcctgagacacctgagaagtggagtgctcaggctattcctgaggcctcttatagaccagttcaaggcgctctgcgatggacagcgctccccacacctgctaaagatatgctcctgcaggtcggggaaaaggacgtgccaatcaaaacaagacggcttaagaagcaggcaaaatcccttcaagaggatgtgacttgggaactcgtggtactgcggagaatgctgaaagaatggaagacagcttgggctctgattattgagtggcaccatgaaactgtcgagaatttactccagtctctaggggacctccatgatgatgttcgcatcaaggcgattactacttgcgccaccgccgccctggaaagaccgaggattgctacttctcagcgcgactctgataagactatccaggacttgcccgaggtgttgttgcctgcacttgaagctgcactgtgtgacaaaaacgcccacgtgcggatggccgctgctatatgccagtacgcgatacaaagccataacccactcgcccgaaatattatgcaaactgcactcctgaaaggcaatagcgtggattcttgggctgctgctcagtgtctcgctctggagggaaccgcaacttatcctgtgatcaaaagaatccttcatcagctgttcacaaagaaaaacgaggatacagaagaacaatcttacattctgttgtcttacctgtcagagaaaactaccctgattcatacgatgttggctgtggaactgaactcatgtcaatggaagaacagaattgtggcatgccaggccttttcccgaataagcggcaacgtctgtttggatatgaaacataagctgatacagctgatgtggaatgactggaacaaggaggtgcggagggccgccgctcaagctttggggcagatgagtcttggaaaggaggtgcacgacatcattcgggtcaaactcggccaggggaacagccaagagcgcgtggaggccctgtatctgattggtgaacttaaactcatgacggctaagctcttgccttcatttctccactgctttagcgatgattttactgccgtcagaagggctgcctgtttggcagccggggcactccaaatacgagacaaaatggtgctggagtgtctgttgaacttgatgcagagggatccatactggaaaataaaggctttcgctattcgtgccttgggccagattgggcaggtgtctcctgagctaacagatttactcctctgggctatacattacgaagagtccccaggagtccggttagaggcatgtagatccatcctggcccttaagctgcaaggagatagggtccgagacactttcctggatgtcctgttgctcgagaaccacgatgcagtcctgaaggaaatgtaccaaacaatgaagatactcaatctgggtaatgagggaaatcaagaaatgcttcaagaaattaagaatcgaattaaaacactgagtcagaaagatctccttactcacaagatactgaagctggagatggtgatgggaaaagtccgcgaggaggcaaagcgcgtctatttaaagcctaaaggggaacagggcccattgaccctgcagactctgctgcaggagaccttccaggacgagatggtcttgccgagacggccctctgaagtgtgtgacaccgaggccgtgataaaaccggtcaagccacgagcccctaacccttggctgcagtcctctgttcccgggctcacgacgcgctcaaaagtccgatctagcttagttaaagacctgaggacaagtcctgagaaaagaatcgcggtgggcccctttagaagcgactaccccgctctgtatctcggaaaatttagtgaacggacctttttctctcccataatgtcatctccgagtggcaaaaaaggggcacatctgtag

SEQ ID NO: 30449 - DNA, 6123 bp, Artificial Sequence
  Description of Artificial Sequence: Synthetic coding sequence
atggaactggcacactcactgcttctgaacgaagaggcttacaatcagctgggggaagtgcagaaagccgagttcatatttgaatggctgagatacctggaaaagctactgctcgcgacgagcaggaatgacgtccgggagaaacaaaagacacttgtcgagcagctgctgagcctcctgaacagttcccccggacctcctactcgtaaattactggccaagaatttggctattctgtattcaatcggggacacattcagtgtccacgaggccattgataagtgcaacgatttgatccgttccaaggatgactccccctcctacctacctacaaaacttgcagcggtggtctgcttggggtccctctacaaaaaattagggcggatacttggcaataccttcacagacacggttggcaacattctcaaggctatgaagagcgcagaaagccagggaagatatgagatcatgctgagtctccaaaacattctgaacggtctcggcgctgccgcagcaccttgccatcgcgatgtatataaagcagccaggtcatgtctaaccgataggagcatggccgttcggtgtgcggctgcaaagaacgaggcaatctttatgtggagtactgacctggacagcgtagcaaccctgtgtttcaagagttttgaaggctctaactatgatgtcagaatcagtgttagtaagttacttggcatcatcttagcaaaggctgtcatcagcaagcatccagggaccgcagctagtcgccagtccattcggagagtcagtctggaggaagtgctagaattgctgggtaccggcttcctacggggctcctccgggtttctacgggcttcgggggacatgctcaaggggacctctagcgtgagtcgagatgtgcgcgtgggggtgacacaggcttacgtcgtttttgtgtctacactggggggcgcatggctggagaagaatttcgccgcatttttttcacacatactgtccctggcgtcaccaagccaccctaaagccacacagacgcagattgatgccgtgtgctgtagaagatgcgtgtctttcattctgcgcaccacaatcggaggtctgctgggggaaaaagctcagttagcagccgtgaaagatatttgtcaggctatatggaaactgaagaaggtgatggacgcagtcatgagcgatgggaatttggaaacaaggctcggatccactgacgtggctgcgtctcagcatatgctggtgtgcgccctacaggagttgggcaacttgattcataaccttgggacaactgcggccccgcttcttcaggactcgtcaacggggctactggactcaattctgtctgtcatcctgcaccctagcatatcagtacgcctagcagctgcctggtgtctccattgcatcgcagtcgctctgcccagctacctaaccccacttctggatagatgtcttgaacgcctcacaggtcataagagcagtccagaagccgtgacaggtttttctttcgcggtggccgctctgttaggcgctgtaaagcactgccctctcggcattccccacggaaaagggaaaattattatgaccctggcagaggatctgttatgttctgccgcccaaaacagcagactctccgcgcaacggactcaggctggatggctgttgatctcagcgctgatgaccctcggccccgccgtcgtcagccaccatctggctagggtccttctgctttggaaatgtgtcttccctgccagtccaaaggatctggagacggagaagtccagaggcgattcatttacttggcaggttacccttgaggggcgtgctggtgccctatgtgccattaagtcatttgtgtcgcattgcggggatctgcttacagaggaggtcacccagcgtctgctgccgccccttccttgtgctgttgatcttcttactcagttaagctctattctgaagatgtacggctccccgcttaaaaccccaagtgtcgtgtatagacagaggctctacgagctgcttatactgctgcctcccgagacttatgaagggaacctgtgtgccatcctgagggagcttgccgccgacctcaccgctcccgatattcaggtggcagcctctaccttcctcttgccacccctgtgccaccaggatgaccttctcattctgtcaccgttcctgcaggagactgaccacaggtttattgaggaacagctgctgctgggaaacggggtcgcctgcggatcactggaatacgatccttactcaatctatgaaaaggatgtggagggtgacagcgtgccgaaacctctgccaccagctctgtctgtgatcagcagcgccagcaagcttttcggcgtggtgtgtgctcacgtgggagagacacagcgtctcttaatccttgaacagctgctggactctattaaacatacaaaaggggctagacagcaggtggttcaactgcatgtagtttccagtgtgtcttctttcctgaagtatgtagccggctctaagggatgtttagggcccgaggaaatgaaaaggttcgcccttactctggtaatgggcgctttagaatcgcccaatccattgctgaggtgcgctgctgctgagtcctgggccaggctcgcccaggtggtggatgacggcgccttcactgcgggcttggcgcaggtgagtttcgacaagctcaaatctgcaagagacgtggtgacgcgcacgggccacagcctggccctaggctccctgcaccgctacctggggggaatcagttccagccagcatctgaattcctgcattggaatcctgtacaccctggcacaggattccacttcacctgacgtgcagacttgggccctgcactctctctcactcataatcgactcagctggtcccctgtattacgtgcacgtcgaaccaacgctgtccttaatcattatgttgctacttaacgtaccgccgacccacgctgaggtgcaccagagcctgggtcgctgcttgaacgctctgatcaccacactgggtcctgagctacagggcaattctacgtctatttctactctccggacttcctgtctgttaggctgcgccgtcatgcaggacaatccggattgtcttgttcaggcgcaggcgattagttgtctgcaacagctccatatgtttgccccccggcatgtaaacttgtccagtctagtgtcctgcctgtgcgtgaacctttgctcaccttacttgcttctgcggcgggcggtgctggcctgcttgagacagctggtccagcgcgaggccgcggaagtcagcgaacacgcggtaatgttggccaaggacagcagggaggagctcacccctgacgccaacattagagaggtgggccttgaaggcgccttgttgattctcctcgataaggagaccgatgaaaggctctgtcacgacatcaaggagacccttaattatatgctgacttccatggcagtggaaaaattgagcttatggctgaagctttgtaaggatgttctggccgcatctgcggattttacagcagtgacctgtgtggacactatgcaggaagaagagggggacaaaggcgacgacgcaagtgttttgaccacccggagggacgagaaaagccatcccttcaccaatccacggtgggccacccgggtgttcgctgccgaatgtgtctgtaggattataaaccagtgcgagaacgcaaattccgcccattttgatatcgcactggcgcaggaaatgaagaaaagagattcacggaacgactttcttgtgctccacctggccgacttgatacgcatggcctttatggccgcaacggatcacagtgaccagctgcgcctgagcggcctggagatgctgctggtagtcattcggaggttcgcaacagtacctgaaccagaattccccgggcatgtcatcctcgagcagtatcaagccaacgtgggagcagcactgagacctgcatttacatctgaaactcccccggatgttacagctaaagcttgtcaggtgtgttctgcgtggatcgcctccggtgttgtgagcgacctgaacgatctcaggcgtgtccaccagctgttggtaagctccctgactaagatccaggccggcaaggaagcattgtcacacttgtacaatgaatccgcaagtacaatggagatattggccgtgctgaaggcctgggctgaggtgtatataatcgccgttcagaggcataaaaatcacagacagcccctgaagaccacaacttgcttggaggacggaatccgtaatggatcatgctcgtctgacgggctcctggatctggtgtacgcggatctgggaacactgtccagattatggttggccgcccttcaggacttcgctctgctgactctgccatctgaattcgccagccagctgcccgccgaagggggggcgttctacaccgccgagacttccgagaatgctaaactgcactattacaatagctgggctctcatcctgcacgctaccgcactgtggctgacttctacaggctttgtggtggccgatccagacgagggagcatccaatttatctagacctgtgacacccacttcgatgtgccaaggcagttcgtctggggctaccattaaatcccctgaagatgtctacaccgaccggtttcacctgatcctgggaatttcagtggaattcctgtgcagcctgcgatcggatgccaccatggaaagtataacagcctgcctacacgccttgcaggcactgctagatgttccctggcccagaagcaagatcggctcagaccaagatctcgggattgaactcctgaatgtgctgcaccgtgtcatccttaccagagaaagtcctagtatccaactggccagcctggaggtagtgcgacaaatcatatgcgccgcccaggagcatgtgaaggagaaacgtcggtcagctgaggtggatgacggtgccgcagagaaggaaaccctgcccgaattcggagaggggaaagatacggggggactcgtccctgggaagtccctggtgttcgccaccctcgagctgtgtgtgtgtattctagtgcggcagttacccgagttgaaccctaagctgactggttcacctggggtcaaggctactaaaccccagatcctcctggaggatggctcacgcctcgtgagcgctgcacttgtgatactgagcgagctgcccgcagtgtgctctccggagggatcgatatccattctgccaaccattctatatttgactataggcgtgttgcgcgagaccgccgtgaaactgccaggcgggcagctgagctctacagtagccgccagcctccaggctttgaaaggtatcctcagcagtccaatggccagggccgagaagtcaagaactgcctggaccgacctgctgaggtccgccctcacgacaatactggactgctgggaccctgtggatgaaactcatcaggaactcgatgaggtgtcccttttgacagctattaccgtgttcatcctttcaacctcccccgaggtcactacaataccatgcttgcagaagaggtgtattgataagttcaaagccactttggaaatcaaagatccggttgtgcaaatcaagacataccagttgttgcacagcatatttcagtatcccaaccctgccgtttcctatccctacatctattctctggccagctgtataatggaaaagctgcaggagatcgacaaacgaaagccggaaaacacagcagaactcgaaatctttcaagaagggatcaaagtccttgaaaccctggtcacagtcgcggaggaacatcaccgggcccagctcgttgcttgcctcttacctatcctcatctcctttctgttggatgagaacagcctgggctcagcaaccagcattatgcgaaatctgcatgatttcgctcttcagaatctaatgcaaatcggcccccagtattccagtgtgtttaaaagtttagtggcatcaagcccagcccttaaggcacgcctagaggccgctataaagggcaatcaggaaagtgtgaaagtaaaaatccctacctccaagtatacgaaaagtcccggtaaaaacagtagcattcaattaaagacgtcatttctctag

SEQ ID NO: 30450 - DNA, 3423 bp, Artificial Sequence
  Description of Artificial Sequence: Synthetic coding sequence
atggagctggctcatagcttacttctcaatgaagaggcatataaccagctcggggaggttcagaaagcagaattcatttttgaatggctgagatacctggaaaagctgctcttagccacatctaggaacgatgtgcgagaaaagcagaagaccctggtcgagcaactgcttagcttgctgaactcaagcccgggcccacccactaggaaattgttggccaagaacctcgcaatcctgtattcaataggagataccttctccgtgcatgaggcaattgataagtgcaacgacctcatcagatctaaggatgactcacccagttacttaccaaccaagttagcagcagttgtctgtttggggagcctctacaagaaactcggccggatcctgggcaacacctttacagatacagtgggtaatatcctcaaagcaatgaaaagcgcagagagccaggggcggtacgagatcatgttgagtctgcaaaacatactgaatggcttgggcgcggcagctgctccctgccacagggatgtctacaaggctgccaggtcctgcctcacagacagaagcatggcagttagatgtgccgccgccaaatgtctgctagagctccagaacgaagccatatttatgtggagcaccgatctagattctgtggctaccttgtgttttaagagcttcgagggcagcaactacgacgttcggatttccgtctcaaaactacttggaattatcctcgctaaggccgtaatcagcaagcatcctggtactgccgcttcacggcaaagcatcagaagagtcagtctggaggaagtccttgagctgcttggcactgggtttctgaggggcagctcaggctttctcagggcctccggcgacatgcttaaaggaacttccagcgtatcacgcgacgtcagggtcggggtgacccaggcatacgtggtctttgtgagcaccttagggggagcctggctcgagaaaaactttgccgcgttcttctctcatattctgagcctagcctctccatcacacccaaaggccactcagacacagatcgatgctgtgtgctgtaggagatgtgtgagctttatcctaaggacaacaatcggtgggcttctaggtgagaaggctcagttagctgctgttaaggatatctgccaggccatatggaagttgaagaaagtgatggatgctgtcatgtccgacggaaatctcgagacccgcctcggcagcaccgatgtggcggcctcccaacatatgctggtatgcgccctgcaagagctggggaatctgatccataatttgggcacgaccgcagccccgttgctgcaggacagctctaccggtttactcgatagcatcctatcagtgatactgcacccgtctatcagtgtcagacttgccgcagcttggtgtttacactgcatcgctgttgcactcccttcttacctcacgccattgctcgatcggtgtttggaaagactgacgggacacaagtcttcccctgaggcagtgactgggttttcttttgcagtggctgccctgctgggcgctgtgaagcattgcccccttgggattccacatgggaaaggcaaaatcataatgacactcgccgaagacctcctctgttctgcggctcagaactctagactgtccgcccaaagaacgcaagccggatggctgctgatcagtgccctcatgacgctcggcccggctgtggtctcacatcacctggccagggtcctgctgctgtggaagtgcgtgttccctgccagccccaaagatctagaaaccgagaaaagcaggggcgacagttttacctggcaggtgaccctcgaggggagggccggtgcattgtgtgccatcaagagctttgtgagccactgtggggacctgttgacagaggaagtaacccagagattgttacccccactgccatgcgctgtggatctgttaactcagctgtcttctatcctcaaaatgtatgggtcccctctgaagactccatctgtggtctaccggcagcgtctgtacgagcttctgatcctactgcccccggaaacctacgaaggcaatctttgtgcaattctccgtgagttagcggcagacctgaccgctccagacatccaagtcgctgcaagtaccttcttacttcctccactgtgccatcaggacgatctcctgattttgtccccttttttgcaggaaaccgatcacagattcatcgaggaacagctgttactgggaaatggcgttgcatgcggctcactggaatatgacccctattccatctacgaaaaggatgtcgagggcgacagcgtgcccaagcctctgcccccagctctgtctgtaatttcttctgccagtaagctctttggagtggtctgcgctcatgtgggcgagacacaaaggttgctgatcttagagcagctcctggattccataaagcataccaagggcgctaggcagcaagtagttcagcttcacgtagtgtcaagcgtctcaagttttctgaagtacgtggcgggatcaaagggttgcctcggcccagaggagatgaagagatttgctctgacactagtaatgggagctctggaaagcccaaacccgttattacggtgcgctgctgcagagtcctgggcacggctagcccaggtagtggatgacggcgcgtttaccgcaggactggcccaggtaagcttcgacaagttgaaatctgctagggacgtagtcactcggactggacatagcctggctctcggcagtctccatcggtatttaggcggcatttctagcagccagcacctgaattcctgcataggaatcctgtacacattggcccaggatagcacaagccctgatgtacagacttgggccctccacagcctgtcccttattatagatagcgcaggtccgctgtattacgtccatgtcgagccaacactgtcactgatcatcatgctcttgctgaacgttccccccactcacgcagaagtacaccagagcctcggccggtgtctgaatgccctgatcaccactctggggcccgaactgcagggtaacagcaccagtataagcactcttcgcacgagttgcctactgggttgcgccgtcatgcaggataacccagactgtctagtgcaggcccaagctatatcatgtctgcaacagctgcatatgtttgcaccccgccacgttaaccttagtagcctggtgtcttgtctctgcgtcaacttatgctccccttacttactgctgaggagggccgttctggcctgtctgcgccagctggttcaacgtgaagctgccgaagtcagcgagcatgccgtcatgctggccaaggattcgcgagaagaacttacccctgtgttcaccgcttccagcccaggggttgactccatatgtcgcaaccacttggaatag

SEQ ID NO: 30451 - DNA, 5898 bp, Artificial Sequence
  Description of Artificial Sequence: Synthetic coding sequence
atggagctggcccattcacttctactgaacgaagaggcatataaccaactgggcgaggtgcagaaagcggaatttattttcgagtggttgcgctaccttgagaaactgttactggccacctctcggaacgatgtgcgcgagaaacagaaaactctggtggagcagcttctgagcctcctcaatagctccccgggcccgcctacacgtaaactcctcgccaaaaacctcgccatactgtactcaatcggagacaccttttctgtccatgaggccattgacaagtgtaacgatctgataagaagtaaggatgattctccctcctatcttcctactaagctggctgctgttgtgtgcctcgggtcactgtataaaaagctgggccgcatacttggcaacacattcaccgacactgtcgggaacattttaaaagcaatgaagtccgccgagtctcagggaagatatgaaatcatgctttcgctacagaatattctgaatggccttggcgcagcagccgccccatgccaccgggacgtctacaaagccgccagatcgtgcctcactgaccgttctatggccgttaggtgcgccgccgccaagaatgaagccatattcatgtggtccactgacctcgatagcgtcgcaaccctatgcttcaaatcgtttgaaggtagcaattatgatgtaagaatttcagtcagcaaactgttgggcattattttggccaaagctgtgatctctaagcatccaggtacagcagccagtcgtcagagcatccgacgtgtatccctcgaagaggtgctggagcttctaggtaccggcttcctgaggggctccagtggcttcctccgagcatcaggagacatgctcaaagggacatctagcgtatctagggacgtgagggtcggagtcacccaagcttacgttgtgttcgtctcgactctcgggggcgcttggttagaaaaaaattttgccgctttcttctcacatatcctgtccctcgcatcaccatcacaccctaaggctacacagacccaaatagatgccgtttgctgtcggaggtgcgtctccttcatattgagaacaaccattgggggcctgctgggcgaaaaagctcaattggctgcagtgaaggatatctgccaggctatctggaagcttaagaaagtgatggatgctgtcatgagtgatggcaatttggagaccagactgggctccaccgatgtggcagcatcgcagcacatgcttgtgtgcgccctgcaggagctgggtaacctaatccacaatctgggtacgacagccgcgccactcctgcaggacagttctaccggcctcctcgactcaatcctttcagtgattctccacccgagcattagcgtccgcttggcagccgcctggtgcctgcattgcatcgccgtggccctgcctagctatcttacacctcttctggacagatgtctcgagagacttacgggtcacaagagcagccctgaagcagttaccggcttttcctttgcagtggctgcactgctcggggcggtgaagcactgccctttgggcataccacatgggaaaggaaagatcataatgacgctcgctgaagaccttctgtgctccgccgctcagaactctcgtctcagcgctcagcggacccaggccgggtggctgttgatttccgcgttgatgacgcttgggcccgccgtagtctcccatcatctggctagggtccttctcttgtggaaatgtgtctttcctgcgagcccaaaggacctggagactgaaaagagtaggggtgactccttcacctggcaagtaaccctggagggcagagctggcgcactgtgcgctatcaaaagcttcgtctctcactgtggggacctgctgaccgaggaggtgacccagcggttacttccaccactgccatgcgccgtcgacctgctcactcagctgagtagtatcctcaaaatgtacggaagtccgctgaagacgccctcagtcgtttaccgccaaagactgtatgaactgctcatactgcttcctcccgaaacatatgaaggaaatctttgtgccatcctgcgggagctcgcagcagatctgactgcccctgatatccaggtagcagcttccaccttcctgctgcctccgctttgccaccaggatgacttactaattttatccccttttttgcaggagaccgaccatcggttcattgaagagcaattgcttctgggcaatggtgtcgcctgtggcagcctggagtacgacccatacagtatatacgaaaaagatgtggagggggacagcgtgcctaaacccctcccccctgccctctctgtgatctcctcagccagcaaactctttggtgtggtctgcgcccacgtgggagagactcaaaggctccttatactagagcagctgttggattccattaagcacaccaaaggtgccagacaacaagtggttcagttgcacgtggtgagttccgtgagcagttttctcaagtacgtcgccggttccaagggctgtttaggtcctgaggaaatgaaacggttcgccttgactcttgtgatgggggctctggagtcgcccaatccactcctaagatgcgctgccgctgaatcttgggcgaggcttgcccaagtggtggacgatggcgccttcactgccgggcttgctcaggtttccttcgacaagctgaagagtgccagggatgtcgtcactagaacaggtcactccttggctctgggctctctacataggtacctcggtggtattagcagctctcagcacttgaacagttgcatcggaattctttacacgctggctcaggatagtacgagcccagatgttcaaacttgggctttgcactccctgtctctcattattgacagcgccggccccctgtattatgtgcacgtggaacctaccctgtccctgatcataatgcttttgcttaatgtccctcccacccatgccgaagtgcatcagtcactgggaaggtgtctgaatgcccttatcaccaccctgggtccggagttacagggcaacagcacctccatttctactttgaggacctcctgtctcctgggttgcgctgtcatgcaggacaaccctgattgcctcgtgcaagcccaggcaatttcttgcttacaacagctgcatatgttcgctccacgccacgtgaatctgtcaagcttggtgtcttgtctgtgtgtcaacctgtgttctccctatttgcttcttcgcagggctgtgttggcttgcctgcggcagttggtgcagagggaagccgccgaggtctccgagcatgccgtcatgctggctaaggactcgcgggaggagttgacccccgacgctaatattagagaagtcggcctggaaggagcccttctcatcctgttggacaaggagaccgatgaacggctgtgccacgatatcaaagaaacactgaattatatgctaacatcaatggctgttgaaaaactgagcctgtggctaaaattgtgcaaagatgtactggccgctagtgcagatttcaccgcggtgacctgcgtcgataccatgcaggaggaggaaggagacaagggtgacgatgccagcgtactgactaccaggagagatgagaaatctcacccattcaccaaccccagatgggcaactagagtctttgccgctgaatgtgtgtgccggattatcaaccagtgcgaaaatgcaaactcagctcacttcgacatagcccttgcccaggagatgaaaaaaagagattctagaaacgattttctcgttctgcatctggcagacctcattcggatggcttttatggccgcgaccgatcactccgaccagttgcgactttctggcctggagatgcttcttgtcgtgatccggcggtttgctacagtgcccgaaccagagttccctggacacgtgatcctggagcagtaccaggcgaacgtgggagctgcccttcgcccagccttcacttccgaaacaccgcctgatgtcactgctaaagcctgccaggtttgttcagcatggattgcctccggcgttgtgtcagacctgaacgacttacggcgggtgcaccagcttctcgtgtcatctctaaccaaaatccaagctggaaaagaggctctgagtcatctctataacgagtccgcttctactatggaaatcctggctgtgctcaaagcatgggctgaagtctacattatcgctgtgcagagacacaaaaaccacagacagcccctcaaaactaccacctgcctggaggatggtattcggaatggaagctgctctagtgatggtctcctcgacctggtctatgccgatctcggcactctctcgcgcttatggttggccgctttacaggatttcgcactcctgaccctcccgtctgaattcgcctctcaattacccgcagaggggggtgcattttataccgcggagaccagtgagaatgctaaactgcactattacaactcctgggccctgatcctgcacgccacagccctgtggctcacttctacaggctttgtggtggcagacccagatgaaggggcgtccaatctgtcccgacccgttactcccactagtatgtgtcaaggctccagttctggcgctactatcaaatctcctgaggacgtgtacaccgacagatttcatttaatcctgggaattagtgtggagtttctctgttccctgaggtctgatgcaaccatggagagtattacagcttgcctgcacgccttgcaggcgctgctggatgtgccgtggccccggagcaagataggaagcgaccaggacctcggcattgagctcctgaatgtcttacatcgggtgatcctcacccgcgaaagtccctctatccaactcgcttctctggaggtggtgcggcagatcatatgtgcggcacaggagcatgtgaaagagaagaggcgctcagctgaagtggatgatggcgctgccgaaaaggagactttaccagagttcggcgaaggaaaagacacagggggactcgttcctggcaaatctctggtcttcgcaactttagagctctgtgtctgcattcttgtgaggcagctccccgagctgaacccgaaactcaccgggagtccaggcgtcaaagcaaccaagccgcagattctgctggaggacggctcgagactggtctctgctgctcttgtgatcctgtccgagctccctgcagtgtgtagtccagaagtggacgaaacccatcaggaactggacgaggtttctctgctgaccgcaatcactgtgtttatcctctccacgagccctgaggtcaccaccattccttgcctgcagaagagatgcatcgacaagtttaaggccactctagagatcaaagaccccgtggtgcagattaagacctaccaattgcttcatagcatattccagtaccccaaccccgccgtatcctacccgtacatctactccctcgcctcctgcattatggaaaaacttcaggaaatcgataagaggaagccagagaacactgccgagctggagatattccaggagggcataaaagttctggaaaccttagtcacagtcgctgaggaacatcaccgggctcagcttgtcgcctgtctgctgcccatccttataagtttcttgctagacgagaattctctcggaagcgccacttcaatcatgcgaaacttgcatgactttgctttgcagaacctcatgcaaatcggacctcagtacagctctgtgttcaagtccctcgtagcatctagccccgctttgaaggcccgattagaagccgcaattaagggaaaccaagagagcgtgaaggtcaaaatacctacgtctaaatataccaaaagccccggtaagaactcttcaatacaattgaaaacttccttcctgtag

SEQ ID NO: 30452 - DNA, 5262 bp, Artificial Sequence
  Description of Artificial Sequence: Synthetic coding sequence
atgctcaaagggacttcaagcgtgtcccgggacgttcgagtgggggttactcaggcgtatgtggtattcgtgtctacactgggcggcgcctggctcgagaaaaatttcgctgcatttttctcacatattctaagcctggcgtctccttcccatcccaaggccacccaaacacagatagatgccgtgtgttgtagaagatgtgttagctttatcctgagaactacaataggggggttgctgggggagaaggcccagctggccgcggtgaaggacatatgtcaggctatctggaaactgaagaaagttatggacgccgtgatgtcagacggaaacctggaaacccggttgggcagcacagacgtggcagcctctcaacatatgctcgtgtgtgctctgcaggaactcggcaacttaattcataatctgggaacgacggccgcccccctgctccaagacagcagcacaggtctcttggatagcatccttagtgtgattcttcacccgtccattagcgtgcggctagccgcagcgtggtgtctccattgcatagctgtagcgttgccgagttacctgaccccgctgctggacaggtgcttggaacggcttacaggccacaagtctagcccagaagctgtgaccggtttctcctttgccgtggccgccctgcttggggcagtaaagcactgcccgctcgggatcccgcatggaaagggcaaaatcataatgacgcttgccgaagacctgctgtgttccgccgcccagaatagccgactcagcgctcaaaggacccaggctggatggctgctgatttccgcgctgatgacactcggccccgctgtggtcagccatcaccttgccagagttctccttctgtggaaatgcgtgttcccagcctccccaaaggatttagaaacggagaagagtcgcggagatagcttcacatggcaggttacgttggagggacgggcgggggccctgtgtgctattaaatcttttgtgtcacactgtggcgatctcctgacggaggaggtaacccaacgtttgctgcctcccctgccctgtgccgttgaccttctgacccagttaagctccattctcaaaatgtatggctctcctctcaagacaccttccgtcgtctatagacaacggctgtacgaactgctcatactgctgcctcccgagacatacgaaggcaatctgtgcgccatactgagagaactcgctgctgatctgacggccccggatatacaggtggccgcctccacattcctgctgcctccactttgtcaccaggatgacctgctgatcctcagcccttttttgcaggaaactgatcacagatttatagaggaacagctgctgctgggaaatggtgtggcctgtgggtcactggaatacgatccgtactctatttacgagaaagacgtcgagggcgatagcgtacccaagcctctgccaccggcattatccgtgatctcaagcgcatcgaaactgtttggagttgtgtgcgcacatgtcggggaaacccaaaggctgttgattttggagcagctcctcgatagtattaagcatacaaagggggcacgccagcaagtggtgcagcttcatgtggtgtctagcgtttcttcattcctgaagtacgtggccggatccaagggatgcttagggcccgaagagatgaaacggtttgccctgaccctcgtgatgggcgccttggagtcacccaatcccctcctcagatgtgccgccgccgaatcatgggcacgcctggcccaggtcgtcgatgacggagcgtttacggcaggactagcgcaggtttccttcgataagctgaaaagcgccagagatgtggtgaccagaaccggtcactccctggctttaggctctctgcatcggtatcttggcggcatcagctcttcacagcatctgaactcttgcattggcattctgtatactctggctcaggactcaacctctcccgatgtgcagacgtgggccctgcattccctgtccctgatcatcgactcggctggccccctgtattacgtgcacgtcgagcctactctgagccttattataatgcttctgttaaatgttcctccaacacacgcagaagttcatcaaagtcttggacgctgcttgaacgctctgattacaaccctgggtccagaactgcaggggaacagtactagcatctcaacactgaggacctcttgcctgctgggatgcgccgtgatgcaagataaccccgattgcctcgtacaggctcaagcgattagttgtcttcaacagctgcatatgttcgcaccccgacacgtcaatctttcgtccctggtgtcttgtctgtgcgtgaacctgtgttcaccttaccttcttctcaggcgcgctgttctggcatgtttgcggcagctggtgcagcgagaggccgcagaggtgagcgaacacgctgtgatgctggctaaagactcacgcgaagaactgacacctgacgccaatattagggaagtgggcctggagggggcacttttaatcctgctagataaggaaacagacgagcgtctctgccacgacattaaggagactctgaattatatgctgacatcaatggctgtggaaaagctctctctttggttaaaattgtgcaaagatgttctggctgcctctgcagactttacagccgtcacatgtgtggacacgatgcaggaggaagagggcgataaaggggatgacgcctctgtccttactacaagaagggacgagaagtcgcaccccttcacgaaccctcgctgggccacaagagtgtttgccgccgagtgtgtgtgtcgtataattaaccagtgtgagaatgccaactctgcccattttgatatcgcactggcccaggaaatgaagaagagagacagtcggaatgactttctggtactacatcttgcggacctcatcagaatggctttcatggcagccacagatcactctgaccagttgcggttgagtgggttggagatgctgttggtggtgataaggcggttcgcaaccgttcccgaaccagagtttccaggccacgtgatcctggaacagtaccaggctaatgttggagccgcgttaaggcctgcgtttacctcggaaacgccgcctgatgtgacagccaaggcctgccaagtgtgtagtgcttggattgccagtggcgtggtgtctgacctgaatgatctgaggagagttcatcagctgctggtatctagtctcacaaagatccaggcaggcaaggaggccttatcacacttatacaacgaaagcgcaagcacaatggaaattctggccgtactcaaggcatgggctgaggtctacattatcgccgttcagagacataagaatcatcgccagccattaaagaccaccacgtgcctggaggatggaattaggaatggttcttgtagcagtgacgggctgctggatctagtgtacgcggatcttggcaccttgtctcggctttggttggctgccctccaagatttcgcccttcttaccttgccaagcgagttcgcttctcagctgcctgcggagggaggcgccttctataccgctgagacctccgagaatgccaaactccattattataattcatgggctttgattctgcatgctacagctttatggctgacctcgacaggcttcgtcgtcgccgaccccgacgaaggtgcttcaaatctgtccagaccagtgactccgacaagcatgtgccagggaagttcgtccggggccactattaaaagtcctgaagatgtgtacacagatcggttccacctaattctaggtatctccgtggaattcctatgttctctgaggtcggacgccactatggaatctatcaccgcctgtctgcatgcactgcaggcgctattggatgttccttggcccaggtccaagatcggctcagaccaagacctgggaatagaactcctcaatgtcctgcaccgagtgatcctgacaagggagtcgccaagcatccagctggcatcactggaagttgtgagacagataatttgcgccgcgcaggaacacgttaaagagaagcggaggtcggctgaagtggacgacggtgcagccgaaaaagagactcttcccgagttcggcgagggaaaagacacagggggtctggtgcccggcaagtcccttgtgttcgccactctggagttatgtgtgtgcatactcgtgagacagctgccagagttaaaccctaaacttactggcagccccggggtgaaggcgacaaaaccccagatccttcttgaagacgggtcgaggcttgtatcggccgccctggtcatcttaagtgaattacctgccgtgtgtagccccgaggggtcaatctccatacttcccactatcctgtacttaactatcggggtattacgcgagacggctgtgaaactgcccggtggtcagctgagtagcactgtggctgcaagtctgcaagcgctaaagggaatcttatcaagccccatggcaagagcagagaagagcaggacagcatggacggatttactccgctccgcactcacgaccattctggactgttgggaccctgtggatgaaacccaccaggagctcgacgaggtgagtcttctgaccgctataaccgtctttatcttgagcaccagccctgaagtcacaactatcccatgtctccagaagcggtgcatcgataagtttaaagccactctggagattaaggacccagtcgtgcagattaaaacataccagctgctacattccatatttcagtaccccaacccggctgtgagctatccgtatatttacagcttagccagttgcattatggaaaagcttcaagaaattgacaagagaaagcctgaaaatacggcagagctggaaatctttcaagaggggatcaaggttctggagactctagtgaccgttgctgaagaacatcaccgggcccagcttgtggcatgtctcctgcccatcttaatatcattcctgctagatgagaactccctagggtcggcaacgagcatcatgagaaacctgcatgattttgccctgcagaacctcatgcaaattgggccacaatacagttcagtgttcaagagcttggttgcttcatcccccgccctaaaggctcgcctagaggcagccatcaaaggcaaccaggagtctgtgaaggtcaagattccaacgtccaaatacactaagagtcctggcaaaaactcctccatccaattgaaaacaagcttcttatag

SEQ ID NO: 30453 - DNA, 6141 bp, Artificial Sequence
  Description of Artificial Sequence: Synthetic coding sequence
atggaactggctcattctctcctcctcaatgaagaggcatataaccagttgggcgaagttcagaaggctgagttcatcttcgagtggctcagatatctggaaaaactactgctggcaacaagccgaaatgatgttcgggaaaaacaaaagactcttgtggaacagcttctaagccttctgaacagctcccctgggcctccaacaaggaaactgctggctaaaaacttggccattttgtactccatcggcgatactttctcagttcacgaggcgatcgacaaatgtaacgatctgatcaggagcaaagacgattctcccagctacttgccaacaaagcttgcagcagtcgtgtgcctgggctcgctttataaaaaactgggacggatccttggcaacacattcaccgatacagttggtaacatccttaaggccatgaaatctgcggagtcccagggtagatacgagatcatgttatctcttcagaatatactgaatggcttaggcgccgccgccgctccttgccacagggacgtgtataaggctgcacgatcatgtttaaccgaccgttcaatggcagtccgttgtgcagctgccaaatgcctcctcgaattgcaaaacgaagctatctttatgtggagcactgatctcgacagcgttgccacgctctgtttcaaatcattcgaagggagtaactatgatgtcaggatcagtgtgagtaagctgcttggcatcatactcgctaaggctgtaatttccaaacaccccgggaccgccgcgtcgaggcagtctattcgcagggtgtccttggaagaagtcctggagctgctgggcactgggttcctgcgaggtagcagcggctttctgcgggctagcggcgacatgcttaagggcacttcctctgtgtcccgggatgttcgcgtgggcgtgacccaggcatatgttgtgtttgtgagtaccttaggcggggcttggctggagaagaattttgccgcgttcttctcccacatcctctctttagcaagtccaagccacccaaaggcgacccagacccaaatcgatgccgtgtgctgccgccgctgcgtgtcctttatactcagaactactattggaggacttctaggtgagaaagctcagctggcagccgtcaaggatatatgtcaggctatttggaagctcaagaaagtcatggacgcagtgatgagtgatggtaatctcgaaacgaggttaggctcgacagatgtagcggcctctcagcacatgctggtgtgtgcccttcaggagctaggcaacctcattcacaatttgggcactaccgccgctcctcttcttcaggactcttcaacgggactactggacagcattctgtcagtgatcctgcatccctcaatatccgtgcgcctggcagcggcctggtgtctgcactgtattgctgtcgctctcccgtcctatttgactccactcctagatcgatgcctcgagcggcttaccggccataaaagtagcccagaggctgttacaggtttttcatttgcagtcgcggccctgttgggagcagtgaaacactgccctctgggaatcccccatggaaaagggaagattataatgacactggctgaggatttgttgtgctctgctgctcaaaactctaggctttcagcccagcgcacccaggcgggttggctgctcatttccgccttgatgaccctcggccctgcagtggtctcccaccatctggcccgggtgctcctcctctggaagtgcgtcttcccagcgagtcccaaagatttagagactgagaaaagtagaggggatagctttacatggcaggtgaccctggagggaagagccggagctctttgtgccattaagtctttcgtgtcacactgcggcgatctccttacggaggaagtcacccagaggctgttacctcctttgccctgcgccgtagatttactgacccagctcagttcgatactgaagatgtacgggagtccgctaaagacaccctccgtggtctataggcagcggctctatgagttgcttatactgttgcctcccgagacatacgagggaaacctttgcgccatcctgcgcgagcttgcagccgacctcactgcccctgatattcaggtcgcggcaagtacttttctcttgcctcccctgtgtcaccaagacgatctgctcattctctcacccttcttacaggagacagatcataggttcatcgaagagcagctcttgttaggtaatggagtcgcctgcggcagcctggagtatgacccttactcgatttacgagaaggacgtggagggcgattccgtgccaaaaccgttgccgccagccctttcagtcatctccagtgccagcaagttgttcggggtggtatgcgcgcatgtgggggaaactcaacgcctgctgatccttgagcagctgctggacagtattaaacacaccaaaggcgcccgtcagcaggtcgttcaactgcatgtggtgtcatctgttagttcctttctcaaatatgtcgccggatccaaagggtgtctaggcccagaagaaatgaagagatttgccctgaccttagtgatgggtgcgctggagagcccaaatccactgctccggtgcgctgcggccgagagctgggcaagacttgctcaagtagtcgacgatggggccttcacagctgggctggcccaggtctcttttgacaagttaaaaagcgcgcgagatgtggtcaccagaacaggacacagcctggccctaggaagtctgcaccggtatctcggcggcatttcctcatcacagcacctgaactcatgcatcggcatactgtatacattggcccaggactcgacctccccagatgtgcagacctgggcgctacactctctgagcctgatcatcgatagcgcaggccctttatattatgtgcacgtggaacctaccctcagtctaataataatgctgctccttaacgtcccccctactcacgctgaagttcaccaatcgttgggccgttgtctgaacgcactgattacaaccttggggcctgaattgcaggggaacagcacaagcatctcaactctgagaacgtcttgtctcctaggatgcgccgttatgcaggacaacccagactgtctggtgcaggcccaggcaattagctgtttgcagcagttgcatatgttcgctccccgccacgtgaacctctcctcactcgtgtcttgtctgtgcgtaaatctgtgtagcccttatctgctgctccggagggccgtgctcgcctgcctccgtcagctggttcaacgcgaagctgcagaggtctccgagcatgccgtcatgctggccaaggactctcgcgaggagctgacccctgatgcaaacattcgggaagtcggcctggagggagctctactgattttgctggacaaggaaacagatgaacgcctatgccacgatatcaaggaaacccttaactatatgctgacctctatggccgtagagaagctgtccctgtggctgaagctctgcaaggacgtcttagcggcgtctgccgactttactgctgtcacttgcgtggacacaatgcaagaagaggagggggataagggggacgacgcctcagtgctgactacacgtagggatgagaagtcccacccttttaccaatccacggtgggcaactagagttttcgccgcagagtgcgtatgccgcattattaaccagtgtgagaatgcgaactcagcacatttcgacattgcgctagcccaggagatgaaaaagcgggacagtcggaatgacttcttggtgttgcatcttgcagacctgattaggatggcatttatggcggccacagaccactcggatcagctgcggctatctggcttagagatgttgctagtagtgatccggagatttgccacagtgcccgagcccgagtttcccggccatgttattttggagcagtaccaagccaatgtcggggccgcactccgaccggcattcacttccgagaccccccctgatgtgaccgcgaaagcatgtcaagtgtgctctgcttggattgctagtggggtagtgagcgatttgaacgatcttagaagggtccaccagcttctggtgagctccctgacaaaaatccaggccgggaaggaggcccttagccacttatacaatgaatcggcgtcaacgatggaaatcctggccgtgctgaaggcatgggcggaggtgtatattatagcagttcaacgccacaagaaccacaggcagcctttgaaaactactacttgtcttgaagatggcatcaggaacgggtcctgctcgtccgatggcctgctcgatctcgtgtatgcagatctcggcacccttagtagactatggctggcagcactccaggattttgcgctgttgaccctcccaagtgagtttgcctcccagttgccagccgaaggcggcgccttctacaccgcagagaccagcgagaacgccaagcttcattactataatagctgggccctgatcctgcacgctacagccttgtggctaacaagcactggtttcgtggttgccgatccggatgagggcgcgtctaacctgagtcgcccggtcacaccaacatccatgtgccagggttcgagctcaggggctacaattaagtcccccgaggacgtgtacacggataggttccacctgatcctgggtatcagcgtggaattcctgtgcagcctaaggagtgatgcaacaatggagagtatcacagcctgcctgcacgcccttcaagctctgctggacgtgccatggccaagatccaagattgggagtgaccaggacctgggaatagaactcctgaatgtgctccatcgggtgatcctaaccagggaatccccaagcatccagctcgcaagtctggaggtggtgcgccaaatcatctgcgccgcccaggaacatgttaaggagaaacggcgcagcgccgaggtggacgacggtgctgctgagaaagaaactctgccagaattcggagagggaaaagataccggtggattggtgccaggaaaatctctggtctttgccactttagagctctgcgtgtgcattctggtgcggcagctgcctgaactcaatcccaagctaactggaagccctggggtgaaggctaccaaaccgcagatacttctcgaggatggtagcagattagtgtctgccgccctggtcattttatcagagctgcctgccgtctgttcccctgagggatcgatatccatcctgccaacaatcctctatctgacaattggtgtgctgagggagactgcagtcaagcttcccggtggccagctgtcctcgacagtggcagcatcactgcaggcactgaaaggcatactatcctcccccatggcccgggcagaaaaaagtaggaccgcttggaccgacttgctgcgtagtgcgctgacaacgattctcgactgctgggacccagtggatgagacccaccaggagctagacgaggtgtcactcctgacagccataacggtctttatattgtccacctcccccgaggtcacgacaattccatgtctccaaaagagatgtatcgataagttcaaggccacactcgagatcaaggatcccgtcgtgcaaatcaagacataccagcttctgcattccatcttccagtacccgaatccagccgtgtcctatccctacatctattcactggcatcttgtattatggaaaagctccaagagattgacaaaagaaaacccgagaataccgctgaactcgaaatattccaagaaggcataaaggtactggagactctggtgaccgttgctgaagagcatcaccgcgcccagttggtggcttgtctactccccattcttatcagctttcttctagacgaaaacagtcttggctcggctacaagcattatgaggaaccttcatgactttgccttacagaatctgatgcagattgggccacagtattcctcggtgttcaaatccctggtggcctcttcccccgccctgaaagcccgcctggaggcagctatcaaaggaaaccaggaatctgtaaaggtgaaaatccccacatccaaatacaccaagtcacctgggaaaaattccagcattcagttgaaaacgtcttttttgtag

SEQ ID NO: 30454 - DNA, 2223 bp, Artificial Sequence
  Description of Artificial Sequence: Synthetic coding sequence
atggcggctttcagtgagatgggagtgatgcccgagatcgctcaagctgttgaagagatggactggttactgccaaccgatatccaagctgagtctattccccttatcctaggaggcggcgacgttctaatggcagctgagaccggctcaggaaaaacaggggctttcagtatacccgtaatccaaatcgtgtacgaaaccctgaaagatcagcaggaaggaaaaaagggcaaaactacaattaagacgggtgcctccgttctgaacaagtggcagatgaacccatacgacaggggaagcgctttcgctattggctctgatgggctctgctgtcagtccagagaagttaaggaatggcacgggtgtcgcgcaactaagggattgatgaaaggtaagcactactacgaggtgagttgccacgatcaaggcctctgtagagtgggatggtcaactatgcaagcctccctggatctgggaacggataagttcggtttcggatttggaggaaccggcaagaagtcacacaataagcagtttgacaactatggagaggagttcactatgcatgacaccatcgggtgctatttggatatcgacaagggccatgtgaagttctccaagaatgggaaggacctagggcttgcattcgaaatcccaccacatatgaagaaccaggctctgtttcctgcttgcgttctcaagaacgccgagcttaaattcaatttcggagaggaggagtttaaatttccccctaaggatggattcgtcgcactctccaaggcccccgacggctacatcgtcaaatcgcaacattccgggaacgcccaagtaacacagaccaaattccttccaaacgccccaaaagcactgatcgtcgagccgtcaagggagctagccgagcaaacactcaacaatattaagcaattcaaaaagtacattgacaacccaaagctaagggagctgctgatcattgggggtgtggccgccagagaccagctgagtgttctggaaaacggcgttgatattgtggtcggaacccctggcaggttagacgacctagtgtcaacgggcaagttaaatctgagccaggtgcgattcctagtcctggatgaggccgacggcctcctgagccagggatatagcgacttcatcaaccggatgcacaatcagatcccgcaagttacgtcagacgggaaaagactgcaggtgatcgtttgttctgcaactcttcattctttcgatgtcaagaagctttcagaaaaaatcatgcacttcccaacgtgggtagacctgaaaggagaggattcagtgcctgacactgtccatcacgtggtcgttcccgtgaaccccaaaacagaccgcctgtgggaacgactgggtaagagccatatccgaacagatgacgttcacgcaaaggataataccaggcctggggccaattccccagaaatgtggtccgaggccatcaaaatcttaaagggggagtacgctgtgagagcgatcaaggagcacaaaatggaccaggctataatcttttgtcgaaccaaaattgattgtgataatctggagcagtatttcatccagcaaggcggagggcctgataagaaaggacaccagttctcttgtgtctgcctgcacggcgacagaaaaccccacgagaggaagcagaatttggaacgcttcaagaagggtgacgttcgcttcctcatctgtaccgacgtagcagcacggggcatcgatatccacggcgtaccctacgtgattaacgtcaccctgccagatgagaagcagaattatgtacatcgaatagggagggtaggaagagctgagcggatgggtctggccatttcactggttgctacagaaaaggagaaggtctggtaccacgtttgctccagtagaggtaaaggttgttacaacactagattaaaagaggacggtggttgcactatctggtataatgagatgcaactcctgtcagagatagaggaacacctcaattgtactatatcacaagtcgagcccgacattaaagtcccagtagacgagtttgatggcaaggtcacttatggtcagaagcgagccgccggcggcggcagctataaggggcacgttgacatcctcgcaccaacagtacaggaactcgccgccctggaaaaggaggcccagacgtcatttcttcatctgggctatcttcccaaccagcttttcaggactttctag

SEQ ID NO: 30455 - DNA, 5949 bp, Artificial Sequence
  Description of Artificial Sequence: Synthetic coding sequence
atggagctggctcattccctgctcctgaacgaggaggccctcgcccagataaccgaggccaagaggcccgtctttatattcgagtggctccgcttcctggacaaggtgctggttgcagccaataaaactgatgtgaaggaaaagcaaaaaaagcttgtggagcagctaactggcctgattagcagctcccccgggcctcccacacgcaagctcctggccaaaaaccttgcagccctttactctatcggcgataccttcactgttttccagactctcgataagtgcaacgatatcattcgaaacaaggatgacactgccgcgtacctcccgactaagttggcggccgtggcctgcgtcggtgcattttatgagaaaatgggcaggatgctggggtccgcgtttcccgagacggttaataatctgttgaaaagcctaaaaagtgccgagagccagggccggtccgaaattctcatgagtctgcagaaagttctgtcaggcttgggtggagctgcagcttccagtcacagagatatctataaaaatgcgcgatctctcctgactgacagaagtatggctgtcaggtgtgccgtggccaaatgcttgctggagctgcagaacgaggccgttttcatgtggacggccgagctcgagaacattgctaccctgtgtttcaaggcccttgagaattcaaattatggagtacgtgttgcggtcagcaaacttctgggcactgttatggctactgctctgatgccaaaacaggccaccgtgatgagacagaatgtgaagagggcaacctttgatgaagtcttggagctcatggctaccggcttcctccgcggcggcagcgggttcctcaagtccggaggagagatgctgaaagtgggaggctccgtgaatcgcgaggtgcgggtgggggtgacgcaggcttatgtcgtgtttgtgacaacactaggtgggcagtggctcgaacgaagctttgctacgtttctgtctcacgtattggaccttgtgagccatccgcgagcaacacagacgcacgtggaagctgtatattcgagacggtgtgtgtcattcatactgagagctacagtgggtagtctcttgggcgaaaaagctcagatcgcagcagctaaagaaatctgtcaggcaatcggcaaacagatgaaggccgtggaagccgtggtgaacgatactagcggggaaaacaaatcaggagctgcagatattgccgcatctcagcatgttatggtgtgcgcactccaggagctgggctctctcgtgcagtccctcaatgcgactgcttctccgcttatccaggaagcctccattggactgctagagatcgttacatctgtcctcttacacccttccatggcagctaggcttgctgctgcatggtgcctgcggtgtgtcgcagtagctctgccatttcaactaaccccatttttagatcgctgtgcagagcgcttaaataacttgaagaccagtcctgaggctgtcagtggatactcattcgctatggcagcactgttgggcggagttcaccagtgtccactggggatcccccatgcaaaggggaagatggtggtgagtatagcagaagacttgttgcgcacggccgcccaaaatagccggctcagcctgcagagaacccaagccggatggctgttgctgggcgcccttatgacactggggccttcagtggttaggtaccaccttcctaaaatgctactgctgtggcggaacgtgtttccccggagccttaaggagctggaggcggaaaaagcacgcggagattccttcacttggcaggtaacgctggaagggcgcgcgggcgccctatgtgccatgcgcagcttcgtggctcactgccccgagttactgactgaggacgtgattaggaagctcatgacacccatagagtgtgcgatgaccatgatgagtcatattcccagcgtgatgaaagctcacggagcacacctcaaggcttccgccgctatggtgaggctcagactatacgacattttggcgctgctcccccccaaaacatatgaggggtcatttaacgctctcctgcgagaactggtggccgagtttacactgactgacaactctgccaacacaacaacatccctcttgcggtcactatgccactacgatgactcagtcttgcttggatcctggctccaggagaccgaccataagagcatcgaggaccagctgcagccaaatagcgcaagtggatcgggggcgctggaacatgacccaagttcaatatacttacggatcccagctggagaggctgtccccggtccactgccactgggcgtgtctgtgattgacgcctccgtggccctgtttggcgttgtattcccccatgtttcctacaaacaccgtctccaaatgcttgatcatttcgctgagtgcgtgaagcaggcgaaaggagtcagacagcaagctgtccaattgaatatatttaccgctgtgctcagtgcgctcaagggacttgccgaaaataaaagcaccttaggtccggaggaggtcagaaaatccgcgctaacactcgttatggggccgcttgacaacccaaatccaattcttcgatgcgctgcgggggaggccctgggaagaatggcacaggtggtgggtgaagctaccttcatcgcgaggatggctcagtatagtttcgacaagcttaagagcgccagagacgtggtgagcaggacaggccactccctcgcgctcggatgcctacaccgatatgtgggcggcattggttccgggcagcatctgaaaacatcggtctccatcttgttggctctcgctcaagacgggacctcacccgaggtgcagacttggtctctacatagtctggctctcattgtggactctagcggacctatgtatcgtggctatgtggaaccaaccctgagcctggtgctgactctgttgctgaccgttcctcccagtcacacagaggttcaccaatgtctcggacgatgtctgggagcaattatcaccacagttggaccagagctgcagggcaatggtgcgacaacatccactatccggagtagctgcctcgttgggtgtgccattactcaggatcattcagatagcctggttcaggcagccgccatatcctgccttcagcagctgcacatgtttgcgccaagacacgttaacttgtcgtctctggtcccaagtctttgtgtccacctgtgttccagtcatctcctgctgcgcagagcggcagtggcatgcttaagacagctggcacagagagaagccgccgaagtctgtgagtacgccatgtccctggcaaagaatactggtgacaaggaaagcagttccgctaacgtgtccccattcgcccccggcgtcagctcccgcacagacattcattgtaggcaccagggggttaatatcactgaaaccggcctggagggtctgttattcgggatgttagaccgagagaccgatcggaagctctgctccgacatccatgataccctgggacacatgctgtcctccttagccgttgaaaagctctcccattggctcatgctctgcaaggatgttctcgcagcttctagcgatatgagtactgccactctgctgtcatcggggaaagatgaggaagccgagaaaaaggacgaaatggacgacgacaccatgtttactactctgggtgaagaggataaaagtaaaccttttgtagctccgagatgggcgacacgcgttttcgcagccgactgcttgtgtagaattataaacctctgcgagaatgctgatcaggcccatttcgacttagccttggccaggtccgccaagctcaggaatccaacgaacgaccttctggtgctacacttatctgatttgattagaatggcctttatggctgcgactgatcacagcaaccagctccggatggcgggcttgcaggcgcttgaggacatcatcaagaagtttgcctccgtgccggagcctgaattcccaggacacgtgatactggaacagtatcaggccaatgtcggggccgcccttaggcccgcattcagtcaagatactccctctgacatcatcgcgaaggcctgtcaagtgtgcagcacatggatcggaagcggtgtagtgtctgacctcaatgatttacggcgcgtgcacaacctgctggtttccagtttagacaaagtgcaggccggcaagggaagttctagccagctgtatagggaatccgcaacaacaatggagaaactggccgtcctcaaggcgtgggctgaggtctacgtagtggcaatgaatatcaagaaggaagctgaatccaagccaaagcgtgctatcaaaaacactgacgatgacgacgacgattgcggaactattgacgaactcccccccgatagcctcattactctggttcaacccgaattgcccactctcagtcgactgtggttagcagccctgaaagattacgcgctcttaaccctgccagccgagttctctagccagctgccacctgacggcggggctttctacacacccgagactatcgacaccgcgcggttgcattatcgcaacagttgggcaccgatcttgcatgcagtagccttgtggctgaacagtactggttttacgtgctccgaaagcaccgaagctgcagcgatttcgggattgcagaaaagatcaaccagcgttaatttgaatcaggcgtctggagcagtgggcagcgctaagagcctacccgaaatcaataaagacagaatgcacttgatactgggggtgtctatccagtttttgtgctcccctcgcccagaggaacccatcgagcacgttaccgcctgcctgcaggcactgcacacgttactggattccccgtacgcaagggttcatatagcggaagaccaactgatcggggtggagctgctcagtgtcttgcatagattgctgttgacatggaatccaagctctgtgcagttactagtcacaggtgtagtgcagcagatcgtgagggcagcccaggattacctccaggagaagcgcaataccctgagatgtatgaccatactgcccacgatcctctttttgatcgcacgcatactcaaagacactgcaataaagagcgccgataaccaggtgccaccccccgtgtccgctgcactgcaggggatcaagtccatagtgacactctcgatggcaaagacagaagctggcgtgcagaaacaatggacggccctgatccgctctaccctcgcatgcattctcgagtattcacagcccgaagattccgtcccaacacccgacgaggtgtccatgttgaccgcaatcgcgctcttcttgtggagcgcaagtaatgagataattggagttcagagcctccagaatggttgtatgaaccggttcaagaacgccctcaattcttgtgacccatgggttcaagcaaaatgctaccaactactgctgtcggtgttccaacattccaatcgcgcattgtcaaccccctacatccattccctggcccctattgtagtagagaagctcaaagccgtggaaaggaataggccggcttcaaatatagagctgctggccgttcaagagggaatcaaggtgctggagacattagtcgcactcggggaagagcagaatagggtccaactgctggcccttctggtgccgacccttattagctatctgctggatgaaaattcctttgcttctgcaagctcagcgtccaaggacttacatgaatttgcccttcaaaatctcatgcatatcggaccattgtacccacacgcttttaagactgtgatgggagccgcaccggaattaaaagtgaggcttgaaaccgcggtgcgggccagtcaagcctccaaggccaaagctgctgcgagacagcccgccccggccatccattcagcccccacgattaaactcaagacgagtttcttctag

SEQ ID NO: 30456 - DNA, 2307 bp, Artificial Sequence
  Description of Artificial Sequence: Synthetic coding sequence
atggagctcgcccatagcctattactcaacgaagaggccttagcccagatcactgaagctaagcgacccgtgtttatcttcgaatggctgagattcctagacaaagtactcgttgccgcgaacaaaaccgatgtaaaggaaaagcagaaaaaactcgtagaacagctcacaggcctcatcagctcctcccccggtcctcctacccgaaaattacttgctaaaaatctggcggccttgtactcaataggcgatacatttacggtctttcaaaccctcgataagtgtaatgatatcataagaaacaaggacgatactgccgcttacctccccacgaagctggccgccgtcgcctgtgttggggctttctacgagaagatgggacggatgctgggaagcgccttcccggagacagttaataacctcctcaagtccctaaagagcgccgagagtcagggtaggagtgaaattctgatgagcctccagaaggtgctctccggactgggtggagcagcagccagttctcatagggacatttataaaaacgcccgcagtctgctgaccgacaggagtatggctgtgcggtgtgctgtagccaaatgtctcctggagctacagaacgaggccgtcttcatgtggactgcagagctggagaatatcgccacattgtgtttcaaggcgctcgagaattcaaactacggcgtgcgcgttgccgtatcaaagctgttgggcactgttatggctaccgctctgatgccaaagcaggcgaccgtcatgcggcagaatgtgaagcgggccacatttgacgaggtgctggaactgatggccacgggttttctaaggggaggcagcggtttcctgaagagtgggggcgaaatgctaaaggtgggagggtcagtcaatagggaggtcagagtgggggtgacacaggcttatgtcgttttcgtaactaccctagggggccaatggctcgagagatcatttgctacatttctgagccacgtgctggatttggtttctcaccctagggcaactcaaacccacgttgaggccgtgtattctaggagatgcgtcagcttcattctgagggccacggttggaagcctgctgggagagaaagcccaaatagctgccgccaaggagatttgccaggcaattgggaaacagatgaaggcagtagaggctgtggtcaacgacacatctggcgaaaacaagtctggggcagcagacattgccgcttctcagcacgtcatggtctgcgctctgcaggaactcggctcactcgtgcagtcactgaatgcaactgccagtccactgatccaggaagcctcaattgggctcttagagattgttacttccgtgttgctccatcccagcatggccgcaaggctcgccgccgcatggtgtctgcgttgtgtagccgtcgccttaccatttcagctaaccccctttctggacagatgtgccgagcggttgaacaacttaaagacgagtccggaggccgtgtcaggatactcttttgctatggccgccttactaggcggagtccaccaatgtccacttgggattccacatgcaaagggcaagatggtcgtgagcattgccgaagatctgctgcggaccgcagcgcagaacagtaggctgtccctacaacggacacaggccggatggttacttctgggagccctgatgacccttggccctagtgtcgtccgataccatctcccaaagatgctgctcctgtggcggaacgtctttccaaggtctcttaaggaactggaagcggaaaaggcacgcggcgattccttcacttggcaggtgaccctcgaggggagagctggtgcactctgcgcgatgagaagcttcgtggcacattgccctgaattgttgactgaagacgtaattaggaaattaatgacacctatagagtgtgccatgactatgatgtcccacatccctagcgtgatgaaagcccatggggcccatcttaaggcttctgccgccatggttagattgaggctgtatgatatactggcccttcttccacccaagacctacgagggatctttcaacgcgctgttacgcgagctggtcgccgagttcacactgacagacaacagtgcaaatactactaccagcttgctgcgatccctgtgccactatgacgattccgtattactgggctcttggttgcaagagaccgatcacaagtctatcgaggaccagctgcagcctaattccgcctccggttcgggagctctggaacatgaccctagcagcatatatttactgctgtttctggtgcattag

SEQ ID NO: 30457 - DNA, 3546 bp, Artificial Sequence
  Description of Artificial Sequence: Synthetic coding sequence
atggctgcagtgcaggtggtggggagttggccctcagtccagcccagggaggcacctcgggaagcgatcccggaacgcgggaacggctttagattactgtctgctcgactgtgtgctctgaggcctgatgattccagtagtgccagaacggaaatacacttactgtttgatcaattgatttccgaaaattactccgaagggtccggcgtggctcccgaagacgttagcgctttacttgtgcaggcctgcaggctggtcccattgaatcagaaccatcttgtgagcaaagtgtcccagctgatccaccatctgttaaatagactgcaagtgattgtcgatgaacaacacctggattttctgttggcttacactatttctgctattcaccagtgctcttcatggacccatcgggagattctgcaggctttagctgccctcgtctactgcaacggatccaaatgccagaaatatctccctgagttgctggggaataccggactgctgatgaagctcagcgatctggcccagagtgaccctgaagtgcggcgggcagcggttcattgtatggccaacttatgtctgagcgtccctggtcagccgtatctggaagagccctatcagaacgtctgctttcaggccttccttacaattttgcagagtccaaagagcagtgacatggatgatattaccttctgtatgctgcttcaaaacgccctgaaaggcatccagagcttattgaacgggggaagaatgaagttgactcagacagatgaattaggtgccctgctcgccgtcctcaagaaatttatgttccacggccttcccggcctgaatattgaaatgcccactgttttgtatcccactcctctccctcaatacgatggaaggacacctattaagccccagcagtcagagtcgtctgccagcaggcctactctgaacaaaaaaaagaagtccaaagtaaagccaaagaaaattcagcagggcgaggaagaggagaaagagtctagcggtgaaatcgaagcagctcctgtcaccggaacgggccgggtcaatctgcatgagggcaatacctggtgcccaagtagcttgggtgttcagagcctacctctagacggctccggtgcggctgaaaaagatggggtgagcagcagcttttcatcctcaagttggaaacgagtgagctcgtctgagtctgactttagcgacgcagagggagggatgcagtctaagatgaggtcatatcaggctaaggtgcggcagggtgcccttgtttgctttctgtccaccattaagagcatcgaaaaaaaagttctgtacggctactggtccgcatttattcctgatactcccgagttagggtcacctcagtccgtttcactgatgactctgacactgaaggacccttcccctaaaaccagagcttgcgcgctccaggtactgtccgccatattggagggcagtaagcagtttttaagtgtggcagaagatactagtgaccatcggagggcctttactcccttctctgtgatgatagcttgcagtatcagagaactgcatcggtgtctgctccttgctttggtggccgagtccagctctcagaccgttactcagattattaaatgcctggccaacctggtttcaaatgccccctacgatagactcaagttgtctctgctgactaaggtgtggaatcagatcaagccatacatccgacataaagacgttaatgtgcgagtgtctagcctgacactgttgggtgcaatcgtcagcacacacgcacctctcccggaagtgcagctcctgttacagcagccatgcagcagtggcttgggcaacagtaatagtgcgacgcctcacctgtcaccccccgactggtggaagaaggcaccagctggaccgtcactggaagagacttcagtatcttccccaaaaggtagttccgagccatgttggctgattcgcctgtgcatttctattgtcgtcctgcccaaggaggattcatgtagtggctcagacgccggcagcgccgccggaagtacgtacgagccgtcaccaatgcgcctagaggccctgcaggtactaacgctgctggcacgggggtatttttccatgacccaagcttacctgatggaacttggggaagtcatctgcaaatgtatgggtgaagccgatccgtctattcagctgcatggagctaagcttctggaagagctgggaactggattaatccaacaatacaagcctgacagtaccgcagccccagatcagcgcgcccctgtcttcctggtggtgatgttctggacaatgatgctcaatggccctctccccagagctcttcaaaacagcgaacatccaacactccaagcttctgcgtgcgacgcgctgtcatctatcctcccggaagcgtttagtaaccttcctaacgaccggcagatgctttgtattactgtgttactcgggctgaacgacagtaaaaatcggcttgtcaaagcagctacgtcccgggccctgggcgtgtacgtgctattcccttgcctcaggcaagatgtgattttcgtggccgacgctgcaaatgccatcctgatgtccctggaggacaaatctctcaacgtacgcgcgaaggcggcttggagtcttggcaaccttacagacaccctcatagtaaacatggagactccagatcccagttttcaggaggaattttctgggctgcttttactgaagatgctgagatccgccattgaagcttccaaggataaggacaaggtgaaatccaacgcggtacgggctctgggtaacctgctgcactttcttcaaccttcacatatcgagaagcccactttcgcagagatcatcgaagagtctattcaggcattgatttcaacggttctcacagaagcagcgatgaaagtgagatggaatgcctgctacgctatgggaaatgtattcaaaaatcctgctctgccgctgggaactgccccttggacttcacaagcatacaatgcactcacctcagtggtgaccagttgcaaaaactttaaagtaagaatcagaagtgcagctgcactgagtgtgcccggaaagagggaacaatatggcagtgtggatcagtacgcgcgtatttggaacgccctagtaactgctttgcaaaagagcgaggacaccatcgatttcctcgagttcaaatactgtgttagcctacgcactcagatttgccaggcactcattcatttactgagtttggcttctgcatccgatctgccgtgcatgaaagagacacttgagctgagtgggaacatggtgcagtcgtacatcctgcagttcctgaaaagcggtgctgaaggggatgatactggcgccccgcattccccacaggaacgggaccagatggtgcgaatggccctgaaacacatgggttctattcaggctccaaccggggatacggcccggcgtgcaattatggggttcttggaggaaattttagcagtgtgctttgactcttcgggaagtcagggggccctccctgggctgaccaaccagtag

SEQ ID NO: 30458 - DNA, 2751 bp, Artificial Sequence
  Description of Artificial Sequence: Synthetic coding sequence
atgtcgaaatacctaccagaactgctaggaaacacgggcctgttgatgaagctgtcagacttggcacagagcgacccagaggtcaggagggctgctgtgcattgcatggcaaatctttgtttgagcgtgcctggacagccctatctagaggagccctaccagaacgtgtgtttccaggcattcctcacaatcctgcagtcaccgaaatcctccgatatggacgatattacattttgcatgttgttgcagaacgctcttaaagggatacagtctcttctgaacgggggtaggatgaaattaactcagacagacgaactgggagcccttctggcagtactcaaaaaatttatgtttcacggcctaccgggcctgaatatagagatgcccacagtgctgtacccaacaccgctgccacaatatgacggcaggactcccatcaagccacagcaatccgagtccagtgcttctcgaccaaccctgaacaagaagaaaaagtccaaagtgaagcctaagaaaattcaacagggcgaagaagaggagaaagagtcctctggcgagatcgaggcggctcccgtcaccggcacgggccgtgtgaatctgcatgagggcaacacgtggtgtccctcctccctgggggtgcagagcttacctttagatggctcgggcgcggcagaaaaagacggggtctccagctctttttctagctcatcttggaagcgggtgtcaagctctgagtcggacttctccgacgctgaggggggaatgcaatcaaagatgaggtcctatcaggcgaaggtcaggcagggcgcactggtttgtttcctgtcgacaatcaaatccatcgaaaaaaaggtcctgtatggctactggtcggcgttcatcccagatacgccggaactgggatcacctcagagcgtctctctgatgaccctaactctgaaagatccttctccaaagacacgggcttgcgcccttcaggtgcttagcgccattctggaggggagcaagcagttcctcagtgtcgcggaagacacttccgaccaccgccgggcctttactcccttcagcgtgatgatcgcatgtagcatacgggagctccacaggtgtctcctgcttgcgctggttgccgaaagctcctctcaaactgtcacccagatcatcaagtgcctggcgaacctggtctccaatgctccatacgacagattgaaactttccttgctaaccaaggtttggaatcagatcaagccttacattagacacaaggatgtgaatgttagagtctctagccttactctcctgggcgccattgtgtcgacacatgccccattgcctgaggtgcaactgctgctccaacaaccttgctcttcaggcctgggcaactccaatagtgccactcctcatttgtctccccccgattggtggaaaaaagcacccgctgggcctagtctcgaggagactagtgtgtccagccccaagggctcgagtgaaccttgctggttgatccgattgtgcattagcatcgttgtgctccctaaggaggacagctgctccggatctgatgccgggtctgcggccggatctacctatgaacccagccccatgagactcgaggcattcagcaacttacccaacgacagacagatgctgtgcataactgtcttgctcggtctgaacgattctaaaaataggctggtaaaggccgctacctccagagccttaggtgtttacgttctctttccgtgtcttaggcaggatgttatattcgtcgccgatgcagcaaacgccattttgatgagtctggaggacaaaagtctgaatgttagggctaaggcagcctggtcactggggaatcttacagacacacttatagtcaacatggagactcccgacccatcgttccaggaggaatttagcggtctgctgctcctgaagatgctcaggtcagcgatcgaggcctctaaagacaaagacaaagttaagtccaatgccgtgcgggcactgggaaacctcctacacttcctgcaaccctcacacattgagaagccaacgtttgctgagattatcgaggaatccattcaagcactgatctctacagtcctcaccgaagctgctatgaaggtgagatggaatgcgtgctatgccatggggaatgtcttcaagaatccagctttaccgttaggtaccgcgccctggacttcccaggcttacaatgctttgacatccgttgtcacctcatgtaaaaactttaaggtgcgcattcggagcgcagccgctctgtccgtacccggtaaacgggaacagtatggcagtgttgaccagtacgcaaggatttggaacgcactagtgaccgccctccagaagtcggaggacaccattgatttcctggaatttaagtattgtgtgagtctcagaactcaaatatgtcaagcccttattcacctgcttagtctggcatctgcatcggatctaccctgtatgaaagaaaccctggagttatctggcaacatggtgcaaagctacatccttcagtttcttaaaagtggcgcagagggcgacgacaccggcgcccctcactccccgcaggaaagagatcagatggtgcgcatggccctcaagcatatggggtcaatccaagcacctactggtgacacagccagaagagccatcatggggtttttggaggagatcttggcggtctgctttgatagtagcgggagtcaaggagctctgcctggacttaccaatcagtag

SEQ ID NO: 30459 - DNA, 4926 bp, Artificial Sequence
  Description of Artificial Sequence: Synthetic coding sequence
atgaccgaaagctccatgaagaaactggcctcaaccctgctggatgccattactgataaagacccgctggtgcaggaacaggtttgttccgccctgtgctccctgggcgaagctagacctgtggaaacactcagagcatgtgaagagtaccttcgtcagcacgataaactggcccatccttatagagctgctgtgcttcgggccatggaacgagtgcttagcagtcgtgcgtccgaactggataaggatacggcctctacaatcattcttctggcctcaagtgaaatgacaaagacaaaggacctcgtatgggactggcagcaggcagccagtggcgtgctggttgcggtgggccgccagtttatctcaaaagtgatggaagaactcttgagacggctgcaccccggcacattacctcactgcgccgtcctgcataccttggcttccctgagcgtggctaatgcattcggcgtagtgccctttctcccctcagtactgtcctccctactccccgttcttggtgtggccaaacaggacaccgtgcgcgtagcattttgcagcgccctacaacggttcagcgaaggagccctggagtatcttgctaacctggacagggcgcccgaccctactgtacggaaggatgcatttgccaccgatatcttctccgcctatgacgttctcttccaccagtggctgcagtctagggaagccaaattgagattggctgtagtcgaagcccttggtcccatgtctcatctgctcccctctgagaggctcgaggagcagctcccgaagctactaccaggcattctggcactctataaaaagcatgccgagacattttatctctcaaaatccttaggccagatcctcgaggctgcggtttccgtaggatcccgaaccctcgaaacccagctggacgcgctcctcgcagcactccactcgcagatttgcgtacctgttgaatcttcgtcaccgttggtcatgagcaatcaaaaggaggtcctacggtgttttacagtcctggcatgttcctctcccgatagactccttgcttttctcttgcctcgcctcgatacgtccaacgagcgaactagagtgggcactctccaggtagtgcggcatgtgattaattctgcagctgcgcagatggaggacaagaaaccttttatcctgagtagtatgcgcctgccgctgcttgacaccaattcaaaggtgaagcgcgccgttgtccaggtgattagcgccatggcacatcatgggtacttggaacagcccggtggggaagctatgatcgagtatatcgtgcagcagtgcgcattgcctcccgagcaggaacccgagaaacctgggcctggttctaaagacccaaaggctgattctgtgagggcaatttctgtgcgaaccttatacctggttagcacaaccgtggatcgtatgtcccacgtcctgtggccatacctgctccagtttctgacccctgttagattcacaggcgctcttacaccgctctgtcgcagtctggtccacctggcccagaaacgccaagaagcgggcgcagatgctttcctgatccaatacgatgctcatgccagcttaccttctccatacgcggtgacagggaggctgcttgtggtctcttcctccccgtacttgggagacggaaggggggccgccgccttgagacttctctcagtactccatcctaatatccatccacttctcggacagcattgggagacaacagttcccttgctgctgggctacctcgatgagcatactgaggagactctgccacaagaggaatgggaggaaaaactgcttatgtttcttagagacacactagccatcatctcagacaacgcttggatctgccagctcagcctggagctgtgtaggcagcttccatgttatgacgaagctccgcaggaaaaaaatttcttatataaatgcatcggaaccactctaggcgcagcaagctcaaaggaggtggtgcgcaagcatctgcaggagctgttggagaccgcgcgttaccaagaagaagctgagcgggaagggttagcatgttgttttggcatctgtgccatttctcacttagaggatacccttgcacaactcgaagatttcgtgcgttctgaggtattcaggaaaagcattggaatcctgaatatttttaaggatcgttctgagaacgaagtcgagaaggtgaagtctgcgttaatactgtgttacggtcacgtagccgccagagccccccgagaactggttctggcaaaagttgaatcagacattctacgcaatatctgtcagcacttttctacaaaggttctaggcatcaaggtggagacaaaggacccagcccttaagctgtgtctcgtacagtctgtgtgcatggtctcccgcgccatttgttcttcaactcaagccggatctttccactttactaggaaagcagagcttgtggcacaaatgatggagttcatccgggctgaacccccggactctctccgaacccccattcggaaaaaggccatgctgacctgcacctatctcgtgtctgtcgagcccgcactcgatgagcaggccagggctgatgtgattcacggctgcctgcactctataatggctctgctccccgagccgaaagaagaggacggcggatgccaaaaatctttgtatctggagaccctgcatgctcttgaggatctgctgacatccctgctccaaagaaatatgacacctcagggattgcaaataatgatagagcatctgtcgccatggattaaatcgccccgcggtcacgagcgtgcacgagccctcggcctcagtgccttattattacgttacttcctcgagcatcttcgcgtgtcagcattggtgccatttcacaaccttgggcttctcatcgggctcttctcgccccggtgcgcggacctgtggcccgcgacacgacaagaggctgtggattgcgtgtactctttattgtacctgcagctcgggtacgagggttttagccgagactaccgtgacgatgttgccgagaggctcctgtccctaaaagacggtctcgtgcatccagatcccgcgattctgttccacacttgtcatagtgtgggtcagatcatcgcaaaaagattgcccccagatcagctcatctctctgctcttgacaatgtttgaagcgttgggagaccctgaaaagaactgttctcgcgctgctacagtcatgatcaattgtctcctgcaggagcggggtggggtcttacaggaaaaagtgccagaaatagtttccgtcctgagaagtaagctccaggaagctcaaggagagcacgtccttcctgccgcccagcattctgtttacctcctcgctactcagcactgcgctgcggtggtgagcagtctgctgggctcgccactacctctggacagccacacatgtatgctgtggagggcactggctgtggaaccaaggctcgctgctcaagttctcggcctgctgcttgaaaagatgtcccgggacgtcccttttaaggagtcccgcgcgtttttgctcggccggacccctgaccgtgtcgcaaccctgttgcccctgtccgccacttgtgcactgttcgaggtcatgagtacccccgcagctgggcccgcggtgctcgagctctatccacagttattcgtcgtcctcctcctcagagtaagctgcacggtcggagtccagctcccacggaaccttcaagcgcaggagcggaggggggcaagtccagctctggctactaggaacctggagccctgctcatccgccgtcgatacgttgaggagtatgctcctgagatccgggtctgaggatgtggttcaacgaatggatcttgagggcggctgggaattattaaggacatccgccgggcacgaagagggcgccaccagattagccagggccatggccgaacatgccggcccaaggctccctctggtacttaagactctggcctgtacgcactcttctgcctatgagaaccaacgggtgactacgaccgctttccttgccgagttactgaattccaacgtggccaacgacctgatgcttctggattcactcttagagtcccttgccgcccgacagaaagacacctgtgcgagtgtacgacgtctcgtgttacgcggattggctaatctggcatccggctgccccgacaaagtgcgcacgcatgggccacaattgctgaccgccatgattggtggactggatgacggtgataaccctcatagtcctgtggccctagaagccatgttgggcctggcccgcctggtccacctcgtggagtcctgggatctgcgctccgggctgttgcacgtcgcaattagaatccgcccttttttcgattcagaaaaaatggagttccggaccgcctctattcgcctctttggccacctcaacaaggtgtgccacggcgactgtgaggacgtttttctagatcaggtggtaggcggcctcgcaccacttctgctgcacctccaggacccacaggccaccgtcgccagcgcatgccggttcgctctccgcatgtgtggtcctaatctggcatgcgaggaactctctgcggctttccagaagcacctgcaagagggacgcgctttacactttggcgaatttcttaataccacttgcaagcacctcatgcaccacttccccgaccttctggggcgtctgctgacaacatgcttattttacttcaagagctcctgggaaaacgtgagggccgctgcccctctgttcacagggttcttggttcttcacagcgagccccgccagcagccacaggtcgatcttgaccagttgattgcagcccttcagattctccttaaagatccggctcccgaagtgaggacccgggccgctgaggcactcggtcgattagtcaaacttgcttag

SEQ ID NO: 30460 - DNA, 1023 bp, Artificial Sequence
  Description of Artificial Sequence: Synthetic coding sequence
atggaacgagttctgagctccagagctagcgaactggacaaggacactgccagcactattattctgcttgccagcagcgagatgacaaaaactaaggatctggtgtgggactggcaacaggctgcttctggcgtgttagtcgctgtgggccggcagttcatttctaaggttatggaggagctgctgagacggcttcaccccggaacccttccccattgcgctgtgcttcatactcttgccagcctcagcgtggccaacgctttcggggtggtgccgtttctcccaagtgtgctaagctcacttctgcccgttcttggcgtagccaagcaggatactgttcgagtcgccttctgttccgcactacaacgtttcagtgagggagccctcgagtaccttgcaaatcttgaccgcgctccagatcctacagtgcgaaaggatgcattcgctactgatattttttccgcgtatgacgttctgtttcaccagtggctacagagtagagaggctaagcttcgtctggccgtggtggaagccctcggaccaatgagtcacctgctcccttcagagcggctcgaagaacagctacctaagcttttgcctggcatacttgcattgtataaaaaacacgccgagaccttttatctgtcaaaaagcctgggccaaattctggaagctgccgtgtcggtcggcagtcgaactctggagacacagctggacgccctgctggcagcgttacactctcagatctgtgtccccgtagagtcaagcagtcccctcgtcatgtccaaccagaaagaagtcttgagatgttttactgtgctggcttgttcctcccccgaccggcttctggcatttctgctgccacggctggatacatcaaacgaaagaacacgggtcggaaccctgcaggtggtgcgacatgtgattaatagcgctggagagtgtctgcacgcttcacttgcagccacgcccggccacgtccaagatggggccggaccgggcaggctgtgcccctccaagtag

SEQ ID NO: 30461 - DNA, 4926 bp, Artificial Sequence
  Description of Artificial Sequence: Synthetic coding sequence
atgacggagtcttctatgaaaaagttagccagtaccctcctcgatgccatcacagacaaagatcctctcgtccaggaacaggtgtgcagcgccctttgctcattgggggaggcgagaccagtggagacccttagggcttgtgaagaatacctgcgacagcacgataagttggcgcacccgtacagagcggcggttctccgggccatggaaagagttctgagtagtcgagccagcgaactggataaagacaccgcatctaccatcatcctactggcatcctccgagatgaccaagacaaaagatttagtgtgggactggcagcaggcagccagtggtgttttggtggccgttgggcgccagtttatttcgaaagtgatggaggaacttctgaggcggttgcaccccggtacactgccccattgcgccgttttgcatactcttgcatccctttcagtggccaatgcttttggggtggttccattccttccgtctgtattaagctccctgttacctgtgctgggagtcgccaaacaggacactgtgagagttgccttttgcagcgcactgcaacggttctctgagggggcgcttgagtatctggccaacctggatagagctccagatcctacggtacggaaggacgcatttgccacggacattttcagcgcctatgatgttctgtttcaccaatggctgcagtcaagggaggcaaagttgcggctggctgtcgtcgaagcattaggaccaatgtctcaccttctcccttcagagcgattagaggagcaactgccaaaactgctcccagggatcctcgcgctgtataagaagcacgccgaaactttttatctatcaaagagcctggggcagatactggaagcagctgtttctgtgggcagccggactcttgaaacccaactggacgcccttcttgctgccctccactctcagatttgtgtgcctgtcgagtccagtagtcctctcgtgatgtctaaccagaaagaggtgctccggtgcttcactgtactagcatgcagcagcccagaccgtttacttgcattcctcttgccacggctggacacatccaacgaaagaactagggtcggaaccttgcaggttgttcggcacgtgataaattccgcggcagctcagatggaagataaaaaacctttcatactgtctagcatgagactgcctctgctcgataccaacagcaaggtaaagagggcagtcgtccaggtgattagcgcgatggcgcatcatgggtacctcgagcagccaggcggtgaagcgatgatcgaatatatcgtgcaacagtgcgccctcccccccgagcaggaaccagaaaagccaggtcctgggtccaaggaccccaaagcagattccgtccgtgcaatctccgttcgtacactgtatctcgtctctacaactgtcgatcgcatgtcccacgtgctttggccataccttctccaatttttaacccctgttcggtttacgggggcgttgacaccattgtgccggagcctggtccacctcgctcagaagcgccaggaggccggcgccgatgcattccttattcagtacgacgcccacgccagtctgccaagtccatacgccgtgacagggcgtcttttagtggtcagtagctctccatatcttggtgatggccgaggggcggccgcattgcgtctgctctctgtactccacccaaatattcaccctttgttaggccagcattgggagactaccgtgcccttgttgctgggatacttagacgaacataccgaggagactctcccacaggaggagtgggaggaaaagctactaatgttccttagggatacgctcgctataatcagtgacaatgcatggatatgccagctctcattggaactctgtagacaacttccatgctatgatgaggctccacaagagaagaatttcctttacaagtgcatcggcaccacactgggtgccgcctctagtaaggaagttgtgagaaaacatcttcaggagctgttggaaactgcgcgctaccaggaggaggccgagagggaaggcctggcttgctgctttggaatctgtgcaatttctcacctggaagatacgctggcccaactggaggattttgtgaggagcgaagttttccggaagtcaatcgggatacttaacatttttaaggataggtctgaaaatgaagtcgaaaaggtgaaaagcgccctgatcttgtgttacggccatgttgctgccagagcccccagagagttggtccttgccaaggtagaatctgatatcttaaggaacatttgtcagcacttctcaacaaaagtgctgggtattaaagtcgagactaaagaccccgcccttaaactctgtttagtacagagtgtctgtatggtcagtcgcgctatctgttctagtactcaagcaggttcatttcacttcacacggaaagccgagctggtcgcgcagatgatggaatttattagagctgaacccccagatagcctgcgtacacccatccgaaaaaaagcgatgctgacatgtacatacttggtgtcagtggagcctgctcttgacgagcaagctagagcagacgtgattcatggatgtctgcactctattatggcacttttacctgaacccaaagaagaagatgggggatgccagaagtcactgtacctagagaccctgcacgcactcgaggatctgctgacgtccctcttgcagcgcaacatgactccacaggggctgcagatcatgatcgagcacctttccccctggattaagagtccgcgcgggcacgagcgagcaagagccctggggttaagcgctctgttattgcgctatttcctggagcacctgcgcgtcagcgccctcgtgcctttccacaacctcggtctactgattggccttttttctccaagatgtgctgatctctggcctgccactaggcaggaagcggtagactgtgtgtattcgctcctttatctacagctgggttatgaaggcttttccagggactatcgcgacgacgtggctgaaagactcctttcactgaaggacggcctggttcatccagaccctgccatcttgttccacacttgccattccgtgggccagattattgccaaaaggcttcctcccgaccagctgatttccctccttcttacgatgttcgaggccctgggggatccagaaaaaaattgttctagagccgccactgtaatgatcaattgcctgctgcaggaacgcggcggcgtcctgcaggagaaggtcccagaaattgtctccgttttgcgctcgaagctccaagaggctcaaggcgaacacgtgctgccagcggcacaacacagcgtgtatctgctggccacgcagcactgtgcagctgtggtatcctccttattggggtctccacttcctctagattcacacacttgtatgttgtggcgggccttggcagtggagcctaggctggctgcgcaggtgttgggcctgttgttagagaagatgagtagggacgtgcctttcaaggagagtcgcgccttcttattagggagaacacctgatagagtcgccacccttctgccactcagcgcaacgtgcgccctgttcgaagttatgagcactcctgccgccggccctgccgttcttgagctttatccccagctttttgtggtactcctgctccgggtctcctgtacagtgggggtgcagctgccacgcaatctacaagcacaggagaggaggggcgcaagtccggctctggccacaaggaaccttgaaccatgctcctccgcagtagatactctgcggtccatgttacttcgaagtgggtcagaagacgtagtgcagcgcatggatctagaaggaggttgggagttactacgtactagcgccggacatgaggagggagcgaccaggctggcgagggccatggctgagcacgccgggccccggctcccattggttctgaaaaccctggcctgtacacactccagtgcatacgagaatcaacgggtgacgactaccgcttttctagcagaacttttgaattccaatgtagccaatgacttgatgcttctggactcattgctggaaagtcttgccgctaggcaaaaagatacctgtgcttccgtccggcggttggtgctccgcggtcttgccaaccttgcctctggctgcccagacaaagtcagaacacacggtccgcagctgctgactgcaatgatcggtggcctagacgatggcgataatcctcacagtcctgtagctctggaggcaatgctgggcctggcacggcttgtgcacctcgtagaaagctgggatctacggtccggattgttgcatgtggccatcaggattagacccttttttgattccgagaagatggaattcagaaccgcgagtatcaggttattcggacacctgaacaaggtctgtcacggcgattgtgaagacgtattcctggaccaagtagtcggcgggctggcgccattactgctgcacctgcaggatcctcaggccaccgtggccagtgcctgccgcttcgcgcttcgcatgtgtggccctaatctcgcttgtgaagagctctcagccgcgttccaaaaacatcttcaggagggtcgagcactacacttcggggaatttctcaatactacctgcaagcacttgatgcaccatttcccggatctgctcgggagactgctgaccacgtgccttttctattttaagagtagttgggagaatgtgcgcgccgctgcgcctctgtttacaggctttctcgtgctgcatagcgagccgaggcagcaaccacaagtggacctcgaccagctcattgcggcactgcagatactccttaaggacccagcccccgaggtgagaacccgcgctgctgaggcgctcggtagactcgttaagctcgcgtag

SEQ ID NO: 30462 - DNA, 1653 bp, Artificial Sequence
  Description of Artificial Sequence: Synthetic coding sequence
atgattaattgcctcttacaggaacgggggggggttctccaggaaaaggtgccagaaatcgtttcagtgctgcgatcgaaactccaggaggcccagggcgaacacgtgctgcctgcggcacagcacagcgtttatctgctcgcaacacagcattgtgccgctgtcgtgtccagtttgctagggagtccccttcctctggactctcacacttgcatgctttggagagctcttgctgtggaacctcgccttgctgcacaggtgctgggcttgctcctggagaagatgagtagagacgtcccttttaaggagtctcgcgccttcctgctaggccgcactcctgaccgggtggctactcttctgcctctgagcgccacatgcgccctgtttgaggtcatgagcacccctgcagctggacctgccgtgctcgaactataccctcagctcttcgtcgtgctgcttctcagggtgagttgtacagtaggggtgcagctgccccggaaccttcaggctcaggagcgacggggagcttctcccgctctggcaacccggaatctggagccatgttcatccgcagtggatactctccgatcaatgttgttaagatcaggctcagaagacgtggtacagcgtatggacttggaggggggttgggagttgcttagaacctctgccggacatgaggagggagcaacccgactggcccgggcaatggccgaacacgcaggtcctcgcctccccctggtgttgaaaaccctagcctgcactcactcgtctgcgtacgaaaatcagcgggtcaccacaaccgccttcctagccgaactgctgaactcgaatgtggccaacgatctgatgttactagattcactccttgaatcactagcggcaagacagaaggatacatgtgcttcagttaggcggttagtgctccgggggttggctaacctcgcatccggctgccctgataaggtgagaacacatggcccacaattgttaacggcaatgatcggcggactcgatgatggggacaacccacactctcctgtggctctggaagctatgctcggtttagctcgtctggtgcacctggtggaaagctgggacctgaggtccgggcttctgcacgtggctattaggatacgacctttttttgacagtgagaaaatggagtttagaaccgcttcaatccggctgtttggacacctgaacaaggtctgtcatggagattgtgaagatgtgtttttggaccaagtggtgggggggttggcgcctcttctgctccatcttcaggaccctcaggccacagtcgcgagcgcatgtcgtttcgcactcaggatgtgtggtcccaatctggcctgcgaggagctcagcgctgcattccagaagcatttacaggaaggcagagcattacactttggggagttcctcaacacaacgtgcaaacacctcatgcaccacttccccgacctcctgggccggctcctgacaacgtgcctcttctacttcaaatctagttgggagaatgtgagagcagcggcccccttattcactggcttcctggtgctgcactctgaacctcgacagcagccacaggtggacctcgaccagctgattgcagcccctttactctatccccagcggtccagatcatgctag

SEQ ID NO: 30463 - DNA, 1269 bp, Artificial Sequence
  Description of Artificial Sequence: Synthetic coding sequence
atgacagaatcatctatgaagaaactagccagcacgctcttggatgccattacagataaggatccattggtgcaagaacaagtgtgctcggccctgtgttccttgggcgaggccagaccagttgagaccttaagagcctgtgaagaatatcttcggcaacatgataaactggcccacccctatagggctgctgtgttacgggctatggagcgcgtgctgagcagccgggcatcagaactagacaaggatacagcgtccaccattattctgttggccagcagtgaaatgacaaagaccaaggacctggtgtgggattggcagcaagcggccagcggtgttctggtcgcggtcggacgccagtttatttctaaggttatggaggagttgcttcgcagactacatcccggaacgctgccccattgcgctgtgctccacaccctcgcttcattgagcgtggccaatgcatttggggttgtgccctttctcccatcagtcctctccagtctactgccagtactcggcgtggctaagcaggacactgtgcgcgtcgcgttctgcagtgctctccaacgctttagcgagggtgccttggaatacctggcaaacttggaccgggctccagatcccacagtgagaaaggacgcattcgcgactgacatcttcagcgcctatgacgtgctgtttcaccaatggctgcaatcaagagaagcgaagctgagactggctgtagtcgaggccctcggtcctatgtcacacctgctccctagtgagcgcttggaggagcagttaccaaagctcctgccggggatcctggccctgtataagaaacatgccgagacattctacctgtctaagtccctaggccagatcctcgaggcagcggtcagcgtcggcagccgaactctcgagacccagttagatgctctgcttgctgcactacacagtcagatctgcgtccccgtggagtctagttcaccgttagtcatgtcaaaccagaaggaagtgttaagatgctttaccgtgctggcttgttctagtccagaccgcttactagcttttctgctaccccgcctggacacgagtaatgagcgtacccgcgtgggcacactgcaggtggtgcggcacgtgatcaactctgctggcagtacaaataccaggatcactttgatgctccctagcgctgtgacccgcctcaagcacgaggattgtcccgcacgggcagcgcctcagccggctgatttgacagccgcccctgcaagtgtcgcttag

SEQ ID NO: 30464 - DNA, 4926 bp, Artificial Sequence
  Description of Artificial Sequence: Synthetic coding sequence
atgacagaatcatcaatgaagaagctagctagtactctcttagacgccatcacggataaggacccactcgtgcaggaacaggtgtgtagtgcactgtgttcactaggagaagccaggccggtggagacactgagagcatgcgaggagtatttgagacagcatgacaaattggcccacccgtatcgtgctgctgtcctgcgagccatggagcgagtgctctctagtagagcatccgaactcgacaaagacacagcaagcacgattatcctcctcgcctcatccgaaatgacaaaaacaaaagatctggtgtgggactggcaacaagcagcctctggagtgctggttgccgtaggcagacagttcatctctaaagtcatggaagaactgctgagaaggctgcacccaggcacactgccacactgcgcagtgttgcatacactcgcctctctcagtgtggccaatgcatttggcgtggtgccttttcttccctcagtcctttcttccctcctcccagtactaggggtggcaaagcaggatactgtccgggtggcattctgctcagcactccagaggttttcagaaggagctctggaatacttggccaatctagatagggcccctgaccctaccgtgagaaaggacgcgtttgcaacagacatcttttctgcatatgacgtgttgttccaccagtggcttcagagtcgtgaggccaaactccgattagccgttgtagaagcactgggaccaatgtcgcacctgctgccttcagagagactggaagagcagctcccaaagttactgccagggatcctcgccctgtacaaaaaacacgccgagacgttctatctctcaaaaagcctgggccagattttggaggcagccgtttctgtggggtcaaggaccctcgagacgcagctcgacgccctgctggcagccttgcattcccaaatatgcgtcccggtcgaaagcagctctcctttagtgatgagtaaccaaaaagaagtgctacgctgtttcacagtgttggcctgttcctcacctgataggctcctagcttttctcctgccacgtctggacacgtcaaatgagaggacccgcgtgggcaccctgcaggtagtgaggcatgtgatcaattccgccgctgcccaaatggaggataaaaagccatttattttgagctcaatgcgactgcctttgctcgacactaacagcaaggttaaaagagctgtcgttcaggttatcagcgctatggctcaccatgggtacttagagcagcctggcggagaggctatgatcgagtacatagtgcagcagtgcgcacttcctccggaacaggagcctgagaaaccaggccctggttctaaagaccctaaagctgacagcgtgcgcgccattagtgtccgtacactttacttggtttccaccaccgtcgaccgtatgtcacatgtgctctggccatacctgctacagtttttaacacctgtgcggttcaccggcgcacttaccccactctgcagatctctcgtgcatttagcccagaaaaggcaggaggcgggagcagacgctttccttatccaatatgacgcccatgcttctctccctagcccttacgcagtcacaggccggctcctggtggttagctcatccccttatctaggagacggacggggcgctgcagcactgcgactcctgtctgttctccacccgaatatacacccactgctgggccagcattgggaaacgaccgtgcccttactgctgggctacctggatgagcataccgaagaaacactgcctcaagaagagtgggaggagaaactcctaatgtttctgcgcgataccctggccattataagtgataatgcctggatctgtcaactgtccctggaactttgccgacaactgccgtgctatgacgaagcacctcaggagaagaattttttgtataagtgtattggaactacgttaggtgccgcttccagcaaggaggtggtccggaagcatcttcaggaactcctggagaccgctcgttaccaggaggaggccgagcgtgaaggattggcttgctgcttcggtatctgcgcgatcagccacctggaggataccttggcacaacttgaggactttgttcgctcagaagtcttccgtaagagtataggtatcctgaacatcttcaaagacaggtcagaaaatgaggtggaaaaggtgaagtctgccctcatactctgctacgggcatgtcgccgcccgggcccccagagaactggttcttgccaaggtcgaaagtgacatcctgaggaatatttgccagcacttttccaccaaggttcttgggatcaaagtggagactaaggaccccgctctaaagctatgtttggtccagagtgtttgcatggtgagcagagcgatttgctcatccacacaggcaggatctttccatttcactagaaaagcagaactggtcgctcagatgatggaatttatccgggcagagccccctgactccctcaggaccccaattaggaaaaaagcaatgctgacttgtacctacctcgtgtccgtagagcccgccctggacgagcaagcccgagccgatgttatccacgggtgtctgcatagcataatggccttgctcccggagcctaaggaagaggatgggggctgtcaaaaatctctctacctggaaactttgcatgccctcgaggatcttttgactagtttacttcaacgaaatatgacgccacaggggcttcagatcatgattgaacaccttagtccctggatcaagtctccaaggggccatgaaagagccagggcccttggactgtccgccctcttactccgctatttcttagagcatctcagagtatccgccctggtccctttccataacctggggctgctaatcggactgttcagcccacggtgtgccgacctctggcctgccactcgacaagaggcagtcgattgtgtgtacagcctgctgtacttgcaactgggttatgagggatttagcagagattatcgagatgacgtggccgagaggctcctttccctcaaagacggattagtgcaccctgacccggcgatcctattccacacgtgtcacagcgtcggtcagattattgccaaacgcctcccaccagaccagttgatcagtctcctgttgacaatgtttgaggctcttggggatccagagaaaaattgttcacgcgcagccacggtgatgattaactgcctgctccaagaacgcggtggcgtcctgcaggaaaaggtgcccgagatagtcagcgtcctgagatcgaaactgcaggaggcgcagggagagcacgtcctgcctgcagctcagcactctgtctaccttctggctacacagcattgtgctgccgtcgtgtcctccttacttggcagtcctctgcccctggacagtcatacttgtatgctgtggcgggccctggccgtcgaacctcgtctggctgcccaggtgttggggctcctgctggagaagatgagcagagatgtccccttcaaggagtcgcgtgctttcctgttgggtaggaccccggatcgcgtggccaccctccttcccctgtcagcaacgtgtgccctatttgaggtcatgagcactcctgcagctggaccagccgtcctggaactgtaccctcagctgtttgttgtactgttactgcgagtgtcgtgcaccgtaggggtccaactgcctcggaatctgcaggcacaggaaagacgcggtgcatcaccagccctggctaccaggaacctggagccgtgttccagtgccgtcgacactttgcgatctatgctgcttcgaagcggaagcgaggacgtcgtccagaggatggacctggaaggtgggtgggaattgctgaggacttccgcgggccatgaagagggagcgacacggctggcccgtgcaatggctgaacatgccggaccaagattgcccctggtgcttaagaccctggcgtgcactcattcgtcggcatacgagaaccaaagagtgactaccaccgctttcctggctgagctgcttaacagcaatgtggccaacgatcttatgttactggactccctgctggagtcattggccgctcgtcagaaagacacctgtgcttccgtgcggagactggtgctgcgagggttggctaatctggcatcaggatgtccggataaagtgagaactcacgggccccagttgttgactgcgatgattggagggctggatgacggcgataatccacacagccccgtcgccctggaggcgatgctcggcctggcccgtctggtgcatctagttgagagctgggatctgcggtcaggtttgctacacgtagcaatacgaatccgccccttttttgattctgagaagatggagtttcgtacagcatcaattaggttgttcggacatctcaacaaagtgtgccatggagattgcgaggatgtgtttctggatcaggtggtgggcggtctagctccactcttgttacacctgcaggacccgcaggccaccgtcgccagcgcgtgtcgtttcgctctgaggatgtgcggccccaacctggcgtgcgaagagctctctgcagcttttcaaaaacacctccaggagggccgtgccctccatttcggtgagtttcttaatacaacctgcaagcacttgatgcaccattttccagatctgctgggcaggctgttgacgacctgtctattttactttaagagcagttgggagaacgtgagagcagccgcccccctgttcaccgggttcctggtattgcacagcgagcccagacagcagccgcaggtggacctcgaccaactgattgctgccctccagatccttttaaaggacccagcccccgaggtgcgcacacgggcagccgaggcacttggcagactagttaaattagcgtag

SEQ ID NO: 30465 - DNA, 1848 bp, Artificial Sequence
  Description of Artificial Sequence: Synthetic coding sequence
atgcgcataatcgctaaacgccttcctcctgaccagttgatttctctcctgctgacaatgttcgaggcactgggcgaccctgagaagaactgctctagagcagctaccgtgatgatcaactgcctccttcaggagaggggcggggtgctccaggagaaggtgcccgagatagtgtccgtgcttagatctaagctacaggaagcccagggagagcatgtactccctgctgcccaacacagcgtgtatttattagcaactcagcattgcgctgctgtggtgtcctctttgctcggatcccctcttcctctggacagccacacctgtatgctctggagggccctggccgtggagcctcgtttagcggcgcaggtgctggggcttttgctggagaagatgtcccgcgacgtcccttttaaggaatctagagctttccttttaggccgcacccctgaccgggtcgccaccctgctgcccctttctgctacttgcgctttatttgaggtgatgagcacccctgccgctgggccggctgtgctagaactgtacccgcagttgttcgtggtactcctactaagagttagctgcaccgtaggcgtgcagcttcctaggaacctacaggcccaggaacgcaggggtgcttcccctgcgttagccacacgtaacctggaaccctgctcctccgcagtcgatacactgcgatcaatgttgctgagaagtgggagcgaggacgtggtccagcggatggatttagagggtgggtgggagctgctaagaacatccgcaggacacgaggagggagccacacgtctggctcgcgcaatggcagaacacgcaggtccccgcctgcccctcgtattgaaaacactggcctgcacacacagttcagcctacgaaaatcaacgcgttaccacaacagcctttctggcagagcttctcaacagcaacgtggccaatgacttgatgttgctggacagtcttctcgagtcgctggccgccaggcagaaggatacctgcgcctccgtgcggcgcttggtgttgcgcggtttggccaacctggcttccggttgtccggataaagtgaggacacacgggccgcaattattaactgccatgatcggagggttggacgacggagacaacccgcactctcccgtagcgctggaggccatgctcggcctagctcgcctcgtgcacttggtagagagctgggacctcagaagtggactcctccatgtcgccatcagaatcaggccgttttttgactccgagaaaatggagtttcgaacagcctcaatccgtctcttcggccacctcaataaggtgtgccacggcgactgtgaagacgtcttcctggaccaggtggtgggagggctggctccattgcttttgcatctacaggacccgcaggctacggtggctagtgcatgtcggttcgccctccgtatgtgcggccctaacttggcctgcgaggagctgtccgctgctttccagaagcatttgcaggagggaagggccctgcacttcggagaatttctgaatacgacttgtaaacatctgatgcatcactttcccgatctccttggtagactgttaaccacgtgcctcttctactttaagtccagttgggagaacgtgagagctgctgcacccttgtttactgggaagcaccacccactcccacacccccacgccgctcggcagcctcggttgatgcctccactgcatcgtgtccccggagccgctctaggggcccaggctgccgcagccggtgggcctggcccggcccactgtggcgctccggaccccgctgaaggtccgggcccccggggagctgatgagggatgttag

SEQ ID NO: 30466 - DNA, 4926 bp, Artificial Sequence
  Description of Artificial Sequence: Synthetic coding sequence
atgacagagtcctcaatgaaaaagctggcatccacacttctggatgccatcactgataaagatcctttggtgcaggaacaagtttgttccgctctctgctctttgggggaggcccggcctgtcgaaactctgagggcttgcgaagagtatcttagacagcacgacaagctcgctcatccatacagagccgctgttttgcgagcaatggagagggtgctcagttcacgcgcatctgagctcgacaaggacacagcatcgaccattattctcctcgcaagctctgagatgaccaagactaaggacctggtgtgggactggcagcaggccgcgagcggagtgcttgtagcggtgggcaggcaatttatcagcaaggttatggaggaattgctgagaaggctccaccccgggaccctgccgcactgtgccgtgctccatactctcgcaagtctatccgtggccaatgcatttggcgttgtcccattccttccatcagtgctgtcctctctgttgccagtacttggggtagccaaacaggacacagtgcgcgtggcgttctgttctgccctacagagattctcagagggcgcgctggaatacctcgcgaatctggaccgcgcgcccgatccgaccgtgagaaaagacgcctttgctacagacatcttctccgcctacgacgtgctgtttcaccagtggctccagagtagagaggctaaactgcgattggccgtggtggaggcgctggggcccatgtcacaccttctgccctcagagagattggaagagcagttgcctaaactgttgcctggcattctcgcactttataaaaaacacgcagaaactttctatctgagtaagtctctcggtcagattttggaagccgctgtaagtgtcggctcacgcaccctggagacccagctggatgcgctgctggccgctctgcacagccagatctgtgtgcccgtcgaaagcagctcccccctggtgatgtctaatcagaaggaagtgctacgatgctttacagtgctggcatgttcctctcctgaccggctgttggccttcctcttacccagacttgatacaagcaacgagagaacccgggtcggtacactgcaggtcgtgagacacgttattaacagtgctgctgcccagatggaagacaagaagccgtttatactttcgagcatgaggctcccacttctggacactaactccaaagtcaagagggctgtagttcaggtaatttccgctatggcccatcacgggtacctcgagcagcctggaggcgaagccatgatagagtacatcgtccaacaatgtgccttgccccctgagcaggagcctgagaagcccggccccggatcaaaagatcccaaagctgatagtgttcgagcaatttccgtgaggaccctttaccttgttagcactacagttgacaggatgtcccacgttctttggccatacctgctgcagttcctgacacccgtccgcttcacaggagctctgacccctctctgtagatcacttgtacatctggcccagaaaagacaggaggccggtgctgatgcttttctaatccagtacgacgcacacgcaagcctaccctcgccctacgccgtgactgggaggctgctcgtcgtaagctctagcccatacctgggtgatgggagaggggcagccgctttgcgcctgttatctgtcttgcaccctaacatccatccccttttggggcagcattgggaaacgactgtacccctccttctgggctatctcgatgaacataccgaggaaacactgccccaggaagagtgggaggagaagctccttatgtttctgcgggatacgctggccatcattagtgataatgcttggatttgtcagctttcccttgaactctgcagacagctgccctgttacgatgaggctcctcaggaaaagaacttcttgtacaagtgcataggcacgacactgggggcagcctcaagcaaggaagtcgtaagaaaacatcttcaggagctgctggagactgccagatatcaggaagaggcagaacgtgaagggctggcctgttgtttcggcatatgtgccatttcccacctggaggacactcttgcacagctggaagacttcgtccgcagcgaggtattccggaaatccatcgggatcctgaacattttcaaagatcggagtgagaacgaagtggagaaagtgaagagtgctttgatcctgtgctatggtcacgttgcagccagggccccccgagagctggtcctggccaaggttgagtccgacatactgcgtaacatttgtcaacacttcagtaccaaagtccttggcattaaggttgagacaaaggacccggccttgaaattatgtctggtccaatccgtgtgtatggtgtccagagccatctgcagttccactcaagccgggtcctttcatttcacaagaaaagccgaactggtggcacagatgatggagtttattagagccgaaccacctgacagccttcgtactcctatccgtaagaaggcaatgctcacctgcacatatctcgtgagcgtggagccggcactggacgagcaggcacgcgcagacgtgattcacggttgcctgcactccattatggcccttctccctgaaccaaaagaagaggatgggggatgccaaaaatccttatacctagaaacgctacacgcactcgaggacctcctgacaagcctgctgcaacgaaacatgactcctcagggccttcagatcatgattgaacacctcagcccatggattaagtctccacgcggtcacgagagagcaagggcgctcggcctgagcgctctactcctgcgatactttctggagcatctgagggtgtcagcactggtaccctttcataatcttggcctgttaataggcctgttctctccacgatgtgctgacttgtggcccgccaccaggcaggaggcagtggattgtgtgtactctctcctttacctccagttaggatatgagggattttctcgggactaccgcgatgatgtggccgaaagactgctcagcctgaaggatggccttgtgcacccagatcctgcaatcctgtttcacacttgtcactccgtggggcaaatcatagccaagagattaccccccgatcagctgatcagtctactgttgacaatgttcgaagccctcggcgatcccgagaagaattgctcgagggcagctacagtgatgattaattgtctccttcaggagagggggggagtgcttcaagaaaaggttcccgaaattgtatccgtccttaggtccaagctgcaggaagcccagggcgaacacgtgctccccgcagcgcagcattccgtataccttttggcgacacagcactgcgccgcagtggtgtcatcattactgggctcccccctaccattagatagtcacacatgcatgctatggcgcgctctggccgtggagccccggctcgcagctcaggtgcttgggttgctcctagagaagatgagccgcgacgtcccgttcaaagagtcgagagcattcttattagggcggacaccagatcgtgtggcgaccctgcttccactttccgcgacctgcgccttgttcgaggtcatgtctaccccagcagctggcccagcagtgttggagctgtatccgcagctattcgtagtgctgctcctgagagtgtcgtgcaccgtcggagtgcagctcccacgcaatctgcaggctcaagagcggaggggagcaagtccggccctggcaacacgcaaccttgagccctgttccagtgctgtcgacaccttacggagcatgctactgagatccggttctgaagacgtggtgcagaggatggatcttgaaggggggtgggaactgcttcgcacttccgccgggcacgaggaaggagccacgcgcttggctcgtgcgatggccgagcatgctgggccaagactcccactggtgttgaaaaccctggcttgcacccactctagcgcctatgaaaaccagcgggtgaccacaacggcctttctcgcagaactgcttaactccaacgtggcaaacgatttaatgttgctcgattctttgctcgaatctttggctgcacgtcaaaaggacacgtgtgcaagtgttcgccggctggttcttaggggtctggcaaatctcgcctcaggctgccccgacaaggtccgaactcacggacctcagctcctcacagctatgatcggaggcctcgatgatggggacaatcctcatagccccgtggctctagaggccatgttaggtcttgccagacttgtccacctggttgagagctgggacctgaggtccggactgctccatgtggccattcgaatccgtccattctttgattccgaaaaaatggaatttcgcaccgcatcgatcaggttattcggccatctcaacaaagtttgccatggggactgtgaagatgttttcctggatcaggttgtgggtggtctggcccccctattgctgcacctgcaagatccgcaagctactgtcgctagcgcctgtcggtttgctctgcgcatgtgtggtccgaatctggcctgcgaggaattaagcgcagcattccagaagcacctgcaagagggtcgggccttgcacttcggcgaattcctgaacaccacctgtaagcacttgatgcatcacttccccgatttgctgggaagactgttgacaacttgtttgttttatttcaaaagctcttgggagaatgtcagggccgccgctccactgtttactggcttcctcgtgctgcatagcgagccccggcagcagcctcaggtggatctagaccagctcatcgctgccctgcagatcctcctgaaagaccccgctcccgaagtgcgcaccagagccgcagaggcccttgggcgtctagtaaaactggcctag

SEQ ID NO: 30467 - DNA, 3873 bp, Artificial Sequence
  Description of Artificial Sequence: Synthetic coding sequence
atgaaagcatcctcatgtttcctgatcctagcacatagcaatccgggagagttgatggaatttttcgacgagcaggtgcgcagcaacaacgaagcgataagagtgggcattctgacgctactgcgcctggcagttaatgccgacgaacctcgcctgcgcgaccacataatatcaattgaaagaacggtgaagattgtcatgggtgatttgtctaccaaagtaagaaattccgtcctcctgttgatccagaccatgtgtgagaagagctacatcgaagctcgcgaaggctggccacttatcgattacgtttttagccagtttgccaccctgaacaggaatttggaaaagccagtcaagacaaatttccacgaaaacgaaaaggaggaggaatccgtgagagaaacaagcctggaagttctgaaaaccttggatcctctagttatcggcatgccccaagtactctggccaaggatcctaacctttgtcgtgccagcagaatacaccgaggcattagagcctctgttctctattatacggatccttatcatggctgaggagaagaagcagcactcagccaaggagtcaacagccctggtggtgtctaccggcgccgtcaagctgccatctcctcagcagctactcgcgcggcttctggttattagcatgcccgccagccttggggagttgaggggagccggagctatcggcctactgaagattctccctgaaatcattcacccaaaactcgtcgacctgtggaaaacacgcttacctgagctcctgcagcctcttgaaggaaaaaatataagcacagttctctgggaaacaatgctgttgcagcagcttcttaaggaatccctctggaagatctcggatgtagcttggactatccagcttacgcaggatttcaagcagcagatgggatcctatagcaataactccaccgaaaaaaagttcctgtggaaggcactcggtacaactctggcttgttgtcaggacagcgacttcgtgaattcccagattaaagagtttcttacagcccccaatcaactcggtgatcagcgacagggcattacatccatcctggggtactgcgcagaaaaccacctcgacatcgtgttgaaagtcctaaaaaccttccaaaaccaggagaagttcttcatgaaccggtgtaagagtttgttttccggtaagaaaagcctgacgaaaaccgacgttatggtgatctacggtgcagtggctcttcatgcccctaagaagcaactactgtctagactcaaccaggatatcatttctcaggtgctctcactgcatggacagtgtagccaggtgctgggaatgtcagttatgaacaaggatatggatttgcagatgagctttacaagatccattaccgagataggaatcgccgtacaggacgctgaagatcaggggttccagttttcctacaaagagatgctgatcggatatatgctggacttcataagagatgagcccctcgatagcctggcttcccctataaggtggaaagccctgattgccatccgctacctaagtaagctcaaaccgcagctgagtctgcaggatcatctgaatatcttggaggagaacatccgccgcctcctgcctcttccacccctggaaaacctaaagtctgagggtcaaaccgacaaggataaggagcatatccaatttctctacgagcgttcaatggatgcactgggtaaactcttgaaaactatgatgtgggataatgttaatgccgaggattgccaggagatgtttaacctgttacagatgtggctcgtaagtcagaaagagtgggagcgcgagcgagcctttcagattactgctaaagtattgacaaacgacatcgaagcacccgaaaactttaaaatcggcagcttgcttggactgctggccccccacagttgtgatacactccctacaattagacaggcagcggccagtagtaccattgggcttttctacatcaaagggatccacctggaggtcgaacgcctgcaaggtttacaggaagggctggagagtgacgacgtacaggttcaaattaagatttcttcaaagatcgctaagatcgtgtctaaatttatccctaatgaagagatactaatgtttctggaggaaatgctcgatggcctggaaagcttgaatcccacctgcacaaaggcctgtggtatctggatgattaccgtactgaagcagcaaggagccgcacttgaagaccagctgcttgaaatattgggcactatatatcatcacatgccagtcctgcgccagaaggaagagtcatttcagtttattctcgaggccattagccaaatagcttccttccatatggacactgttgtggtcaatcttcttcagaagcctctgccattcgaccgcgacacaaagactctgtggaaagcactggctgagaaacccgcgagctctggcaagttgctgcaggcgttaatcgataagctggagaccgaactggaggatgacattgcccgcgtcgaagccatttctgttgcatgcgccatgtatgaggtgattagcatgggaaccagcgtgactggcctgtaccctgaactttttacattgttgctgaagctcgtctcctgcaccctaggtcagaagatgctgacttgcccctggtcacacagacggcacgtgatgcagcaaggcgaacagcagcagataccagatccctgccggcttagcaccgcaactctcaaatgcctgcaggcccaagccatgcgcgagggcctggcgaaggaatctgacgaaggcgacaacctgtggaccttactgagtagcccaagtacccatcatatcggcgtgtgcagcctggcccggtcgatggcagtatggcagcatggagtgatcctggacatcatggagcaattgctctcaagtcttacaagctcatccgaaaattatcgtattacaggggccgccttcttcagtgagctcatgaaagaacccatcctttggaaacatggcaaccttagaaatgtgttgatcctgatggatcaaagcgcctgggactctaatgctaccttacggcagatggcgattagagggctcggaaacacggcttctggcgcgcctcacaaagtcaagaagcacaagcagctcatgcttgaaagcatcattagaggcctttatcacctggcacggacagaagtggtgtgcgagagtcttaaggctctgaagaaaatcttagagctcttgaccgatcgcgatgtgagcttctactttaaggagatcgtgttacaaactcgaacattcttcgaagacgagcaggacgatgtccgtctaaccgccattttcctcttcgaggatctggctccacttactgggaggcgatggaagattttctttgcggaagagatcaagaaatcccttatcagtttcctgctccacttgtgggatcctaatcccaagattggcgtggcttgtcgcgatgttttgatggtatgcataccctttttaggccttcaagagctgtacggagtactggaccgcctgctggatcaggaccttcctagagcaagagacttttacaggcagttttgcgttaagcttgccaaaaagaatcaggaaattctttggatcctccacacgcattctttcaccttcttcacgtcaacatgggaggtgatcaggtccgctgctgttaaactgacagatgctgttgtactaaacttgacttcccagtatgtggaactcctcgatagggaacagttgacaacacgcctccaggctctccgccaggatccttgtatatccgtgcagcgggcagcagaggctgctcttcagaccctattgagacgctgtaaagagacatcaatccctctctag

SEQ ID NO: 30468 - DNA, 4758 bp, Artificial Sequence
  Description of Artificial Sequence: Synthetic coding sequence
atgaccttgagcacggaggaatccatagagatgtttggcgatataaacttgactctcggtatgttaaacaaggaagatatcgtgaataaagaggacatctacagccatctgaccagcgtcatacagaatacagatattctggatgacgccatagtccagcggctgatatactacgccagcaaggacatgcgagacaacaatatgctgcgcgaaattcgtatgctggctggcgaggtgctggtcagtctggcggcacatgattttaattcagtgatgtatgaggtacaaagcaactttagaatcctggaactgccagacgagtttgtcgtcctggccctcgctgagctagctacttcttacgtgtctcaaagcattcctttcatgatgatgacgcttctcacaatgcagactatgctgcggcttgccgaggacgaaagaatgaaggggacgttttgcattgccctagaaaagttctcgaaagccatctacaaatatgtcaaccactggcgtgactttccttacccaaggctcgatgctaataggttgagtgacaaaattttcatgctcttctggtatattatggagaagtgggccccactagcctcgcctatgcagacactcagcatcgtaaaagctcatgggcccacggtcagtctgctgcttcacagagaagatttccgggggtatgccctcggtcaagttccctggcttctaaaccagtacaaggacaaagaaatagacttccacgtgactcagtctttgaagcagattctgaccgctgcagttctgtatgatatcggacttccccggagtctgcgtcgtagtatctttattaatctgttgcaacagatttgcagggctcctgagcccccggtgaaagagaatgaaatgaaagccagttcctgctttctgattttggcacactccaatcctggcgaactgatggaattctttgacgaacaggtgcggagcaataatgaggctatccgagtcggtatcttaactctgctaagactggcagtcaacgccgatgagccccggctgagagatcatatcatatcaatagagcggacagtcaaaattgttatgggggatttatctaccaaggtcaggaacagtgtactacttttgattcagaccatgtgtgagaaaagttacattgaggcaagggagggctggccactgatcgactacgtgttctcgcagtttgcaacccttaataggaaccttgaaaagccagtcaagacgaacttccatgaaaatgagaaagaggaagaaagcgttcgagagactagcttggaagtgttaaaaacgctggatcctctggttatcggaatgccccaggttctgtggccccggattctgaccttcgtcgtgccagcagaatacaccgaagcactggagcccctctttagtatcattagaatcctgataatggcggaggaaaagaaacagcactcagctaaagagagcaccgccctggtagtgtcaacaggcgccgttaaattgccatcacctcagcagcttctagcgaggttgctggtaatctcgatgccggcttctcttggagaacttaggggcgcaggtgccatcggactgctgaagattctgcccgagataatccatccaaagctagtagacttatggaaaacccgcctgccagagctcctgcagcctctggagggtaaaaacataagcactgtgctctgggagaccatgcttctccagctcctcaaggagtctctctggaaaatttctgatgtggcttggacaatccagctcactcaggacttcaaacaacagatggggagctacagtaacaactccaccgagaaaaagtttctctggaaggctctcggaactaccctggcttgttgccaagacagcgactttgtgaatagtcagatcaaggaatttctgacagcccctaaccagctgggtgaccaaagacaagggatcacaagcatcctaggatattgcgcggaaaaccacctcgacatcgtgctgaaggtgctgaaaacctttcagaatcaggagaaattcttcatgaataggtgcaaatcactcttctcaggcaagaagtccctcacgaagactgacgtgatggttatttatggcgcggtggcgttgcacgccccaaagaagcagctattatcccgcttgaaccaggacatcattagccaggtgctctcactccatgggcagtgtagccaggtgctgggaatgagcgttatgaataaagacatggatttgcagatgtcatttacacggagcatcaccgagattgggatcgctgtacaggacgccgaggatcagggattccagttcagctacaaggagatgctgatcggctacatgctggatttcattcgggacgaacccctcgattcacttgcgagccctatcagatggaaggcactaatagctatccggtacctttcaaagctgaagccacaactgagcctgcaggatcatctgaacattctggaggaaaacatacggcgtctgctccctttgcctcctctagagaatttaaaatccgaggggcagaccgacaaggataaagagcacatccagttcctgtacgagagatcaatggatgccctggggaagctgcttaaaacaatgatgtgggacaatgtgaacgcggaggattgccaggagatgttcaacttactgcagatgtggctggtgtctcaaaaagaatgggagcgcgaaagggcattccagattaccgccaaggtgctcactaacgacattgaagctcccgaaaacttcaagatcggtagcctgttggggctgttagctcctcactcctgtgacacgttgcctactatcagacaggctgctgctagtagcaccatcgggctgttttacattaagggaatccatctcgaggtggaacgtcttcaggggctccaggagggcttggagtcggatgacgtgcaggtgcagataaaaattagctcaaaaatcgcaaaaattgtgtccaagtttattcccaacgaagaaatactcatgtttctcgaagagatgctcgatggattggaaagtctcaaccctacctgtaccaaggcatgtggaatttggatgatcacagtgctgaaacagcagggcgcagcactggaagaccagctgctggagattctcgggacaatctatcaccatatgcctgtgctcagacagaaggaagaaagcttccaatttatactggaggccatatcacagatcgcctcgttccacatggacacggtggtagtaaatttactccaaaaaccactacctttcgacagagatactaaaaccctgtggaaggcacttgcggaaaagcccgccagtagtgggaaacttttacaagctcttatcgataaactggaaacggagttagaagatgatatcgctcgggttgaggccatcagcgtcgcctgcgctatgtatgaagtgatatccatgggcacttctgtgactggattatatccagagctgttcacgctgctcctaaagctagtttcctgcacactcggtcagaagatgctcacttgcccctggagccatcggcggcacgtcatgcaacagggagagcagcagcagattccagacccctgccgactttctacagccacactcaagtgcctacaggcgcaggcaatgcgagagggactggccaaggagagcgacgagggggataatctgtggaccctcctgtcttcaccatccacccaccatatcggagtctgctcacttgccaggtcaatggctgtgtggcagcacggcgttatactggatattatggaacagctcctttcatccctaacgtcttccagcgagaactacagaattactggggccgccttttttagcgagctcatgaaggaacctattctgtggaaacacggcaacctccgtaacgttcttatcctcatggatcaatctgcctgggattccaatgccaccttaagacagatggccattcggggcttaggaaataccgctagcggagcacctcacaaagttaagaaacataagcagctgatgcttgagagcattattaggggcctttatcatctggccaggacagaagtcgtttgcgaatcccttaaagccctgaagaaaatcttagagttgctgactgaccgggatgtgtctttttactttaaagagattgttttgcaaacccggacctttttcgaggatgagcaggatgacgtgcgcctgactgcgattttcctgtttgaggatctggccccactcaccggccgccgatggaaaatattttttgccgaggaaattaagaagagcctgattagcttcctactccatttatgggaccccaaccccaaaatcggtgtggcttgtcgggacgtgctgatggtctgcatcccttttctgggtctgcaggagctgtacggtgtgcttgaccgcctactggatcaagacctcccccgggccagagatttttaccggcaattctgcgtgaagctcgctaagaaaaatcaggagatcttatggatcctccatactcattcttttacttttttcacgagcacctgggaggtcatccggagtgcagctgtcaagctgaccgatgccgtggtgctgaacctgaccagccaatatgtcgagttgctggatcgtgagcagttgactactcggctccaggcccttcgccaagacccctgtatctccgtccagcgcgccgctgaggctgcgctgcagacactgctaaggaggtgtaaggaaacttctattcctctctag

SEQ ID NO: 30469 - DNA, 225 bp, Artificial Sequence
  Description of Artificial Sequence: Synthetic coding sequence
atggacgttagaggacctgaagcacctggcggccgcgcactgcgagatgccgctgagaacctgttccaagagttacaagagcatttccaagctcttactgccactctgaacctgaggatggaggagatgggtaacagaatcgaggatttacaaaaaaacgtcaaggatttaatggtgcaggcaggtattgagaattctatcaaagaacagatgttaaaaacctag

SEQ ID NO: 30470 - DNA, 549 bp, Artificial Sequence
  Description of Artificial Sequence: Synthetic coding sequence
atgtctggacggagcgtgcctcacgctcaccctgcaacagccgagtatgaatttgcgaatccttcccgcctgggggaacagcgtttcggagaaggtttgcttcctgaggagatcctcacccccacgctgtatcatgggtactacgtgcggcctagggccgctcccgctggggaaggaagtcgcgccggcgcgtccgagttaagactgtcagaggggaagttccaggctttcctggacgtctctcattttacaccagacgaggtgacagtgaggacagtggataatctgctcgaagtgtctgcacggcacccccagcgtctggatcggcacggcttcgtgagccgcgaattctgccgtacatatgttctgccagcagacgtcgatccctggcgtgtccgggcagctctgagccacgatgggatcctcaatctcgaggcacctagaggtggcaggcacctggatacagaggtgaacgaggtatatatatccctcctgcccgccccacccgacccggaggaagaggaagaggcagccatagtggagccttag

SEQ ID NO: 30471 - DNA, 435 bp, Artificial Sequence
  Description of Artificial Sequence: Synthetic coding sequence
atgaggaaaatagacctgtgtttgtcttcagaggggagcgaagtcattctggccacttcctcagatgagaaacatcctcccgagaatatcattgacggcaatcccgagaccttttggaccacgacaggcatgtttccacaggaattcatcatttgctttcataagcatgtacgtattgagagactcgtcatccagtcttactttgtgcagactttgaaaatcgaaaagtctacctccaaggagccagttgattttgaacaatggatcgagaaagacctggtacacacagagggccaactccagaacgaggagatcgtggcacacgatggcagcgccacctacctgcggtttatcatcgtaagcgcttttgatcatttcgcatccgtccattccgtaagcgcagaaggcacggtagtgagcaatctttcctcctag

SEQ ID NO: 30472 - DNA, 225 bp, Artificial Sequence
  Description of Artificial Sequence: Synthetic coding sequence
atgaggaagattgacttgtgtctatcaagcgaaggttctgaagtaatcctggcaacctcctccgatgaaaagcacccacccgaaaacattattgacgggaaccccgaaacgttctggacaactacaggtatgtttccacaagagttcataatatgcttccacaagcatgtgcgcattgaacgcttagtgattcagtcttattttgggaagcagatcctgcattag

SEQ ID NO: 30473 - DNA, 339 bp, Artificial Sequence
  Description of Artificial Sequence: Synthetic coding sequence
atgaggaagatcgacctgtgcctgtcctccgagggaagcgaggttatcctggcaacttcaagcgacgagaaacatccccccgagaatatcatagacggcaaccctgagaccttctggactactacaggcatgtttccacaggagttcatcatctgcttccataagcacgtgcggattgaaaggctcgtcatacagagctattttgtgcagactcttaaaatcgaaaaaagcacgtcaaaagaaccagtcgacttcgagcagtggatcgagaaagatttggtccatactgaggggcagctccaaaatgaagagatcgtggtttccgagtataccctctag

SEQ ID NO: 30474 - DNA, 435 bp, Artificial Sequence
  Description of Artificial Sequence: Synthetic coding sequence
atgcgcaaaatcgatctgtgtctgtcctcggagggctccgaggtgatattggctacgtcaagcgacgaaaagcacccccccgaaaatatcatagatggcaatcctgagaccttctggaccaccaccggaatgtttccccaagaattcatcatctgtttccataagcacgtgaggatcgaaaggcttgtgattcaatcatatttcgtccagacccttaagattgagaagagcacaagcaaggagccagtggattttgaacaatggatagagaaagatttagtgcatactgagggtcagctgcaaaacgaagagatcgttgctcatgacggatcagccacctacctgcgttttattatcgtgtctgcattcgatcattttgcttctgtgcatagtgtctcagcagaaggaaccgtggtgtctaatctctcctcatag

SEQ ID NO: 30475 - DNA, 417 bp, Artificial Sequence
  Description of Artificial Sequence: Synthetic coding sequence
atgggtgtgtccaaccaggggtgttcacggaatgcccgccaccagaaagcacgctcaatgccactgcaggaccagcatcttgcactcgccatcctcttagaattagccgtacaacgagggacactcagtcaaatgctcagcgccattctgctgctcttacagctgtgggatagtcgtgcacaggaaacggataatgaacgctctgcccagggaaccagtacactgctgctcagtctcttgcagactttccaaagtataatttgtggaaaggacacaccgcctagcgagggaaacatgcacctattatccgggcctttatcaccaagcgagagcttcttgcggtatctaactctgcacaagaccacgtccttacctttgatttgtaacaagcgccagcttctatcttggccaatctag

SEQ ID NO: 30476 - DNA, 7839 bp, Artificial Sequence
  Description of Artificial Sequence: Synthetic coding sequence
atggccgacgtggatcccgatacgcttctcgagtggctccagatgggtcagggagatgagcgggatatgcaacttatcgccctggaacaactctgtatgctcctcctcatgtccgacaacgtggacaggtgctttgagacctgcccaccccggactttcctgccagcactgtgtaaaattttcctcgatgaatcagcccctgacaatgttttggaagttactgccagggccataacatactacctggacgtgtctgctgagtgtacgcgccgtatcgtcggggtggacggggccatcaaggctctttgcaataggcttgtcgtggtggagcttaacaatcggaccagccgggatctggccgagcaatgcgtcaaagtactggaattaatttgcactagagagtcaggcgcagtcttcgaagccggtggcctgaactgcgttctgacctttatccgtgactcgggccaccttgtgcataaggacaccttgcattctgccatggcagtcgtgagtcgcctgtgcggtaaaatggaacctcaggacagttcgctggaaatatgcgtggagtcactgtcctccctgcttaagcatgaggatcaccaagtgagcgacggagccctcaggtgctttgcctcattggctgatcgcttcactcgcaggggtgtggaccctgctcctctcgccaagcacggcctaaccgaggagctgctgtctagaatggcagcggctggcggaacggtgagcggcccttcaagcgcttgtaaacccggtaggtccacgactggcgccccgtcgacaacagctgatagcaagttgtctaaccaggtgtccaccatcgtgagcttgctcagcacactgtgtcgcggcagtcccgtggtgacacacgacttgctgcggtctgagctgcctgactcgatcgagtcagcgcttcaaggagacgagagatgcgtgctggatactatgcggcttgtcgatctacttcttgtgctactgttcgagggcaggaaagccctacccaagtctagtgcaggcagcactggcagaattcccggcctgcgccgtctggattcttccggcgagcggtcccacaggcagctgatcgattgtatccgttccaaggacaccgacgcccttattgacgcaattgatactggggcttttgaagtcaactttatggatgatgtcggccagactctgctgaattgggccagcgctttcggaacacaggagatggttgaatttctgtgcgagcggggcgccgatgtgaaccggggacagcgcagctcttcactccattacgctgcctgcttcggccggccccaagttgccaaaacgcttttaagacatggcgccaatccagatctccgagacgaggacgggaagacgcccctcgacaaagctagagaacgcggtcactccgaggtcgtggccattcttcagtcccctggcgactggatgtgtccagttaataaaggagatgataagaagaaaaaggatacaaacaaggatgaggaagagtgtaacgagccaaaaggagatcctgagatggctccaatttacctgaagaggttgttgccagtcttcgcccagacatttcaacagacaatgctgccgtcgatcagaaaggcgtctctggcacttatccggaaaatgatacatttttgcagcgaggcactcctaaaagaagtatgtgattctgatgtcgggcacaatctgccaacgatcctggtggagattaccgctaccgtgctagaccaggaggacgacgacgacggacacctcttggccttgcaaattattagggatctggtggacaaaggcggtgacatattccttgatcaactcgcacgcctgggagtgatctccaaggtctcaactttagccggccccagctccgatgatgaaaatgaggaggagagtaaacccgagaaggaggatgagccacaggaagacgccaaggaactgcagcagggcaaaccataccattggcgggactggagtatcataagaggtcgcgactgtctatacatctggtcagacgccgccgcccttgagctctctaacggttccaacgggtggtttaggttcattctcgatgggaagctggcgactatgtattcctccgggtccccagaaggcggaagcgactcgtcggaatcacgatctgaattcctcgaaaagcttcagcgggccagaggacaagttaagccatctacctcatcccagcctatcctgtcagccccaggccctaccaaactaacagtgggcaattggagtttgacatgcctgaaggagggggaaatcgctattcacaattctgatggtcagcaggccactatactgaaggaggatttaccaggattcgtctttgaatctaaccggggaaccaaacacagttttacagccgaaaccagcctcgggtcagagttcgtgaccggttggaccggtaagagggggaggaagctcaaaagcaagttggagaagacgaaacagaaggtccgaacaatggctcgcgatctttacgatgaccacttcaaggccgtggagtctatgccccgaggggtggtggttacactcagaaacattgccactcaacttgagagctcctgggaattacatacaaaccgccagtgtatagagagcgaaaacacatggcgggacctgatgaaaactgccctggagaacttgatcgtgttgttaaaggacgagaacacaattagcccctatgagatgtgctcatctggactggtgcaagcactcctcactgtgctcaacaacgtctctctgtccagctctaaagagcagaagtattcattcaccccatcagtggaaatcaacgtctttaagacggcattttccgagaatgaggacgatgaatccagacctgctgtggctttgattcgcaagctaattgctgtgctcgaatccatagagcgccttcctcttcacctgtacgacacccctggtagcacatataacctgcaaatcctgaccaggcgccttagattcaggcttgaacgcgcacctggcgagaccgcccttattgataggaccggaagaatgctgaaaatggagccccttgctactgtggagtccttggagcagtatttacttaagatggtggctaagcaatggtacgacttcgataggagctctttcgtgtttgttcggaagttacgcgaaggtcagaatttcattttccgccatcagcatgacttcgatgagaacggaataatctactggattggaaccaacgctaaaacagcctatgaatgggtaaaccctgccgcgtacggactggtcgttgtcacatcaagcgagggtcggaacttgccatacggccgactggaagatatcttgtccagggacaacagcgccctgaactgtcatagcaacgacgataaaaacgcatggtttgccatcgatctgggcttatgggttatcccatccgcttacacactgaggcacgcaagaggatacggccgatccgctctacgcaactgggtttttcaagtcagtaaggatggccaaaattggactagcctttacacacacgtagacgactgtagcttgaacgagccaggaagcactgcaacctggcctctggatccaccaaaagatgagaagcaaggctggagacatgtccggatcaaacagatgggtaaaaacgcaagtgggcagacacactatctttccctgagcggctttgaattgtatggaaccgtgaacggggtgtgcgaggaccagctggggaaggccgcaaaagaggccgaagctaatctgaggcggcaaagaaggctggttagaagtcaagtgctcaaatacatggttcccggagcccgagttatcagagggttggactggaaatggcgggaccaggacggtagcccccagggagagggaaccgtgactggagagctccacaatggatggatagacgtgacatgggacgcaggtggatccaatagctacaggatgggcgccgagggcaaatttgatttaaagctagcaccaggttacgatccagacacagtggcctcgccaaagccagtgagctcaaccgtgtctgggacaacgcagagctggagttctctggtgaaaaacaattgtcctgataagacgagcgcagccgcaggttcatcttcccgtaaaggaagtagctccagcgtgtgcagcgtcgccagcagcagtgacatctcattaggatcaaccaagaccgagagacggtccgagatcgtgatggaacactccattgtgagcggagctgatgtgcatgaacctatcgttgtactgagttctgctgaaaacgtgccgcagaccgaggtcggctcgagtagtagcgctagtacgagcaccttaactgccgaaacaggctctgagaacgccgagagaaagctcggtcctgattctagtgttcggacgcccggtgaaagctccgcgatttcaatggggattgtgtctgtgtccagtcctgacgtgtccagcgtttcagaactcacgaacaaagaggccgcctcacaacgccccctgagctcctctgcatcgaacaggctctctgtttcaagcctcctggcggcaggggcacctatgagttcaagcgcaagtgtgccgaacctgtcctctcgcgagacgagcagtctggagagtttcgtgagaagggttgcaaatatcgcccgcaccaacgccaccaacaacatgaacctctctaggagctcgtctgacaacaacactaacaccctgggtcggaacgtaatgagtactgccaccagtcccttgatgggggctcagagttttcctaacctcacaacccccggaacgaccagcactgtgactatgtccacctcctctgtgacgagctctagcaatgtggccactgccacgaccgtgttgtctgtcggacagagcctcagcaacacccttaccacaagcttgacctctacaagctctgaatccgacactgggcaagaggccgagtattccttgtacgacttcctggactcttgtcgggcctcgacattgctggctgagctcgatgatgatgaggatcttccggagccagacgaagaggacgacgaaaatgaggacgataatcaggaagaccaggaatatgaggaggtgatgatccttcggaggcctagtttgcagcgccgggccggttcaaggtctgatgtgacacaccatgctgtaacatcgcagctgccgcaggttccagctggggccgggtcacggcccattggagagcaggaagaggaggagtatgagactaaaggtggaagacggaggacctgggacgatgattatgtgctgaagcgacagtttagcgcgctggtgcccgcgtttgatcctcggcccggacggacaaacgtccagcaaacaaccgacttggagatcccacctccggggaccccccacagcgaattacttgaggaagtggagtgcacaccttcacccaggctcgccctcacacttaaggtcaccggccttggtaccacacgagaggtggagctgcctctcaccaacttcaggagcacaattttctactacgtgcaaaaacttctccagctgtcttgtaacgggaatgtaaaaagcgataagctgaggcgcatctgggagccaacatataccattatgtatagagagatgaaggattccgacaaggagaaagaaaacggcaagatggggtgttggtctattgaacacgttgagcagtacctgggcacagatgagttacctaaaaatgatctgattacatatctacagaaaaacgccgatgccgcctttctgagacattggaagctgacgggaacgaacaagagcattaggaaaaaccgcaattgctctcaattgatcgcagcctataaggacttctgcgagcacggaacaaagtctggattgaatcaaggtgccatttctaccctgcagagtagtgacattctgaacctcaccaaagagcaaccacaagctaaggccgggaatgggcagaactcttgtggggtggaggacgtgctacagctgctgcgcattctctacatcgtagccagcgacccatactcccgaattagtcaggaagatggggacgagcagctgcagtttaccttcccaccagatgagttcaccagtaaaaagataaccactaaaatccttcagcagattgaagagcctttggccttggcaagcggagcgctgcccgattggtgtgagcagctgacatctaagtgtccattcctcattccttttgagactcgacagctctactttacgtgcactgcctttggggcctctcgcgccatagtgtggttgcagaaccgccgagaggctaccgttgaacgtaccagaacaacaagttccgtgagacgcgacgaccccggtgaatttagagtaggcaggttaaagcacgaaagggttaaagtcccccggggagagtccctgatggagtgggccgagaacgtcatgcagattcacgccgataggaaatcagtgttagaggtagaatttttgggagaagagggcacagggctggggcctactctcgaattctacgctctagtcgcagctgagtttcagcggacggacttaggtgcctggctttgcgatgacaacttcccagacgacgaaagcaggcacgtggatttaggaggtggtcttaagcccccgggctattatgtacagcgatcttgcggactctttacagccccgtttcctcaggacagcgacgagcttgaaaggataacaaaactcttccactttctaggaatttttctcgccaaatgtatccaggataaccgtctggtcgaccttcctatttccaaacctttttttaaattgatgtgcatgggagacatcaaatctaacatgtcgaagctgatctatgaatcccgcggagaccgggatctacactgtactgagagccagagcgaagcctctacagaggaagggcacgattccctgtccgtgggatccttcgaggaagattcgaagtcagagttcattctcgatccccctaaaccgaaaccgccggcttggttcaacggcatcctgacgtgggaggactttgagcttgtgaacccccacagggctcgctttctgaaggagatcaaggatctggccataaaacggcgacagatactgtccaacaagggcttaagcgaggacgagaagaataccaaactccaggaactggttttaaaaaacccgagtggctcaggtcctccgctgagtatcgaggacttgggattgaactttcagttttgcccatcctcccgaatatatggatttaccgcggtggacttgaaacctagcggcgaggacgagatgattacaatggacaacgcggaggaatacgtcgaccttatgtttgacttctgtatgcacactggcatccagaaacagatggaggcctttcgcgacggcttcaacaaagtatttccgatggagaaactctcctcgttctctcacgaagaggtccagatgatcctgtgcgggaatcagagcccctcatgggccgcggaggacatcataaattacacagaaccgaagctcggctatacacgggatagtcctgggttcctgcgttttgttagagtcctctgcggtatgtccagcgacgagaggaaggcattcctgcaattcactactggatgtagcactttgccgccggggggactcgcaaaccttcacccccgcttgaccgttgtgagaaaagtggacgcgacagatgcttcctatccaagcgtaaatacttgtgtacactatttgaagctccccgagtatagctctgaggagatcatgagggagagactgctcgctgccaccatggaaaaaggattccatctgaactag

SEQ ID NO: 30477 - DNA, 516 bp, Artificial Sequence
  Description of Artificial Sequence: Synthetic coding sequence
aaagtttttttaaaagccgtagctggaaactatcacatattccggcatacaggaatccagaaacagatggaggcctttagagacgggtttaacaaagtgttcccaatggaaaaactgtcctctttctcgcacgaggaggtgcagatgatcttatgcggcaaccagtctccctcatgggctgccgaagacatcataaattataccgaacccaagctgggatacacaagagacagcccgggctttttgcgttttgtaagagtcctgtgcggcatgtcctctgacgaaaggaaagctttcttgcagttcaccactggttgctctactttaccccctggaggccttgcaaatctccatcctcggctgaccgtggtcaggaaggtcgacgcgacggatgcctcctatccctccgtgaacacatgtgtgcattatcttaaacttcccgagtactccagtgaagagattatgcgcgaacggttgctcgctgcaacaatggaaaaagggtttcacctgaactag

SEQ ID NO: 30478 - DNA, 7833 bp, Artificial Sequence
  Description of Artificial Sequence: Synthetic coding sequence
atggcggacgtggacccggacactttgctggagtggctgcagatgggccagggggacgaacgcgatatgcaactcattgccctggaacaactgtgcatgctgctgttaatgagtgacaatgtagaccggtgctttgaaacatgtcctcctcggacctttcttcccgcattatgcaagatattcttggatgaatccgcccctgacaatgtactggaagtgaccgcgagggcaattacctactatctggacgtgtcggctgagtgcactcgacggattgtgggggttgacggggccataaaggctctgtgcaacaggctggtggttgtggagttgaacaatcgcacatctagggatcttgccgagcagtgtgttaaggtcctggaattgatatgcacccgggagtcgggggctgtgtttgaagccggagggttgaattgtgtccttacgttcatccgggatagcggtcacctggtgcacaaagataccttacatagcgcgatggccgtggtgagtcgattgtgcggtaagatggagcctcaagacagcagcctcgaaatttgcgtggagtccctctccagtctccttaagcacgaggaccaccaggtctccgacggtgctctgagatgcttcgcgtcactcgctgatcggtttacccggaggggcgttgaccctgcccccctcgccaaacatggcctgaccgaagagctgttgagccgcatggccgccgctggagggaccgtgagcggtcccagttctgcctgtaaacctgggagaagtaccacaggggccccatcgaccacagccgatagtaaactgagcaaccaggtatcaacaattgttagtcttctgagcacattatgcagaggaagtccagttgtcactcacgatctgctgcggtcggagctgcctgactctatcgagtccgcactccagggagacgagcgttgcgttctggacaccatgcgcctcgttgaccttctgctcgtgctcttgttcgaagggcgtaaagccttgccgaagtcctctgcagggagtaccggtaggatcccaggcctgcgccgtctggactcgtccggtgagagaagccataggcagctcattgactgtatccgaagtaaagatacagacgcactgattgatgccatcgatacgggcgccttcgaagtaaattttatggacgacgttgggcagaccctcctcaattgggcatctgcttttggaacccaggaaatggtggaattcctttgcgaacggggagccgacgtgaacagaggacagcgcagcagctccttgcactacgcagcctgctttggtagacctcaggtagctaaaaccctcctccgacacggtgccaatcctgatctccgcgacgaggacgggaagacccccctggataaggcaagggaaagaggacatagtgaggttgtggcaatcctgcagtcaccaggtgattggatgtgtccggtaaataagggtgacgacaagaagaaaaaagatacgaataaagacgaagaggaatgcaacgagccgaagggagacccggagatggcccccatttacttgaagagattgctgcctgtgttcgcacagacctttcagcaaacaatgctcccatcaatccggaaagcgagcctagcgctcatacgaaaaatgatccacttttgcagcgaggccctattgaaggaagtgtgcgacagcgatgtgggccataacctccctactatcctggtggagattacggccactgtgctggatcaggaggacgatgacgacggtcatctgctggccttgcagatcatccgcgatttagtggacaagggcggggatatattcctggatcagttagctcgactgggcgtcataagcaaagttagtactttggcagggccgtccagtgacgatgaaaatgaagaggagtccaagccagagaaagaagacgaacctcaagaggacgcaaaggaactgcaacagggtaagccctatcactggagggattggagcatcatcagaggcagggattgtctgtatatctggtccgatgccgctgccctcgagttgtcgaatggctcaaacggctggtttagattcattctggatggaaagctcgcaaccatgtactccagcggttcaccggagggcgggtccgattcttctgaaagcagatctgagttcctggagaagctgcagcgagctcgtgggcaggtgaaaccgtctacatccagccagcccatactcagtgcccctgggcctacaaaattaactgtgggaaactggtctcttacttgtctcaaggaaggcgaaatcgcaattcacaatagcgatggccagcaagccacaatcctgaaagaagacctccctggctttgtttttgagtccaatcgggggacaaagcactcttttaccgcagagaccagtctggggtccgaattcgtgaccggctggaccggcaagagaggacggaaactaaagtctaaactagaaaagaccaaacagaaagtcaggaccatggctcgggatttgtacgacgatcatttcaaggccgtcgagtccatgccccgcggggtggtggtcactctgagaaatatcgcgacccagctcgaaagttcttgggagctccatactaatagacagtgcatcgagtcagaaaacacatggagggatctgatgaaaaccgccctggagaacctgattgtactgctgaaggacgagaataccatctcaccatacgagatgtgttcttcagggctggtgcaggctctactgaccgtgctgaataactcgatggacctagacatgaagcaggactgctcacagctcgtagagcggatcaacgtcttcaagaccgctttctcagaaaacgaggacgatgaatcccggcccgccgttgctttgatcagaaagttaatcgctgtgcttgaatccattgagcgtctcccacttcatctttacgacactcctggctccacttataacctccagatcttgacacggcgcttacgatttcgcctggaacgggcccctggtgagacagcactgatcgacagaaccggcagaatgctgaagatggagccactcgccactgtcgagtctctggagcagtacttgcttaagatggtggctaagcagtggtacgacttcgatcgcagttccttcgtttttgtgcggaaactgagagagggccagaactttatatttcggcatcagcacgacttcgacgaaaacggaatcatttactggatcggcacgaacgcaaaaaccgcctatgagtgggtcaaccctgctgcctatggactagtagtggtcactagttccgaaggaaggaatctgccctacggaaggttggaggacatcctatcaagggataacagcgccctcaactgccactcaaacgatgacaaaaacgcctggttcgctattgatctcgggctgtgggttatacccagtgcatacacacttcgccacgcgcgggggtatggaagatccgcgctccggaattgggtgttccaggtctccaaagacggacagaattggacctccttgtacacacacgtggatgactgctctttaaatgagccaggctccacagccacttggcctttggatccccccaaggatgaaaaacaggggtggcggcatgtgaggattaaacagatgggaaaaaatgcctccggccaaacccattatctctctctttcaggattcgagctgtatgggaccgtgaatggtgtgtgcgaggatcaactagggaaggcagccaaggaagctgaggcgaacctcagaaggcagcgtaggctcgtcagatcacaagtcttgaaatatatggtccccggggccagagtcatacgaggattggactggaagtggcgggaccaggatgggtctcctcaaggagaggggacagtcacaggagaacttcacaacggatggatcgatgtgacctgggacgcgggcggcagtaactcatacagaatgggtgcggaagggaaattcgacctcaaactcgcacccgggtacgatcctgatactgtggctagtcctaagcctgtgagttcaaccgtgagtgggaccacacagtcttggtcctctctggtgaaaaacaattgccccgacaagacttcagccgcagccggctccagctccaggaagggaagtagttcaagcgtttgctcagtggcgtccagctccgacatctccctcggcagtaccaaaactgagcgacgaagcgagatcgttatggagcactctatcgtgtccggtgctgatgttcacgagcctatagtggtgcttagtagtgcagagaacgtcccacagacagaggttggctcatcctccagtgccagcacctccactctcaccgctgagacggggtcagagaacgccgaacggaagcttggtcccgatagcagcgtgcgtacccctggggaaagctcagccatctccatgggcatcgtatcagtcagctcacctgacgtgtcttcagtgagtgaactcaccaacaaagaggccgctagtcaacgcccactgagtagctccgccagtaacagactaagtgtgtcaagcctgcttgcagccggagctccaatgagtagttcagcctcagtgcccaatctcagtagtagagaaacgagttcgctggaatcttttgtgcgcagagtggctaacatcgcccggacgaacgcgactaacaacatgaatctcagccggtcttcaagtgacaacaatacaaacaccctgggcagaaatgtgatgtctaccgccacttcccccttgatgggggctcagtcatttcccaacctcaccacgcctggtacaacttcaacagtgacaatgtcgacttcttctgtgactagtagcagcaacgtggccaccgccactaccgtgttaagcgtcgggcagtccctcagtaatacactgacaacctccttaacctctacgagcagcgaatccgacaccggccaagaagcagagtacagtctctatgatttcttggatagctgtagagcatcaacactcctcgccgaactcgacgacgacgaggacttgccagagcctgatgaggaggatgatgagaacgaggacgacaatcaggaagatcaggaatatgaggaggtcatgatcctcaggcggcccagtcttcaacgccgggctggatcacgcagtgacgtgacccaccacgccgtgaccagtcagctaccacaggtacccgctggggccggctctcggccaattggcgaacaggaagaagaagaatacgaaacaaagggaggccgtcgacgaacctgggatgacgactatgttctgaagcgtcagttcagcgccctggttccagcgtttgaccccagacccggccggacgaacgtgcagcagacgaccgacctggagatacctcccccaggtacaccacactcagagctgcttgaagaagtggagtgtactccaagcccacgtctggccttaactctcaaagtcaccgggctgggaaccaccagggaagtggaactgccgttgaccaactttcggtctacaatcttttactacgtgcagaaattactgcagctgtcgtgcaatggcaacgtgaagagcgacaagctccggcgcatttgggaacccacctacactatcatgtatagggagatgaaggattcggacaaagagaaggaaaatggaaaaatggggtgctggtccatcgaacacgtcgagcaatatctggggacagacgagctgcccaaaaatgatctgattacgtaccttcagaaaaatgctgacgccgccttcctgcgccattggaagcttacgggaacgaacaagtctatcagaaagaatagaaactgctcccagctcatcgccgcatacaaagacttctgtgaacatggtaccaaaagcggcctgaaccagggcgctatcagtacactgcagtccagtgatattctcaacctgaccaaagaacagcctcaggcaaaagcaggaaacggccagaactcctgtggcgtagaggacgtcctgcaacttctgcggatcctgtatatagttgcaagcgatccttactcacggatctcacaagaggacggggatgagcagttacagtttacctttcctcccgatgagttcacatccaaaaagatcaccaccaaaatcctccagcagatagaggagcctctcgcactggcgtcaggcgcgctccctgactggtgcgagcagttgactagcaagtgcccatttcttatcccgttcgagacgcggcagctgtattttacatgcacagcatttggagcctcaagggcaattgtgtggctccaaaatcgtagagaagctacagtggagcggacacgcactacgtcatcagttcggcgcgatgatccgggagagttccgggtgggaaggctcaagcacgagcgggttaaagtcccgaggggagagtccctgatggagtgggccgagaatgtgatgcagattcacgcagatcggaaatcagtcctggaggtggagttccttggcgaagaggggacaggtttgggacctacactcgaattctacgccctggttgcagcagagtttcaacgtacagatcttggagcttggctttgcgacgataactttcctgacgacgaatctcgtcatgtggatctcggggggggcctaaagccgcccggatactatgtacagcgatcttgcggactgtttacagcgccttttcctcaagacagcgatgagctggagaggattactaaactgtttcatttcctcggcatttttctggcaaaatgtatccaagacaatcgtctggtggacctcccgatctctaagcctttcttcaagctgatgtgcatgggggatatcaaaagtaacatgagcaaactgatttacgagtccagaggcgatagagatttacattgtacagaaagtcaatccgaagcatcaactgaagagggtcacgatagcctgagcgtgggaagcttcgaagaggacagcaaaagcgagttcattctagaccctcccaaaccgaaacccccagcttggttcaacggcattctgacatgggaggacttcgaactggtgaatccacaccgagctagattcctaaaggagatcaaagacctggcgatcaaacgccggcaaattctgagtaacaaaggcttatccgaagacgagaaaaataccaagctgcaagaactcgtgctgaaaaacccttctggttctggcccaccgctgagcatagaggacttggggctgaattttcagttctgtccaagctcgcggatctacggctttacagcagtggacctcaaaccctcaggcgaagacgagatgattactatggacaacgcggaagaatatgtcgacctgatgttcgatttttgcatgcacactggaattcagaagcaaatggaggctttccgcgatggcttcaataaggtttttcctatggaaaaactctctagcttcagccacgaggaggtccagatgatcctgtgcggcaaccagagccccagttgggctgcagaagacataattaactatactgaaccaaagttgggatacacccgggacagtccaggcttcctgaggtttgtccgggtcttatgtggtatgtcgagtgatgaacggaaggctttccttcaattcaccaccgggtgttctacactgccccccggaggcctggccaatcttcacccgaggcttacagttgtccggaaggtggatgcaaccgatgcgtcatatccttcagtgaatacatgtgtccattacctgaaattacccgagtatagctcagaggagatcatgcgggagagactcctagccgctacaatggaaaagggcttccacctgaactag

SEQ ID NO: 30479 - DNA, 7833 bp, Artificial Sequence
  Description of Artificial Sequence: Synthetic coding sequence
atggcagacgtggatcctgacaccctgctggagtggctccaaatgggccaaggcgatgagcgtgacatgcagctcatagccttggagcagttgtgcatgcttctcttaatgagtgacaacgtcgacagatgtttcgaaacgtgcccgccgaggacatttctccctgctttatgcaaaatcttcctcgacgagagcgctcctgacaacgtcctagaggtcaccgcacgggcgatcacatattacctggacgttagcgctgagtgtacgcggcgcatcgtgggtgtggacggggccatcaaggcgctctgcaatcggctggtcgttgttgaactgaacaatcggacatcccgggatctggccgagcagtgcgtaaaagtgctggagcttatctgcacccgggagtctggagccgtattcgaggctggtggccttaactgtgtcctgacctttataagagatagtggtcacctcgttcataaagacacgcttcatagtgccatggccgtcgtgtcccggttgtgcggtaagatggaacctcaggactcatcactggagatctgtgtggagagtctttcttcccttctaaagcacgaggatcatcaggtgtccgatggagccctgagatgcttcgcttctctggcagacagattcacacgccggggggttgatccagctcctcttgcaaagcacggcctgaccgaagaactgttgagcaggatggccgcagccgggggaaccgtatcgggaccctcctctgcttgtaagcccggccggtccactacaggggcgcccagtacgaccgcagactctaagttgtcaaaccaagttagtacaatcgtgtcactgctgagcacactctgcagagggagcccagtggtgacgcacgacctcttaagatccgagctccctgacagcatagagtctgcgctgcaaggggacgaacgctgtgtgctcgacacaatgagactcgtagatttgctgctggtgctgttgttcgagggcagaaaggccctacctaaatcgtctgcagggtcaacgggacggatcccaggactccgacggctagatagttctggagagagaagccatcggcaactaatcgactgtattcgctctaaagacaccgacgccttgatcgacgccatcgacaccggggcctttgaggtgaacttcatggacgatgtaggccagacattactgaactgggccagcgcattcggtacacaggagatggtcgagttcctatgcgagcggggagccgatgtcaatagaggacagagatccagctccctccattacgctgcctgtttcggccgaccccaggtggccaaaactctgctgcggcatggtgctaaccctgacttgcgtgatgaagacggaaaaacgcctctcgacaaagcccgggaacgcggccactcagaagtggtggccatacttcagtctcccggagattggatgtgtccagtgaataaaggggatgacaagaaaaagaaggataccaacaaagatgaggaagaatgtaacgaacccaaaggcgatcccgaaatggccccgatatatctgaaacggctgctgccggtgttcgctcagactttccaacagaccatgttgcctagcattagaaaggcctctttggcactcattcgcaagatgatccacttctgctctgaagccttactgaaagaagtttgtgactctgatgtcgggcacaacctgcctaccatcctcgttgaaataacagctactgtgctggatcaggaagacgacgacgatggtcacttgctcgctcttcagatcatccgtgatctcgtggacaagggtggagacatattcctagaccagctcgctcggctaggcgttatctctaaggtatcaaccctagccggtccttcatcagatgacgagaacgaggaagagtctaagcccgagaaggaggacgaaccacaggaagacgccaaagagctacagcaggggaagccctaccattggagagactggagtattattcgtggccgagactgtctttatatttggtccgatgcagctgcacttgagctgtccaatgggagcaacgggtggtttcgcttcatcttagacggtaagctggcaactatgtacagttcaggctctcccgaggggggttccgattcttccgagagccggtccgaattcctcgagaaactccagcgtgcgcgcggccaggtgaaaccctccacctcatcccagccaatactgagtgcgccaggcccaacaaaactgacagtgggaaattggagcctgacatgcctgaaagagggagagatagccattcataacagtgatggccagcaggccacaatattgaaagaggacctcccgggtttcgtgttcgagagtaatcgtggcacaaagcattcttttaccgccgagaccagcttgggatccgaattcgtgaccggctggactggaaaacgaggtagaaagctgaagtcaaagctcgagaagacaaaacagaaggtaaggacaatggcacgcgacctatatgacgaccactttaaggccgttgagagcatgcctcgcggggttgtcgttaccctgagaaacatcgctacacagctggagagtagctgggaactgcacacaaaccgccagtgtattgagtcagagaacacatggagggaccttatgaagacagctctcgagaatctaattgtgctcctgaaggacgaaaacacgatttcaccttacgagatgtgctcaagtgggctagttcaagctctgttgacggtgctgaacaactccatggacttggatatgaagcaagattgtagccaactggtagaaagaattaatgtttttaaaacagcattctcggagaacgaggacgacgaaagcaggcccgctgtggcactaattcggaagctgattgccgttctggagagtattgagcgcttgcccctgcacctgtacgacacaccaggttccacgtacaacctgcagattctgacccgccgactgcggttccggttggagcgcgctcctggcgagacagcccttatcgacaggactgggcgcatgctgaaaatggagccgctggccaccgtggagtccctggagcagtatcttctgaaaatggtcgccaagcaatggtatgactttgatcggagtagctttgtcttcgtacggaaattacgcgaaggccagaacttcatcttccgccaccagcatgacttcgatgaaaatggcattatctactggataggcacgaacgcaaaaacggcttatgaatgggttaatcccgcggcatatggactagtggtggtcacatcctcggaaggaagaaacctgccatacggacgcctcgaggacatcttatcaagggataactcagctctcaactgccacagcaacgatgacaagaatgcctggttcgcaatagatctaggactatgggtcataccgtccgcctacaccctgcggcatgcccgggggtacggcaggtctgcattgcggaactgggtctttcaagtgtccaaggacgggcagaactggacaagcctttatacacacgttgatgactgttcgctcaatgagcctggatctactgctacctggccattggatccgcctaaggacgagaagcagggttggcgtcacgtgcggataaaacaaatgggcaagaatgcctccgggcagacccattacctttctctttcaggtttcgaactgtatgggacagtgaatggagtgtgtgaagaccagctcggtaaagctgcaaaggaagcagaggcaaacctgagacgtcagcgccgcctcgtgcggtcccaagtactgaaatacatggtcccaggggcacgggtgatacgcggcctcgattggaagtggagggaccaggacgggtcaccacagggcgaggggactgtgacaggagaactgcacaatggatggattgacgtgacgtgggatgcaggcggctccaacagctacagaatgggtgccgagggtaagtttgacctgaaactagcccctggctatgatcctgataccgtggctagcccaaaacctgtctcaagtaccgtcagtggaacgacacaaagctggtcgtcccttgttaagaataactgtccagacaagacgtcagctgcagccggatcatcctctaggaagggaagttcctcatccgtctgctcagtcgcttcttccagtgatatatccctgggctccaccaaaaccgaaagacgttccgagatagttatggagcatagtattgtctctggcgccgatgttcacgagccaatcgtggtactttcctctgcagagaatgtgcctcagacagaggtgggcagttcatcttctgcctccaccagcactctgactgctgagactggaagtgagaacgccgagcgtaagctcggccccgactcatccgtgcgcacgccaggcgagtcctctgctatctcgatgggtattgttagcgtgtcttcaccggatgtgagtagcgtgtcggagctaactaacaaagaagccgctagtcagcggcctctttcttcctctgcctccaaccggctgtccgttagttctctcctggcggctggggccccaatgtcatcgtctgcctccgtccccaatctgtccagtcgcgagaccagtagtctggagagctttgtcagacgggtcgctaatatcgcccggacaaacgctaccaataacatgaatctgtctagaagttcatccgataacaatactaacaccctggggcgcaatgtcatgtcaacagccacatctccattgatgggtgcccagagctttcccaacctgacgactccaggcacgacttcaaccgtgacgatgtccacaagctctgtgacctctagttcaaatgttgcaacagcaacaacagttttatctgtcggacagtcactgtcaaataccttgaccacaagcttgacctccactagttctgaaagcgataccggacaggaggccgaatacagcctttatgatttcctcgattcgtgtcgcgcttcgacactgttggcggagctggatgacgacgaagatctcccagagcctgacgaagaggacgacgagaacgaggacgataaccaggaggaccaggaatacgaggaggtcatgattctacgccgcccatcactgcaaaggagggcgggttcaagaagcgacgttactcatcacgctgtcacctctcagttaccccaggtgcccgcaggggcgggatcgagacccataggggagcaggaggaggaggaatacgagacaaaggggggtcgaagaaggacttgggatgacgactatgtattgaaaaggcagttctccgctctggtgcccgccttcgacccgcgccccggaagaaccaatgtacagcagaccaccgatctggaaattccacccccaggaacgccccactccgaactgctggaggaggtggagtgcactccttcaccaaggctcgccctgacattgaaggtcaccggcctaggcactactagggaggtcgaacttcccctgacaaactttaggtcaacaatattctattatgtacagaagctgctgcagcttagctgcaacggtaacgtgaaatcagataaattacggcggatctgggagcccacttacacaatcatgtaccgggagatgaaggattcagataaggagaaggaaaatggtaaaatgggctgctggagtattgaacacgtggagcagtatctgggaactgacgagctgcctaagaatgatttgatcacgtacctacagaaaaacgccgacgcagctttcctcaggcactggaaactgactgggacgaataagtccatccggaagaacaggaactgcagtcaattgatcgccgcctacaaggacttttgtgaacacggaaccaagagtggactgaaccaaggagccatctctacactccagagtagcgatattctcaatctcaccaaggaacagccccaggccaaagccggcaatggacagaattcctgtggagtagaggatgtgctccagctgcttagaatcctgtacattgtggcctccgacccgtatagccgtatttcacaggaggacggggatgagcaactgcaatttacatttccgcctgatgaattcacctccaagaagattaccactaagatattacaacagatcgaggagcctctggctctggccagcggggccctgccagattggtgcgaacagttaacctcaaaatgtccctttctcataccatttgagacccgccaactgtatttcacctgcaccgcgtttggggcatctagggccattgtgtggctgcagaaccgccgcgaagccaccgtggaaaggacccgaactaccagctccgtaagaagagatgatcccggcgagtttcgggtgggtaggctgaaacacgagcgggtgaaggtgcctcgcggtgagtctttgatggaatgggccgagaacgtcatgcagatccacgccgaccgcaaatccgtgctggaggtggagtttctaggcgaagagggaaccggcctcggccccaccctggagttctacgccctggttgccgccgagttccagcgaacagacctgggggcatggctgtgtgacgataactttcccgatgacgagtcccgccacgttgatctaggagggggtctgaagccccctgggtattatgtacagagaagttgcgggctgtttactgctccttttccccaagactctgacgagttagaaagaatcactaaactgttccatttcctgggaatcttcctcgctaaatgcatccaggataataggctggtggacctgcccatctctaagcccttcttcaaactgatgtgcatgggcgatatcaaaagcaatatgtccaagctgatctacgagtcccggggggatagagacctacactgtacagaaagccaaagtgaggcctccacagaggagggacatgactctctttccgttggttccttcgaggaggactcaaagagcgagtttatactggaccctcctaaaccgaaaccacctgcctggttcaacggcatcttaacatgggaagactttgagctggtgaatccccatagggcccgtttccttaaagagatcaaagatctcgccattaagcgccgccaaatcctcagcaacaagggactctcagaggacgagaagaacactaagctgcaggaactcgtattgaagaacccatccggctcaggccccccgctgtcaatcgaggacctaggccttaacttccagttctgtccttcttctcgcatttatggcttcactgcagtggatcttaaacctagtggagaagacgaaatgattacaatggacaatgcggaggagtacgtggatctcatgttcgacttctgcatgcacactgggatccaaaagcaaatggaagcgttccgagacggctttaataaagtgtttcccatggaaaagttaagcagcttttcccatgaggaggtgcaaatgattctgtgcggcaaccaaagtcccagttgggcggccgaggacatcatcaactatacagagccaaagctggggtacacccgagacagccccgggttccttcggttcgtgcgcgtgctgtgcggcatgagtagcgacgagcgtaaggcctttctccagtttacgacaggatgctcaacacttcctcccggcggtctggctaatctccatccccggctgactgttgttaggaaagtcgacgccaccgacgcttcatatccgtccgttaacacgtgtgtgcactatctgaaactccccgaatacagttccgaggagattatgagggaacgattgctggccgctactatggagaaaggcttccaccttaactag

SEQ ID NO: 30480 - DNA, 2781 bp, Artificial Sequence
  Description of Artificial Sequence: Synthetic coding sequence
atggccgatgtagaccctgacaccctgttagaatggctgcagatgggacagggtgacgagcgggacatgcagctaatagcgcttgagcagctgtgcatgctgttattgatgagcgataatgtggataggtgcttcgaaacctgtccacctcgcacattcctgccagctttgtgtaagatttttctagatgagagtgcaccagataatgtcctggaagtgactgccagggctatcacctactacctcgacgtgtcggccgagtgcacccggcggatcgttggtgtggacggggccattaaagcgctctgcaaccgcctggttgtcgtcgagctgaacaatcgcacgagccgagatctcgcggagcagtgcgtgaaagtattagagctgatttgtactcgggaatctggagccgtgtttgaagcaggtggacttaactgtgtcctgacatttatccgcgactccggccatctggtccacaaggataccttgcatagcgccatggctgtggtgtcccgtctgtgtggcaagatggaacctcaagattcctcccttgagatctgtgttgagtctttgtcctctctcctcaagcacgaggaccatcaagtctccgacggcgcactgcgctgttttgctagtctagctgaccgctttacacgcagaggcgtagatcccgctcccctcgctaaacacggactgactgaagaactgctgagccgcatggcagctgctggtgggaccgtctcagggcccagtagcgcgtgcaagcccggtaggtctaccacaggcgcccctagcaccaccgctgattcaaaactgagcaatcaagtcagcactattgttagcttgctgtcaacgctgtgcaggggaagtccagtcgtgacccacgacctgctgcgtagcgagctgccggactcgatagaaagtgcactccagggcgatgaacgctgtgtcctggataccatgagactggtggacttgctgcttgtcctccttttcgaaggccgtaaggcactgcccaaatcctccgctgggagcaccgggaggatcccagggctccgccgcctggatagtagcggcgagcgctcccacaggcagctgattgattgtatacgttcaaaggacacagatgctttgatagatgccattgacaccggggcttttgaagttaattttatggatgacgtaggtcaaaccctactgaattgggcctcagcctttggtacgcaggagatggtggaatttctctgtgaacgtggcgctgatgtcaatcgtggacagagaagttcatccctacattacgcagcgtgcttcgggaggcctcaggtggctaagaccctcctgcgtcacggcgccaaccccgacctcagagacgaagatggaaagaccccactcgataaggccagagagagagggcattctgaagttgtggccatactgcagagcccaggggactggatgtgccctgtgaataagggggatgataagaagaaaaaggacaccaataaagacgaggaggagtgtaatgagccgaagggggaccctgaaatggctccgatttacctgaaaagactgctacctgtgttcgcccagactttccaacagaccatgctgccatccatacgcaaagcgagcctggccctcatccggaagatgattcatttctgttccgaggccctgttgaaagaggtgtgtgattcagacgttggccacaacttgcccaccattcttgtggaaattacagcaaccgtgctcgatcaggaagatgacgacgatgggcatttacttgctctgcagataattcgagacctggttgataagggtggcgacatcttcctggatcaactggccagactgggcgtcataagcaaggtctctactctagccggaccgtcgagcgatgacgagaacgaggaggaaagcaaaccggagaaggaggatgagcctcaggaagacgctaaagaactgcagcagggaaaaccttatcactggagagactggtccataatcagggggagggattgcttgtacatctggtctgatgccgccgccttggagctcagcaatggctccaacggctggtttcgctttatcctggatggaaagctggcaacaatgtactcttcaggttcgcctgaaggggggagtgattcatccgagagtcgctccgagtttcttgaaaaactccaaagggctcgagggcaagtgaaaccatccacctcatcccagccaattctctcggctcccgggccaacaaagctgaccgtgggtaactggtcactcacttgcctgaaagagggagaaattgctatccacaacagcgatggacagcaggccacaatattgaaggaggatttgccaggtttcgtattcgagagtaaccgtgggacaaagcattcatttacagctgagaccagtctgggctccgaattcgttacgggatggacaggaaaacggggccgcaaactgaaatcaaagctggagaagacaaaacagaaagtgcgaacgatggcaagagatttgtatgacgaccatttcaaagccgtcgaaagcatgccccgtggggtcgtggtcacactcaggaatatcgcaactcagctcgagagtagctgggaacttcacaccaaccgccagtgcatcgagagtgagaacacctggcgcgacctgatgaagaccgcactggagaacttaattgtgctcctaaaggacgaaaatacaatctccccatacgagatgtgttccagcggattggtgcaggctctgctgactgttcttaacaactag

SEQ ID NO: 30481 - DNA, 2331 bp, Artificial Sequence
  Description of Artificial Sequence: Synthetic coding sequence
atgagcgaggctgttagagtcccctcaccggccacacccctagtggtcgccgccccagcgccagaagagcgcaagggaaaggagtccgagagggaaaagctgccaccaatcgttagtgctggcgccggtgcaaccgccggtctggaccgcggtgccaagggccagatttcgacattcagctccttcatcagcgccgtatctccaaaaaaggaggcagccgagaatagaagctctcccgcgcatcttgtgtttcctaacattaaaaacgtccgggagcccccgcctatctgtctcgacgtgcggcaaaagcagcggaccagcatggacgctagcagttcagaaatgaaggctcctgtgctcccggaacccatcttacccatccagcctaaaaccgtgaaggacttccaggaggatgtagaaaaagtgaagtcttccggcgactggaaagccgtccatgatttttatcttacaacattcgactcatttccagagcttaatgccgcctttaagaaggacgctacggccagtttcaatactatagaagatagtggaatcaatgcaaagtttgtgaatgccgtgtatgacactcttctgaacacaccacaggatgttcagaaaaccgtacttaaaggaattatcaatagtctacttcgcgaatggaaaggaccgcgcacaaaagacgacctccgcgcctactttatcttactgcagaatccacagtttaataacaccagtacatatgtgatctatgcccacctgttgcggcagatcgccacacttgtggaagctgaccaccattttctggtgcattggttcaagaagttgagccagaagcgctttaaacaactcgtggagcggctgcttcaattcatttctctgagactcttccctgctaagcctgaggaattccccccgattacaaagtgttcatggtggattccttccgctgccaaggttcttgccttgttgaacactgccaataatttagtacaccccccccttattccatacacggatttctacaattccaccctcgatcatatcgacctgatggaggaataccatacatggcagaactttgggaactcccatcgcttctccttctgtcaatatcccttcgttatcagcgttgccgcaaaaaaaattatcatacaacgggattccgaacagcagatgataaacattgctcggcagagcctcgtcgataaagtctcccggagacaaagaccggacatgaacatcctcttccttaatatgaaagtgcgcagaacgcatctcgtaagcgatagcctagacgaactgaccaggaagcgggcagatctgaagaaaaaactgaaagtcacttttgttggagaagcaggcctggacatgggcggattgaccaaagagtggtttttgctgctgatacgccaaattttccatcctgattatggtatgttcacataccacaaggactcccattgccactggttttcgtcttttaagtgcgacaattattccgagttccgtctagtcggtatattgatgggactcgctgtatacaactctatcactttagatatccgcttcccaccatgctgctacaagaaacttctttccccccccataattccctcagaccagaacattccagtggggatctgtaatgttacagtggacgacctatgtcaaattatgccagagctggcccacggattatcagagttgcttagtcacgagggtaatgtggaagaagacttttacagtacattccaggtattccaagaggagttcggtattattaagtcttataacctcaagcctggcggggacaagattagcgtgaccaaccagaaccgaaaagagtatgtgcagttgtacaccgattttctgctcaataaatccatttataagcagttcgccgctttttactacggcttccattccgtgtgtgctagtaatgcactgatgctactgcggcctgaggaggtggagatcttggtgtgtggatcgcccgatttggacatgcacgccctgcagcgatctacccaatacgacgggtatgccaagactgatctcacgattaaatacttctgggacgtggtcctcggatttcctctggatcttcaaaagaagctgctgcacttcacgacagggtccgacagggtccctgtggggggcatggcagacctcaacttcaaaatcagcaagaatgagacatctacgaattgtcttcccgtggcgcacacttgcttcaaccagctctgtcttcccccctataagtccaaaaaggacttgaaacagaaactcatcatagggattagcaactcagaggggtttggtctggagtag

SEQ ID NO: 30482 - DNA, 1281 bp, Artificial Sequence
  Description of Artificial Sequence: Synthetic coding sequence
atggaggagtaccatacatggcagaattttgggaatagtcaccgatttagtttctgccagtacccattcgtgatcagtgtggccgctaaaaagatcattatccagcgcgatagcgagcagcagatgatcaacatagcaaggcagtcactggtcgataaggtgtccaggagacagaggcccgatatgaacatattatttcttaatatgaaagtgaggcgtacccacctcgtctcagactcattagacgagctgactcggaagagggctgatctgaaaaagaagctgaaggttacattcgttggggaagccggtctggacatgggcggtcttaccaaggagtggttcttgcttctcatacgccagatattccatcctgactatggtatgttcacttaccacaaggattcacattgccactggttctcatcgtttaagtgcgacaactatagcgagtttagattggttggaattcttatgggactggccgtttacaacagtatcactctggacatcagatttccaccttgctgttacaaaaagctgctctcacccccaattatccctagcgaccagaatatacccgttggaatctgcaacgttaccgtggatgatctttgtcagattatgcccgagctcgcccatggcttgagcgagttgctgagtcatgagggcaatgtagaagaggatttctattctacatttcaggtatttcaggaagaattcggaataattaagagctataatctaaagccaggtggcgataaaatctcagtgacaaatcaaaaccgtaaggagtacgttcagctctacactgatttccttttgaataagagcatctataagcagtttgcagccttctactatgggtttcacagtgtctgcgccagcaacgccctcatgctcctgcggccagaagaggtggaaatcctggtctgcggtagcccggatctggatatgcacgcattgcagcggagcacacagtatgatggctatgccaagacggacttgaccatcaagtacttctgggatgtcgtgctgggatttcctctcgacttgcaaaagaaactgctgcacttcaccactggttctgatcgagtccctgtcggaggtatggccgatctaaatttcaaaatcagcaaaaacgaaaccagcaccaactgcctgcctgtcgcccacacctgttttaatcagctttgtcttccaccatataagtctaagaaagacctcaaacaaaaacttattattggtatatcaaattccgagggttttggcctggagtag

SEQ ID NO: 30483 - DNA, 444 bp, Artificial Sequence
  Description of Artificial Sequence: Synthetic coding sequence
ttgagccagaagaggttcaagcagctggttgaaagattattgcaattcatctccctccggttatttccagctaagcccgaggaatttcctcctataacaaaatgctcttggtggataccatccgctgctaaggttcttgccctgttaaacactgcaaataacctggtccacccacctctgattccatacactgatttctacaatagcacactggatcatatagacctcatggaggaataccatacctggcagaatttcgggaactcccatcgaatggcagtgcgtatcaaaagaaactacactcatactataattctttacatggtcaaacataatcctaaggtgatgttctacattgcaacaagaggaaccttagactcactttcaattatcttactcaaaattcatcacttcgcctttagcttctttcacctcctttcatag

SEQ ID NO: 30484 - DNA, 624 bp, Artificial Sequence
  Description of Artificial Sequence: Synthetic coding sequence
atgagcgaggctgtccgcgtgccctctcctgccacacctctggtggtggccgcaccagccccagaggaacgaaaaggcaaggagagcgaacgggagaagctaccacctatcgtttcagccggcgccggggccaccgccggactcgacagaggggccaagggacagatttcaacattctcctctttcatttctgctgtttctcccaagaaagaggccgccgagaatcggtctagtccagcccatctagtcttccctaacatcaaaaacgtgcgggaacctcctccgatctgcctcgacgtgcgacagaaacagcgcacctctatggacgcttcttccagcgaaatgaaggcaccagtcctaccggaacctatcctgccaatccagcccaaaacagttaaagactttcaggaagacgtggagaaggtcaaatcgagtggcgactggaaggcagtccacgacttttatctaacaacattcgactcattccccgagttaaatgccgccttcaagaaagacgccactgcatcgttcaacacaattgaagatagcggaattaacgcaaagtttgtcaacgccgtgtacgatacccttctgaatactgtgagcatcatgacctgcaaatag

SEQ ID NO: 30485 - DNA, 2343 bp, Artificial Sequence
  Description of Artificial Sequence: Synthetic coding sequence
atgtccgaggcggtaagggtaccatctcctgctacccccttagttgttgccgctcctgccccggaggagcggaagggcaaggagtccgagagggagaaattgccgcctattgtgagcgccggcgccggcgccactgccggtttagatagaggcgccaaggggcagatctcaactttctccagcttcatatctgcagtgtcccctaagaaggaagccgcagagaataggagctctcctgcccacctcgtgttcccgaacataaagaacgtcagagagccaccgcctatctgcttggacgtcagacagaaacaaaggacaagcatggatgcctccagcagcgagatgaaagcccctgtgctaccggaaccaatcctcccaatccagcccaagaccgtgaaagacttccaggaggacgtggaaaaggtgaagtcctccggggattggaaagccgtgcacgatttctaccttaccactttcgacagctttcctgagctcaacgccgccttcaagaaggacgctaccgcgtcctttaacacaattgaagatagcggaataaacgctaagtttgttaacgcagtgtacgacacactcttgaatacccctcaggacgtgcagaagaccgtgctaaaagggatcatcaactccctcttgagggagtggaaagggcccagaaccaaagatgacttgcgggcctattttatactactgcagaatccccagtttaacaatacaagcacgtatgtgatttacgctcacttgctaaggcagatcgcgacactagttgaggctgaccaccactttctggtgcattggttcaagaaacagtatagccgcctaagccaaaaacgcttcaaacagcttgtcgaaagactcctccagtttattagtctccggctctttcccgcaaagccagaggaattcccgcccattacaaagtgttcatggtggatcccaagcgctgcgaaggtgttggctctgctgaacacggccaataacctggtgcacccccctctgatcccatacaccgacttttataatagcactctcgaccatatcgatctgatggaagagtaccacacatggcagaacttcgggaatagccatcgattttctttttgtcagtacccttttgtgataagcgtcgctgctaagaaaattatcatccagagggactctgaacagcagatgatcaatattgctcgacagtctctggtggataaagtatcccggcgccagcggcctgatatgaatattctgttcctgaatatgaaggtgcgtcggacacaccttgtgagtgacagcctcgacgagctcacccggaagcgagcggacctgaagaagaaattaaaagttacatttgttggagaggccggcctggacatggggggactgactaaggagtggtttctgctgctcattcgacaaatcttccaccccgactatggcatgttcacctatcacaaagactcccattgccactggttcagcagtttcaagtgtgataattatagtgagttccgcttggtcgggattctaatgggcctggcagtatacaactccattactctggacatccgctttcccccgtgctgctataagaaacttttgtcgcccccaattatacccagcgatcagaacattcccgtgggtatttgcaacgtcacagtggacgacctttgccaaataatgcccgagctagcacacggcctgtcagaactgctcagccacgaagggaacgttgaggaggatttctattctacgttccaggtcttccaggaagagttcggcattattaagagttataaccttaagccaggcggcgataagatctccgtaactaaccagaacaggaaggaatacgtccaactatataccgacttcctcctgaacaagtccatatataaacaatttgctgcgttttactatggctttcatagcgtttgtgcctccaatgctctgatgctgctgcggcctgaagaagtagaaatattagtttgtggaagccccgacctagacatgcacgcactgcaaagaagcacacaatatgacggatacgcgaaaaccgatcttactatcaagtatttttgggacgtggtgctgggttttcctctcgacctgcagaagaagctcctacatttcacaacgggttcagatcgcgtccctgttggcggtatggctgatctcaatttcaaaatcagtaagaacgagacaagcacgaattgtcttcccgtggcacatacctgtttcaaccagttgtgcctgccaccctataaatctaagaaggacctgaaacagaagctcatcataggaatttcaaactcggaggggtttggcttggaatag

SEQ ID NO: 30486 - DNA, 1098 bp, Artificial Sequence
  Description of Artificial Sequence: Synthetic coding sequence
atgaatattttgttcttaaatatgaaagtcaggcgcacacacctggtatctgattctctcgatgagcttacgagaaagcgcgctgacctgaaaaaaaaactgaaggtcactttcgttggagaggcaggcctagatatggggggcctgaccaaggaatggtttctgttactgatccgccagatctttcaccccgattatggaatgttcacgtaccacaaggattctcattgtcattggtttagctccttcaagtgcgacaactatagtgagtttcgtttggtgggcattttaatgggcttagccgtgtataactcaatcacgctggacatcaggtttccgccttgttgctataagaagctgttatcccccccaatcattccatcggaccagaatattccggttggcatatgtaacgtgacagtggacgacctatgccaaattatgccagagctggcccacggcctgagcgaactcctctcacatgaaggcaacgttgaagaggacttttattcaacttttcaggtttttcaggaggagttcggaattattaaatcatataatctgaaaccagggggtgacaaaatcagcgtgaccaaccagaataggaaagaatacgtgcagctctacacagacttcctgctcaataagagtatctacaagcagtttgcagcattttactacggctttcacagtgtatgtgcaagtaatgctctcatgttgctgaggcctgaggaagtcgagattcttgtgtgtggtagcccggatcttgatatgcatgccctgcagcggtcaactcagtatgacggctatgcaaaaacagacctaaccatcaagtacttctgggatgtggtgctgggctttcctctagatctgcaaaaaaagttgctgcactttaccactggcagcgaccgagtgccagtgggcggcatggctgatcttaatttcaagatcagtaagaacgaaacctcaaccaattgtctcccggtggcccacacttgcttcaaccagctctgtctgccgccttacaagagcaagaaggatcttaagcaaaaactgatcattggcatctcaaacagcgaaggattcggcctcgagtag

SEQ ID NO: 30487 - DNA, 3306 bp, Artificial Sequence
  Description of Artificial Sequence: Synthetic coding sequence
atggatgagtgcggaagtcgcatccgcagacgggtgtctctgcctaagcgcaacaggccgtctctcggttgcattttcggtgctcccaccgccgccgagctggttccaggcgatgaggggaaagaggaagaagagatggtggcggagaaccgacgcaggaaaacagccggggtcctgcctgtcgaggtgcagcccctgttgctttcagactcccccgaatgcctggtacttggcggaggggacaccaatcccgatttgctgagacacatgccgaccgaccggggagttggggatcaacctaacgactccgaggttgacatgtttggcgattacgactcctttactgagaattcctttattgcgcaagtcgatgacctggaacagaagtacatgcaactccccgagcacaagaagcacgcgaccgactttgcaacggaaaacctgtgtagcgaaagtatcaaaaataagctttcgatcaccaccataggcaacttgactgagcttcaaaccgacaagcacaccgaaaatcagtccgggtacgaaggagtcacaattgaacctggggccgatcttctgtatgacgtcccgagtagtcaggccatctatttcgagaacctgcagaatagttccaacgacttgggtgatcactctatgaaggaaagggattggaagtccagctctcacaatactgtgaacgaagaattaccccacaactgtattgaacagccacagcagaacgatgagtcatcctccaaggttcggactagcagcgacatgaataggcgtaaaagcataaaagaccatctgaaaaacgcaatgaccgggaacgcgaaggcacagacgcccatcttcagcagatctaaacagctgaaggacacactgctctccgaagaaattaacgtggctaaaaaaactgtcgagtcgtcttctaacgacctgggtccattctactccctgccctccaaagttcgagacttgtacgctcaattcaagggaatagagaagttgtatgaatggcagcacacatgcctgactctgaatagtgttcaagagcgaaaaaatctcatctactcactgcccacgagcggagggaaaaccctggtggcagagatcctgatgctgcaggaactgctgtgttgccgtaaggacgtcctgatgatcctgccgtacgtcgccattgtgcaagaaaagatcagtggcctgtctagctttggaatcgaactcggttttttcgtcgaggaatatgcaggatccaaggggagatttccacccactaaaaggcgagagaagaagtctctgtacattgcgacaattgagaagggacactctctggtaaactctctcatcgaaaccggtcgcatcgattctctgggcctcgtggtggtggatgaattgcacatgattggagagggctcccggggggccaccctcgagatgacgcttgctaaaattctctatacctcaaagacaacccaaataattggtatgtctgccaccctgaataacgttgaagatctgcagaagtttctgcaagcggaatattataccagtcagtttaggccagtggagctgaaggaatacctaaagataaacgatactatctatgaggttgatagcaaggcagagaatggcatgacgttttcgcgtttattgaattacaaatacagcgacacccttaaaaagatggatcctgatcacctcgttgcattggttaccgaagttatccctaactattcctgcctggtgttttgccctagcaagaaaaattgcgaaaatgtggcagagatgatttgtaaatttctgtcgaaagagtatttaaagcacaaggaaaaagaaaagtgtgaagtgattaagaacctcaaaaacattggaaatgggaacctgtgccccgtcttgaagcgtactatccctttcggcgtcgcttatcatcattctggcttgacctcagatgaacggaagctactcgaggaagcctacagcaccggtgtgctgtgcttattcacctgtacaagcaccttagcggcgggagtcaatctgcccgctcgcagagtgatacttcgtgccccatatgtagctaaggagtttcttaaacgcaaccagtacaaacagatgataggacgggctggccgcgcgggaattgatacaatcggcgaatcgattcttatactccaggaaaaagacaagcaacaagtcctggagttgattactaaacccctggaaaattgttatagtcacctggtgcaggaatttaccaagggaattcaaactctctttctgagcctgatcggcctaaaaattgcaactaatctggacgatatctaccattttatgaatggaacattcttcggcgtccaacagaaggttctgctcaaagaaaaatctctttgggagatcactgttgaaagtctccgatatcttacagagaagggtttgctgcagaaggatacaatctataagagcgaggaagaagtacaatacaacttccacattaccaagctggggcgcgctagttttaagggtacaattgatctggcctattgtgatatcttgtatagagatctgaagaaaggtctagaaggtctggttctggaatctctgctgcaccttatctacctgactactccttatgatcttgtatcccagtgtaacccagactggatgatttacttcagacagttctcccaactgtcccctgcagagcagaacgtggctgcaattctgggcgtctctgagagctttatcggaaagaaggcaagtgggcaggctataggtaagaaagtggacaagaatgtagtgaatcggctgtacttgtcattcgtgttatatactctcctgaaggaaactaacatctggactgtgtctgagaagttcaacatgccacgagggtatatccagaacctgctcactggcaccgcctctttttcctcttgtgttttacacttctgcgaagagcttgaagagttttgggtctatcgagcactcctcgtggaactgaccaaaaaactcacttactgtgtgaaggccgaattgattccattaatggaagtaactggagtgctcgagggacgggcaaaacagctctactctgccggttacaaatcgctcatgcacctagcgaatgccaatccagaggtcttagtgcgcacaatcgatcacttgagtcgtcgccaggccaaacaaatagtgagctcggccaagatgctcttgcacgagaaagccgaagctttacaggaagaagtggaggagctcctgcgcctaccttccgactttccaggcgcagtcgcatcctctactgataaggcttag

SEQ ID NO: 30488 - DNA, 546 bp, Artificial Sequence
  Description of Artificial Sequence: Synthetic coding sequence
atgacaactaccaccacattcaaaggggtggatcccaactcccggaactcaagccgggtgctgcgcccccccggggggggaagcaatttcagtttgggcttcgacgagccaacggaacagcccgtgagaaaaaataaaatggcctctaatatatttgggaccccagaggagaaccaggcctcttgggctaagagtgccggggccaaaagctccgggggcagagaggatctcgaatcttcaggcctgcagagacgcaacagtagcgaggctagcagcggcgactttctggacttaaagaaaatgtggacccagacatgccaagccgcatggggtagggtcaagagatctccctgcctgctcaggctgtgccccgcccgctggccccgcccccagtgtcatccagaggagattcctctggccgccagtcctgcctcttcatgggtgtcaagcgactgcccagagcgttgcaggtcagtttgcttcctccacgcctgtgaattacacaacctatccttaacagtgcatctgttagacctgttccactag

SEQ ID NO: 30489 - DNA, 327 bp, Artificial Sequence
  Description of Artificial Sequence: Synthetic coding sequence
atggcgtccaacatattcggaacccctgaagaaaaccaagcaagctgggccaagtctgccggcgcaaaatccagcggtggaagagaggacctggagtctagtggtctgcagagaaggaactcctcagaggcctccagtggggactttctggacctgaagacctctggcggaaagattgaaaatgtggatactgacctgcccgggtctttgggacagagcgaggaaaaacccgtcccagccgcacctgtcccctctcccgtggctccagctcccgttccgagtcggcgaaacccccctggaggtaaaagctccctggtcttaggttag

SEQ ID NO: 30490 - DNA, 327 bp, Artificial Sequence
  Description of Artificial Sequence: Synthetic coding sequence
atggccagcaacatatttgggacaccagaagaaaaccaagcgtcatgggcaaagtctgctggtgccaagagcagtggggggagagaggatctcgagagcagcggtctgcagagaagaaacagttccgaggcatcctccggggacttcctagatttgaaaggggagggggatatacatgagaatgtggatacagatttgccaggcagcctgggccagtcagaagagaagcctgtacctgccgccccggtgccatcaccggtggcccctgctccagtcccctccaggcgaaaccctcctgggggcaagtctagtctggtcctgggatag

SEQ ID NO: 30491 - DNA, 465 bp, Artificial Sequence
  Description of Artificial Sequence: Synthetic coding sequence
atgactacaaccacaacatttaaaggcgtagacccaaattcacgtaacagtagtagagtcttgaggcctccaggtggtggttccaatttttccctcggcttcgatgagccaactgagcagcctgtccgcaagaacaagatggcttcaaacatcttcgggaccccagaggaaaatcaagcgagttgggcaaagtcggcgggggcgaaatcatccggcggccgcgaagacttagagtcctcaggcctgcagcgcagaaacagtagcgaggctagcagtggcgatttcctagatcttaagggggaaggcgacattcatgaaaatgtggacacggatctgcccgggtccctgggccagtctgaagaaaaaccagttccggcagccccagttccatcccctgtcgctcctgccccagtgccaagccgaagaaacccccccgggggcaagagttccctggtcctcggttag

SEQ ID NO: 30492 - DNA, 198 bp, Artificial Sequence
  Description of Artificial Sequence: Synthetic coding sequence
atgcagagtgaagtgcagcgtcagcctgatcgcagcatacaaaaccccctcactgtcggatcccatacaccatgcttgactccccctacaatgagctgcaataacagccaagtttggtggtgtgtccccgtggtgcctgcaacctgggaacctgaagccgggggcagcctggaatccagctcttcccggctccagtag

SEQ ID NO: 30493 - DNA, 663 bp, Artificial Sequence
  Description of Artificial Sequence: Synthetic coding sequence
atggcgttgtcctccgtcggccgggcgtggtgccctccggggttcatcaggcagaatggggtctgcaccgaccttgacgaatgtagggtacgtaatctttgccagcacgcctgtcggaacactgaaggatcgtatcaatgtctgtgtcccgccggttaccggttacttcccagtgggaaaaactgccaggatataaatgaatgtgaagaggagagcatagaatgcggcccaggccagatgtgcttcaacactagggggagttatcagtgtgtcgataccccctgtccggcaacatatcgccagggacctagtccaggcacttgtttcagaagatgcagtcaagactgtggtacaggggggcccagtactttgcagtaccgcctgctccctctgcccctgggggtgagagcccaccatgatgtggcccgattgacagcctttagtgaagtcggagtgccagcaaacagaaccgaattgtctatgctggagcccgaccccaggagcccattcgccctcaggccattacgggctggactgggagcagtgtatacccgacgggcgctgacccgtgccggactttatcggcttacggtgcgagcggccgctcctcgccatcaatctgttttcgttctgttgatcgctgtatctccgtacccttactag

SEQ ID NO: 30494 - DNA, 990 bp, Artificial Sequence
  Description of Artificial Sequence: Synthetic coding sequence
atgatggcaccagtcgttctaacctgccacagcaccggaatccccgcacctactgtgtcctggtccaaggccggcgcacagcttggcgccaggggtagcggatacagagtatcaccttcaggagcccttgagatcggccaagcccttcctatccacgcaggtcggtacacctgcagtgctaggaactctgctggggtcgcgcataagcacgtgttccttactgtccaggcctcgcctgtggttaagccactgccatccgtggtgcgtgccgtggcggaggaagaggtgcttttaccatgtgaagctagtggtatacccaggcctacgatcacgtggcaaaaggaaggactcaacgttgccactggtgtgtcgacacaggtccttcccgggggtcagctgaggatcgcccacgcaagccccgaagacgctggcaactatctctgtattgctaaaaatagcgccgggtctgcaatggggaaaacccggttggtggtccaggtgccacccgtgattgaaaatggcttgcctgatctctcaacaacggaaggatctcacgcatttctaccctgtaaggccagggggtctccagaacctaatattacctgggataaggatggccagcctgtctcaggtgccgaaggtaaattcactattcagccttctggcgagctcctcgtcaaaaacctcgagggccaagacgcaggaacatacacgtgcacagcggagaacgccgtggggagggctagacggcgggtgcacttaaccattctcgttttgcccgtatttacaaccttgccaggtgacagaagcctgaggttgggagacaggctgtggctccgctgtgctgcccgcggcagccctactcctcggattgggtggacggtgaacgaccgccccgtgaccggcctcggtttgctaggaatgggagggacagaatctcaggatacaggacgcctgaggagagagggacgctggggggaccctacttag

SEQ ID NO: 30495 - DNA, 462 bp, Artificial Sequence
  Description of Artificial Sequence: Synthetic coding sequence
atgcggggagccagcgcccggccccccctgcttggcagtgaagagcctttttgtccagcgtcacgatccgtgcgcgaggggggtggcggagtgtcgccccccccaggacagcctccttgcccagaagggaggtggggcggccagccaccagctcggccggctgacccaagtgggagggaggtcggggggagtgccccttgtcccgcgtccagaccggtccgggaggtcagaggggcgtctgcccgaccaccactcctgggatctgaagaaccgttgtgtccggcctcacgcccaatttgggaaggagggggaggcgtcagcccccctccctgccagcccccctgtccaggtggaagaggcgcatcggccaggccacctctgttaggcaatgaagaacctctctgtcccgcaacgactcctagtggtcggtgtactcagcagctggtggagaacggaccatag

SEQ ID NO: 30496 - DNA, 1866 bp, Artificial Sequence
  Description of Artificial Sequence: Synthetic coding sequence
atgtcccctgtgtttcccatgctgacagtgcttacaatgttttattatatctgcctcaggagacgggcgcgcacggccactcggggtgaaatgatgaatactcaccgggccatcgagagcaacagccagacctccccactgaatgctgaagtcgtgcagtacgcaaaggaggtagttgacttctcaagtcattacggctctgaaaactctatgtcatacacaatgtggaatttggccggggtgccgaatgtgttcccatcctctggagactttacgcagacagccgtgttccgcacctacggtacctggtgggaccaatgtcctagcgcatccctccctttcaaaaggacccccccgaactttcagagccaggactacgtggagctgacttttgagcaacaggtctatcctacagccgtgcatgtgctggagacttaccacccaggcgcagtgatacgcatcttggcctgcagcgccaacccatattccccgaaccccccggcagaagtccgttgggaaatcctgtggtccgaacgccctacaaaagtaaacgcctcacaagcccgccagttcaagccttgtattaagcagatcaatttccccacgaacctcattcgcctcgaagtgaactctagcctgctggaatactacacagaattagatgcagtcgtgttgcatggcgtcaaggataaaccagtactcagcctgaaaactagcctgatcgatatgaatgacattgaggacgatgcgtatgcagagaaagacggatgcgggatggacagcctgaacaagaaatttagctccgccgttctcggtgagggccctaacaatgggtatttcgataaactcccctacgaacttatccagctgatcctgaatcatctgaccctgcccgacctgtgcaggctggcccagacctgcaagctgttgagccagcactgctgcgaccccctgcagtatatccacttaaatcttcagccctactgggcaaaactcgacgacacatcactggagtttctgcaatcgaggtgcacactcgttcagtggttgaatctctcctggactgggaatagagggttcatctctgtggcagggttctcaaggttcctgaaagtttgcggcagtgagctggtgagactcgaattatcctgcagtcattttcttaacgagacctgtctcgaggtgatctctgaaatgtgtcctaacctgcaggcactgaacttgtctagctgtgacaaactgccgccgcaagccttcaaccatattgccaaactgtgttccctgaaaaggctggtgctctatagaaccaaggtggagcagacggctctgctgtctattctgaacttctgcagcgaactgcagcatttatcactggggagttgtgtgatgatagaggactacgacgtgattgccagtatgatcggtgccaagtgcaagaaactgcgcactctagacttgtggcgatgcaaaaatattactgaaaatggtatcgccgagctggcctcagggtgtcccctgctcgaggagcttgatctgggctggtgccctacactacagtcctcaaccgggtgctttaccaggctcgcccaccagttgcctaatctgcagaaacttttcctgaccgccaaccggagtgtgtgtgatacagacatcgatgaacttgcctgcaactgtacaaggttacagcagctggacatcttgggcacgaggatggtttcccctgcgtctctccgtaaactgctcgaatcctgtaaggatctgagtctcctcgacgtgagtttttgtagtcaaattgataaccgtgcggttctggaactcaatgcttccttcccaaaggtgttcattaagaagagttttacccagtag

SEQ ID NO: 30497 - DNA, 756 bp, Artificial Sequence
  Description of Artificial Sequence: Synthetic coding sequence
atgtccgcatatgggatgcccatgtacaaatcgggggatctcgtgttcgccaagcttaaggggtacgcccattggcctgctaggatagaacatatgacgcagccgaatagataccaggtttttttcttcggcacacacgaaaccgcttttttaagtcctaagcgactgtttccgtacaaggagtgcaaagaaaaatttgggaaaccgaacaagcgtcggggcttttcagccgggctctgggaaatcgagaacaatccaactgttcaggccagcgactgcccacttgcttctgaaaagggtagcggagacggcccctggccagaaccagaagccgccgagggggacgaggataagccgacacatgcaggtggggggggggatgaactcggaaaaccagatgacgacaaacccaccgaggaggaaaagggccccttaaagcggtctgctggggatcccccagaggacgctcccaagaggcctaaggaagcggcccccgatcaagaagaggaggctgaggcagagagggccgccgaggctgagcgcgctgcagcggccgctgccgctacagctgtggacgaagagtctccattcctcgttgccgtggagaatggatcagcacccagcgaaccaggcctggtgtgtgagccaccccagccagaagaagaagagctcagagaggaggaggtggcagacgaggaggcgagccaggaatggcacgctgaggctccaggcgggggagaccgggatagcctctag

SEQ ID NO: 30498 - DNA, 345 bp, Artificial Sequence
  Description of Artificial Sequence: Synthetic coding sequence
atgttcggcgcctgctacaagcagcccttaaagccttccggatcagagccaccagccgaggagtgcagaatgacgccacgtcacgcaggatgtgatgtcacagagatgcaaaggattcttagccagcccaccttcaccgagcatctgttacgggccgtctgcactaaactggccaacatgtacagcacatccacagattgcagggaacactgtcgaagaggcatgaaagctaaacagttgaaagccgaagcagggcgtagctgtcagagaaagggcgtgcccatccaaacacctcgcgagcatagctggatctcctgtaagaaagagttcgaggctaatccttag

SEQ ID NO: 30499 - DNA, 231 bp, Artificial Sequence
  Description of Artificial Sequence: Synthetic coding sequence
atgttcggagcctgttacaagcagcctctgaagccgagtgggtccgaaccccctgcagaggagtgtagaatgacgcccaggcatgccggttgtgacgtgactgagatgcagcgaatactcagccagcccaccttcaccgagcatctgctccgcgcagtgctgagcacagagcgcggtccataccccgaccctaaacgggcatttctcgatttacttcaagaaaggatctag

SEQ ID NO: 30500 - DNA, 366 bp, Artificial Sequence
  Description of Artificial Sequence: Synthetic coding sequence
atgttcggagcgtgctacaagcagcccctaaagcccagtgggagtgagcctccggcagaggaatgccgtatgacccctaggcatgcaggatgcgacgtgaccgagatgcagaggatcctgtcccagcccacatttacagagcatttgctgcgagcagtgtgtcttgtaaacgggaaaggtagtctatctcgtccccaggagagcatcctgggatcccttgccagaaaaaacctgagacgaatccatcgggtgtctctcgtcatgtgtgtgaggcccctgagcccctctaaggccatcatctcacctgtaacctgtatgtacaccagtcgctggcctgaagcctccgaggagtcacagaaaaagtag

SEQ ID NO: 30501 - DNA, 465 bp, Artificial Sequence
  Description of Artificial Sequence: Synthetic coding sequence
atgtttggcgcctgctacaagcagcctctgaaacctagcggctctgaaccacctgccgaggaatgtcgcatgacaccccgccacgccgggtgcgatgtgacagagatgcaacgcatcctgagccagcctaccttcaccgagcatcttctaagagcagtgtgtaccaaactggccaacatgtatagtacttccaccgattgccgcgaacactgcagaagagggatgaaggcaaaacagttaaaggcagaggctggtcgtggtctggtcaacggaaagggtagcctctctagaccacaagaaagtattctgggcagcctggccagaaaaaatctccggagaatacaccgggttagcctcgtcatgtgtgtacgccctttgagtccaagtaaggcgatcatttcaccagtcacatgcatgtatacttcccggtggccagaggcgagtgaggaaagccagaagaagtag

SEQ ID NO: 30502 - DNA, 345 bp, Artificial Sequence
  Description of Artificial Sequence: Synthetic coding sequence
atgttcggtgcttgttacaagcagcccctgaaaccaagcggctccgagccaccggcagaggaatgtagaatgaccccgcgtcatgccggatgtgacgttactgagatgcagcggattctcagccagcccacattcaccgagcacctgttgagggccgtctgcacaaagttagcaaatatgtactcaacttccaccgactgtcgtgaacattgtagacggggaatgaaagctaagcagttgaaagcagaagcgggtcgctcttgtcagcgcaagggggttccaattcagacgcctcgcgaacactcatggatctcatgtaaaaaggagttcgaggccaacccttag

SEQ ID NO: 30503 - DNA, 1350 bp, Artificial Sequence
  Description of Artificial Sequence: Synthetic coding sequence
atgatgctgtccactgaaggtcgggagggatttgtcgtcaaggtgagaggattgccctggtcatgctccgctgatgaagtaatgaggttcttctcagattgcaagattcaaaatggaacaagcgggattaggtttatttacactagagagggaagaccatctggagaagccttcgtggagctagagagtgaggaggaagtcaagctggccctaaagaaagacagggagactatgggacacaggtacgtcgaagtcttcaagagcaattcggtagagatggattgggtactaaaacacaccggacctaactcccccgataccgccaacgatggattcgtcaggctccggggcttgccctttgggtgtagtaaggaggaaattgtgcagttcttttccggactggagatcgtgcctaacggtatgactctgccagtggattttcagggcaggagcacaggtgaggcgtttgtgcagttcgcgtcacaggagatcgcagaaaaggcactcaagaagcataaagagaggatcgggcaccgatatatcgagatctttaaatctagcagagccgaagttaggacacattacgatccccctcggaaactgatggctatgcagcgcccaggcccctacgacagaccaggagccggccggggttacaactctatcggtcgcggagccggattcgagcggatgagaagaggggcgtatggtggcggttacggaggttatgacgactatggtgggtacaatgatgggtacggctttgggtccgatcgcttcggcagggacctcaattattgcttcagtggaatgtcggaccatagatatggagacggcggatcctcctttcaatccactaccgggcattgtgttcacatgcgcggtctcccatacagagctaccgaaaacgatatctacaactttttcagtcctctcaatccaatgcgagtgcacatcgagatcggccctgacggtcgcgtcactggcgaggctgacgtagaatttgctactcacgaggacgcagtggctgccatggctaaagataaggctaatatgcagcacaggtatgtcgagttgttccttaacagtacggccgggaccagtggcggggcttacgaccactcatatgtcgaactatttctcaattccaccgccggagcctcgggtggggcttacgggtctcagatgatgggtggaatgggcctctcaaaccagtcttcctacggcggcccagcatcccagcagttgagtgggggttatggcgggggatatggtggccagtcatctatgtctggttatgaccaggtcttgcaggagaactccagtgattaccaaagcaacctagcctag

SEQ ID NO: 30504 - DNA, 1656 bp, Artificial Sequence
  Description of Artificial Sequence: Synthetic coding sequence
atggatgagggcgtgaactttaagcccacggaagccgggagactcatggcctggtattacattactttcgaaaccgtaaagaagttctataccatttcagggaaagaaactttgtcagatcttgttaccctgatcgcaggatgcaaggagttcctcgatatccagttgcgcatcaatgagaagaaaaccttaaatacactcaacaaggatcctaaccgcatcacaatccgctttcccatggaaggaagaatcaaaacacgggaaatgaaagtgaactgtctgatacaagctcagttgggttgtatccctatccaagatttcgccctgacccaggacaccgctaaaatcttccgtcacgggtctaggattactcgctggttaagcgatttcgtggccgcgcaagagaaaaagttcgccgtgctgctcaattccctgatcttggcaaagtgcttccgatgcaagctgtgggagaactcgctccacgtatctaaacagctcgaaaaaataggcattacattgtccaacgccattgttaatgccgggctgaccagcttcaagaagatcgaggaaacagacgctcgggagctggagctgattctgaaccgccatcctccatttgggactcaaatcaaagagactgtgatgtatctccctaaatacgagctgaaggtggagcagataacccgatactcagacacaaccgccgaaatcctggttacagtgatccttcgcaacttcgaacagctgcaaaccaaaagaaccgcctctgattcccactacgtcacgctaatcatcggggacgccgataatcaggtggtatatttgcataaaatcacagattcagtgttgttaaaggccggatcctgggccaagaaaatcgctgtgaaacgggcacttaagtctgaggatctgagcattaacctgatctcatcagaatttgtgggcctggatatccagcaaaaacttacagttttttatttggagcctaaacggtttggcaaccagattactatgcagcggaaaagcgaaacacaaatctctcattctaagcattctgacatttcgacaatcgctgggccgaataagggcaccacagcttcgaaaaaacctgggaatcgagagtgtaatcacttgtgtaaatctaagcacacttgcggccacgactgctgcaagatcggagtggctcaaaaatctgagatcaaggaatccacaatctcctcttatctgtctgacctgcgtaatcggaacgctgtctctagtgtgccacccgttaaacggctgaagatacaaatgaacaaaagccaatcagtggacctaaaggagttcggatttaccccgaaacccagcctaccgtcgatcagcaggtcggagtatctaaacatcagcgaactgcctatcatggagcagtgggatcaacctgagatttacggaaaggtgcgccaagaaccatctgagtaccaggataaagaagtcttaaatgtcaacttcgaattaggtaatgaggtatgggacgactttgatgatgagaatcttgaagtcaccagtttttcaaccgacaccgaaaagacaaagatatcagtcctcttccaccatatgcggtgtaggatttttttataccagatcctgctgtgtccctctagcgtacatccaccatag

SEQ ID NO: 30505 - DNA, 2493 bp, Artificial Sequence
  Description of Artificial Sequence: Synthetic coding sequence
atgattgcctgtttcttgtggaagatttgtttcctgaaaaaccagatgaaactaaaaatggccccgattaaagccctgtgcagccagagattcgacgactggaaagagaaatttggccccattggtttgaactgtaaagagctgaccggtgatactgttatggatgacctcttcgaaatccagcacgcccatatcatcatgacaacccccgagaagtgggattccatgacccgcaagtggcgcgacaattccctggtacagcttgtcaggctgttcctgatcgacgaggtgcatatagtgaaagacgagaatcggggccccacgcttgaggtcgtggtctcccggatgaagaccgttcagtcggtgtctcagactctcaagaacacttctacagccataccaatgcgttttgtggccgtctctgctaccatcccgaacgctgaagatattgctgaatggcttagtgatggcgagagacccgccgtgtgccttaagatggacgagtctcatcgtcctgtcaagctccagaaagtggtccttgggttcccatgcagctcaaaccagactgaatttaaattcgatctgacactaaattataaaatagccagtgttatccagatgtactccgaccagaagcctacgctggtgttctgtgcaacgagaaagggagtgcagcaggctgcctcagtgctggtcaaagatgccaagtttatcatgaccgtggagcagaaacagaggcttcagaaatatgcttacagcgtgcgagatagcaagctgcgagacatacttaaggatggcgcagcttaccaccacgccggcatggagcttagtgaccgaaaagtggtggagggcgcatttaccgtgggagaccttccagtgctctttaccacatcaactctcgcaatgggagtgaacctgcccgctcatctggtggtgattaagtctactatgcattacgctggagggctgttcgaagagtatagtgagaccgacatcttgcagatgatcggtcgcgcaggccgaccccagttcgatactaccgctaccgccgtgataatgacgagactgtctacccgggacaaatatatccagatgctcgcatgcagagacaccgtagagtcaagcctccaccgccaccttattgagcacttgaatgcagagatcgtgctgcatacaatcacggatgtcaacatagcagttgagtggatccgctccacgctgctgtatattagagcgcttaaaaatccatctcactacggcttcgcctctggcctgaacaaggacggcattgaagccaagctgcaagagctctgcttgaagaatctgaacgacctcagctctttagatcttatcaaaatggacgagggcgtaaattttaagccaaccgaagccggcaggttaatggcttggtattatataacattcgaaactgtgaagaagttctataccatctctggaaaggagaccctgtcagacctggtgaccttgatcgccgggtgtaaggaatttttagatatccagttgcgaatcaacgagaagaaaactcttaatacactgaataaggatcctaaccgtatcaccattcggtttcccatggaaggacgcattaagacgagggagatgaaagtcaactgtcttatacaggcacagcttgggtgtatcccaatacaggattttgccttgacgcaggacactgctaaaatattccgtcacggaagcaggatcactagatggttatctgatttcgtggcagctcaagaaaagaagttcgctgttctgctcaatagtctcattttggccaagtgctttcggtgtaagctgtgggaaaattctttgcacgtctcgaagcagcttgagaaaatcggcattacgttgtccaacgcgattgtgaacgcgggtttaacctctttcaaaaagatagaagaaactgatgctcgggaattggaactcatcctgaatcggcatccaccgtttggcacacagatcaaagagaccgtgatgtatttgcccaaatatgagttgaaggtcgaacagatcactcgctacagcgatactactgcagagatcctggtgacggtgatcctccgcaacttcgagcagctccagactaagcgcacagcctccgatagccattatgtgaccctcattatcggcgatgcagacaatcaggtcgtgtatttgcataaaatcaccgactcggtgctattgaaagctggaagttgggcgaaaaagattgctgttaagcgcgccttgaagtccgaagacttgtcaatcaacctcatatcatctgagttcgttggtctggatatacagcagaagctgaccgtgttctacttagagccgaagagatttggtaatcagatcacgatgcaacggaaatcggagacccagattagtcattccaagcattccgacattagcacaattgcagggcctaataaaggcacaacagcatcaaaaacctgggagccaaggatgcagtcaagcttgtag

SEQ ID NO: 30506 - DNA, 3345 bp, Artificial Sequence
  Description of Artificial Sequence: Synthetic coding sequence
atggaggtaccgctgccctggttgaatattaaaatcgtttatatggctcccataaaagcactgtgttctcagaggttcgacgactggaaggaaaagtttggccctatcgggctgaattgcaaagagctgacaggggatactgttatggatgatctgttcgagattcagcacgcccacatcattatgaccacacccgaaaagtgggactccatgaccaggaagtggcgggataactctctggtgcagctggtgagactttttctcatcgacgaagtacatatcgtgaaggatgagaacagaggccccacactcgaagttgtggtttccagaatgaaaaccgtgcagtctgtgtcccaaaccttaaagaacacgtcgaccgctattcccatgcgcttcgtcgcagtttctgctactattccaaatgcggaggatatcgccgaatggctgtcagacggcgaacgccccgcggtgtgcttaaagatggacgaatcacatcgccccgtaaagctgcaaaaggtagtgttggggtttccctgttccagtaatcagaccgagttcaagtttgacctgacactgaactacaaaattgcttctgtgatacagatgtacagtgatcaaaagccaaccctagtgttttgcgccactcgtaagggggtgcagcaggcagctagcgttctggttaaggacgctaaattcatcatgactgtggaacagaagcagcggctgcaaaagtatgcatactccgtacgagactcaaagctccgggacattcttaaggacggcgccgcctaccaccacgcaggtatggagctctctgatagaaaggtggtcgaaggagctttcaccgtgggagatttgccagtcctcttcactacttcgacactcgcaatgggggtcaatctgccagctcatctggtcgtcattaaaagtactatgcattacgcaggcgggctctttgaagaatatagtgaaactgacatccttcaaatgatcggtcgtgcgggacgtccccaatttgacacaacagccactgcagtgatcatgacccggctgtcgacaagggacaaatacattcaaatgctggcatgccgcgacactgtagagtcatcgctccacaggcacctgattgaacatctgaacgctgagatagtactgcatactatcactgacgtgaatattgctgtggaatggatcaggtcaacgttattgtatatccgtgcactgaaaaatccatcccattatggcttcgcctctggactcaataaggacggaattgaagcaaaacttcaggagctttgcttaaagaacttgaacgatctatcctctctggacctgatcaaaatggatgaaggcgtcaatttcaaacctacagaggcgggccggctgatggcatggtactatatcacttttgaaacagttaaaaagttttataccatcagtggcaaagagacgctgagcgatctggtaacgctcatcgcgggttgcaaggagttcctcgatatccaactcagaatcaacgagaaaaaaactctgaatactctcaataaggaccccaatcgcattacaattaggtttcctatggagggcagaatcaaaacccgcgagatgaaagtgaactgcctgatccaggcccagctgggatgcatcccaattcaggacttcgcactcacacaggatacagctaagatttttcgacatgggtctagaatcacaaggtggctttctgattttgtggcggctcaggagaaaaagttcgctgttctcctgaattccttgatcctcgctaaatgtttccgttgcaaactgtgggagaattcgctgcatgtctctaaacaactggagaaaataggaatcaccctgagtaacgctatagttaatgcagggcttacctcttttaagaaaatagaagaaaccgatgcaagggagctggaattaattctgaatcggcatcccccattcgggacccaaatcaaggagacggtgatgtatctgccaaagtatgaactgaaagtcgagcagattacgcggtactcggacacgacggcggagattctggtgacagtcatcctacggaatttcgagcagctgcagactaagcgaaccgcaagcgactcccactacgtgactctgattattggggatgcagacaatcaggtcgtctatttgcataagattaccgactctgtactgctgaaggctggcagttgggccaagaagatagctgtcaaaagagcacttaagtccgaagatttgtcaatcaatttgatctcttctgagttcgtgggccttgacatccagcagaaattgacagtgttttacttggaacctaaaaggttcggtaatcagattaccatgcagagaaagagcgaaacacaaatcagccacagtaagcactctgatatctctacgatcgccggcccaaacaagggtactacggccagcaagaagcctggaaatcgggagtgcaaccacttatgtaaaagtaagcacacctgcggccatgactgctgcaagattggtgtggcccaaaaatccgagatcaaagaatcaacaatttccagctacctctctgacctcagaaatcggaatgccgtgtcatctgttcctcccgtcaagaggctgaagatacaaatgaataagtctcagtcagtggacctaaaagagtttgggttcaccccaaaaccatcacttccgtctatcagccgttctgaatacctcaacatctctgaactgccaattatggaacaatgggaccagcccgaaatctacgggaaggtcaggcaggaaccgagtgagtaccaggataaagaagtcctcaacgtgaactttgaactgggcaacgaagtgtgggatgactttgatgatgagaatctggaggtaacctcgttctcaacagataccgaaaaaacgaagatcagcggcttcgggaataccctctcaagcagcactcgcggctctaaactacctctgcaggaaagcaagtcaaaatttcagcgagagatgagcaatagttttgtgtcttctcacgaaatgagtgatatcagtctgagcaacagcgctatgcctaaattttccgcttccagcatgactaagctgcctcaacaagcgggcaatgccgtgattgtgcactttcaggaaaggaaaccacaaaacctatcccctgagatcgagaaacagtgtttcacattttctgaaaaaaatccaaactctagtaactacaagaaagtcgatttcttcatcagaaattcagagtgcaaaaaggaggtggatttctctatgtatcaccccgatgacgaggctgatgagatgaagagtttgctcgggattttcgatggtatcttctag

SEQ ID NO: 30507 - DNA, 4308 bp, Artificial Sequence
  Description of Artificial Sequence: Synthetic coding sequence
atgctgaagtcaaacgattgcctattcagtctggagaacttattcttcgagaagccggatgaagttgagaatcacccagacaacgagaaatcactcgattggtttctacctccagcccctctcattagcgaaatccctgacacacaggagctcgaagaagaacttgagtcccacaaactcctcggccaggaaaagcgacctaagatgctcaccagcaatctaaaaatcactaacgaggacactaattacatctccctaacacagaagtttcagttcgcttttccttctgataaatatgagcaggatgacctgaatctggaaggagtgggtaacaatgatctcagccacatcgcaggtaagttgacatacgcatcacaaaaatataagaaccatatcggaaccgagattgcccctgagaagtccgtacccgacgatactaagttggtcaatttcgccgaggacaagggagagagcacctctgtattccggaagcggctttttaagatctctgataatattcacgggtccgcctactccaatgacaacgagcttgattctcacattggaagcgtgaaaattgtacagaccgagatgaacaagggaaaaagtcgcaactactcaaactctaagcagaaatttcagtacagcgctaatgtatttactgccaataacgctttttcagcgtcagagatcggggaaggtatgttcaaggctccatcattttcagttgcatttcagccacacgatatccaggaggttactgaaaacggactgggctccctaaaggccgtgacagagatccccgctaaatttagaagcatttttaaggaattcccttactttaactacattcagtcaaaagctttcgatgatctgctgtacacagatcgcaactttgtgatttgtgcccccacaggctcgggaaaaacggtggtcttcgagttggctataactcggttgctgatggaagtcccgctgccatggctcaacattaagatcgtttatatggcaccaatcaaagcgctgtgctctcagcgcttcgacgactggaaggaaaaatttgggcctattggtctaaattgtaaggagttgaccggcgatacggtcatggatgatttattcgagatacaacacgcacacatcatcatgactacccctgagaagtgggactcgatgacgcggaaatggagggacaacagcctagtgcagctcgtcaggctgtttttgatcgatgaggtgcatattgtgaaggatgagaaccggggccctacactagaggtcgtcgtgtctcggatgaagacggtccaatccgtgagtcagactctcaagaacacctcaacagctatcccgatgcgattcgtcgctgtgagtgcgactattcccaatgcagaggatatcgccgagtggctaagtgatggggagaggccagcagtgtgcctcaaaatggatgagtctcaccggccagttaagctgcagaaggtggtgctggggtttccctgctcttccaatcaaaccgaatttaaattcgatctgactctaaattacaagatcgccagcgtgatacagatgtattcagaccagaagcctactctggtcttttgtgctacccgtaagggagtccagcaagccgcttctgtgttagtgaaagacgcaaagttcattatgaccgtggagcagaaacagcgcctccagaagtatgcttactccgttcgagatagtaagctcagagacatcctcaaagacggggccgcctaccaccatgccggtatggaactgtctgacagaaaggtagtcgagggggcttttactgtgggggatctgccggtattgttcactacgtccacactggctatgggtgtgaacctgccagcgcacctggtggtcatcaaatctactatgcattatgctggcggcctgttcgaagagtacagcgaaactgatatcctccagatgattgggcgagcaggccggccccagtttgatactactgctacagcagtgattatgacaaggctctccacacgagacaagtatatacagatgctggcatgtcgagacacggtggagtcttctctacataggcaccttatcgagcatctgaatgctgaaattgttctgcacacaatcacggacgtcaacatcgcggtggagtggatccggagtacattactctacattcgcgcacttaagaatccctcccactatggcttcgcatcagggttgaataaggatgggatcgaggccaagctccaggaactgtgcttgaagaatctgaatgatctcagcagcctggaccttatcaagatggacgagggtgtcaactttaagcccacagaggcaggcagattaatggcttggtactatattaccttcgagactgtcaaaaagttttacaccattagcggtaaggagactctctccgatcttgtaaccttgattgcagggtgtaaagagttcctcgatatccagttacggattaacgaaaagaagacgttgaacacattgaacaaagatcccaatcgcatcacaatacgcttccctatggagggacgaattaagaccagagagatgaaagtgaattgcctgattcaagcccaacttggatgcatccctatccaagactttgccctgactcaggacactgcaaaaatctttcgacacggctcacggataacaaggtggcttagtgatttcgtcgccgcacaggagaaaaaatttgctgtgctgctcaacagtttgattctggcgaagtgcttcagatgtaagctgtgggagaattcactacatgtgtcaaagcaactcgaaaagattggaattaccttatctaacgcaattgtgaatgcaggcctgaccagtttcaagaagattgaagagactgatgcccgagagcttgagcttatcctgaaccgacaccccccttttggcactcaaattaaagagaccgtcatgtacctgcctaaatacgaattaaaggtcgaacagataacacggtattcagacacgacagcggaaatcctggtgaccgtcattttgagaaactttgagcagttacagacaaaacgcacagcatcagattcccactatgtgaccctgatcataggggatgcagacaatcaggtcgtttatcttcataagattacagactctgtcttgcttaaggccggtagctgggcaaaaaagatcgctgtcaagagggcactcaagtcagaggacctttctatcaaccttatctccagcgagtttgtaggcctagacatccaacagaagctgacagtcttctacctcgaaccaaagcgtttcgggaatcagattaccatgcaaagaaagtcagagacacagatttctcatagcaaacactctgatataagcacgattgcaggcccaaacaaagggaccacggcctctaagaaaccaggcaaccgcgaatgcaatcacctgtgtaagtctaagcatacttgtgggcatgactgttgtaagattggagttgctcagaagtctgagatcaaagagagcaccatctcttcctacctcagcgacttacgcaacagaaatgccgttagctctgttccgcccgtcaagcgactgaagattcaaatgaataagtctcagagcgtggacctgaaagagtttggcttcacacccaagccctcactgccatctatctcccggtccgagtatttaaacattagcgagcttccgattatggaacagtgggaccagcctgaaatctatggaaaggtgcgtcaggaaccctccgagtaccaggacaaagaggtgctcaatgtgaactttgagctcggtaatgaggtctgggatgacttcgacgatgagaatttagaagtcacatcttttagcaccgacaccgaaaagaccaagatcagtggctttggcaataccttatcctcctctacccgcggcagcaaattacctctgcaggagtctaagtccaagtttcagcgggagatgtcgaactccttcgtgtcaagtcacgagatgtccgatatatccctcagtaactccgcaatgccaaaattctctgcttccagcatgacaaaactgcctcaacaagcggggaacgcagtgattgtgcattttcaagagcggaagccgcagaatttgagtcccgaaattgaaaagcagtgtttcaccttcagcgaaaagaaccccaactcaagcaattacaaaaaagtggactttttcattaggaattccgagtgcaaaaaagaggtggacttctctatgtaccaccctgatgatgaggccgatgagatgaagagcctattagggatcttcgatggcattttctag

SEQ ID NO: 30508 - DNA, 417 bp, Artificial Sequence
  Description of Artificial Sequence: Synthetic coding sequence
atgctgaaaagtaacgattgcctattcagtctcgaaaacttattctttgagaaacctgacgaggtggagaaccaccctgacaacgagaaaagtctcgactggtttctgccacctgcgccgcttatctcagaaatcccagacacccaggagctggaagaggagcttgaatcccataaacttctggggcaagaaaaaagacctaaaatgctgaccagtaatctgaagattaccaacgaagacacaaactatatctctctcactcaaaagtttcagtttgcattccccagcgacaagtacgagcaagatgatctcaacttggagggagtgggcaataacgacctctctcatattgcaggcaagctaacttacgccagccagaagtacaagaatcacatcggcacggagatcgcaccttag

SEQ ID NO: 30509 - DNA, 2187 bp, Artificial Sequence
  Description of Artificial Sequence: Synthetic coding sequence
agccaggcatggagatcgtccgaggggctgattaatcggagatctacaggtctgggagctgtcagacgggagatatatgataaagtccagttctccacaatgctcaaatctaatgactgtctgttcagcttggagaacttgttcttcgagaagcctgatgaggttgaaaaccatcccgataacgagaagtctctggactggtttttgcccccagccccactgatttccgagatccccgacacacaggagttggaagaggaactagagagtcataaactgctgggtcaggagaaaaggcccaagatgctgacttccaatttgaagatcaccaacgaagacacgaactatataagtctgactcaaaaattccagttcgccttccccagcgacaagtacgagcaggatgacttgaacttagagggggtgggaaacaatgatctgtcacacatcgccggcaagcttacttatgccagtcagaagtacaagaatcacatagggacagagatcgctcctgagaagagtgtgccagatgatacaaagctagtcaacttcgccgaggacaaaggggaatctacgagtgtttttaggaaacggctgtttaaaatttctgataacatacatgggagtgcgtattctaatgacaacgaactcgattcacatattgggtcagtcaagatcgtccagaccgagatgaataaaggaaagtcgcgaaactacagcaattcaaagcagaagtttcaatactccgcaaacgtgtttacggctaataatgcgttcagcgccagcgagattggagagggtatgtttaaagcaccctccttctctgttgccttccaacctcacgacattcaggaggtgacagagaacggcctgggatccttgaaggcggtcactgaaatcccagcaaaattccgatccatctttaaagagttcccatacttcaactacattcagtccaaggcgtttgatgaccttctgtacactgatcgcaattttgttatctgcgcccccactggtagcgggaagaccgtggttttcgaattagctatcacaagactgctgatggaagttcctctcccatggttaaacataaagatcgtctatatggcaccaatcaaggcactttgttctcagagatttgatgactggaaggagaagtttgggccaataggtctcaactgcaaagagctaacaggcgacactgtgatggacgacctgtttgaaattcagcatgcccacatcattatgacaaccccagaaaagtgggattctatgacccgcaagtggagggataacagcctggtccaattagtgcgcctctttctcatcgacgaggtccacattgtgaaggatgagaatcgcgggccaaccctggaggttgtcgtaagtaggatgaaaacagtccagtccgtatcacagacactcaagaacacctctaccgctattccaatgaggtttgtggcagttagtgcaaccatccccaatgcggaagatatcgctgaatggctctcagatggggaacgacctgcggtgtgtctaaaaatggatgaaagccatagaccggttaagctccagaaggttgtcctaggattcccatgtagtagtaatcagaccgaatttaaattcgatcttacactgaactataaaatagcttctgtgatccagatgtacagtgaccaaaagcctacgttggttttctgcgcaacacgcaagggggttcagcaagcggcctcggtgctggtcaaagatgcaaagttcataatgacagtagagcaaaagcaacggcttcagaaatatgcctactcagttagggattcgaaactgagggatatacttaaggacggggctgcctatcaccacgcaggcatggaattgtcggatagaaaagtcgtcgaaggggccttcaccgtcggagacctacctgtgctcttcacaacttcaacactggccatgggcgtcaacctaccagcccacctggtcgtgattaagagcaccatgcattacgccggcggcctattcgaggagtatagcgagaccgatattctgcagatgatcggaagggcaggcagacctcagtttgatacgaccgctacggcggtcataatgacccgcctttctactcgggataagtacatccagatgttagcctgtcgcgacacagtggagagcagactacatgcacactag

SEQ ID NO: 30510 - DNA, 294 bp, Artificial Sequence
  Description of Artificial Sequence: Synthetic coding sequence
atgtcttctgacaaccagtggagtgccgacgaggatgaagggcagctgagtaggctgattagaaaatccagggatagcccttttgtccccataggcatcgcaggctttgttacggtagtatcctgcggactctacaagctgaaataccggcgggatcagaagatgtcaattcacctgattcacatgcgcgtagccgcacaaggattcgtggtcggcgccgtgacattgggggtcctctatagcatgtacaaggattatattagaccgagattcttctctgaatcaaaaaaatag

SEQ ID NO: 30511 - DNA, 603 bp, Artificial Sequence
  Description of Artificial Sequence: Synthetic coding sequence
atggctaagggagacccgaagaagcctaaggggaagatgtccgcgtatgccttctttgtgcaaacatgtagggaggagcacaagaaaaaaaacccagaggtgcctgttaatttcgcagagtttagcaagaagtgtagcgaaagatggaaaactatgagcggaaaggagaagtctaagttcgatgagatggccaaagccgacaaagttcgctacgatcgcgaaatgaaagactacggccctgctaagggggggaaaaagaagaaggaccctaacgccccaaaacgacctccttctggctttttcctgttctgttccgagtttcgccccaagataaagtccacaaatccaggcatcagtatcggggatgtggcgaaaaagctgggggagatgtggaacaatttgaatgatagcgaaaagcaaccctacatcaccaaggccgccaagttgaaggaaaagtacgagaaggacgtcgccgattataaatctaaaggcaagttcgacggcgctaagggacccgctaaggtggcacgaaagaaggtcgaagaggaggatgaggaagaagaggaagaggaggaggaggaggaggaagaggaggacgagtag

SEQ ID NO: 30512 - DNA, 267 bp, Artificial Sequence
  Description of Artificial Sequence: Synthetic coding sequence
atgcctaagaggaaggctaagggcgacgccaagggcgacaaggctaaaagacggtctacacgcctgtcagctaagcccgctccccctaagccacagccgaagcccaaaaaggcccccgccaagaaaggagaaaagatacctaaaggcaagaagggcaaggccgacgccggcaaggagggaaacaacccagccgaaaatggcgacgctaaaaccgatcaggcgcagaaagccgagggggccggggtggcgaaagccagcgatgagtag

SEQ ID NO: 30513 - DNA, 576 bp, Artificial Sequence
  Description of Artificial Sequence: Synthetic coding sequence
atgggtaagactaattcaaagcttgccccagaagtgttggaagacctcgtgcagaatactgaattctcagaacaggagctgaaacagtggtataagggcttcctgaaggactgtccctcaggaatcctgaacctggaagagttccagcagttgtacatcaagtttttcccctatggggatgcgagcaagtttgcccaacacgcattccgcactttcgacaagaacggagacggcacaatcgacttccgcgaattcatttgcgctctgagtgtgacctctagaggttcattcgagcagaagctgaattgggcatttgagatgtacgacctggatggtgatggtagaattaccagactggagatgctggaaatcatcgaagcaatctataagatggtggggaccgtgattatgatgaggatgaaccaggacggactaaccccacaacaacgggtggataaaatctttaaaaagatggatcaagacaaggacgatcagatcacactggaagagttcaaagaggccgctaagtcggatccttccattgtgctgctgcttcagtgtgacatgcagaagtag

SEQ ID NO: 30514 - DNA, 552 bp, Artificial Sequence
  Description of Artificial Sequence: Synthetic coding sequence
atgggtaagaccaattctaaacttgccccagaagtattagaagacctcgtccagaacactgagtttagcgaacaagaactcaaagactgcccatctgggatcctcaatctcgaggagttccagcagctgtacataaagttctttccttatggagatgcttctaagttcgctcaacatgccttccgcaccttcgataaaaacggagacggaacaatcgattttcgggagtttatttgtgcgctgagcgtgacgtcacggggctccttcgaacagaaactaaattgggctttcgagatgtacgacctggacggggatggccgaattacaaggttagagatgctggagattatagaggccatctacaaaatggtggggaccgtgattatgatgcgcatgaatcaggacggcctcaccccgcagcagagggtggacaagatatttaaaaagatggaccaggacaaggacgaccagatcacactcgaggaattcaaggaagctgccaaatctgacccttcaatcgttctcctactccagtgcgatatgcaaaaatag

SEQ ID NO: 30515 - DNA, 1065 bp, Artificial Sequence
  Description of Artificial Sequence: Synthetic coding sequence
atggccgaggtgctgcgcaccctagccggaaagcccaagtgtcacgccctccgcccaatgatcctcttcctgattatgctggtactcgtgctcttcggctatggggtgctgagtcctcggagcctaatgcctggcagtcttgagagaggtttttgcatggccgttcgggagcccgaccacctccagcgtgtctcactgcccagaatggtctacccccagccgaaagtattgacgccttgcagaaaggacgtccttgtggtgaccccctggttggcccccattgtctgggaaggcacctttaatattgacatcttgaatgagcagttccgtttgcagaacactacaataggcctcacagtatttgctatcaaaaaatacgttgcgtttctaaagctgtttttggagaccgccgagaaacactttatggtaggacaccgggtgcattactatgtgtttaccgaccagttggcggccgtccctagagtaaccttgggaaccggccgccagctgagcgtgttggaggtgagggcatacaagcgctggcaagacgttagcatgaggaggatggagatgatatcagatttctgtgagaggaggttcctgtctgaagttgactatctggtatgcgtggacgtggacatggagtttcgcgatcatgtgggagtggaaatcctgacgcccctgttcggcacattacatccagggttctacggctccagcagagaggctttcacctacgagaggcggccgcagagccaggcctacatccctaaggacgaaggagacttctattacctcggtggtttcttcggaggatctgtccaggaagtgcagcgcctaacaagagcatgccatcaggctatgatggtggatcaggcaaacgggattgaagccgtgtggcacgatgagtcccacctgaataagtacctgttgcggcacaaacccaccaaggtactgtcccctgagtatctgtgggaccagcaactgctggggtggcccgcagttctccggaagctccgatttaccgccgtgcccaagaaccaccaagccgtgcggaacccatag

SEQ ID NO: 30516 - DNA, 126 bp, Artificial Sequence
  Description of Artificial Sequence: Synthetic coding sequence
ctggaggagcaacccgaatgtagggaagaaaaaaggggaagtctgcacgtttggaaatccgagctcgtggaggtggaggacgacgtgtacctgcggcattcgagcagtttaacatatcgcctctag

SEQ ID NO: 30517 - DNA, 3648 bp, Artificial Sequence
  Description of Artificial Sequence: Synthetic coding sequence
atgacctctactggccaggatagcaccactacaagacagagaaggagtaggcagaatccacaaagccccccgcaagactcaagtgtgacttccaagcgaaatataaagaagggcgctgtcccccggagtatccccaaccttgccgaggtgaaaaagaagggaaagatgaaaaagctaggtcaggcaatggaggaggacctcattgtcgggctgcaggggatggacctgaacctggaggctgaagccctggcgggaacaggtctggtcctggacgagcagctaaatgaatttcattgtttatgggacgattcttttccggagggccccgagcggctccatgcgattaaggaacagctgatccaggagggtctgctggatcgttgcgtaagtttccaggcacgtttcgcggagaaggaagaactaatgttggtgcattcactggaatatatcgacctgatggaaactacccagtacatgaatgaaggagaactgcgcgtactagcagatacatatgacagcgtctatttacatcctaatagctactcctgtgcatgcttggcttccggctcagtactgagactggttgatgccgtgctaggtgcggagatcaggaatgggatggctattatcagaccccccggacaccacgcccagcactcactcatggatggctactgcatgttcaaccacgtagccgtggccgctcggtacgcccaacaaaagcaccgtatccgtcgggtcttgattgttgattgggacgttcaccacggccagggcacccagttcactttcgaccaggaccctagtgtcctgtatttcagcattcatagatatgaacagggtcggttttggcctcatctgaaggcttccaattggagtaccaccgggtttggacagggccagggatacaccattaatgtgccttggaaccaagttgggatgagggacgctgactacatcgccgccttcctccatgttctgctgcctgttgccttggagtttcagcctcagctggtactagtcgctgccggcttcgacgcgctgcagggagatccaaaaggcgaaatggcagcaacccccgcaggcttcgcacaactaacccatctactgatgggtctggctggtgggaaattaattctttcactggaaggaggctacaatctgcgcgcactggctgaaggagtaagcgcatcgttacatacactgcttggggacccttgtcctatgctggaatcacccggagcaccttgccgaagcgctcaggcaagcgtgagttgcgccctcgaggccctggagcctttttgggaagtactcgtgagaagcaccgagaccgtagaacgagataacatggaggaggataatgtcgaggaatctgaggaagaaggcccgtgggaaccaccggtgcttcctatactgacatggccagtgctgcagagccgtacaggcctagtttatgaccagaacatgatgaatcactgcaatctatgggactctcaccaccccgaagtgccacaacgcatcttgcggatcatgtgccggctagaggagctggggctggcagggagatgcctcacattaacgccacggcctgccaccgaagctgagctcctgacatgtcacagcgccgaatacgttggccatctgcgggctacggagaagatgaaaactagggaacttcacagggagtcaagcaacttcgactcgatctacatttgccctagtacatttgcttgcgcccagttagcgacaggcgcagcgtgccgcctggtggaggctgtgctgtcaggggaggtcctcaacggagctgctgtggtgagacctcctggacatcacgcagaacaagacgccgcttgcggcttttgctttttcaattctgtcgctgtggcagcaagacatgcccagaccatttcaggacacgccctccgtattttaatcgtcgattgggacgtccaccacgggaacggcacccaacatatgttcgaagacgaccccagcgtgttgtacgttagcctgcataggtatgaccatggcactttcttccctatgggtgatgagggagcttcatcccagatcggtagagcggctggcaccggattcacagttaatgttgcctggaacggacctcgtatgggcgacgctgactacttagctgcctggcaccgccttgtgttgcccatcgcatatgaatttaaccccgagctcgtcctggtctcggcgggtttcgatgcggcaaggggggatcctctcggagggtgccaggtgtcacctgagggatatgctcatctcacacacctgctgatgggcctggcatctggtcgcatcattctgattctggagggtggctataatctaacttcaatctccgagagtatggccgcttgtacccggtccttacttggagatcccccccccctgctgactcttcctaggcctcctctcagcggggctctagccagtattacagaaaccatacaggtccatcggcgctattggcgaagcctccgggttatgaaagttgaagatcgggagggccctagcagctcaaaacttgttactaagaaggccccccagccagcgaagccccggcttgcagagcgaatgacaacacgtgagaaaaaggtcctggaagcaggcatgggaaaagttactagcgcatctttcggagaggagtcgactcctggccagacgaattcagagacagccgtagtggctcttacgcaagaccagccaagcgaggctgctacgggaggagctacactggcccagactatttcagaggcagctattggtggtgcgatgttgggccaaactacgtctgaggaagccgttgggggggccacacccgaccagacaacaagcgaggagacagtggggggtgcgatcttggaccagacgacatcagaggacgcagttgggggcgcaactttagggcagacgacatctgaagaggccgtcggaggcgctacactggcccagacgacaagcgaggccgccatggaaggggccaccctggaccagactacatcagaagaggcacctggcgggaccgagcttatacagacaccactagcgtcctcaaccgaccaccaaacccctccaacgtccccagtccaggggactacgccccaaatcagtccctcaacccttattggtagtttgcggaccttagaactgggttcagagagtcagggggccagcgagagccaggcccctggcgaggagaacctgttaggggaagccgcaggcgggcaggacatggcagactcgatgctgatgcaaggttcccgcggcttgaccgatcaagctatcttctacgcagttacaccactcccctggtgcccacacctggtggccgtttgtccaatacctgccgcaggcttagatgtgacccagccttgcggagactgcgggacaatacaggaaaattgggtgtgcctgtcctgctaccaagtctattgcggacgatatatcaatggacatatgttgcagcaccacggaaactctggacatcctctggtgctctcctatattgatctgagtgcttggtgctattactgccaggcctacgtacatcaccaagcactcctcgatgttaaaaacatcgcccatcagaacaagttcggcgaagatatgcctcatccccactag

SEQ ID NO: 30518 - DNA, 312 bp, Artificial Sequence
  Description of Artificial Sequence: Synthetic coding sequence
atgagcgggagagggaaaggaggaaagggtcttggtaagggcggcgcaaagaggcatcgcaaggtcctgcgggacaatattcaggggattaccaaaccagcaatccggcggctcgccagacgtggcggagtcaagcgtatcagcggccttatatatgaagaaacaaggggcgtgctaaaagtgtttttagaaaacgtcatcagagacgccgtgacttacactgaacacgccaagcgaaaaacagtgacagcaatggatgttgtgtatgccctcaaaagacagggacgcacactgtacggatttggcggttag

SEQ ID NO: 30519 - DNA, 312 bp, Artificial Sequence
  Description of Artificial Sequence: Synthetic coding sequence
atgtcaggcagagggaagggggggaagggactcggtaagggcggcgcaaagagacaccggaaggtactgagagacaacattcagggaatcacaaagcctgctatccggcgacttgcccgacgggggggtgttaaacggatttcagggctgatatatgaggagaccagaggcgtccttaaagtctttctggagaacgtgatccgcgacgccgtgacatatacagagcacgctaaaagaaagacagtgaccgctatggatgttgtatatgcactcaagcgccaaggccgcacactgtatgggtttgggggatag

SEQ ID NO: 30520 - DNA, 2145 bp, Artificial Sequence
  Description of Artificial Sequence: Synthetic coding sequence
atgcctgccgccgcaggtgatgggcttctgggcgagccagctgctccaggaggcgggggcggcgctgaggacgcggctaggccagctgccgcctgtgaagggtcatttctgcccgcttgggtctcaggtgtcccccgggagagactgagggacttccaacatcacaaaagggtgggtaactatctcatcggaagccgcaagctgggagaggggtcctttgccaaagtgcgggagggcctgcacgtcctcaccggagagaaagtggcgatcaaagtgatcgacaaaaaacgggcgaagaaagatacttacgtaactaagaacttacggagagagggacagattcagcagatgatcagacaccctaatattacccagctactcgacatcctggagaccgaaaactcttattatctcgttatggaactttgtccaggaggcaatctgatgcacaagatctatgagaagaagaggctggaagaatcggaggcaagacgatacatacgccaacttatctccgcagtagagcatctgcaccgcgccggggtggtacaccgagacctcaaaatcgagaacctgctactggatgaggacaataatatcaaattgatcgatttcggcctatctaactgcgcagggatcctaggatatagtgatccttttagcacccagtgcgggtcacctgcttatgctgctcctgaacttctggcaagaaaaaagtacggcccaaaaattgatgtatggtctataggggtaaatatgtatgcaatgctcactggaaccctgcctttcaccgtggaaccattttccctgagagcgctctaccagaaaatggtggataaggaaatgaatcccctacccacgcagttatccaccggggcaattagcttcctgaggtctctcttagaacccgatccagtgaagcgacccaacatccagcaggccctcgccaataggtggctgaatgagaactacactggcaaggtaccctgtaacgtgacctacccgaaccgcatctccctagaagatctcagtccctctgtcgttctgcacatgactgagaagctcgggtacaaaaacagcgacgttatcaatactgtcctgtccaatcgggcgtgtcacatcctggccatttatttcctcttgaataagaagctcgagaggtatctgagcggtaagtcagacatccaggattctctctgttataaaactcgcttgtaccagatcgagaaataccgggctcctaaagagagctatgaagcatcccttgacacatggacacgggacctggagttccacgctgtacaggataagaagccaaaggagcaggaaaaaagaggtgatttcctgcatcgtcctttctccaaaaagctcgataagaatcttcccagtcacaaacaaccatccggatcactcatgacccagatccaaaatacaaaagccttgttgaaggatcgtaaggcatctaagtcctcattccctgataaagatagcttcggctgccggaatattttccgaaaaacctctgactcaaactgtgttgcttctagttctatggaatttatccccgtgcctcctccaagaacacccagaatcgtaaaaaaacctgagcctcatcagccgggccctggttcaactgggatcccacataaggaagatccactcatgctggatatggtgaggtcatttgagagtgtggaccgcgacgatcatgtggaagtattgtccccaagccaccattatcgcattctgaacagcccagtgtcccttgcccgacggaattcgtcagagcgcaccttaagccccggtctgccttcaggatctatgtctccactgcacacacctctgcacccaactctcgtctctttcgcccacgaggacaagaacagcccccccaaggaggagggattgtgttgtccaccaccagttccctctaatggacctatgcagccgctgggcagccccaactgtgttaagagcaggggtcggttcccaatgatgggtattgggcagatgttaagaaagaggcaccaaagtttgcagccctccgcagaccgaccactggaagcgtcactgccaccgctgcagcccctggctcccgtgaacctggccttcgacatggctgacggcgtcaagacccagtgctag

SEQ ID NO: 30521 - DNA, 762 bp, Artificial Sequence
  Description of Artificial Sequence: Synthetic coding sequence
atggggctctcccccggtgccgagggcgagtacgctctacgtctgcctcgcatacctccacccttgccaaagccggcctccagaaccgcatctacaggccctaaggaccagcccccagcactcagaagaagcgccgtcccccactcaggacttaactctatctctcccctcgaactcgaggaatccgttggctttgctgctctcgtgcagctaccagcaaagcagccccctccgggcaccttagaacaggggcgatccattcagcaaggggagaaggccgtggtgtcactagagactacgccctcacagaaggcagactggtcgtccatacctaaacctgaaaatgaagggaagctcatcaagcaagcagcagagggcaaacctcgcccaagacccggtgacttaattgagatatttcgtatcggctatgaacattgggccatatacgtggaggatgactgcgttgtgcacctggcacccccctcagaagaattcgaggtggggtcaatcacatccatattctcaaatagggccgtggtgaaatactcaaggttagaggatgtgcttcacggttgctcctggaaggtgaataataaactggacggcacctacctccccttgccggtggacaaaatcatccaacggacaaaaaaaatggtgaataagatcgtgcagtactctctgatcgaggggaactgcagggccagaccagacggacgcagcgaagggtgttggtcttcatacttttcctgctctggctag

SEQ ID NO: 30522 - DNA, 810 bp, Artificial Sequence
  Description of Artificial Sequence: Synthetic coding sequence
atgggcctctctcctggcgccgagggcgagtatgcgctgcggctcccccgcatccccccacccctgcccaagccggcttcgagaactgcttccactggacccaaagatcagcctcccgctctgaggaggagtgccgtaccgcattcagaagagtccgttggttttgccgcgctcgtgcaattgcccgccaagcagcctccgccagggaccttagagcagggccgcagcatccaacagggggagaaggccgtggtgagcctggaaacaactccgtcacagaaggccgattggagctctattccaaagccagagaatgaggggaaactcattaaacaggctgctgaaggaaagccacggccacgacccggtgacctgatcgagatattcaggatcggatacgagcactgggcaatctatgtcgaggatgattgtgtggtccacctggccccaccatccgaggaattcgaggttggcagcattacttcaattttcagtaaccgtgccgtcgtgaaatatagcaggctcgaggatgtgctgcacggctgcagttggaaagtgaataacaaactcgatggtacttacctgccgcttcccgtcgataagatcatccaacgcaccaagaagatggtcaataagattgtgcagtactctctgattgaaggaaactgtgagcattttgtcaatgggctgcgctacggggtgcccagaagccaacaggtcgagcatgcactgatggagggagcaaaagcagctggagcagttatttctgccgtggtcgatagcatcaaaccaaaacccatcactgcatag

SEQ ID NO: 30523 - DNA, 840 bp, Artificial Sequence
  Description of Artificial Sequence: Synthetic coding sequence
atgggcttgagtcctggcgctgagggggaatacgcccttcgcttgccgcgcatcccgcccccactgcccaagccagcctcccgaacagcgtccacagggcctaaggaccagcccccagctctgcggcggagcgctgtgccacactcaggactgaactcaatcagcccccttgagctggaggaatccgtggggtttgccgctctggttcaactcccagcaaagcagcctccgcctggaactcttgaacaaggccgctctatccaacaaggagagaaggccgttgttagcctggagacaacaccatctcaaaaggcggattggagctcaattccaaaaccggagaatgaaggaaagcttattaagcaggctgctgaaggcaagcctaggccaaggccaggtgatctgatcgaaattttccggatcggttatgagcactgggcaatctatgtagaagatgattgcgtggtgcaccttgctcctccctcagaggaatttgaggtcggcagcatcacatcaattttcagtaatagggctgtcgtgaagtactcccgactggaagacgtactccatggatgctcttggaaagtcaacaataaactagatgggacttaccttcccctgcctgttgacaaaataattcaacggacaaagaagatggtaaacaaaattgttcagtattccctgatagagggcaactgcgagcactttgttaatgggctgagatacggggtccctcgttcacagcaagtggagcatgcactaatggagggcgctaaggcagccggggcggtgattagtgccgtcgtggattctattaaacccaaacccatcacagcctag

SEQ ID NO: 30524 - DNA, 2961 bp, Artificial Sequence
  Description of Artificial Sequence: Synthetic coding sequence
atggacagaatggcgtcatccatgaagcaggtgcccaaccccttgcccaaggtactgtctaggaggggggtgggcgccggcctggaggcggcagagcgtgaaagtttcgaacggactcaaacagtcagcatcaacaaagcgatcaatacgcaggaagtagctgtgaaggagaaacacgcccgtacctgcattttggggacgcaccacgaaaagggggcccagaccttctggtcggtggtgaatcggctccctctctcatcaaacgctgtgctctgttggaagttttgccatgtgttccacaagcttctcagggatggacatcccaacgtcctaaaggatagcttgcgttataggaatgaactcagcgacatgagtagaatgtggggtcatctgtctgagggatacgggcagctgtgctctatttatctcaagctgttgcggacaaagatggaatatcacacaaaaaatcccagatttcctggcaacttgcaaatgagtgatcggcagctggacgaagcaggcgagagcgatgtgaataatttttttcagctgacagtcgaaatgttcgactaccttgaatgtgaacttaaccttttccagactgtgtttaactcacttgacatgtctcggtcagtttccgtgaccgcggccggacaatgcaggctggctcccctcatacaggtgatccttgactgtagtcacctgtatgactatactgtgaagctgttgttcaagctgcactcgtgtttgcctgcagatacattgcaaggccaccgggacagatttatggagcagttcaccaaattaaaagacctcttttatagatcctccaatttgcagtatttcaaacgactgatccagattcctcaactccccgagaaccccccaaatttcctgagagcctccgccctgtctgagcatattagccctgtagtagtgattcctgcagaggcttcatcacccgactcagaaccagtgctcgaaaaagatgacttgatggatatggacgcaagccaacagaatctgtttgacaataagttcgatgacatatttgggagttccttcagcagtgatccctttaacttcaatagtcagaatggggtaaataaggacgagaaggaccatctcattgagaggttgtatagagaaatatcagggttaaaggcgcagcttgaaaatatgaagacagaaagccaacgggtggtgttacagttaaaaggccacgtgtccgagctggaagcagacctggctgaacagcaacaccttcgtcaacaggccgcggacgattgcgagttcctgcgggctgaactcgacgaactaaggcggcagagagaagacacagaaaaggcccagcggtcactatctgagattgaaaggaaagcccaggccaacgagcagcgatacagcaagttgaaggaaaaatattcagaattggtccagaaccatgccgacctgttgagaaaaaacgctgaggtgactaagcaggtttccatggcaagacaggcccaggtcgacctggagcgagagaagaaagagctcgaggatagtttggagcgaatttccgaccaggggcaaaggaagacccaggagcagctggaagtcttagagtcccttaaacaggagctcgccactagccagcgtgaactccaggtcctgcaggggagcctggagacatccgcacaatccgaggccaactgggctgctgagttcgctgagctggagaaagaaagagatagtcttgtgtctggggctgcacatcgcgaggaggagttgtcggcactgaggaaggagttgcaagacacgcaattgaagctcgccagcaccgaagagagcatgtgtcagctggccaaagaccaaaggaagatgttgctcgtcggaagcaggaaggccgcagaacaagtgattcaggatgccctgaaccagctcgaggaaccgccccttatatcttgcgcggggagtgctgaccatctgctgagcaccgtgacttcaatctcgtcatgtatcgaacaactggagaaatcatggagccagtacttggcgtgtccagaggatatttccggattgctgcattcaatcacactgttagcccatctcactagcgacgccattgcgcacggcgcaacaacctgtttacgtgcacccccggagccagcagacagcctgaccgaagcgtgcaagcaatacggaagagagacacttgcatatctggcatcactggaggaagagggaagcctcgagaacgctgattctaccgcaatgaggaactgcctgagcaaaatcaaggccatcggcgaggagttgctgcctcgggggctggacatcaaacaggaggagttgggggacctggtggataaggaaatggccgctacaagcgcagcaatagagaccgctaccgctaggatcgaagggacagcaagccccaaagagttctacgctaagaactcacgctggacagaagggcttatctctgcttctaaagccgtgggctggggcgcaactgttatggtggacgccgctgatttggtggtccagggaagaggcaaattcgaagaattaatggtctgtagtcacgagatagccgcatcaactgcccaactggtggccgcatccaaagttaaggctgacaaagactcacccaatctcgctcagctgcaacaggcatccagaggtgtgaatcaggcgactgccggggtggtagcctctaccatatccggaaaaagccaaatcgaagagactgacaatatggattttagtagcatgacgctcacccagatcaagcggcaggagatggattcacaggtccgagtactcgagctggaaaacgaactgcagaaagagcgacagaaactgggggagctaaggaagaaacactacgagttggcaggagtagccgaaggatgggaggaaggtaccgaggcatcgccgccaaccttacaggaagtggtcactgaaaaagaatag

SEQ ID NO: 30525 - DNA, 1308 bp, Artificial Sequence
  Description of Artificial Sequence: Synthetic coding sequence
atggccgcccaccttcttccaatttgtgccctgttcttgacgctcctggacatggcccaggggtttcgagggccacttttgccgaatcgaccattcacaacagtatggaacgccaatacacagtggtgcctggaacggcacggggtggatgtggatgtaagtgtgttcgatgttgtcgcaaaccctggccagacatttaggggaccggacatgacaatattctacagcagtcagctgggcacttatccctattacaccccaacaggtgagccagtgtttggtgggctgcctcaaaacgccagccttatcgcccatttggctcgaacttttcaagacatactcgcggccattcccgcccctgactttagcggcctggccgtgatcgactgggaggcttggcgcccaagatgggcctttaattgggataccaaagacatctataggcagcggtctagggcgcttgtccaggcccaacatcccgactggcccgcaccacaagttgaggccgtggctcaggaccagttccagggtgctgcccgcgcctggatggctggaaccctgcagctgggccgcgctctccgccctagaggcctgtggggattctacggattccctgattgttacaattatgactttctgtctccgaactacacggggcagtgcccatccgggatacgtgcccagaatgatcagcttgggtggctgtggggacagtcgcgcgcgctctacccttccatttacatgccagccgtcctggagggcactgggaagtcccagatgtacgtgcaacaccgcgtagctgaggcctttcgggtggcagtggccgctggagatccaaatctacctgtgctgccctacgtccaaattttttacgacactacgaaccattttttacctctcgacgagctagagcactcactgggtgaaagtgccgcccaaggcgccgcaggcgtggtgctttgggtcagctgggaaaacactagaaccaaggaaagctgtcaggctatcaaagaatacatggatacaactctcggcccgttcatcttgaacgtgacatcgggtgctctcttgtgttctcaggccctgtgtagcggccacggtcggtgtgtgcgacgcaccagccatccaaaagctctcctgttactgaaccccgcatcgttcagtatccagctcaccccaggggggggacccctatcacttcgcggtgccctgtcactggaggaccaggcgcagatggcagtggaatttaaatgtagatgctatcctggctggcaggcaccttggtgtgaaagaaagtcaatgtggtag

SEQ ID NO: 30526 - DNA, 1308 bp, Artificial Sequence
  Description of Artificial Sequence: Synthetic coding sequence
atggcagcccacctgctcccgatttgtgccctctttctcacattgctggatatggcacaaggttttagaggaccactcctcccaaatcgtccctttaccacggtctggaacgcaaacactcaatggtgcttggaaaggcacggcgtggatgtggatgtcagtgtgtttgatgtcgtcgccaatccggggcagactttcagagggccagacatgaccatcttctacagttcccagttagggacctacccttactacacccccacaggtgaacccgtattcggtggcctccctcagaacgcctcactgatcgcccatcttgcccgcacatttcaggatatcttggctgcaatacccgcacctgacttttctggcctggctgtgatcgattgggaagcttggcgaccccgttgggcgttcaactgggatactaaggacatatatcgtcaacggagtcgtgctctcgtacaagctcaacatcctgactggccagcccctcaggtggaagccgtggcccaagatcagtttcaaggtgctgctcgcgcttggatggcaggcaccctccagctcgggagagctctgcggcctagaggtctatggggcttctatgggtttcctgattgttacaattacgattttttatcccccaattatactgggcaatgtccctctggcattcgagcccagaatgatcagttgggatggctctggggccagtcgagggcattgtatcccagtatttacatgcctgccgtgcttgaggggacaggaaagtcacaaatgtacgtccagcaccgagtggccgaagcttttagagtggctgtcgcagctggcgacccaaatctccccgtcctgccctacgtgcagatattctacgatactactaatcacttcctcccgctggacgagctggaacacagcctaggggagagtgccgctcaaggggcagccggggtggtattgtgggtctcgtgggagaacaccagaacaaaggagagctgccaagccatcaaagaatacatggacaccaccctcggccccttcatcctcaacgtgactagtggcgctctgctttgttcgcaggctctctgttcaggccacggtaggtgcgtgcgcagaacttcccacccaaaggcccttctcttgcttaatcccgccagcttttcaattcagctgacaccaggagggggccccctgagcttacggggcgctctcagccttgaagaccaggcacagatggccgtggagttcaagtgcaggtgctacccgggatggcaggcgccttggtgtgagcgaaaatccatgtggtag

SEQ ID NO: 30527 - DNA, 1422 bp, Artificial Sequence
  Description of Artificial Sequence: Synthetic coding sequence
atgagagccgggccaggtcccactgttacgcttgcattggttctcgcagtgagctgggctatggaattgaaacctaccgccccacctatattcaccggacgcccctttgtggtcgcctgggatgtgcctactcaggattgcgggcctcgtctcaaagtcccccttgacctgaatgcatttgatgttcaagcctctcctaatgagggctttgtcaaccaaaatattaccatcttttaccgggaccggttggggctttatccacggttcgactctgctgggcgctctgtgcacggcggggtgcctcagaatgtgtctctctgggcacataggaaaatgcttcagaagcgtgtggaacactatattcggactcaagagtcagcaggtctagctgtaatcgattgggaggattggcgaccagtctgggtaaggaactggcaggataaggacgtgtatcgcaggctaagcagacagctggttgcttctcgtcacccagactggccccccgaccgaattgtgaaacaggcccagtatgaattcgaattcgctgcccaacagttcatgcttgaaaccttgcgctacgtgaaggccgtgcggcctcggcatttatggggattttacttatttccggattgctacaaccacgattatgtgcaaaactgggaatcgtataccggcagatgtccggatgtcgaagtcgctcggaatgaccagctggcatggttatgggctgagagcacagccctatttcccagcgtttacttagacgaaaccctagcatcaagccgccacggaagaaattttgtttctttcagagtgcaagaggcccttcgggttgctagaactcaccatgctaatcacgctttaccagtgtacgtgtttacgcgtcccacctactcaagaaggctgacaggactttctgaaatggacctgattagtacaattggagagtccgccgctctgggtgccgctggagtgatcctttggggagatgccggctacactacctccactgagacatgtcagtatcttaaagattatctgaccaggcttctggtgccatatgtcgtgaatgtgtcgtgggcgactcagtactgtagcagggctcagtgccatggacacggccgttgcgttaggcggaatcccagtgcttccacctttttgcatttaagcactaactcatttcggctggtccccggtcacgcacccggcgagcctcagctgagaccagtgggtgagctcagttgggccgacatcgaccatctccagacgcactttcgatgccagtgctatctcgggtggtccggcgagcagtgccagtgggatcaccgtcaggccgccggaggggcctctgaggcctgggccggatcgcatctaacctcactgcttgccctcgccgctctggcattcacctggacattgtag

SEQ ID NO: 30528 - DNA, 1422 bp, Artificial Sequence
  Description of Artificial Sequence: Synthetic coding sequence
atgcgcgctgggccaggcccaacggtgaccctagcccttgttttagccgtgagttgggcaatggagctgaaaccgaccgcccctcctattttcacgggaagaccattcgtggtggcttgggacgtccccacacaggattgtggccctcgcctgaaggtgccactggaccttaacgcctttgatgttcaggcctcaccaaatgaaggcttcgtcaaccagaatattaccatattctatagagacaggctgggtctgtaccctcgctttgatagcgcaggacggtctgttcatggtggcgtcccacaaaacgtctccttatgggcacatcgcaaaatgctccagaagcgggtggaacattacatccggactcaggagtcggcaggactggctgtgatagactgggaggactggagacccgtgtgggtcaggaactggcaagataaggatgtctataggcgactgtccaggcagctcgtcgcatctagacaccctgactggcctccggacagaattgtgaagcaggcacagtacgaattcgagttcgccgcacagcagttcatgctggagacactgaggtacgtaaaagccgtgagaccccgtcatctgtgggggttctatctgttcccagactgctacaatcacgattatgtacaaaactgggaatcttacacagggcgctgccccgatgttgaggttgcccgtaacgaccagctagcatggctgtgggcagagtccaccgctttgttcccttccgtgtatttagatgagactctggcgagctctcgccacggacgaaatttcgtttctttccgtgtgcaagaggccctaagagtggcgcggacacaccatgccaatcacgcgctgccagtgtacgtctttacacgccccacttattctcgccgattgactgggctgtccgaaatggacctcatcagcaccatcggggaaagcgctgcactcggtgcagctggcgttatcttgtggggagacgcaggatatactacgtccaccgagacctgccagtatctcaaagattatctcacccgccttctagtcccatatgtggttaacgtatcctgggccacccagtactgctccagggcccaatgccacggtcacgggcgctgtgtcaggcggaatcctagcgcctctacgttccttcacctgagcacaaattcattccggctagttcctggccacgccccaggcgaaccacagcttagacccgtgggagaactctcgtgggccgatatcgatcaccttcagactcactttcggtgccagtgctatctaggttggagcggagagcagtgccagtgggaccataggcaagcagcagggggggcaagcgaagcttgggcgggttcgcacctgaccagcttgcttgcactcgcagccttagcttttacatggactctgtag

SEQ ID NO: 30529 - DNA, 1164 bp, Artificial Sequence
  Description of Artificial Sequence: Synthetic coding sequence
atgactacccaactgggccctgctttggtcctgggggtagcactgtgtctgggctgtgggcagcccttgccccaggtcccagaaaggcccttcagcgtgctgtggaatgtgccatcggcccattgcgaggcaagattcggcgtccaccttcccctaaatgccttggggattatcgctaatcgtgggcaacattttcacgggcagaacatgacgattttttataagaaccagctgggtttgtatccttacttcggcccaaggggcacagctcacaatgggggcatccctcaggcgctgccccttgaccgtcatctcgccctcgcagcctaccagattcaccatagcttgaggcctggcttcgctgggcccgccgtgctggattgggaggaatggtgccctctatgggctggtaattggggccggagacgcgcctaccaagctgccagctgggcttgggctcaacaagtgtttccagacctggacccccaagagcagctctacaaagcatacacaggtttcgagcaggccgctagggccctcatggaggacacactgcgggttgcccaagcattgagaccgcacggtctgtggggcttttaccattatcccgcctgtggaaatggttggcatagtatggcttcaaactacactgggcggtgtcacgcggccacccttgcccgtaacacccaactgcattggttgtgggctgcctcgagcgctctattccccagtatctatctccccccacgcctccccccggcccaccaccaggcatttgtgcggcatcggcttgaggaggcttttagagtcgcgcttgtggggcaccgacacccactcccagtgctggcgtacgtgagactgacccaccggcggtctggccgctttctgtcccaggaggagtgctggcacctccatgactacctggttgataccctggggccgtacgtgattaatgtgacacgcgccgcaatggcctgttctcatcagcgctgccacggacacggtcgatgcgcccggagagaccccggacaaatggaggcgttcctccacctttggcccgacggatctctcggggactggaagtctttctcgtgtcactgctattggggatgggccggcccgacgtgtcaggagccaaggcccggcccaaaggaggccgtctag

SEQ ID NO: 30530 - DNA, 612 bp, Artificial Sequence
  Description of Artificial Sequence: Synthetic coding sequence
atgaaagtgaaggttatccctgtccttgaggacaattacatgtatctggtgatagaggagttgactagggaggccgtcgcagtggacgtagccgtccccaagcgccttctggagatcgtcggacgtgaaggcgtttctctgaccgcagtgctcactacgcatcaccattgggatcatgcccgcggaaatcccgagctggctagattacgccctgggctggccgtactgggcgctgacgagcgaatttttagcctcacacgacgcctcgcccacggtgaagaactgcgagttagcgccaggtcgagggaagggagaggtggaagaccaggttctactcggccacatcggtccgcttgttcctccgccgcagtccgtggccacccccgcgccctgccacctgatgctaggccccatcgacggccccatgaactgcttcccgtgggcggccggcttccaggcccaactaggcctgtgctggggaggcgtgccgtgggaggccgtctgcgcctggtacccgggggacagagacctgcagacgtgccagagccaggacgcgccggctatcccgctccccgggatgaaggtgtcctcagaccaagagctcacgcttag

SEQ ID NO: 30531 - DNA, 849 bp, Artificial Sequence
  Description of Artificial Sequence: Synthetic coding sequence
atgaaggtaaaagtcatccccgttttggaggacaattatatgtatcttgtgatcgaagaacttactcgggaggccgtcgcggtcgacgtggcggtcccaaaacgcctcctagaaattgttggccgagagggagtttccctcaccgcggttttgacaacacaccaccactgggatcacgctcggggcaaccctgaattggcccgccttaggcccggcttggcagtactcggtgccgacgaacgcatcttcagcctgacccggaggttagcacatggcgaggagctaaggttcggagcaattcatgtccgctgcctgctcacccctggacatacagccgggcacatgagttacttcttgtgggaggacgactgtcccgatccccccgccctgtttagcggcgatgcgcttagtgtggccgggtgcggatcctgtctggaaggctccgcgcagcagatgtaccagtctctcgctgagctgggcacgctgcccccggagactaaagttttttgtggacatgagcacaccctctctaacctggagttcgcacagaaagtggagccctgtaatgaccatgttcgtgctaagctgtcctgggcaaaaaagcgagatgaggatgacgttccaaccgtaccttcaacccttggcgaggaacgactctacaatccatttctgcgcgtcgcagaagaacctgtgcgcaagttcactggcaaagccgtcccagctgatgttttggaggctttgtgtaaggagcgggcacggttcgagcaagcaggggaaccccgacagcctcaggcccgcgctctgctagccctccagtggggactgctgtctgccgctcctcatgattag

SEQ ID NO: 30532 - DNA, 609 bp, Artificial Sequence
  Description of Artificial Sequence: Synthetic coding sequence
atgaaggtgaaggtgatcccggtcttggaagacaactacatgtaccttgtgattgaggaattgactcgggaagccgtcgcggtggacgtagcagtacctaaaaggctgctggagatagtcggcagggagggcgtctctctaactgccgtattaacaactcatcaccactgggatcacgctcgaggaaaccccgagctagcccgcctgcgccctggcctggccgttcttggagccgatgaaaggatctttagcctcacgagaagactggctcacggcgaggaactgcgcttcggcgcgatccatgtccgatgcctgctgactccagggcacacggcaggacacatgtcttacttcctgtgggaagatgactgcccagaccccccagctctattttctggcacacggtcagccgaacgcgcccaccccgcatcacggcggcctaggcctatttgtagcgaccccccctccccggccaggaggagagcagtaggcggccgactccggctcgtaccagggggccagagacccgcagacgtgcccgagcctggtagggccggctaccccgccccccgcgacgagggggttctccggccccgcgcgcacgcatag

SEQ ID NO: 30533 - DNA, 507 bp, Artificial Sequence
  Description of Artificial Sequence: Synthetic coding sequence
atgtttcccttaatttcaagccaccacttatggtggggtggattgcgcagaaccgtgtgtctgaatcttccagttctcacattacaacacttccagcacatgcacatcaaagtcggagacagggccgagctgcggagagcatttactcaaaccgacgtcgccaccttttctgaactgactggcgatgttaatcctctgcatttgaatgaggacttcgcaaaacacactaagtttggaaacactattgttcatggagtgcttatcaatgggctgattagtgccttactgggaaccaaaatgcccggcccaggttgcgtcttcctgtctcaggagatttcatttccagcaccgctgtatattggtgaggtggtgctcgccagtgccgaggtaaaaaagttaaagcgttttatagccataatcgctgtctcatgcagcgtaatcgagagtaaaaaaacggtcatggagggatgggtaaaagttatggtgcccgaggcctcaaagagctag

SEQ ID NO: 30534 - DNA, 1164 bp, Artificial Sequence
  Description of Artificial Sequence: Synthetic coding sequence
atgaatagacatcatctgcaggaccatttcctggaaattgataagaagaattgttgcgtgttcagggatgactttattgccaaagtacttcctcccgtcctgggcctcgagttcatcttcggtttactcggtaacggactggcactttggattttttgtttccatttaaagagctggaaaagttctcgcatcttcttattcaacttagcagtggcagattttttgctgatcatttgccttccattcgtcatggattactatgtgcggcggtccgactggaagttcggcgatattccatgtaggctggtcctgttcatgtttgccatgaatcgccagggctctatcatcttcttaacggtggtcgctgtggatcgctacttccgggtcgtgcacccccatcatgctctgaacaaaatcagcaactggactgcagccatcatttcatgcctcctgtggggtatcactgtcgggctcactgtccacttactcaaaaaaaaacttctgatccagaacggaactgccaacgtctgcatctctttctctatctgtcatacatttaggtggcacgaagctatgttcttactggagttctttctgccccttggtattatcctgttctgctcggctcgaataatctggtcactgagacaaaggcagatggaccgccacgcaaaaatcaagcgcgcaataacatttattatggtggtggccatcgtgttcgtgatttgtttcctcccttcagtcgtggtgcgcattcacattttttggttgttacatacaagcggaacccaaaactgtgaggtgtaccgtagcgtagacctagcattcttcatcactttaagctttacatacatgaattccatgctagacccagtggtgtattacttctctagtccttcatttcctaatttttttagcacattgatcaacagatgtctgcagaggaagatcaccggcgaaccggataataaccgcagtacaagcgtggaattaacaggcgaccctaataagaccaggggcgccccagaagccctgatagccaattccggggagccttggagcccctcttatctgggtcctacctctaataaccactccaagaaagggcattgccatcaagagcctgcctctttggagaagcagttaggatgttgtatcgaatag

SEQ ID NO: 30535 - DNA, 966 bp, Artificial Sequence
  Description of Artificial Sequence: Synthetic coding sequence
atgagtggtaacggaaatgctgcagctactgcggaggagaactcgcctaagatgcgcgtgattcgcgtgggtaccaggaaatcccaattggcaagaatccagacagattcagtggtcgccacgcttaaggcatcgtatccagggctgcagttcgagattatagccatgagtacaacaggcgacaagatactggacactgccttatccaaaatcggagagaagagtctgttcacaaaggagctggagcacgctctggagaaaaatgaggtcgacctggtcgttcacagtctgaaagatctcccaactgtgttaccaccaggcttcaccatcggtgcgatttgtaagagagagaatccacatgatgccgtggttttccacccaaagtttgtgggtaagacactcgaaacgctccccgagaaatcagtggtcggcacctcttcgctcagacgcgccgcccagctacagagaaagttcccgcatctggaatttcggagcatccgcggtaatctgaacacaagacttagaaaactcgacgagcagcaggagttttcggcaataatcttagcaaccgccggattgcagcggatgggttggcacaaccgagtgggacagattttgcacccggaggagtgtatgtacgcagtggggcaggaagggggctgctcagtgcccgtggctgtgcacaccgctatgaaagacggccaactgtatctcaccggcggggtgtggagccttgacggctctgattcaattcaggaaacaatgcaagccacgatccatgtccccgctcagcacgaagatggtcccgaagacgacccgcagctggtgggcattaccgccaggaatattccacggggccctcagttagcagcccagaacctgggaatatctttggctaatcttctcctgagcaagggcgcaaagaatattttggacgttgcccggcagcttaacgacgcccattag

SEQ ID NO: 30536 - DNA, 1035 bp, Artificial Sequence
  Description of Artificial Sequence: Synthetic coding sequence
atgcgtgtcattagagtggggaccaggaagtctcagctcgcacggatacaaacagactcagtggtcgccactctcaaggcttcctacccaggtttgcagtttgagatcatagcgatgtctactacgggcgacaaaatactggatacagctttaagcaagattggcgaaaagtcactttttaccaaagagctggaacatgcgctggagaaaaacgaagtggacctcgtcgtccatagtctgaaagatctgcctaccgtcctcccacccggttttactatcggtgcaatatgtaagcgggagaacccacatgatgctgtagtgtttcacccgaaattcgttgggaagacgctggaaacactgcctgagaaatcagtggttggtacgagctcccttcgaagagccgctcaactgcaacgtaaattccctcatctggaattccgttcaatccgcgggaaccttaatacccgtctccgcaaactggatgaacaacaggagttttccgccataattctggctaccgctggcctgcagagaatggggtggcataacagggtagggcagatcctgcatccagaggagtgcatgtacgccgtgggacagggggctctgggcgtagaagtgagggccaaggatcaagacatcctggaccttgtcggagtcctccatgaccccgaaacactgttgcgctgcattgccgagcgagccttcctacggcatctggaagggggatgctcagtcccagtcgcagtgcacacagcgatgaaagacggccagctctacttaaccggcggggtgtggtcccttgatggcagcgactctatccaggagaccatgcaggcgactatccatgtgccggcacagcacgaggacggacccgaggacgatcctcagcttgttggtataactgcacgcaacatcccacgcgggccccagttagccgctcagaacctaggaattagcctggccaacctgctgcttagcaagggtgccaaaaatattctcgatgtggctcggcagctgaatgatgcacactag

SEQ ID NO: 30537 - DNA, 915 bp, Artificial Sequence
  Description of Artificial Sequence: Synthetic coding sequence
atgagagtcatccgtgtgggtacccgcaagtctcagctggcccggatccagaccgattctgtggtcgccaccctcaaagcaagctatcccggcttgcagtttgagatcatcgccatgagtacaactggcgacaagattctggacacagctctgagcaagatcggcgagaagtctctattcacgaaagaattagaacacgccctcgaaaagaatgaggtggatctggtggtacactccttgaaggatctccccactgtgcttccccccggattcacaatcggtgcaatctgcaaaagagagaaccctcacgatgcggtagtgtttcatccaaagttcgttggcaagacactggagacactgcccgaaaagagtgtggtgggcacctctagcctccgaagggccgcccaacttcagcgtaagttcccccatctcgaatttcgctcgattagggggaatcttaacacgcgactgcgcaaactggatgaacagcaggaattcagcgccattatcttggctacagctggcctacaaagaatggggtggcacaatcgggtgggtcaaatactccatcccgaggaatgtatgtatgcggtgggtcaagaaggaggctgttctgtgccagtggccgtacacaccgccatgaaggacggccagctgtatctgactgggggtgtgtggagcctcgacggctccgacagcattcaggaaacaatgcaggccactatacatgttcctgcacagcacgaggacggaccagaggatgatcctcagctcgtggggatcactgcccgaaacattcccagagggccacagctggcggcccagaatctgggaatttcacttgcgaacctgctgctatctaaaggtgctaaaaacattctggatgttgctcggcagcttaacgatgcccattag

SEQ ID NO: 30538 - DNA, 834 bp, Artificial Sequence
  Description of Artificial Sequence: Synthetic coding sequence
atggcccctctgcggtttagtgccaacctctcatggctgtttcctgagctgtccggcctgcccgcacgagtcagagcagccgggagcagcgggtttgaggccgttgaagtggcctggccatacgccgagacaccagaggctctggcgcgagccgcgcgcgaagcaggattgcgccttgtactgatcaacacgccacccggagaccaggagaaaggcgaaatgggactgggcgcagtgccgggacgtcaggccgccttcagagagggtctggagcaagcagtgaggtacgccaaagcgcttggctgcccgaggatccacttaatggctgggcgcgtgccccagggtgcagatcgtattgcagtgaaggccgagatggaggctgtgtttctagaaaatctgaggcacgccgctggcgttctggcccaggaagacttggtcggtcttctggaacctataaacaccagaattaccgatccccaatacttcctggacacgccacaacaagccgccgctatactccagaaggtggggaggccgaacctacagcttcagatggatatatttcactggcaaataatggacgggaatcttacgggaaacattcgcgagttcctgcccatcgtcggtcacgtgcaggtggcgcaggtgcccgggagaggggaaccaagcagccctggcgagttgaactttccgtatctctttcagcttctcgaggatgagggctataagggctttgtgggctgcgaatatcaaccacggggggataccgtggagggtcttagttggctcagaagctactgggacagacggggacatccagaagcgggccaatag

SEQ ID NO: 30539 - DNA, 690 bp, Artificial Sequence
  Description of Artificial Sequence: Synthetic coding sequence
atgggattaggcgctgttccaggacgtcaggccgcctttcgtgagggactcgagcaggctgtccggagcggacattgtctgatgggacgaaaactgtccgtgccctgcaaaggcgccgtcgctcgggggggcctggtatatctggccgctttcctgagactggatatgattcacctgatggctggacgagtgcctcaaggcgccgatcggattgccgtgaaagctgagatggaggccgtgttcctggagaacctacgccatgcagctggcgtgctggcgcaggaagatttggtgggccttctggagccaattaacacaaggatcacggatccgcaatactttctggatactccacagcaggccgccgctattttacagaaagttggtcgcccgaatctgcagcttcaaatggacatttttcactggcagattatggatggtaatcttaccgggaatatccgggagttccttcccatcgtgggccatgtgcaggtcgctcaggtcccggggaggggcgaaccctccagtccaggggaactcaacttcccctacttatttcagctgttagaagatgaagggtataaaggctttgtgggttgcgagtatcagccacggggcgatacggtcgaagggctgtcctggctgagatcctattgggatcggcgcggccatcccgaggctgggcagtag

SEQ ID NO: 30540 - DNA, 615 bp, Artificial Sequence
  Description of Artificial Sequence: Synthetic coding sequence
atggggctcggggctgtaccgggccgtcaggctgctttccgtgagggactggaacaggctgtgcgctatgcgaaagcgcttggctgtccacgtattcatctcatggccggcagagtccctcagggggcggatcgcattgctgtgaaagcagaaatggaggccgtgttcttagaaaacttaaggcacgcagcaggagttttggctcaggaggacctggtgggactactcgaaccaatcaacacaaggataactgaccctcagtactttctggacactccccaacaggctgccgcaattctccagaaggtcggcagacctaacttgcagctacaaatggatattttccattggcaaatcatggatgggaacctgactggaaatatacgagagtttttgcccattgtcgggcacgttcaggtggcacaggtgcccggccgaggcgagccaagttcccctggagaactgaactttccctacttgtttcaactgctggaagatgagggttacaagggctttgttggctgcgaatatcagcctcgaggtgataccgtagaaggcctatcttggctgcggtcttactgggacaggcggggacatcccgaggcaggccaatag

SEQ ID NO: 30541 - DNA, 744 bp, Artificial Sequence
  Description of Artificial Sequence: Synthetic coding sequence
atggcccctctgcgtttctccgctaatttatcttggctgttccccgagctctcaggtttacccgctagggtaagggccgcaggctcctctggtttcgaggcagtcgaagtggcttggccatacgctgagacacctgaggccctggcacgcgcagccagggaggccggtctgcgcctagtcctgataaataccccaccaggagatcaggaaaaaggagagatggggctaggagctgttcccgggaggcaggccgcattccgggagggactggaacaggccgtgaggtatgccaaggcgctgggctgccctcgtattcatctgatggcaggtcgggtccctcagggggctgaccgcattgccgttaaggcagaaatggaagctgtgttcttagagaacttaagacacgctgctggcgttttagcgcaggaggacctggtgggcctcctggagcctataaacacccgcataactgatccacaatatttccttgacacccctcagcaggccgcagccatccttcagaaagtgggccgaccaaatctgcaacttcagatggacatttttcattggcagatcatggacggcaacctgacagggaatattcgagagttcctgccaatcgtcggccacgtacaggtggcccaagtgccaggacgcggcgagccctccagtcccggggaactgaactttccctacctgttccagctgctggaggacgaggggtacaaaggatttgtgggatag

SEQ ID NO: 30542 - DNA, 909 bp, Artificial Sequence
  Description of Artificial Sequence: Synthetic coding sequence
atggctcctcttcgctttagcgccaacctcagttggctgtttcccgaactgtcgggcctgccggcccgtgttcgggcagcaggaagttccgggttcgaggccgtcgaagtcgcttggccttacgcagaaacccctgaggcattggcaagggccgcgcgggaggcaggtctgaggcttgtactcattaatacacccccaggcgaccaagaaaagggcgaaatgggactaggggccgtgcccggtcgccaagctgccttcagagagggcctggaacaagcagtcaggtcaggccattgcctgatgggcaggaagttgtccgtcccctgcaaaggcgccgttgcccgcggggggctggtgtacctggcggcattcctgagactggatatgatacacctgatggctgggagggtgcctcagggagctgaccggattgccgtgaaagccgagatggaggcagtgttcttggagaatctcagacacgcagctggtgtgctggcgcaggaagatttggtggggttgttggagcccatcaatactcgcattaccgaccctcagtacttcctggacaccccccagcaggcagcagccatcttgcaaaaggtcggccgccccaacctccagcttcagatggacattttccattggcagatcatggatggtaatctgactggaaacatccgggaattcctacccatagtcggacacgttcaggtcgctcaggttcctggtcgaggagagccttcatctccgggtgaacttaatttcccctatctgtttcaactgttagaggacgaagggtacaaggggttcgtgggatgcgaatatcagccccgaggtgatacagtggaaggcctctcatggctccggagttactgggacagaaggggacatccagaggcagggcagtag

SEQ ID NO: 30543 - DNA, 162 bp, Artificial Sequence
  Description of Artificial Sequence: Synthetic coding sequence
atgtgctcctactatcacatgaaaaaaagatcagtttcaggatgtaacattaccattttcgcggtgatgttttcccacctgtctgccgggaaaagcccgtgcgggaaccaggcgaatgtcctgtgtatcagccgactcgagtttgtgcagtaccagtcttag

SEQ ID NO: 30544 - DNA, 1011 bp, Artificial Sequence
  Description of Artificial Sequence: Synthetic coding sequence
atgcccccccccgcccctggagcccgcctcaggctactggccgcagccgcattggcagggctcgctgtgatatctaggggcctcctgagtcagtcactcgagtttaactctcccgccgacaattataccgtgtgcgagggagacaatgccacgctaagctgctttatcgacgagcatgttacaagggtggcctggctgaaccgctctaatatcctctacgcaggcaatgacagatggaccagtgaccctcgagttagattacttatcaatactcctgaggaattctcaattctgataacagaagtggggcttggagacgagggtctgtatacttgctctttccagaccagacaccagccttatacaacacaggtgtacttgattgtgcatgtccctgcccggatcgtgaacatttcctcccccgtgacagtgaatgaaggcggcaatgttaatctgctctgcctggcggtgggcaggccagagcctacggtgacctggagacagctcagagacggttttacatctgaaggcgaaatcctggaaataagcgatatccagagggggcaagccggagagtacgagtgcgtgactcacaatggtgtaaactcagcaccagactcccggagggtcctcgtcacagttaactatccgccgacaattacagatgtgacaagtgcaaggacggccctcggaagggctgcgctattgaggtgtgaggccatggccgtgcctccagcagacttccagtggtacaaggacgaccgcctgctttcatccggaaccgctgaaggcctcaaggtgcaaactgaaaggacacggtctatgttgctattcgccaacgttagtgcacgtcattacggcaattatacctgtcgagccgccaatcgcctcggagcatcttcggcttccatgcgtctcctgcggccaggatcattggagaattccgcaccccgaccaccaggcttgctcgctttactgtccgctctgggatggctgtggtggcggatgtag

SEQ ID NO: 30545 - DNA, 1215 bp, Artificial Sequence
  Description of Artificial Sequence: Synthetic coding sequence
atggaatgtgcccttgatgctcagagcctgataagtatctcacttagaaagatccattcaagtaggacccaacggggtgggataaagcttcataaaaatcttctggtgagctatgtgttgcgcaacgccagacagttgtacttgtcagagcgctatgcagaactctatagaagacaacagcaacagcaacagcagcaacccccccaccaccagcatcagcatctggcttacgccgccccagggatgcccgcaagtgcggccgactttggcccactccaacttgggggcggaggggacgccgaagcacgggagcctgccgctaggcaccagttgcaccagttacaccagcttcatcaactccaccttcagcagcagctgcatcaacatcagcaccctgccccccgcgggtgcgcagctgcagccgcagccggagctccggctggaggggcaggagcgctctccgaactccccggctgtgctgcccttcagcctcctcacggcgcccctcacagaggtcagccacttgagcctttgcagccagggcccgcccccctgcctctgccactgccccctcctgcccctgctgctctctgccccagagaccctcgggctcctgcagcatgcagtgcgcctccgggcgcggcgccccctgcagcggctgccagccccccagccagccccgcccccgcgagctcacccggtttttatagaggtgcctacccaacacccagtgactttggattgcattgttcgagccaaaccaccgtactcgatctggacacacatgtcgttacaactgtggagaatggatacctgcaccaggattgctgcgcttcagcccactgcccttgttgcggacagggcgccccggggcctgggctggcctctgccgccggctgtaaacggaagtactatccaggccaggaagaagaggaagatgacgaagaggatgctggaggcctgggcgctgaacccccaggcggcgcgcccttcgcaccttgtaagcgggcccggtttgaggacttttgtcccgacagcagccccgatgcatccaacatcagtaatcttatcagcatcttcggctccggtttctccgggttggtgtctcgtcagccagattcgtccgagcagccaccaccattgaacgggcagctatgtgctaagcaagcgttagcaagtctaggagcctggactagagcaatcgtggccttctag

SEQ ID NO: 30546 - DNA, 1392 bp, Artificial Sequence
  Description of Artificial Sequence: Synthetic coding sequence
atggccacgtctaagcttcctgtggtccctggtgaggaagagaatactatcctcatggctaaggagcggctcgaagctcttcggacagcatttgaatctggcgacctgccacaggcggcaagccatctgcaggaactcttagcatcaactgagtctatccggctcgaagtcggcgtgacaggagagtctggcgccgggaaatcctctttaattaacgctctgcgtgggctcgaagccgaagatccaggagccgccctcacgggggtgatggagacaacaatgcagccctcaccatacccgcacccacaattccctgatgtgacgctctgggatctgcccggcgctggatccccagggtgtcccgcagataaataccttaagcaggtggacttttcccggtacgacttttttctcctagtttcgccacgcaggtgtggggcggtggagaccaggttggcggccgagatcctgtgtcaaggaaagaagttttatttcgtcagaacgaaagtggatgaggacctggcagctaccaggacacagaggccaagtggctttagggaagcagctgtgctgcaggaaattcgagaccattgcgccgaacgcctgcgggaggcaggagtggcagatccgaggatcttcctagtgtccaacctcagccctgcccgttatgactttccaacactggtgtctacatgggaacacgatctccccagccaccggagacacgcgggattacttagcttgcccgatatctctttggaagctctacagaagaagaaagccatgttacaggagcaggtcctcaaaaccgcattggtccttggcgtcattcaggcgctgcctgtcccaggactggccgcagcatatgacgacgctttactgatccattccctcagaggttatcatcgctctttcgggctggacgatgatagcttagccaagctggccgaacaggtcgggaagcaggcgggtgatctgaggtccgtcatcaggtcaccactggctaatgaagtctctcccgagaccgtgttgaggctctactcccagtcgagcgatggcgcaatgcgggttgcgcgggcgttcgagcggggaattccagtgttcggaacattggtggcgggggggattagcttcggcgccgtgtatactatgctacaagggtgtctgaatgaaatggctgaagatgctcagagagttcgtataaaagccttggaagacgatgagccacagcccgaggtctcgctggaagtcgcttcagacaatggcgttgagaagggtggttccggagagggcggtggggaagaagcacccctgtccacatgccgcaagctcggcctactgttaaagtacattttagatagctggaagaagcatgattctgaagagaagtag

SEQ ID NO: 30547 - DNA, 1872 bp, Artificial Sequence
  Description of Artificial Sequence: Synthetic coding sequence
atgcccccgccacagggagacgtaactgcgctgtttcttggtcccccagggctcgggaaaagcgctttaattgcagcactctgcgacaaagatgtcgaaacgttggaagctcctgagggccgcccagattcaggagtaccaagcctgcgggcggcaggaccaggcttatttctgggcgaactgtcctgcccccccgccgcgcccgggccatgggctgctgaggccaatgtgctggtcctcgtgttgccaggacccgagggaaacggtgagcctctggctcctgctctgggggaagcagccctggcagccttggcccgtgggaccccactcttagccgttaggaacttaagacctggcgactcccagaccgccgcccaggctcgtgatcagacagcagcccttctcaacagcgctggcctcggagctgctgatctctttgtgctgcctgccaattgcgggtcgagcgacgggtgcgaggagttagagcgactgcgcgccgctcttcagagccaggctgaggcgctgcggaggcttttgccaccagcgcaggacgggttcgaagtgctgggcgctgccgaacttgaggccgtgagggaggcattcgaaaccgggggccttgaagctgccctctcttgggttcggagtggccttgagcgactggggagtgccagactggatctggccgttgccggtaaggctgacgtcggactggtggtggacatgcttctgggcctggacccgggtgacccaggggccgctcctgctagcgtgcctacagctcccacccccttccctgcgcccgagcgccccaacgtggttctgtggaccgttcctctcggccacacaggtacagctaccactgcagccgccgctagccacccaacccactacgatgcgctgatcctagtgacccctggtgcaccaactgaaaaggactgggcccaggtgcaggccctgcttctgcctgacgcccccctcgtctgtgtgaggaccgatggcgagggagaggaccctgagtgcctgggagagggaaagatggaaaatcccaagggcgaatcactgaaaaatgcaggtgggggcggactggaaaacgcactgagcaaagggagagagaagtgttcagcaggttcccagaaggcgggatctggtgaggggcccggaaaggccgggagcgaagggctgcagcaggtcgtggggatgaaaaaatccgggggaggagacagcgagcgcgcagcagctttgtcacccgaagacgagacatgggaggtgttggaagaggccccccccccagtttttcccctaaggcccggggggctgcccggactctgcgaatggcttagacgtgccttaccgcctgcccaggccggggcgctcctgctggccttgcccccggctagcccaagtgcggctcgcactaaggccgcggccttgcgagccggggcttggagaccagctcttctggcaagtttggcggcagcggcagctcccttgcccggattgggttgggcctgtgatgtagccctcctgaggggccaactcgccgagtggcgcagaggcctgggactggagcccacggctcttgcccgcagggagagggctctgggcctagccagtggagagctagcagcccgggcacattttcccggacctgttactagggctgaggtcgaggccagactcggggcatgggccggtgagggcactgcaggcggagctgcactgggtgctctctccttcctctggccagcggggggggcagcagccactggcggtttggggtaccgggccgctcacggcgtcttgctgcaggctttagatgagatgagagcggacgctgaggctgttttggcaccaccagaacccgctcagtag

SEQ ID NO: 30548 - DNA, 3981 bp, Artificial Sequence
  Description of Artificial Sequence: Synthetic coding sequence
atgactacaatacacagtcggcagatgctgcaggaacatgtgagtatggaattcagctcaagtacaactcacgtccagacattcagccagaccacgaagatcgtcggagaggaagtcgtgagaagaaagtcatcatccatcgtggaatttttctccctggttactcgttcctctaatatccctgcaggggattcagtgcccgagttcgtggagaaaccacagcctgtcacagcgcctgagggagacaaagcagtgttccgtgccagagtacagggcaacgctaagcctcatatttcatggaagagggaatcaggcatacctatcaaagagagcgcaaaaattttctacgacagcatcaataaggagcatgtgttaaagctcgagccactcacttctgacgactccgataactacaaatgcatagcctccaatgatcacgcagacgccatctatacagtttctttattggtgacagaaggccaggaaaagatggattttaaaaagatgctgaaaaagcgcgcccccccggcccctaaaaagaagcaaaaaaaagtggccaatgagaaagagatgctggaaatcttatccaaggttcctaagaaggactttgaaaaagtgtgcatggaatacgggttcaccgattttcggggactgctgcgcaagttgaaggagatgaaaaagaaggtggaagtcgaagctattcgcatcttaaaaccactggaagataaggaaactaaggttgacacgaccgtggtcttcgattgtatcatggagctcaaggaccccaacgtgaaaatgatttggattaagggcaccgagcctctgcgcattcagtactctctgggaaagtacgatgtcaaacagatgggaactaaatatatgctggtgatctcaaatgtgaacatgaatgacgccggaatttactctctctccgttggggacaaaagaatgagcgcggagctgactgtcctcgacgagccactcaagtttctcggcgagatgaaaccggttaaggttacagagcggcagacagccgtgtttgagatccgactgagtaagaaggagcccaactttgtctggaaattcaatggcaaggaactcaagagggatgacaaatatgagattactgtgtcagaagatggcctgacgcacacattaaaaatcaaagacgccaggttatctgacagcggtgagttcagcgccgaggccggcaatctcgtgcagaaggctcagctgaccgtggaccgtatacctatcaagttcgtgtctaatctcaagaacgtgcgagtcaaagagcgatcgcgcgcctgcttggagtgcgaactgacctctaaggatgtgactctgcggtggaaaaaagacggacagctactgatgcacggaaccaaatactctatgaatcacgaggggaaaagagctgagttgattatcgaagatgcacagctgtccgacgggggggaatataccgtggtggccatgcaggacggagacccgactgaatactacagcaccgccatcgtgacagtcgaggagagactcgcgactgtgaagtctggcatgtccgacgtacatgccgcaactggctcacccgccgaactgtgtgtcgtgcttaacgatgagaaggtggagggagtatggctgaaagatgggaaagaaataacagatctgccaggcatgcagattgtgaaacagggcgccgtccataaattgatttttccgagcatgggccccgagcatgaaggcaaatacacgttcagggcaaaagggactgaatccgaggcgtcggtgttcatcgccgacccccccaccatcgatccttcagttttagaagctctggcagcccatgccatcacggtcaaagttggccacactgctcacatcaaggtgccctttagaggtaaacccctcccaaaggttacgtggtataaagatggaatggaggtgacagaggaagagcgtgtatctatggaaagaggcgaagaccaggctctgctgaccatctcgaactgcgtgcgggaggactctggcctcatcctgttaaaactcaaaaacgaccacggcagtgccacagcgacccttcatctaagcgtattagaccgcccaaaacctccacagggacgggtggagtttctggaattatccggctcttgcgtacacatgaaatggaaggctcctaaggacaatggcggtcgcccagtgacgcaatttatcgtggagagacgggccgtgggtaaaaagtcttggatcaaaattggagaggtggacggaaaagtcacgaacttttccaccaacaaagtcgaagagggcaaggcctaccagttcaggattctagcagtgaactcagaaggggtgtctgacccccttgaaacagaagaggtgttcgctggcaatcctatcgagccacctggattcgcatcacaacctcaggtcacggacgtaaccaaggaagctgtgacgatcacatggaacgccccaacacaagacggcggagcccctgtactaggatacatcgttgaaagacgcaagaagggctctaatttatgggtccccgtgaacaaggacccaattcaaggcactaaatgcactgtcgacggcctgctcgaggatactgagtacgagttccgggtgatcgccgtgaataaagctggacctgggcaaccgtctgtaccctctagttctgttgtcgccaaggatcccgtcaagcccccaggcctggtgcaggatttgcatgttagtgacagctccaacagttccattagtctagcatggagagagcccgcggaaggggaccctccctcagggtacatactagagatgcgggcagaggatacaaaagagtggagtaaatgtacgaaaatcccgatatcaggcacttgctacacggtggggggactgattgaacgtcaaaaatacttctttagaattcgcgcagtgaatgaagctggagtcggggagcctgtagagctggacaagggagtacgcgcaatgcctcccccagccgcaccaaaattcgacctcagcgcaaggctcaaatcccatatggtggtgcgggctggcaccgctctctgcattcatgccgcattctctggatcaccaccgcccgacgttatatggcagaaagacggcgtacccaccaaagggagggagaccataacaaaatccaagaatcactcccaattcctcataaattctaccaagcgctccgatagcggggtgtacagaattctgttacagaacgagttcggggaagcacggtacgatattcatgtgcgggtggccgactttcccaggcctcccaccaacctgcggctctttgaggaagtgcccaacacggttacgctgacctggaatcactctccagatgttcaggaagacggcgaagcccactacatcatcatgaaacgtgatgcctcaacagctacctggtatactgccgctgaaagggtattttcgaataaatacaccgtgactggtctgctgccagggcggaagtattattttagagtggtcgcacggaacgagattggcgacagcgagcctctggattcgcgcgatacctggctcatcaacaaagatcagatccaggacctgtctgcaaaattaaaaccttatgaaaaaaaggattggaggcacgccccccgattcgtcactcctctaaagccacacactgtactgcgtggccaagactgcaccatgacatgtgctttcctcggaaatcccagaccaacagttaccctgtacaaaggggatgtgaatattacggctaacagcaaattctggtataacagcacttccggtgtgtgtacattagtgataccaacatgcacactgaaagactctggcgattatagcgtgctcgtagaaaacgaattggggaaagatcgctcaagctgtaccctgacagtgtacgataaggatgacaagtcagtcgtcgcctctattacagagtctttgcagaagaagagcaagcatctgatgtag

SEQ ID NO: 30549 - DNA, 1827 bp, Artificial Sequence
  Description of Artificial Sequence: Synthetic coding sequence
atgggatggcagcctatgggtgaaaactggggttgtctagaggaaatgctgaacgaagatcaatctcgggagccgcctgggcacctcggctcgcgtaggagtggcaaagacggcagacttgacatatacggcgagcgcagagacgctactaggagctctacctccagatacaagcctggaacagggtctttcagtaaagatgcacaaggcccgatgggccatttctcacaagggttagcagacatggaagtgcagccgggcgaagcagccaccctgagctgcacgctgacctccgatctgggtcccggcacttggttcaaggatggggtgaagctcactacccaggacggggtgatattcaagcaagatggcctggtgcatagcttgtttatcacacatgttcagggcactcaggctggtcgctacaccttcgtcgctggcgaccaacagtctgaagcgactctgactgtgcaggacagccccaccattgcccccgatgtgacagagaagctgagggagcctctcgtcgtgaaagctggtaaacccgttatcgtgaagatcccattccagagccacctgcctattcaggccgcatggcgaaaggacggggccgaagtggtcggcagttcagaccgagaggcccaggtagaccttggtgacggctatacccgcctttgcctgccatctgcgggccggaaagactgcggtcagtattcggttacccttagaagcgaaggaggtagcgtacaagccgagctcacactccaggtgatcgacaagcccgaccctcctcagggacctatggaagtgcaagactgccatcgcgccggggtgtgtctacggtggcgcccgcccagagataacggcggtaggacagtcgaatgctatgtagttgagcgaaggcaagcgggccgatcaacttggttaaaagttggggaagcccctgcggattccacaactttcactgacgcacacgtggaacctggtcgtaaatatacatttagggttagggccgtgacctccgaaggcgctggggaggccctggaatctgaagagattctggtagcacctgaagcgctgccgaaagctcctagcgcaccggctatactatcagcttcctctcaaggaataaccctgacatggacagcgccacggggacctggttccgctcacatcctaggctaccttatcgaacgccggaagaaaggcagcaacacttggactgccgttaacgatcagccagtgcccgaaaggagatggacggtcgccgacgtgagacaaggatgtcaatacgaatttagggtgaccgccgtagcacctagcggacccggtgaacctgggccacctagtgacgctgtgtttgctcgagatcctatgagaccgccaggactcgtcagaaatctccaggttacagaccgttcaaacactagcatcacacttagctgggccggtcctgatacacaagagggagatgaagcccagggctatgtcgtagaactgtgttcaagtgattccctccaatggctcccttgccatgtcggtactgtccctgtgactacatacacagctaagggtctccgtcccggggagggatactttgtacgggtcacagccgtaaacgagggcggtcagtcacagccgagtgcgcttgacacacttgtacaggccatgcctgtgactgtgtgcccaaagttcttggtggacagctccactaaggacctgttgacggtgaaggtgggggacacggtacgggtgcctgtcagtttcgagcacgcgcggaggccgcttggtccgagcacctgcagacgtacttgtctgggcaggtag

SEQ ID NO: 30550 - DNA, 11127 bp, Artificial Sequence
  Description of Artificial Sequence: Synthetic coding sequence
atggccggtaagctgagaaaatcccacatcccaggagtgagtatttggcagctggtcgaggagattcccgaagggtgctcaaccccagacttcgaacagaagccagtcacatctgccttgcctgagggaaagaacgctgtatttcgtgctgtcgtgtgcggagaacctcggccggaggtccggtggcaaaactctaaaggcgacctgtctgattcatccaaatataaaatcagctcctcacctgggtctaaggagcacgtcctccagatcaataagctcaccggcgaggataccgatttgtatcggtgtaccgctgtgaatgcatatggtgaagcagcttgctccgttcgcctgactgttattgaggttgggtttcgcaagaatcgtaaaaggcatcgcgagcctcaggaggatctaagaaaggaactgatggatttcagaaagttattaaaaaaacgggcccctcccgccccgaagaaaaaaatggatcttgagcagatctggcagctgctgatgacagctgacagaaaggactatgagaagatttgcctcaagtatggaatcgtggactatagaggcatgcttcggaggcttcaggagatgaaaaaggaacaggaagataaaatggcgcagtacattaataccataagctccctcaggcacattagagtaaccaaagatgggaacgctaaattcgatttggagctcgaccttaaagacagccagtctaagatctacctgtacaaagatggcgagatgatcccctacgggttcaataatcagaccaaacactgtctgaggaggttaggaaaaaggtatgagtttcagattcaggacttgagacctgaagacagtggtatctaccaagtgaaagtggaagacgctgtggtgttttctacagaactggaggcttccgcaatccctccacgggtagtcgtgcccctcgctgaaacccactgtgaggagcagggcgatgccgtcttcgagtgtactctttctagtccctgcccaagcgctgcgtggcattttagacacagactgctgcatccttccgacaagtacgaggtgtatgtgtcaccggacggcctgacgcatcggctggttgttaggggagcccgatttagcgacatggggccctattccttagggacgggtctctacacgagttctgcctggctcgtggtagaagccggaaaagataaagatcttcagtctaccagtgctgaccacaagctgcagcgacagggggctcaggcctctggagccgaggagagtggaagtattgaatctcaaggggagaaatcacgagaacagggtcctaggggtggttcgctggaaggcgcggggcctgccagcggcctccagcacatcgcatcccccgaccgggatggactcggcagacacgggtacagtctaatgggtgataaagggacggccgactctgcctggggacctggtcaggaaggcgagggtttccctgtcgccgaaggctctcgtgctaccctgccaagggaaaatcagagtcaccgggaaggcggatgggcccgctccctcgccgaaaggcctcaccttcaaggggagagcagcgaatctgggcttggtttacccgagaagcagcaacaagacagaggaagggattccaatagtgatgagtgctggcggaaggcaggaggctgggaagctggcagcagccgcctgcaggccggtggcttaggatccagcagggaggggaaagagcaccgcggcgatagtggccggcagcttgaccggcatgcgcctgagcagttatgggacgccaggctgggaccgggccgtggaaagagtgatctccagggctgccagagcgacccagtggggtcctggcccagaggtaagcagatagagatttcacaggatgattccctggcggagatggatcgcggagacgcccccagccgcgagcgaggccggggcattgtcgtctggggcgggggcactgggctcggcgaggctggcgatagtaacggagccggtggccctgggaccctggaactgaccggcggtcggggctcgggaagcaaggtgggtatggccccagagagttggggtagccagggaggcagagacgccgattacggggaagctcgcggctactggggttctggagagctacttgagcagattcccggtggcaaagattttcaggaaccgagtatctcgggtggaaggaaatttctgctgggcgacggctctcctgagattaaggctgaggattctctccaggaagctgatggaatttgtcggggagagtctgtcgtgaccggatctgcatacaagactggccccgggggtcctggcgatcctcgaggctgtgagggtgtcctgcaggagctgcgcgggcgcgatggacaggagactgcgtgggccagcggggaggtggagtatgatcctaggtcattccagagctcacagggctggacagctggacatagagcggcaggaggcatcggcagaatcgagtctaagggcacatcaccctgggacgacacccccagcagccttagaaaaacaggcgctcatcacggtccaggagtgctcggaccctccgggggacaggaaggtatgggcgggatctgggtggccgggttaactgagagcgggcaaggagtggatgcgaggagccactggttgtcccgagcccccgggctgggagcgcaggggagtggcggcaccttgggagataagaagggcctccgcggaccgggtagcatcggctcggagccagatttttggaatggcagcggatcttctagagttaagggccccagaggtgaaactggttacaaagacggtttggagggcccaggcagaatggaatcccgctacgagggtggtctcggctattcacgagaaatctcttccaaatcaggagcgggctattcatatggaagtggggtgcccggagaaatgggcagcggacacggtgcaggatgtcgtgtatctcctcgagctcccgccggagtcgagtcggaagagggaggtggctaccgtcatggttctggggccccgggcggggtatggtccgggaacgaggactccgggccagctggcggaggaagtgggcgagtggcaagtctgaagaatgggtctggcgggcccgacggggcacccatgaatgacacccgcaattgggcctcagcgtgtcaggccggaatggacccacgaggtgggcatcatagtgacggtgggctgggtagccctggagtgactgggtccgccggcagaggaggcctcaaagcccctggagtggtggagactgtgggcatgggctgtgtcgaagctgaaccagagtccagcggtcgcatccgcccttggggtcagactgggaattacggtggattccgggctagtgaggcgttaggggcatttggggagggcggttatgaggacgggagcggtggtccgggcgctatggggccaggctctctgagagccggctccaaggtgggcgagggtgacggcacacgctgcccaggcgcaaaggctagcggagccggggcaggctacagagacgatacacgccatcccgaatccctggcccctcacaatggggcggcgagtgggagccagtgggcgtacggagcaggcaatgtgctgggatatgaagatggatcagaactgcccggccctcagggcacaggagtgaggactgcctacggagagaggagtcggggtctggggcccaggtcaactgggcctggcggggaggcagggtttcgggatggtagcggaggtctccagggaatggggtctgcagatgggccaggatgtcgcaaaggcatcggtagttctggggaaatgggaagcgttgataaagaaggatacaagaaggacctgggagctccagagaacatggggagcggctccaaagcagactatcgcgatggagtggggggctcaggggccatgggtagcatggatgaagccgggtacagaaaagaccttggcgcccctgagggcatcagttcaggctccaaggcagattacaggggcggtctgcaggattcacgggaggccggatcaggttccaaagctgactattccggagggctgaaaggctctcgggagatcggttcaatggatgaaaccgacaaccgaaaggatctcggagtgcctgaaggcatgggtgctggctatcgggcgggattgaggggaccgggcgaaatgggcagtctggacgagtcaggccatcgcaatggaatcggaggctatggcgagatggggtctggttacagagaagacctgggtgcgcctgagggcatggggacaggttcgaaagcaggatatcgggacgggctgagaggatctggagagatgaggagtatggacgaggcgggttaccgaaagaacctgggcgcacccgagcgcatggactcgggaagtaaagctggctacaggggaggccttcgcggcagcggcgaaatgggtcttatcgaagctggctaccggaaggatctgggggttagtgagggtggtggctctggaagcaaggccggataccggggaggactggggtccggggagatgggatcagttgataaggcaggataccgcaaagacctgggcgccagtgaagctatcggatcaggttctaaagccggctttaccgacggactgggcggctctgaggagatgggctccgtcaacaaggctgggtatcgcaaggacctaggcgcacctaagggtatggggtccgggtctaaggcaagctttagagatggactgggcggctcaggtgagatggggagcgtcaacgaggcgggctatcgcaaggatctgggggtcccagaaggaattggaagcggctccaaagccgggttccgagacggactgggaggcagtgaggaaatgggtagcgtgaacaaagctggctaccgtaaggatctgggggcaccaaaagggattgggtccggttccaaagccggattccgcgatggtctgggctcctctggagagatgggctctatggacgaggccgggtatcgcaagaacctgggcgcccccgaaggaatcgggtccggtagcaaggcaggatttcgagatgggctcgggtcttctgtagagatggggtccgttaacgaagccggctatcgcaaggatctcggagcaccagaagggatgggttccggctcaaaagctggatttcgggacggactggggggatccggcgagatgggaagtgtcaatgaggcaggctaccgaaaagacctaggggcacctaagggtatcggcagcggaagcaaggccgattttagggacgccctgggatcttcaggcgaaatggggagcatggatgaggccggctacagaaaggacctgtgggcacccgaggggatcggctctggtagcaaggctgggttcagggacggcctggggagcagtgtggagatggggagcgtcaacgaagcaggatatcgcaaagatctcggagctccagagggtatgggaagcggaagcaaggcagggttcagagacggactggggggttcaggggaaatgggaagcgtgaacgaggccggctatcgcaaagacctgggggccccgaagggaatcggttcgggcagcaaagccgattttcgggatgctctgggatcttccggcgaaatggggtctatggacgaggccgggtaccgcaaggatctgtgggctcccgagggaattggatctgggtcaaaggccgggtttagagatggactgggtagctccgttgagatgggtagtgtgaacgaggctggttatcggaaggacttaggagctccggagggtatggggagtggttccaaggaggggttccgcgatggactcggaggttctgaggaaatggggtcagtgaataaagctggatacagaaaagatttaggagcaccaaagggaatggggagcggcagcaaggaagggtttcgcgacggactgggaggcagcgaagaaatgggcagcatggacgaggcaggttaccgaaaggatcttggggcacccgagggtattggatcaggctctaaggctggtttccgagatgggcttggagggagtgaagaaatgcggagcatggatgaggctgggtataggaaggatctgggggctccggaaaggatcggtagcggtagcaaggccgggttccgcgacggccttggatccagcgttgagatgggatccgtcaatgaggcgggataccggaaggaccttggtgctcctaaggggatggggtccggcagcaagacgggattcagggatggtctgggcgggtccgaagagatggagagtatggacgaggctggataccgcaaggatcttggggcaccagaagggatcgggtcaggttccaaggctggcttcagagacggccttggcagctcaactgaaatgggatcggtcaatgaggctggctaccgtaaggaccttggagctccaaagggcatggggtccgagtctaaagccggctttagagatgggcttgggtccagcggtgagatggggagtatggatgaagccggctatcggaaggatttgggagcaccagagggcatgggcagcgggtccaaggctggtttcagagacggactgggaggcagcgaggaaatggggagtgtcaacaaggcaggttacaggaaagacctgggcgcacccaagggcatggggagcggcagcaaggccgggtttcgcgacggcctagggagctccggggagatgggatcaatggatgaagccgattatcgaaaggacttaggcgcccctgaggagatgggaagtggttcctatacagattatagaaacggactgggttcatcaggcaagatttcttcgggtgatgaggcaggatataagaacgtgctgggcggttcaggccgcaacccgctgggaagcgaagcaggctctcgcgggagtctggaagattccgggtatatcctgagctggaatgaggctgggtcaagacaaggcttcgggggcactagcgggatgggctctgggagcgaggttagctaccggggtggcagcggcgggtccggggaaactggtccggaaggcaaaatgggatatggcgacggatccgggcggcttggcgtaccaggtagtctcgctggcataggtcacgaggcagggcccaggggacacaaggcaatgggacaccgcagcggttactgggtggccagcgaaggagacacaaactccaaagacggacccgaacgtgccagggaaactcgcctcgtagatggcgctgggcctggtgttgagcccggtatggctggcatgccaggtacggccggcggtatggctcacagggatagtctcagaggtactggcgtgttaggttcccagggcggacgccaaaccctctccgacgagcgcggatcaacaaaggatttaggcggttacggcacatctggcattccggaagcttctgaggccgcaggagccaagggtaagcctgacgtcaaggaatggcaagacagtagtggaactcctggctcctccagggacaggggagctccaagagtgaaagaccgcagccccgatcaggcaggcatcatgggtgcctccggcttcctggacggtaagggagcagtcgaaggagagacttgggccggaatggccgccctgggctccggctatgaaagggatatttggaaggccggacccggaatgactgataggggccgggtggctggtcagggaggactggcctcacagggaggtggcgattctcttctcggcgggcgacgagtcggtagcgggtcctccgtcggcactggccaggacctggactcaggatctatgcctgggggaaggggcaaaagtacgagcggcccagccgacagacaaggtaccagtaacgcttgggcgcctgactgggaaaatcagggcttttcccagggttccattgatgccggaaagcagcctgccgggtcccgtgcctcaggctcactccaagagaaagacgcggccttcggtgggacccacgagggcccgggaggtttcaaaggaggtgagggggcaccgggacaggaagctgctggcgggtgccgctcaccctggtccctggattctaagggctccagcccaggaaggggttccagtgtggacgctgaagatagtgggatcctgggcaagggaaattcaacggagtggggcaacgccctcacacctaaaccaggagagtcaggtcctcagggggcctggaacggcctggacgggccgttcggacggaaagcctcacgagaccgtagcggcggaacccaggatttgagttcacagcggggtaagggacagagaggggggaaacggtcattgggggagcagggcagcctggaggcggagaatggggaagttcaggggcccggcgcgctgaaggaggacgaggggcagggggttgaggaagcgggtaggtctggccgccgccctgggtctctgaggtcgagatctcaggcccagagcggcgctgaggttggtgggggaaagcggcgaggcgccgatgaggccggatctatgggctggcagccgatgggagaaaactggggctgcctggaagaaatgctaaacgaggatcagagtcgcgagccaccagggcatctgggctctaggagatctggaaaagatgggagactggatatttacggcgaaaggcgggacgcgactcggagcagtacctcccggtacaaacctggaactggctctttttccaaggacgcacagggaccgatgggccatttctcacagggactcgctgacatggaagttcagcccggtgaggccgctacactgtcctgtactttaacgagtgatctgggtcctgggacatggttcaaggatggggtgaagctgacgacacaggacggagtcatctttaagcaggatggtctggtgcacagtctgtttattacgcacgtacagggaacgcaggccggccgttacactttcgttgcgggagaccagcaatctgaggctaccttgactgttcaagattctcccactattgccccagatgtgaccgagaagctccgggagcccctggtagtcaaagccggaaagcccgtaatcgtgaagatcccgtttcaatcccacctgcctatccaggcggcttggcgcaaagacggcgcggaggtagttgggagctccgacagggaggcacaggtcgatttgggcgatggttacacaagactgtgcctgccgtccgccgggcgcaaggactgtggccagtacagtgtcacgttgaggagcgaaggaggctcagtgcaagcagagctgacccttcaggtgatcgacaaacccgatcctcctcaggggcctatggaagtccaggactgtcatagggcaggagtgtgcctccgctggaggccacccagagacaacggtggccgcacagtggagtgctacgtcgtagagaggagacaggccgggcgctcaacctggttgaaggtgggggaggctcccgctgactcaacaacattcacagacgcccatgtggagcccggccgcaaatatacgtttagagtgcgggccgtaacctccgaaggagccggggaggctcttgaatccgaggaaatactggtggcccctgaggccctccctaaagctccatctgcacctgcgatcctctctgcctcctcacagggaattacacttacctggactgcaccgagagggccgggcagtgcccacatcctaggatatctgatcgagagaaggaagaagggctctaacacatggaccgcagtgaatgaccagcccgtaccggagcggcggtggacagtggctgacgtacgccaggggtgtcagtacgaatttagggtgaccgcagtggcaccatccggtcctggggaaccaggaccaccatccgacgcggtcttcgctagggatcctatgcggccaccaggcttggtcagaaatctgcaggtcactgatcggtctaatacatccataactctgtcctgggcggggcctgatacccaagaaggagatgaggctcagggttacgtcgtagagttgtgtagctcagacagtctgcagtggctgccttgccatgtaggaactgtgcccgtgactacctatacggccaagggactaaggccgggagagggttattttgtaagggtgactgccgttaacgagggcggtcagagtcagccatctgcactggacacacttgttcaggcaatgcccgtcaccgtctgccccaagttcttagtcgactcctcaacaaaagacttactaacagtgaaggtgggcgacacggtccgagtgcccgtgagctttgaagccatgcccatgccggaagtcacttggctgaaggatggtttgccgctacccaagcgctccgtgaccgtcacaaaggacggacttactcaacttctcatacccgttgcaggcttatcagattcaggattatatactgttgttcttagaacactccagggtaaagaagtggcccatagcttccgcatcagagtggccgcctgcccccaagctcctggccctattcacttacaggagaacgttccaggaactgtgactgccgagtgggagccttcaccagacgaggcacaggatgtgcctctgcattatgcagtgttcactcggagttcagctcacgggccttggcatgaagccgctgaccgcatccacactaaccgctttaccctcctgggaatacttcctggacatgagtatcatttccgtgtcgtggccaagaacgagctgggcgcatctaagccctcggatacctcacaaccatggtgtatcccaaggcaacgggatcgattcactgtaaaagccccgtgctatcgagaacctgacctctcacagaaaccacgattcctggtgggcttgcggagccacttgctcccacaggggtgcgagtgctgtatgagctgtgccgtgcaaggctcccctcgcccgcatgtcacttggtttaagaacgaccgctcgctcgaggggaatccagcagtttactcaacagatctgcttggtgtgtgcagcctgaccatcccatctgtgtcgccgaaagattcgggagagtacaaagcagtggccgaaaacacactggggcaagctgtgtcaaccgctaccctgatagttatcgagccatccacctag

SEQ ID NO: 30551 - DNA, 1713 bp, Artificial Sequence
  Description of Artificial Sequence: Synthetic coding sequence
atggcagggaaactcaggaagtcccacattcctggggtaagtatctggcaattggtggaagaaatccccgagggctgtagtactccggactttgagcagaagcccgtgaccagcgccctaccagaaggcaagaacgcggtcttcagagcagttgtatgtggcgagccccgacctgaggtgcgctggcaaaactctaagggcgatctgtccgactcttctaagtacaaaataagttctagtccaggcagcaaggagcatgtcctgcagattaataaactcacgggggaagacactgacttgtacaggtgcacagcagtcaacgcttatggcgaggctgcttgctcagtgcgcttgacagtgatagaggtggggtttcgtaagaataggaagcgccacagggaacctcaggaagatctgcgtaaagagctcatggatttcaggaagttactaaaaaaacgggccccccctgcacccaaaaagaaaatggatctggagcagatctggcagctcctgatgactgccgaccgcaaggactacgaaaagatctgcctgaaatacggtattgtagattatcgagggatgttgcggaggttgcaggagatgaaaaaagagcaagaggacaagatggctcagtatatcaatactatctctagcttaagacatattcgggtgactaaagatggtaacgcgaagtttgacctggaacttgacttaaaagactcccagtccaaaatatacttgtataaggatggcgaaatgatcccatatgggttcaataatcagaccaaacattgtctccgaagactgggcaaaaggtatgagttccagattcaggacctgagacctgaagactcgggaatctatcaggtgaaggttgaagacgctgtcgtcttcagcacagaacttgaggcgagtgcaatcccaccaagagtggtagttccattggcggagactcactgtgaggaacagggcgacgcagtgttcgaatgcaccttatctagcccctgcccctcagccgcttggcactttcgtcatcgtctgttacacccctccgacaaatatgaggtgtatgtgtccccagatgggttgacccaccgcctggttgtgcggggagctaggtttagtgatatgggaccctactcccttggaacagggctgtacaccagcagcgcctggctggtagttgaagcagggaaggacaaggacctacagagcacatctgctgatcacaaactgcagtccaggcggagtggaaaggacggaagactggacatttacggggagaggcgcgacgccacaagatctagtactagcagatacaagcccggtaccggttcattctccaaagatgcgcagggccccatgggacacttttctcaagggttggcagatatggaagtgcagccgggagaagccgctaccctgtcctgtacactgacttccgacttggggcccgggacttggtttaaagacggtgttaagctcaccacccaagacggcgtcatttttaaacaggacggcttagtgcattccctcttcatcacccatgtgcaggggacacaagcgggacggtacacattcgtggcaggcgatcagcagtctgaggcaacgttgactgtgcaggattctccaaccatcgcccctgacgttaccgagaagttgcgtgagccattagttgtcaaggccggcaagcccattcaaacttaccactag

SEQ ID NO: 30552 - DNA, 1446 bp, Artificial Sequence
  Description of Artificial Sequence: Synthetic coding sequence
atgatgttgaagagtataaccgaatcattcgccacagccatccatggcttaaaagtagggcacttgacagatcgtgtgatacaacgtagtaaacgaatgatccttgacaccctgggagccggatttttaggtaccacaaccgaagtgtttcacattgcctctcaatactctaaaatctacagctcaaacatcagcagcactgtgtggggccagcccgacattaggctgcctcccacttacgctgctttcgtgaacggagtcgccatccactccatggactttgacgacacctggcaccctgccactcaccccagcggagcagtcctgcccgtcttaacagctctggctgaggccctgccgagaagccccaaattttccggtctggacctgcttctggcattcaacgtgggcatagaagtgcagggtcggctgcttcacttcgcaaaagaagccaacgacatgccaaagcgttttcatccccctagcgttgtaggcacgctcggaagcgccgccgcagcatccaagttcctcgggctatcctcaactaagtgtagagaggctctggctatcgccgtatcacatgcgggcgctccgatggctaacgccgctacccagacaaagcccttacatatcggcaatgcagcaaaacacggtattgaagcggctttcttggctatgctcggactgcaggggaataaacaagtgctggatctcgaggctggattcggagctttctacgctaattacagccccaaagtgctaccctctatcgcctcgtattcctggctgcttgaccagcaggatgtggctttcaagaggttccctgcccatttgagcacgcactgggtcgctgatgccgcggctagtgtgcgaaaacaccttgtggctgaacgcgcgctgctgcccacagattatataaagaggatagttctgcgaatccctaacgttcagtatgtaaataggcccttcccagtatccgagcacgaagcaagacacagcttccaatacgttgcttgcgcgatgttgcttgatggaggtattacagtgccaagcttccatgagtgtcagattaatagaccacaggtgcgggagctcttgagcaaggtggaactggagtatccgccagacaatttgccttcatttaacatactttactgtgaaatcagtgtgacattaaaggacggagccacattcaccgaccggtctgacaccttttatggccactggaggaagcccctgagccaggaagacctggaagaaaaattcagggctaatgcttccaaaatgctgtcctgggataccgttgagagccttatcaagatcgtgaaaaatctcgaggatctggaagactgttctgttctgaccactttgttgaaggggccatcccccccagaagtggcctctaacagcccagcctgcaacaattctattactaatctctcctag

SEQ ID NO: 30553 - DNA, 1446 bp, Artificial Sequence
  Description of Artificial Sequence: Synthetic coding sequence
tttcctttgaagagcattaccgagagctttgctaccgccatccacggtttaaaggttggccacctcactgatcgagtcattcagcgctcaaagcggatgattctggatacgctcggggccggctttctgggcactactacagaggtgtttcacattgccagtcagtactccaagatttacagtagtaacatatcatctactgtctggggccagcctgacatccgattaccccccacctatgcagccttcgtgaacggcgtagctatacacagcatggattttgacgacacatggcaccccgccacgcacccttctggcgccgtgcttcccgttctgactgctctggcagaggccttgccgcgaagccccaaattttcaggtctcgacctgctcttggccttcaacgtggggatcgaagtccagggacggctgctgcactttgccaaagaggccaacgacatgcctaagcggttccatcctcctagcgttgttggcacattgggatcggcagccgccgcatctaagtttctgggtctgtcttctacaaaatgtagggaggcattagccatcgctgtgagccatgctggggccccaatggctaacgctgccacccaaacaaaacccctccacatcggtaatgccgcaaaacatggaattgaagccgctttccttgccatgctgggccttcaaggtaacaaacaagtcctcgatctcgaggccgggtttggggcattctacgcgaactattcaccaaaggtgcttccatcgatcgcctcatactcttggctcctggaccagcaggacgtggcctttaagcggtttcccgcccatctgtccactcattgggtggctgacgcagccgcaagtgttcgcaagcatcttgtggccgaaagagccttactcccgactgactatataaagcgcattgtcctgagaatccccaacgtgcagtacgttaatagaccatttcctgtttctgaacatgaagccaggcattcttttcagtacgtggcttgcgcaatgctgctcgatggcggcatcacagtgccatcatttcacgagtgtcagatcaaccggccccaggtcagggagctcttgtccaaggtggagctcgaatatccaccggacaacctcccatcgttcaatatcttatactgtgagattagtgtgaccttgaaagacggcgctacatttacagataggtctgataccttctatggccactggagaaaacccctgtcgcaggaagacctggaggagaaattccgagctaacgcaagcaagatgctgagctgggatacagtggagagccttatcaagatcgtgaagaatctggaggatctggaagattgctctgtattaaccacactgctgaaaggacctagccccccagaggtggcgagcaattcgccagcgtgcaacaactccattaccaatttatcttag

SEQ ID NO: 30554 - DNA, 963 bp, Artificial Sequence
  Description of Artificial Sequence: Synthetic coding sequence
atggctgagggagacgcagggagcgatcaacgtcaaaacgaagaaattgaggcaatggcagccatttatggagaggagtggtgcgttatcgacgattgcgcgaaaatattctgcattcgtatcagtgatgacatcgatgaccctaagtggaccttatgcctgcaggtgatgctgcctaatgagtaccccggaacagcgcctcccatttatcagctcaacgcaccttggcttaaggggcaagaacgcgctgacctcagcaatagtttggaggagatttacatccagaatatcggtgagtcaatcctctatctctgggtcgagaaaattcgggatgtattaatccagaagagccagatgacagaacccggaccagacgttaagaaaaagacagaggaggaagacgtagagtgcgaggatgatttgattcttgcctgccagcctgagagttccctgaaggccttagactttgacattagcgagacacgtaccgaagtggaggtcgaagagcttcctcctatcgaccatggtatcccgattacggatcggaggtccacattccaggcccatctcgcccctgtggtttgtccaaaacaagtgaagatggtgctgagcaaactgtatgagaataaaaagatagctagcgctacacacaacatctacgcctatcgaatctattgtgaagacaaacagactttcctgcaggactgcgaagacgacggggagactgctgccggcgggcggcttttgcatttaatggagatacttaacgtcaaaaacgtgatggtggtggtgagcaggtggtacggtggaatcctgctgggacccgatcgttttaagcatattaataactgcgctagaaacatcctggtggagaagaactatacaaactcgccggaagagagcagtaaggcgctgggtaaaaataagaaagtgaggaaggataagaaacgcaatgagcactag

SEQ ID NO: 30555 - DNA, 492 bp, Artificial Sequence
  Description of Artificial Sequence: Synthetic coding sequence
atgagcaccaacgaaaacgccaacacacaggcagcccacctgcatcgatcaaaaaacaaaggcaaggatagcaccgaaactcggcgccaccgtatagaggtaaatgtggaactcagaaaggccaaaaaagatgaccaaatgttgaagcgccgaaacgtttcctcatttcctgatgatgctacctctccgctccaggaaaactgtaacaaccagacccccgctctgcgcgctataggaaacatcgtgactgggacagacgagcagacccaggtcgttatcgatgcaggggcacttgctgtgttccctagtctgctgacaaaccctaaaactaacatccagaaagaggcaacatggaccatgagtaatatcacagctagccgccaagaccagatccagcaagtggtgaatcacggacttgttccctttctggtgagcgacttgagcaagatcttgcggcacaagcggaagttgtatgggccatggaatagctag

SEQ ID NO: 30556 - DNA, 156 bp, Artificial Sequence
  Description of Artificial Sequence: Synthetic coding sequence
atgtcaggcccactgtccccagtctgctcttgccctcaactgcccttcatgctgtccccctgtcatatgcaccaccaccccgggcacgtggccctgagccagacagtgagcccggccagtctgctcacccagggcttgggtctgcctcagcattag

SEQ ID NO: 30557 - DNA, 2775 bp, Artificial Sequence
  Description of Artificial Sequence: Synthetic coding sequence
atggagataaaggaggagggtgcgagcgaggagggacagcacttcctgccaactgcacaggctaacgatcccggggactgccagttcacaagcatccagaagacacctaacgaaccacagctggaattcatattggcttgcaaagacctggtggctccagtcagggaccggaaactgaataccctcgtgcagatctcagtgatccatccagtcgagcagagtctgactcgctactctagcacggagattgtggagggaacgagggaccccctctttctgaccggggttaccttcccctctgaatacccaatctacgaggagaccaagatcaagctgaccgtgtacgacgttaaggataaaagtcatgataccgttagaacctcagtgctgcctgagcataaggatccacctccagaagtgggtcgctctttcctgggctacgcctccttcaaggtcggagagctgctcaagtccaaggagcaactactggtgttgagcctgcgaacaagcgatggaggcaaggtcgtggggacaatcgaagtgtccgtggtgaaaatgggcgagatcgaagatggagaagcggatcacatcaccaccgacgtccagggccagaaatgtgcactggtgtgtgagtgtacagccccagaaagtgtatccgggaaggataatctgccattcctgaattctgtgcttaaaaacccagtatgcaagctctatcgctttccaaccagcgataataaatggatgcggatccgtgagcaaatgtccgaaagcatccttagttttcacatccctaaggagcttattagtttgcacatcaaagaggacctctgccggaaccaggagattaaggagctgggcgaactcagccctcactgggataacctccggaaaaacgttctgacgcattgcgaccagatggtgaatatgtatcaggacatcttaactgaactttctaaggagaccggctcttcctttaaatctagtagtagcaaaggcgaaaagactctggaatttgtccccataaatcttcacctgcagcggatgcaagttcattccccacacttaaaggatgccctttacgacgtgatcactgtcggagctcccgcggcccattttcaaggattcaaaaatggtgggctcaggaaactcttgcatcggttcgaaacggaacgcagaaacactgggtaccagtttatctactatagtcccgagaacaccgcaaaagcaaaggaagtgctgagcaatatcaatcaactccagcccctgatcgcaactcacgccgaccttttgctgaattctgcatctcaacactctccagattctttaaaaaatagtttaaagatgctatcggaaaagacagagttgtttgtacacgcatttaaagatcagctggtaaggagtgccctacttgccctctacactgcccgacctggcggcatcctgaaaaagcctccctctcccaagtcaagtacagaagaaagtagcccccaggatcaacccccagtgatgaggggccaagattccatcccgcaccatagtgactatgacgaggaggaatgggatagagtgtgggctaacgtgggcaaatctcttaattgtataatcgcaatggtggacaagttaatcgagagggatggcgggagcgagggctctggtgggaataacgatggcgaaaaggaaccttccctgactgatgctattccctctcacccacgcgaggattggtatgaacaactgtaccctttgatcctcacgcttaaggactgcatgggtgaggtggttaatcgcgccaagcagagcctgaccttcgtgctgctgcaggagctcgcctactcattacctcagtgccttatgctcacgctgcgaagggacatcgtcttctcccaggcactagccgggctcgtctgtgggttcataatcaaactgcagacatctctgtacgatccgggattcctgcagcagttgcatacagtagggctgatcgtgcagtatgaaggcctcttgtctacatattccgacgagatcgggatgctcgaggatatggctgttggaatttccgacctgaaaaaggtggcatttaagattattgaggccaaatctaacgatgttctgccagtaatcaccggccgccgcgaacactatgtcgtggaagttaaattacctgcaaggatgttcgaaagtctgccgctccagataaaggaggggcagctgctgcacgtatatcctgtcctcttcaacgtgggtatcaatgagcagcaaaccctggccgagcgctttggagatgtgtccctccaggagtctataaatcaggagaactttgagctgcttcaagagtactataaaatctttatggagaagatgccacccgattacatctcgcacttccaagagcagaacgacctgaaagccttattggagaacctgttgcagaacatccaaagcaaaaagagaaaaaatgttgagatcatgtggctcgcagccactatctgcagaaaactgaatggaatccggtttacttgttgtaaatcagcaaaggacaggacctccatgtctgtgaccctggaacagtgttctatcctacgtgacgaacaccagctccataaagattttttcatccgggccttggattgcatgagaagagagggatgtcggatcgagaacgtcttgaaaaacatcaagtgtcgaaagtatgcttttaacatgctgcaactgatggcgtttccaaagtactataggccacccgagggtacgtatggaaaggcggacacctag

SEQ ID NO: 30558 - DNA, 2775 bp, Artificial Sequence
  Description of Artificial Sequence: Synthetic coding sequence
atggagatcaaggaagagggcgcctccgaagaaggacagcatttcctgcccactgcacaggccaatgatccaggggactgccagtttacatccatacagaagactcccaacgaaccacagctcgagttcatactagcatgtaaggatctagtcgccccggtcagagatcgtaaattgaacaccctggtgcagatatccgtcatacacccggtcgagcagtctctcacaagatattcttctacagagattgtcgaagggactcgggatccactctttctcactggagtgacctttccctccgaatacccaatttatgaggagacaaagattaagttgacagtttacgatgtgaaagataaaagccacgacaccgtgcgtacctcagttctgccagagcataaggatcctccgcccgaggtcgggaggtcattcctgggatacgctagttttaaagtcggcgagttactcaagtcgaaggaacagctgttggtcctgagtttgaggacatctgatggcgggaaagtggttgggaccattgaggtctcagttgttaagatgggagaaatcgaggatggcgaggcagatcacattacaaccgacgtccagggccaaaaatgtgcgctggtgtgcgaatgtaccgctcccgagagtgtcagcggaaaggacaatctcccattcttaaatagtgttctcaagaacccagtgtgcaagctgtatcggtttcccacatcagataacaagtggatgaggattagggaacaaatgagcgaatccatcctatcatttcacattcctaaggagcttatttctttgcacatcaaggaagatctctgccgtaaccaggagattaaggagctgggggaactgtctccacattgggataaccttagaaagaacgtgctgacacattgcgatcagatggtcaatatgtatcaggatatactgaccgagctgagcaaggaaacaggctccagtttcaaaagctcatcctcgaagggggaaaaaacactggaattcgttcctattaatctgcatctgcagagaatgcaggttcatagtccccatctcaaggatgccttgtatgatgttattaccgtcggggcccccgctgctcattttcaaggtttcaaaaacggcggtctgcggaagcttcttcacagattcgagactgagcgccggaatacaggatatcagttcatatattacagccctgaaaacacggctaaagctaaagaagtgctctctaatatcaatcagctccagcccctgatcgcaacccatgcggacctactactgaacagtgctagccagcattctccggatagtctaaagaatagtctgaaaatgctctccgaaaaaactgagcttttcgtccatgccttcaaggatcagttggtgcgctccgctctattggccctctatacagcaaggcctggcgggattctgaagaaacctcccagcccgaaatcttctaccgaggaaagcagcccccaggatcagcctcctgtaatgagaggacaggatagtattcctcaccattccgactatgatgaagaagaatgggaccgggtttgggccaacgtcggaaagagtttaaactgcatcatcgctatggttgacaagctaattgagcgtgacggtggctctgagggcagcggagggaacaacgacggcgagaaggagcctagcctaaccgacgctatacctagccaccccagggaagattggtacgagcagctctaccctctaatattgaccctgaaggattgcatgggtgaggtggtcaatcgcgctaaacaaagcctaacatttgtgctgctccaggagcttgcatactctttaccccagtgcctgatgctgacacttagacgcgatatcgtcttttcacaagcccttgcaggccttgtgtgtggatttattatcaagctgcaaacttctctctacgacccagggttcctgcagcagctacacaccgtgggactcatagtacagtatgaaggcttgctttccacttatagcgatgaaatcggcatgttggaggacatggctgtcgggatctccgatttaaagaaagtggcgttcaagatcattgaggcaaagagcaacgacgtgcttccagtaattaccggccggcgcgagcattatgtagtggaggtgaaactgcctgctcggatgtttgagtccctgccacttcagatcaaggaaggacagttgttgcatgtataccctgtgctattcaacgtgggtataaacgagcaacaaaccctcgctgagagattcggtgatgtatcactgcaggagtccatcaatcaggaaaattttgagctgctccaggagtactataagatatttatggaaaaaatgccccctgactatattagtcactttcaagaacagaacgatctgaaagccctcctggagaatcttctgcaaaatatacagagtaagaagcgtaaaaacgtcgagattatgtggctcgctgctacaatatgtaggaaattgaacggcatcaggtttacttgctgcaaatcagccaaagacaggaccagcatgtctgtgaccttggaacagtgttctatcttgagggatgagcaccagcttcataaggatttttttatccgtgctctcgattgcatgcgcagggaggggtgtcgaattgagaacgtgctgaaaaatatcaaatgccggaaatatgccttcaatatgctccagttgatggcgttccctaagtactatcgcccaccggaggggacctatggtaaagccgacacgtag

SEQ ID NO: 30559 - DNA, 120 bp, Artificial Sequence
  Description of Artificial Sequence: Synthetic coding sequence
atggagataaaggaggaaggggcaagtgaggagggccagcacttcctgcccactgctcaggcgaatgaccccggagattgtcagtttacatctatacagaagacgccgaatgagccttag

SEQ ID NO: 30560 - DNA, 396 bp, Artificial Sequence
  Description of Artificial Sequence: Synthetic coding sequence
atggaaataaaagaagagggggcctcagaggaaggacaacattttctacctacagcccaggctaacgatcctggggattgtcaattcacttctattcagaagacaccaaacgaaccccaacttgagtttatcctggcttgcaaggacctcgttgccccagttagagacaggaaactgaataccttagtgcagatctctgtcatccatcctgtagagcagagtctcactaggtatagctccactgaaatcgtggagggcacgagagatcctctgttcttaacaggggtgacgtttcctagcgaatacccaatctatgaagaaacgaagattaagctaacagtgtacgatgtgaaggacaaaagtcacgatacgatagccaatagctcccgtatctag

SEQ ID NO: 30561 - DNA, 255 bp, Artificial Sequence
  Description of Artificial Sequence: Synthetic coding sequence
atggaaatcaaagaagaaggagctagcgaggaaggacagcacttcctgcccacagctcaggcaaacgatcccggcgactgccaattcactagtatccagaagaccccaaatgaacctcagctcgagttcattcttgcgtgtaaagatcttgtggctcctgtccgtgatcggaagctaaacaccctggtgcaaatttccgttatccaccctgtggaacagagcctgacccgctattccagtaccgagattgtgtag

SEQ ID NO: 30562 - DNA, 162 bp, Artificial Sequence
  Description of Artificial Sequence: Synthetic coding sequence
atggagattaaggaagagggcgcttctgaggaggggcagcactttctgccaaccgcgcaggctaatgatccaggcgattgtcaattcacctccatccagaagacacctaacgaaccccagctcgagtttattttggatttgaatcaggagctgagggattag

SEQ ID NO: 30563 - DNA, 2775 bp, Artificial Sequence
  Description of Artificial Sequence: Synthetic coding sequence
atggagattaaagaggagggcgcttccgaggagggccaacatttcctccccaccgcccaggctaacgacccaggggactgccagttcacttccattcaaaaaactcccaatgagccccagctggagtttattctggcgtgcaaggaccttgtagcccctgttagagataggaagctgaacaccctggttcaaatctctgttattcaccctgtggagcagagcctcaccagatatagcagtactgagattgtagagggaacccgtgatcccctgttcctgactggggttacattcccctccgagtaccctatctacgaggagactaaaattaaactgactgtgtatgacgtgaaggataagagtcatgacactgtgaggacaagtgtgctgccagagcacaaggatccaccaccagaagttggcagatcttttctggggtacgcatcctttaaggtgggggaactcctgaagagcaaggagcaactgctggttctcagtctgcgcacttctgacggtggcaaagtggtcggtacgattgaagtcagcgttgtgaagatgggagagattgaggatggcgaagccgaccacatcactacggatgttcaggggcagaagtgcgccctggtgtgtgagtgcactgcccctgaatccgtgagtggcaaggataatctcccctttctgaacagcgtcctgaaaaaccccgtttgtaagctgtaccggtttccaacctctgacaacaagtggatgcggattcgagagcaaatgtcggaatctattctaagctttcacattcccaaggagctgatcagcttacatatcaaagaggacctgtgtaggaaccaagagattaaagagctgggagagctgtcgccccactgggacaaccttcgtaagaatgtactgacacattgcgaccaaatggtaaatatgtaccaggacatccttactgaactttcaaaggaaaccggttcaagctttaaatcctcatcgagcaagggggagaagactttggaatttgtgcctatcaatctgcacctgcagcggatgcaggtgcattcaccacatttaaaagacgctctctacgatgtaatcacggtgggagcaccggccgctcacttccaaggtttcaagaatggcggcttgcgtaagctgctacatcggttcgagaccgagaggcgtaatacaggctaccagttcatctactatagccctgagaacacagccaaggccaaggaagtcctgtcaaatattaatcagctccaaccacttattgctacacacgccgacctcctgctgaacagcgcgtctcagcactcacccgattcccttaagaacagcttaaagatgttgagtgagaagaccgaactgtttgtacacgccttcaaagaccagctggtacgttccgccttgctggctctgtacacagctagaccaggtggcatactcaaaaagcctccgagtcccaagtctagtactgaggaaagcagtccccaggaccagccccctgtgatgaggggccaagattccatccctcaccactctgattacgacgaggaagaatgggacagagtctgggcaaatgtcggtaagtcactcaactgcatcattgctatggtggataaacttattgaaagggacggcgggtccgagggttcagggggcaataacgatggcgagaaggagcccagcctgacggatgccattccatcacaccccagggaggattggtatgagcaactataccctctgattctgaccctgaaagattgtatgggagaagtcgtaaacagggccaaacaaagcctgaccttcgtcctgcttcaggagctggcctattcactgcctcagtgcctgatgctgacacttcgtcgggatattgtgttcagccaggctctagccggcttggtctgcggcttcatcataaaactgcagacttcactctacgaccctggctttctgcagcaactgcatacagtaggcctgattgtgcaatatgaaggactcttgtcaacatacagcgacgagatcgggatgctcgaggacatggctgttggcatctctgacctcaagaaggtggcctttaagatcatcgaagccaagtccaatgatgttctgcccgtcatcactggccggagggaacactatgtggtggaggtgaagctacccgctagaatgttcgagtctctgcctctgcagattaaggagggccagctcctgcatgtgtatcctgtgctgtttaacgtcgggatcaatgaacagcagacgctcgctgagaggttcggcgatgtatccctgcaggaaagcattaaccaggaaaattttgagttattacaggagtattacaagatctttatggagaaaatgccccccgattatatctcacacttccaggagcagaacgatctcaaagcgctgctcgagaatctgctccagaatatccaatccaagaagcgtaagaatgtggaaattatgtggctggcggctacgatttgcagaaaactgaacgggatacgctttacatgttgcaagagcgccaaggataggacgtctatgtccgtcacgctcgagcagtgctcaatcttgcgggatgaacaccagctgcataaagatttcttcattcgcgccctggactgcatgcgccgtgaggggtgtagaatagagaacgtgctgaaaaacatcaaatgtcgcaagtatgcatttaatatgcttcagctgatggcattccccaagtactaccggcctcctgaagggacctacggtaaagcagacacctag

SEQ ID NO: 30564 - DNA, 2817 bp, Artificial Sequence
  Description of Artificial Sequence: Synthetic coding sequence
atggaaattaaggaggagggtgccagtgaagaaggtcagcacttcttgcccacggctcaggcgaatgaccccggcgattgccaatttacttctattcagaagacaccgaacgaaccccagctggagttcatcctagcctgtaaagatctggtcgctcccgtgcgagatcgaaaacttaacaccctcgtccagatttccgtgatacaccctgttgaacagtctctgactcgctactcctccactgaaattgttgaagggacccgcgacccccttttcctgacaggcgttactttcccttccgaatacccaatctatgaggagactaaaatcaaattgacggtgtacgatgttaaggacaaatctcacgacaccgtccggacaagtgtgctgcccgaacacaaggacccacctcccgaggtgggccgcagtttcttgggatacgctagtttcaaagtgggcgagctgttgaagtccaaggaacagcttctggttctctcacttcgcacctctgacgggggtaaagttgtggggaccatcgaggtgtcagtcgttaagatgggagagatcgaggatggggaggccgaccatatcaccactgacgttcagggccagaaatgcgccctggtgtgtgagtgcactgcccctgagtccgtgtccggcaaagacaatcttccttttttaaattcagtgctcaaaaatcctgtgtgtaagctgtatcgctttccgacgtccgataataagtggatgcggattagggagcagatgtctgagagcatcctctcttttcatatccccaaggaactgattagcctgcacattaaggaggacctctgcaggaatcaggagattaaggaactcggcgagctctctccccattgggacaatttgcgtaaaaacgtgttaacccactgcgaccagatggttaacatgtatcaggatatcctgacagagctgtctaaggagaccggttctagctttaaaagttcctcaagcaagggggagaagacccttgaattcgtccctatcaacttgcacctgcagcggatgcaggtgcatagccctcacctcaaggatgccctctacgacgtgataactgtcggggctccagcagcacactttcagggtttcaagaatggtggcctgaggaaactcctgcatcgctttgaaaccgagaggcggaatactggttatcagtttatatactactcacccgagaataccgcgaaagccaaggaggtattgtcgaatatcaatcaattgcagccgttgatagcgacccacgccgacctccttctgaattccgccagccagcactccccggacagcctgaagaacagccttaagatgctgagcgaaaagaccgagctgttcgtgcacgcctttaaggatcaactggtccgatctgcactcctggcgctgtataccgctcggcctgggggaatcctaaagaaaccccctagtccaaagtcaagcaccgaggagagcagtccacaagatcaaccacctgttatgagaggccaggacagcatcccgcaccactccgattacgatgaggaagaatgggaccgggtgtgggccaacgttggaaagtctctgaattgcataattgcaatggtcgataagctgatcgagagagatggcggtagcgaggggtccggggggaataatgacggcgagaaggaaccctccctgaccgatgcgatccccagccatccccgcgaggactggtatgaacagctgtacccgctaatactcaccctaaaagattgcatgggcgaagttgtgaatcgcgccaagcagtctctgaccttcgtgctcctgcaggaactagcgtactctcttccccagtgcctcatgctcaccctgaggcgcgatattgtgttctcacaggcccttgccggcttggtgtgcggcttcatcataaaattgcagacaagtctgtatgaccctggcttcctccagcaactccatacagtggggctgatcgttcagtatgagggactcctgtcaacatattctgacgagataggaatgctggaagacatggctgtagggatcagcgatctgaagaaggtcgccttcaaaatcatagaagccaaaagtaacgatgtcctccccgtgattacaggccgcagggagcattacgtcgttgaggtgaagctgcctgctagaatgttcgagagcctcccattgcagatcaaggagggtcagctgctccatgtgtacccagtcctcttcaatgtcggaatcaatgaacagcaaacgctggctgagcgtttcggggatgtctccttgcaggagagcataaaccaggaaaatttcgagttgctgcaggagtactataaaatcttcatggaaaagatgcccccagactacatttcccattttcaggaacaaaatgacctgaaagctctgttggaaaatttgctgcaaaacattcagagcaaaaagaggaaaaacgtggagatcatgtggctcgcggctactatctgccgcaagctcaatggcatccgattcacctgttgcaaatctgccaaagacagaacttcaatgagtgtgactctcgaacaatgtagcatacttcgcgatgagcaccagctccacaaagatttcttcatccgagccctcgactgcatgagaagcagacagacacagggggctctcaatgagagtgacgatccagagaccggatgcctgacggacaataaaccgacatctagacatttttaccctgtagcactgctgctggtgtctagtcacctcctggtagtctggctcattctgtctctcgctctcctcttagccaagtaccagtag

SEQ ID NO: 30565 - DNA, 2454 bp, Artificial Sequence
  Description of Artificial Sequence: Synthetic coding sequence
atggagattaaggaagagggagcttctgaggaggggcaacacttccttcctactgcccaggcgaatgaccccggggattgtcagtttactagcatccagaaaactcccaacgaaccccagctggagtttatactggcatgcaaagacctggtggcgcctgtgcgggacagaaagctgaacacacttgttcagatatccgtgattcacccagtggaacagagtttgacccgttacagttctacggagatcgtcgagggaacacgggaccctttgttccttacgggggtcacttttccaagcgaataccctatttatgaggaaactaagattaagctgactgtttacgatgttaaggacaaatctcatgataccgtgaggacatccgtgttgcccgaacacaaagatccaccccccgaagtagggcggagcttccttggatatgcaagcttcaaggtgggcgaactgctgaagtccaaggagcaattgctcgtcctgtcactcagaacatctgatggaggaaaagtagtgggcacgatcgaggtgagcgtggtgaaaatgggcgagatcgaggatggagaagccgaccatataactacagacgtgcaggggcagaaatgcgccctggtttgtgagtgtacagctcctgagagcgtttcaggtaaagataatctgccatttctgaatagtgttctcaaaaatcctgtgtgtaaactctacagattcccaacctcagataataagtggatgcggataagggagcagatgagcgagtcaattcttagcttccatatcccaaaggagcttatctctttacatatcaaagaggatctctgtcggaatcaggagatcaaagagcttggcgagctgagcccccactgggacaatttacggaaaaatgtacttacccactgtgaccagatggtgaatatgtaccaggatatactgactgaattaagtaaagagactggatcctcctttaagtcatcaagctctaaaggagaaaagaccttggaatttgttcccatcaatctgcatcttcagagaatgcaggtccacagcccacacctcaaggacgctttgtatgacgttatcaccgtcggtgcccccgccgctcattttcagggctttaaaaatgggggcttaagaaagttattacatagattcgaaaccgagagacgaaacaccggctatcagtttatctattattcccctgagaatactgcaaaagcgaaggaagttctgtcaaacattaatcagctccagccccttatcgcgacacacgcagacctccttcttaacagcgcctcacagcacagcccagattctctgaaaaactccttaaagatgctcagtgagaaaaccgagctcttcgtgcacgccttcaaggaccaattggtcaggtccgccctgctggcgctctacacggcacgtccaggtggcatcttgaaaaagccaccttctcccaaaagttccacggaggagtcatccccccaagatcagcccccagtgatgcgggggcaggatagtataccgcatcacagcgactatgatgaggaggaatgggatagagtctgggcaaacgtcggcaaatctctgaattgtattatcgccatggtggacaaactgatcgagcgggacggcgggtcggagggctctgggggaaataatgacggtgagaaggaaccatcgctcactgacgctattccgtcccatccacgagaggactggtacgagcagctgtatcctttgatcctgaccctcaaggattgtatgggagaggttgtgaacagagcaaaacagagtctgacattcgtccttcttcaggagctcgcttacagcttgccacagtgcctgatgttgactctgaggcgggatatcgtgttcagccaggccctggccggcctggtgtgcggctttattatcaaactccaaacatcactgtatgatcctggattcctccaacagctgcacactgtgggcttaatcgtccagtacgagggcctgctatccacctattcggatgaaattgggatgcttgaggatatggccgtgggaatttccgacctgaagaaggtggcatttaaaataatcgaagcaaagtcaaacgatgtactcccggtgattactggtaggcgtgagcactatgttgtggaggtaaagctgcccgctaggatgttcgagagcttaccgcttcagataaaggagggccaactgttgcacgtgtacccagtgctctttaacgtgggtattaacgaacagcagaccctggccgaaaggtttggagatgtttcactccaggaaagtattaatcaggaaaacttcgaattacttcaggagtattacaaaatctttatggagaagatgccccctgactacattagtcattttcaggaacaaaatgacctcaaggccctcctggagaatctgctacagaatatccaaagtaaaaagtag

SEQ ID NO: 30566 - DNA, 2775 bp, Artificial Sequence
  Description of Artificial Sequence: Synthetic coding sequence
atggagattaaggaagaaggagcctctgaggagggacagcacttcctgccgacggcacaggctaacgaccccggtgactgccagtttactagtatccagaaaaccccaaatgagcctcaactagagttcattctcgcctgcaaggacctggtcgcccccgtaagagacaggaaacttaacacactcgtccagatttccgttatccaccctgtggagcagtcattaactcgctacagctccacagagattgttgagggtaccagggatccgctgtttctgaccggcgtgacgttcccatccgaatatcccatttatgaggagacaaaaatcaagcttacggtatacgatgtaaaggataagtcccatgacacagttcgaaccagcgttctgcccgaacataaagacccaccccctgaagtgggccgcagttttttgggatatgcctcctttaaagtcggggagctcctgaagtccaaggaacaacttctggttctgagccttagaacaagtgacggtggaaaggtggttggaactatcgaggtcagcgtcgtgaagatgggggaaatcgaggacggggaagctgaccacatcactaccgacgttcagggacagaagtgcgcactggtgtgcgaatgtactgctccagaatccgtgtccggtaaggataacctgcctttcctcaatagtgtgctgaagaatcctgtgtgcaaactgtacagatttcccaccagcgataataaatggatgaggatccgcgagcagatgtccgaatctatattatctttccatattccaaaggagctgatttcattgcatatcaaagaggacctgtgtaggaaccaagaaatcaaagaattgggggaattaagcccccactgggataatctccgtaagaatgttctgacgcactgcgaccaaatggtgaatatgtaccaggatatcctcaccgagttaagcaaagaaaccggaagctcctttaagtcaagtagtagcaagggtgagaagacactggaattcgtgccaattaatctccatttgcagagaatgcaagtgcattctcctcacctgaaggatgccctctatgacgttatcaccgttggagcccctgctgcccattttcaggggttcaagaacgggggattgaggaaattgctccatcgcttcgaaactgaacggagaaatactgggtatcagttcatctattactccccggagaataccgctaaggcaaaggaagtgctgtcaaacatcaaccagctccagccactgatagcgacacatgcggatctcctgctcaattccgcaagtcagcatagccctgacagtcttaagaactcactgaagatgttgtcagaaaaaactgaattgttcgtccacgcattcaaagaccagctagtgagatccgctttactggccttgtacaccgcaaggccaggaggaattctaaagaagcctccatcccccaaatctagcacggaggagagttccccacaggaccagccaccagttatgagaggtcaggattctatcccccaccacagcgattatgacgaagaagagtgggatagagtgtgggcaaatgttggaaagtcactgaattgtatcatcgccatggtcgataaactgattgaaagggatggggggagtgagggaagcggcgggaataatgatggcgaaaaagagccatcgctgactgacgcgatcccatcccatccacgggaagattggtacgagcagctgtacccactcatcctcaccttgaaagattgcatgggggaagtcgttaatcgagccaagcagagtctgactttcgtgctgttgcaggagctggcatattccctccctcagtgcctcatgctgacgctacgaagggatattgtgttcagtcaagctctggccggactggtgtgtggtttcatcatcaagttgcagacttctttgtatgaccctgggttcctgcagcagctgcatactgttggcttaatcgttcaatacgaaggactcctaagcacctatagcgacgagattggaatgctcgaggacatggcggttggtattagtgacttgaagaaggttgcgtttaagataatcgaagcaaaaagcaatgatgtgctacctgttattaccgggcgccgcgaacattatgtggtggaagttaagctccccgcgagaatgttcgaatccctgcctcttcagattaaagaaggacagctattgcatgtttatccggttctatttaatgtcggcattaatgagcagcagactcttgcagagagatttggcgacgtctccctccaggaaagtatcaaccaggagaacttcgagctgctgcaggaatattataagatttttatggagaaaatgccacccgattacatttctcattttcaagaacaaaacgacctgaaggcgcttctggaaaatctcttacagaatatacagagtaagaaacggaagaacgtagaaatcatgtggttggcagcaaccatatgccgcaaactaaatggaattcggtttacgtgctgtaagagtgcaaaagatcgtacaagcatgtcagtgacactggagcagtgtagcatcctgcgggatgagcaccagctacataaggacttcttcattcgcgccctggactgtatgcgacgcgagggatgtcgcatcgagaatgttcttaaaaacatcaaatgcaggaagtacgccttcaacatgctccagctcatggcgtttccaaaatattatagaccacccgagggaacctacggcaaggctgacacgtag

SEQ ID NO: 30567 - DNA, 1971 bp, Artificial Sequence
  Description of Artificial Sequence: Synthetic coding sequence
atgggtgaaatcgaggacggagaggcagaccatataaccactgatgtgcaaggtcagaagtgcgccctggtttgcgagtgcacggctccagagagcgtgtcaggcaaagataatctcccattcctgaattccgttctgaagaaccctgtgtgcaaactatacaggtttccgacttccgacaacaagtggatgagaatacgggaacagatgtctgagtctatcctctcttttcatattcccaaggagttaatttccctccacataaaagaggatctgtgcagaaaccaggagataaaagaactgggggagttatcaccgcattgggataaccttcgaaagaacgtgttaacccattgtgatcaaatggtgaatatgtaccaggatattttgaccgaactcagtaaagaaactgggagctcttttaaatcatctagttccaagggcgagaagaccttggagtttgtgcctataaatctgcacctgcaaagaatgcaggtgcatagtcctcacctgaaggacgccctgtacgatgtaatcacagtgggcgctcctgctgcacactttcaaggatttaaaaacgggggtctgaggaaactactgcacaggttcgaaacagaacgcagaaataccggttaccagttcatttattattcccctgaaaatacagcgaaggccaaagaagtgctgagtaatatcaaccagctacagcctctaatcgccacccatgcagacttactgctcaattccgcctcacaacactcacccgatagtctaaagaactctctgaaaatgctgtctgagaaaaccgagctttttgtgcacgccttcaaagatcagctggtgcgttccgcgctgctcgcactctacactgctcgacctgggggaattctgaagaaacccccatctcccaagtcttctactgaagagtcctccccgcaggaccagccgccagtgatgagaggacaggacagcataccacaccactctgactatgatgaagaggagtgggaccgggtatgggctaatgtcggcaagtccctcaattgtattatcgctatggtggacaaattgattgagcgcgacggtgggagcgagggaagcgggggaaacaatgacggcgagaaggaaccgtcgctaaccgacgcgattccttcacatcccagggaggactggtacgaacagttatatccactgatcctgaccttgaaagattgtatgggagaggtcgtcaaccgtgcaaaacagagcctcactttcgttcttctgcaagagctcgcctattccctacctcaatgcttgatgcttactctacgaagagatatagttttctcccaggccttggctggactggtgtgcgggttcataataaagttacaaacgtctttgtatgaccctgggttcctccagcagcttcacactgtgggtctaatcgtgcagtacgaagggttgttgtctacgtactctgacgagatcgggatgctggaggatatggcagttggaatttccgatctgaaaaaagtcgcctttaaaattatcgaggcaaaatctaatgacgtcttaccagtgattaccggccggcgagagcactacgttgttgaggtgaaattgcctgcaaggatgttcgaaagtctccctcttcagattaaggaaggccaattactccacgtgtacccggtcctcttcaacgtgggcattaacgagcagcagactttggccgagaggttcggggatgtgagtttgcaggaatcaataaaccaggaaaacttcgaacttctccaagagtactataagattttcatggagaaaatgccacccgactacatctctcactttcaggagcagaatgatcttaaggccctgctggagaacctgttacagaatatccaatcaaaaaaaaaggaatgcaggaactatgtggccggatgcaacgacctaccccagacggaatggtacagttttcatcttttgtag

SEQ ID NO: 30568 - DNA, 2061 bp, Artificial Sequence
  Description of Artificial Sequence: Synthetic coding sequence
atgatccactttcatcctctgatacttcctcacgagcggtcgtttctgggttatgctagtttcaaagtgggggagcttttgaagtcgaaggaacaactcttggtgctttccctgcggacttcagacggcggcaaggttgttggaacaatcgaggtctctgtagttaaaatgggcgaaattgaggacggtgaagccgaccatataactactgacgtccagggacaaaaatgtgcccttgtatgtgaatgtacagctcctgagagtgtaagcggaaaggataatttgcccttcctaaatagcgtgctgaagaatcccgtttgtaaactctacagattccctacttcagacaacaaatggatgcgcatacgcgagcagatgagcgaaagcatccttagcttccacatcccgaaggagttaatatctcttcacataaaggaagacctttgtagaaatcaagaaatcaaagagctcggcgagctctctcctcactgggataatctcagaaaaaacgtgttgactcactgtgaccagatggtaaacatgtaccaagacatcctcacagagttgtctaaggagacagggagttccttcaagagcagttccagcaagggcgagaaaactctggagttcgtcccaatcaacctccatttacaacgaatgcaggtgcacagcccacacctgaaggacgccctttacgatgttatcacagttggggcccctgccgctcacttccagggctttaagaatggaggcctacggaagctgctgcaccggttcgaaaccgaacgacggaacacaggataccagtttatttactactctcccgagaatacagctaaggcaaaagaggtcctgagtaacatcaatcagctacagcctctaatcgcgacacatgctgaccttctattaaacagcgcctcacaacactccccagattccttaaagaactctctgaaaatgctgagtgagaaaacagaactgtttgtccatgccttcaaagaccagctcgtgcgctctgctctgctggctttatacaccgctcggcccggtgggatcttaaaaaaacccccttctccaaaatcatcaacagaagagtcctccccacaggaccagccacccgtcatgcgcggacaagattccattccccaccacagtgactatgacgaagaagagtgggaccgggtgtgggcaaatgtcggaaaatcgctgaactgcataatcgcgatggtggataaactgatcgagagggatggcggttccgagggctccgggggaaataatgacggggagaaagaaccatctttaacagacgccatcccttcccatcctagggaggactggtacgagcagctctaccccctaattctgacactaaaggactgtatgggcgaagttgtgaaccgggccaaacagtccttaaccttcgttcttctacaagagctggcatattcgcttccccaatgcctaatgctcaccctcagaagggacatcgtgttctcccaggcgctggcaggcctcgtgtgtggattcattatcaagttgcagacctctctttacgacccaggcttcctgcagcaactacatacagtaggactcattgtgcaatatgagggcttgttaagcacatacagcgatgagatcggtatgctggaggacatggccgtggggatttctgacctgaagaaagttgcttttaaaatcatcgaagctaaatccaatgacgttctgccagtgatcaccggcagaagagaacattatgtggtcgaagtcaagctaccagctcggatgtttgaaagcttacctctgcagattaaggaggggcagctcctgcacgtgtatcccgtcctgtttaacgtgggcatcaatgaacaacagaccctggcagagaggtttggcgacgtctccctccaggagtccattaaccaggagaactttgagttacttcaggaatactacaagatatttatggagaaaatgcctcccgattacatttcacactttcaggagcagaacgatctcaaagcgttgctcgagaatctattacagaatattcagagctag

SEQ ID NO: 30569 - DNA, 3399 bp, Artificial Sequence
  Description of Artificial Sequence: Synthetic coding sequence
atggagctgttccaggcaaaagatcattatattctgcagcaaggcgaacgcgccctgtggtgtagccgacgcgatggagggttacagctcagacctgctaccgatctcttactggcctggaaccctatttgccttggcttagtggagggagttatcgggaagattcagctccattccgatcttccatggtggctgattctgattaggcagaaagctttggtcggcaagctacctggagaccatgaggtctgcaaagttaccaaaattgctgtgctgtcgctttctgagatggaaccgcaggacctcgagctagagctgtgtaagaaacatcacttcggtatcaacaagccggaaaaaataattcccagccccgacgattccaagttcctcctcaagaccttcactcacatcaagagcaacgtcagcgcaccaaataagaaaaaggtgaaggaatccaaggagaaggagaagctcgaacggagactgctagaggaactgctgaaaatgttcatggactccgagtcgttttactacagcttgacttacgatctgactaactctgtccagaggcagagcacaggggaacgagatggccggcccctgtggcaaaaggtggatgaccgttttttttggaacaagtatatgatccaggacctgaccgaaatcggcaccccggatgttgatttctggatcatcccaatgatccaaggatttgtccaaattgaggagttggttgtaaactacactgagtcatccgacgatgagaagagttcccccgaaactccccctcaggagtccacatgtgtggatgacatccacccgagatttcttgtagcattaatttcgcggcggagccgccaccgcgccgggatgagatacaagaggcgcggagttgataagaatggcaatgtggcaaactatgtggagaccgaacagctcatccacgtgcataaccacactctgagcttcgttcagacaagggggagcgtaccagtattttggtcacaggtcggctatcggtataacccccgtcctagactggaccgatccgagaaagaaacagtggcttatttctgcgcacatttcgaagagcagttgaatatatacaaaaagcaagtcattattaacttggttgaccaggcaggccgagagaaaatcatcggcgatgcctatcttaaacaggtgctgctgttcaataatagtcatcttacttacgtttccttcgacttccatgagcactgccgcgggatgaaattcgagaacgtccagactcttactgacgccatttacgatatcattctagacatgaagtggtgttgggtggacgaggcaggcgtgatctgtaagcaggaagggatcttccgcgtcaattgcatggactgtctcgatagaacaaacgtcgtacaggccgctatcgctagggtcgtcatggagcagcaactgaagaagctgggtgttatgcctcccgagcagcctttaccagtaaagtgcaacaggatctaccagattatgtgggccaataatggagattccattagtaggcagtacgctgggacagccgctctcaagggcgacttcacccgaacaggcgaacgcaagttagctggagtcatgaaagacggagtgaactctgcaaatcggtattatctcaatcggttcaaagacgcgtatcgacaggccgttatcgatttgatgcaaggcatacctgtcaccgaagatctctacagcatctttaccaaagaaaaggaacacgaggcacttcataaagaaaaccagcgcagtcatcaagagctcatcagccagctgctccaatcttacatgaaattgctgctgccagacgatgaaaagttccatggaggctgggcccttatcgattgtgaccccagccttattgacgctacccaccgcgacgtggatgtcttgcttctcctgtccaacagcgcctactacgtggcctattacgatgacgaggtagacaaggtaaaccagtaccagagactgtccctggagaatctggagaagatagaaattggacctgagccaaccctctttgggaaaccgaaatttagctgcatgcggctgcactatcggtacaaggaagcctccggatattttcatactctccgggcggtgatgaggaacccggaggaagatgggaaagacacactgcagtgcattgccgaaatgctccaaattaccaagcaggcaatgggttccgatctccctatcattgaaaagaagttagagaggaagtcaagcaagccacatgaagacattattgggatcagatcccagaaccagggctcattggcgcagggcaagaattttctcatgagtaagttcagttctcttaaccagaaagtgaaacaaacaaagtctaatgtaaatatcggcaatctacgaaagttaggcaattttacaaaaccagagatgaaggtgaatttcctgaaaccaaacttgaaggtcaatctctggaaatctgactcatcccttgaaacaatggagaatacaggagttatggataaggtccaagcagaaagcgatggcgacatgtccagcgacaatgacagctatcattctgacgagtttctgacaaacagcaagtcagatgaagataggcagcttgccaactccctggaaagtgtcggccctattgattacgttctgccaagctgtggcattatcgcctctgcccccaggctgggttcaagatcacaaagccttagctcaactgatagtagcgtgcacgcaccatccgagatcactgtggctcatgggtccggcctggggaaaggtcaggaatcgcccctgaagaagtcgccaagtgccggagatgttcacattctgactgggtttgccaagcccatggacatatattgccatcgattcgttcaggacgcccagaacaaagtcacacatctctccgagacaagaagcgtcagtcaacaggcttctcaggagaggaatcagatgaccaaccaggtttcaaacgagacccagagcgaatctaccgagcaaaccccatcaagaccaagccagctcgacgtgagcctgagcgcaacaggaccacagtttctctccgttgagcccgcgcattcagtggctagccagaaaacaccaacaagtgccagtagtatgctggagttagaaaccggacttcacgtgacacctagcccctccgagtccagcagctcccgagccgtgagtcccttcgccaaaatccggagctccatggtgcaagtggcctctatcacccaggctggactgacccacggcatcaacttcgctgtgagtaaggtgcagaagtcgcccccagagcctgagatcatcaaccaagtgcagcagaacgagctgaagaaaatgttcatccagtgtcagacacggatcattcagatctag

SEQ ID NO: 30570 - DNA, 1569 bp, Artificial Sequence
  Description of Artificial Sequence: Synthetic coding sequence
atgtgccacgatgttatttttatggcctggttaaaacagcagttctccgaatgtaccctgatagatgctacccatcgggatgttgacgtgctcttattgttatcaaactctgcgtattacgtggcctattacgacgacgaagtagataaggttaatcagtatcagagactttcactggagaacctggagaagatcgagatcgggccagaaccgacgctcttcggcaagcccaaattttcctgtatgcggttgcattatcgctataaagaggccagtggatactttcacactctgagagccgttatgcggaatccagaggaggacggaaaggatacactgcagtgcattgctgagatgctccagatcaccaagcaggccatgggcagcgacctgccaataatcgagaagaagcttgaaagaaagagctccaagcctcatgaagacattatcgggattagatctcaaaatcaagggtctctggctcagggaaagaacttcctaatgtccaaattctcgagcctgaaccaaaaggtgaagcagacaaaatcgaatgtgaacatagggaatttgaggaaacttggaaactttaccaagccagagatgaaggttaattttctgaagcccaatctgaaggtgaatttatggaaatccgactccagcctcgaaacaatggagaatactggtgtaatggataaggtgcaggccgagtcagacggtgatatgtcctccgacaacgatagttaccattctgatgagttccttaccaactctaaatcagatgaagacaggcagctcgctaacagtctagagtcagtgggacctatcgattatgtgcttcctagctgcggaatcattgcctctgccccgcgcctgggctctcggtcccagtccctcagctcgacggactcatcagtgcacgcgcccagcgaaatcaccgtggctcatgggtctggactgggcaagggccaagagagccctctgaagaaatctccctcggcaggagatgtgcacatcttgaccggttttgccaagcccatggacatctactgtcaccgcttcgtgcaagatgcgcagaacaaagtgactcacctgagcgaaacccgatcagtgagccagcaggcatcacaagaaaggaatcagatgactaaccaagtttccaacgaaacccagtcagaaagtaccgaacagacaccatcccggccctcccagcttgatgtgagcttatcggcgactggtccacagtttctgtccgtcgagcctgcccattcagtcgccagccagaagacacccaccagcgcgtcttccatgctggaactggagacagggcttcacgtgaccccctcaccaagcgagtccagctcttcacgcgccgtatctccctttgccaagataagatcctctatggttcaggtggccagcatcacccaggctggtcttacacatggcatcaactttgccgtttccaaggttcagaaaagccccccggagcctgaaattatcaaccaagtacagcagaatgagctgaagaaaatgttcattcagtgtcagacccgtattatccagatttag

SEQ ID NO: 30571 - DNA, 372 bp, Artificial Sequence
  Description of Artificial Sequence: Synthetic coding sequence
atggagcctcaggatctcgagctggagctgtgcaaaaaacatcattttggtattaataaacccgagaagattatacctagcccagacgattcaaaattccttctaaagacatttacgcacattaaatccaacgtgagcgccccaaataagaagaaagtgaaagagtcgaaggagaaggagaagcttgaaaggaggttattggaagagctgctgaaaatgttcatggattcggaatccttttattattctctaacttacgatcttacaaatagtgtccagcggcaatccaccggtgagcgggatggcaggccactgtggcaaaaagtgccactgaccgcaagacgggccgggtttgctctcggaaaaaaatag

SEQ ID NO: 30572 - DNA, 1128 bp, Artificial Sequence
  Description of Artificial Sequence: Synthetic coding sequence
atggagctgttccaagcaaaggaccactatattctgcagcaaggggagcgggcactgtggtgcagtaggcgggacggggggttgcagttgcggcccgccacagatttgttgctagcctggaatcccatctgcctgggcctcgtagagggcgtgatcggcaagatccaactgcatagtgacctgccttggtggctgattctgatccgacaaaaagcactcgtgggcaagctacccggcgatcacgaagtgtgtaaggtcacgaagattgcagtgctatccttgtctgaaatggaaccacaagacctggagctcgagctctgtaagaaacaccacttcggaatcaataaaccggaaaagattattccgtcccccgacgactccaaatttcttctcaagactttcacgcacatcaagagcaatgtcagtgcacccaacaaaaaaaaggttaaagaaagtaaggagaaagaaaaactggagagaaggcttctcgaagaactcctgaagatgttcatggattccgagtcattttattactccctcacttatgatcttactaattcagtgcagcgtcagagcacaggcgaaagagatggtcgccctctatggcagaaggtggatgaccggttcttttggaataaatacatgattcaggacttgactgaaattgggacccccgatgtagacttctggattatccccatgatacaaggtttcgtccagattgaggagctggttgtgaactacacagagtcctcagacgacgaaaagagcagcccggagacacctccccaggagtcaacctgcgtagatgatattcaccctagatttctcgtcgccctgatctcaagaagatcgcggcatcgggctggcatgcgttacaagcggaggggggttgacaaaaacggaaacgttgccaattacgtggagaccgagcagctgatccatgtgcacaatcatacattgagtttcgtccagacgaggggatccgttcctgtattctggtcacaagtagggtaccgatataacccacggcctaggttagaccgtagcgaaaaggagacagttgcatacttctgtgcccattttgaggagcaactgaacatttacaagaagcagcagcaaaagtag

SEQ ID NO: 30573 - DNA, 507 bp, Artificial Sequence
  Description of Artificial Sequence: Synthetic coding sequence
atgtctaagaggaagtggagggggtttcggggggctcagcaagagcgggcccagccaccagcagcctcaccgcagccgtgtcctgcgccgcatgctggactgcctggggggtcaagaagaagggcaccagctcctgccggtcagcagcagatgagggccgaaagccgcagcggagctcagcggagaaggggctcggctagaaggggggcgcacagggaagcaggcggatgtgtcagaggacgtacacgctccagcgggtctgagcggtcaaatgccctctggcaagctgtggatgctgcagaagccttggcgctgtcctcccccctacgcaggccctgggaccaagctcagcacttcacgaatccagccccttttagtaaagggccccagtctgccccaccgtctccccctgccggaaggcgccgacgaggagcagatctggccctcaccccgctcgccggcgaaggccacaccagatggaggcagccagggcgccccggtaagtag

SEQ ID NO: 30574 - DNA, 3129 bp, Artificial Sequence
  Description of Artificial Sequence: Synthetic coding sequence
atggagctccagaaaggcaagggcgctgctgctgccgcggctgccagtggtgcagcaggcggaggcggtgggggggctggggcaggcgcacctgggggcggaaggctcctgctttccacaagcttggatgccaaggacgaattggaagaaaggctggaaagatgcatgagtatcgtgaccagcatgaccgccggagtcagcgaaagagaagcgaatgacgctttaaacgcatatgtctgcaaaggcttgcctcagcatgaggagatctgcctgggcttgttcactctgattctgacggaacccgcccaggctcagaagtgctaccgggatttggctctagtgtccagagacggaatgaacatcgtgctgaacaagattaatcagatattaatggagaagtatttgaaactgcaagatacctgtcgtacacagctggtgtggttggtcagagagctcgtgaagtcaggagtgttaggggccgatggggtgtgcatgacattcatgaaacaaattgcaggcggtgacgtcactgccaagaatatatggctggccgagtccgtgctcgacatcctcacggagcagcgtgagtgggtgctgaagtccagtatactgatcgcaatggcggtttatacctaccttagactgatcgtggatcaccacggcaccgcccagctccaggccctgcggcagaaggaggtggatttttgtatctctctgctgcgcgaaagattcatggagtgtttgatgatcggacgtgatttggtgcggctactacagaacgtggcccggataccagaattcgagctgctctggaaggacatcatccataaccctcaagccctgagtccacagttcaccggcatactccagctgttgcaatcgagaacaagtcggaagtttctggcctgccggctgaccccagatatggaaaccaagttgcttttcatgacatctagggtaagattcgggcagcaaaaacgttaccaggactggtttcagcggcagtacctgtctacccccgacagtcagagtctcaggtgcgacctgattcgatatatctgtggggtggtgcacccttctaacgaagttctttcctctgatattttaccacggtgggccatcatcggttggctgctgaccacgtgcacttcaaacgtcgctgcttccaacgcaaaactggccttgttttacgactggctcttctttagccccgacaaggactctatcatgaatatagagcccgccatcctggtcatgcaccacagtatgaagccgcaccctgcaatcaccgccactctgctggatttcatgtgtaggatcatcccaaatttttatcccccactggaggggcatgtccgccagggcgtgttttcctcattaaaccacatcgtcgaaaagagggtgttggcacacctggctccactctttgataatccaaaattggataaggagctacgcgctatgctgagagagaagttccccgaattttgctcctctccaagtcctcccgtcgaagtaaagatcgaggaaccagtatccatggagatggacaatcacatgagcgacaaggatgagtcttgctacgataacgcggaggcagctttcagcgacgacgaagaggacctcaactccaaagggaagaagagagaattccgtttccatccaataaaggagaccgtcgttgaggaacctgtcgacataacaccgtacctggaccagctggatgaaagcctccgggataaagtgcttcaattgcagaaaggcagtgatacagaggcacagtgtgaggtgatgcaggaaatcgtggatcaagttctggaagaggattttgacagtgagcagctgagtgtcctggcgtcctgcttgcaagaactgtttaaggcccacttcaggggggaggtgctacccgaagagatcacggaagaatccctcgaagaatccgtcggcaaacccctgtaccttatttttaggaatctatgtcagatgcaggaagataactcgtcctttagcctcctgctcgaccttctgagcgagttgtatcagaagcagcccaagattggctatcacctgctatactacctccgcgcaagcaaggccgccgctggaaaaatgaacctctacgaaagttttgctcaagctacacagctgggtgatcttcatacctgcctgatgatggatatgaaggcctgccaggaggacgacgtacgtttattgtgccatctgaccccatccatatacactgagttccctgatgaaaccctccgctctggggaactcctgaatatgattgtcgccgtcatagacagcgcccagcttcaggaactggtgtgtcatgtcatgatgggcaacttagtgatgtttcgaaaggacagcgtgctcaatattctgattcaatcactggattgggagaccttcgaacagtattgcgcatggcagttgttcttggctcataatatcccgctggagacaatcattccaatcctccagcacctgaagtataaggagcatcccgaagctttgtcatgtctgcttctccagctgcggcgggaaaagcccagtgaagagatggtgaaaatggtcttgagccgcccctgtcatcctgacgaccaatttacaacttccatcctaaggcattggtgtatgaagcacgatgaactgctggccgagcacattaagagccttctgatcaaaaataatagtctccccagaaaaaggcagagtctgcgctcgtctagcagtaagctggcccagctcacactcgagcagatcttggagcatctggataacctgagacttaatctgactaacaccaagcaaaattttttcagccagacacccattcttcaggccttgcaacacgtgcaggccagctgcgacgaggcccataaaatgaagtttagtgacctcttttctctcgccgaagagtatgaggattcatccacaaaaccaccaaaatcgagacgaaaggctgctctctcatcaccaagatctcgtaagaatgccacccagccgcccaacgccgaggaggaaagcggaagcagctcggcctctgaagaagaagacactaaaccaaagcccaccaagagaaagagaaagggtagctccgccgtggggtctgattcagactag

SEQ ID NO: 30575 - DNA, 1224 bp, Artificial Sequence
  Description of Artificial Sequence: Synthetic coding sequence
atggaatccgctattactttgtggcagttcttactgcaactactgctggaccaaaagcatgaacatctgatctgctggacctcgaacgatggggagtttaagctgctgaaagcagaggaggtagcaaagctctggggcctgaggaaaaacaaaactaatatgaattatgataagctgtctagagctctcaggtactattatgacaagaatattattaagaaagttattggtcagaaattcgtgtacaagtttgtgtctttccccgagattcttaagatggaccctcacgctgtcgagatttctagggaatccctgctcctgcaggattcagactgtaaggcaagcccagagggcagggaggcgcacaaacacgggctggcagcccttagatctactagcagaaatgaatacatccactcgggtctgtattctagcttcactattaatagtctgcagaacccacctgatgcattcaaggcaattaagacagaaaaactggaggaacccccggaagattctccacccgtggaggaagtccgaaccgtcatccgatttgtcaccaataagaccgacaagcatgtgactcgccccgtcgtctccctacctagcacgtccgaggcggctgccgctagcgctttcctcgccagttccgtgtctgctaagatctcctcgctgatgctcccaaatgccgcctctataagctcagcgtccccattctctagccggagtccctccctttctcccaatagccccctcccctccgagcaccgctctctgtttttggaggccgcctgtcacgactcggacagcttggaacctctcaaccttagctctgggtccaaaacaaaaagtccatctctgccccccaaagctaaaaagccgaaaggactggaaatctcagctccacccctagtattatccggaaccgatatagggtccatagctttgaacagcccagcactgccttctggaagcttgactcccgccttctttacagcccagactccaaatggactgctgttgacaccaagccctctgctaagctcaatccacttttggagttctctgtctcctgtagcaccactgtcacctgctcgtcttcagggtccatcaacccttttccaattccccaccctcttgaacggccacatgcctgtacctattccttcgctagaccgggccgcctcccccgtgctgctctccagtaactctcagaaaagctag

SEQ ID NO: 30576 - DNA, 813 bp, Artificial Sequence
  Description of Artificial Sequence: Synthetic coding sequence
atgctggaaggccaagtagactcgctgtctgtcacgctgggcccgctagggctgcctgaattgatggtttcacaacccggatgtgcctacgccatcctgttgtgtacctggaagaaggacaccggctccccaccagcctcagaaggacccaccgatgggtcacgtgaaactcctgcagcacgtgacgtggttctccaccagacatcaggccgaatccataacaagaacgtgtcaacacatctgatagggaacatcaagcaggggcatgggactgaatcgagtggctctggattgtttgctctgtgtaccttggacggcaccttgaaattaatggaggagatggaagaagcggacaaactattgtggagtgtacaggtggaccaccagctgtttgccctggagaagctggacgtaacagggaatgggcatgaggaggttgtggcgtgcgcgtgggatggacagacatatatcatcgaccataacaggaccgtcgtgcgctttcaggtggatgaaaatatccgagccttctgcgcgggactttatgcttgcaaggaggggcggaatagtccctgcctggtgtatgtgactttcaaccagaaaatctatgtttactgggaagttcagctggagcggatggaatctacaaacctggtaaaactgctcgaaaccaaacccgagtatcatagtctgttgcaggagctgggggttgacccagacgatctgcctgttacgagggctctgttgcaccagacactctatcaccctgatcagcctccccagtgtgcacctagttctctgcaggaccctacgtag

SEQ ID NO: 30577 - DNA, 1008 bp, Artificial Sequence
  Description of Artificial Sequence: Synthetic coding sequence
atgcccaccttcgcaggcagtcaggaatcaagaagtcagtggattctggaacatatccctcgtgactgggacggcgatgggtgccgggagcttgtggttgggtatacggacagggtggttcgagctttccgctgggaagaactgggcgaaggaccggaacacctgacggggcagcttgtgagcctaaaaaagtggatgttagaaggacaggtggattctctctccgtcactctcggtccgctcggcctgccggagctgatggtaagccagcctggctgtgcctacgccatccttctgtgcacatggaagaaagacacagggtcccctcccgcaagcgaaggtccgactgacggctcacgggagacacccgccgcccgggacgtggttctgcatcagaccagcgggagaatccataacaaaaacgtgtctacacacctgataggaaatattaagcagggtcacggcactgagagttcgggttccggcctgttcgccctgtgcacactcgatgggaccctgaagttaatggaggagatggaagaggcagacaaactgctctggtcagtgcaggtggaccaccagttgttcgccctggagaagctggatgtcaccggcaatgggcatgaggaggtcgtcgcctgtgcttgggacgggcagacatacatcattgatcataatcgaaccgtggtccggttccaggtcgacgaaaacatacgggctttttgtgcggggctgtatgcctgcaaagaaggtaggaactccccttgcctcgtgtacgtgacgtttaatcagaagatttacgtatactgggaggtgcagcttgagcgcatggagagcaccaacctcgtcaaactattagagacgaagccggaataccattccctcttgcaggagctgggagtggacccagacgacctacctgttacccgggccctgctccaccagaccctctatcaccctgaccaacccccacagtgcgctccttcttctcttcaagaccctacgtag

SEQ ID NO: 30578 - DNA, 693 bp, Artificial Sequence
  Description of Artificial Sequence: Synthetic coding sequence
atgaagctgatcgtgggcattggcgggatgactaatggtggaaaaaccaccctgaccaatagcctgttacgggcactgcctaactgctgcgtgattcaccaggatgacttcttcaaaccccaggaccagatcgccgttggagaagacggatttaagcagtgggacgtcctggagagcctcgatatggaagccatgcttgacacagtccaggcttggctttcgtccccacagaaattcgcccgggcccatggagtcagcgtccagccagaagcttcagacacccacatcttgctacttgagggatttctgctgtatagttataagcccttggtggacttgtattcaagacgctattttttgacggtgccttatgaggagtgtaaatggagaagatccacacggaactatacagttccagacccaccggggcttttcgacggacacgtatggcccatgtatcaaaagtataggcaggagatggaggccaatggagtggaggtggtctacctagacggaatgaaatctcgggaggaattgttcagggaagtgcttgaggatatccagaactccttgctgaacaggagccaggaatccgcgccttctccggcgcggcctgcacgcacacagggtcccgggcgcggatgtggccaccgtactgctaggcccgctgcctcccagcaagactcaatgtag

SEQ ID NO: 30579 - DNA, 561 bp, Artificial Sequence
  Description of Artificial Sequence: Synthetic coding sequence
atgaagctgattgttggtatcgggggcatgacaaatggcggaaagaccactctgaccaactctctgctgagggcattgcccaattgctgcgtcatacatcaggacgacttttttaaaccccaagaccaaattgccgtcggcgaagatggctttaagcaatgggatgttcttgaaagcctggacatggaggccatgctggatactgtgcaggcctggctttcctcaccgcagaaatttgctcgcgcccacggagtctcagtacagcctgaggcctctgatactcacatcctgttactggaggggttcctgctgtactcttacaaataccaaaaataccggcaggaaatggaagctaacggggtggaggtagtgtacttggatggaatgaaatctagagaagaactcttccgggaagtattggaagatattcagaacagcctgctgaatcgcagccaggagtcagcccctagtcctgcccgccctgcccgcacgcagggccccggcaggggctgcggtcaccggaccgccaggccggcagcgagtcagcaagactcgatgtag

SEQ ID NO: 30580 - DNA, 1425 bp, Artificial Sequence
  Description of Artificial Sequence: Synthetic coding sequence
atgagcgaggaatctgacgggaaactgattgaggattctttgatccagcttagatgccattttacctggaagctcctcatagaagctccagagatacctgacctggaaaacagaatctgggaagaaatacagtttttagatacaaaatataacgttggaatccataacctcttagcctacgtgaagcacctgaagggccagaatgaagaagccttggtgtccttgaaaaaagcagaggacttaatacaaaaggagcatgctaaccaagccgatattcgatccctcgtaacatggggcaacttcgcctgggtgtactaccacatgggtagactggcggaggcgcagacatatctcgacaaggttgaaaatacctgcaagaaattcgctaacccgtctaggtacagaatggaatgtccggaagtagactgtgaagagggctgggcactggccaagtgtggaggtaagaactacgagagggctaagacctgctttgagaaagcgctggagggaaacccagaaaatcctgagttcaatacaggctacgctatcacagtttacagacttgataagttcaataccgcttctgggagaaataaagctttttctctccatgtgctcaagcgggcggtccggttgaatcctgacgatgtttatatacgtgttctactagcactgaagttgcaggatgaaggccaagaagcagaaggtgaaaagtacattgaggaggcgttaacttccatttcctcgcaggcgtatgtgtttcagtatgctgcgaaattctatcgaaggaagggaagtgtagataaggccctggagctgctgaagatggctctcgaaacaacccccactagcgccttcttacaccaccagatgggcctttgttaccgagcgcagatgatccaaattaaggaagccaccaactggcaaccaagggggcaggaccgagagacagttgacaggctcgtgcagctagctatttgtaaatttgagaagacaatcatgctgaaacgaactttcgaaatggcctacgtagatcttgcagaaacttacgccgaaatcggtcatcaccggaaagcggaagaacatttccagaaaggtctgagaatgaagatctttgaggaccaattgaagcaagaaatccactatcactatggacgattccaggagcatcatggaaaatcacaggacaaggcaattacccactacttgaaaggcctcaagatcgagaagatgagccactctcgggagaaactactcaacgccctggaaaaactcgcaaagcggtgcatccaccaaaatgtgcgcgttgttgagtccgtgtccctccttgggcttattcacaaattaaaaggggaagtctcagatgcgttactgtgttacgaacgagccctccgcctagccgcagacctgaatcctatattttag

SEQ ID NO: 30581 - DNA, 1449 bp, Artificial Sequence
  Description of Artificial Sequence: Synthetic coding sequence
atgagcgaaatcagaaaagacaccctgaaggctatcctcttggaacttgagtgccacttcacatggaaccttctgaaagaggacatcgatctatttgaagtggaagacaccatcgggcagcaattggaatttctcactacaaaatcaaggttggctctgtataatttgctggcctacgtaaaacacctaaaggggcagaataaagatgctcttgagtgtctggagcaagctgaggagatcatccagcaagagcattctgacaaagaggaagtgagatcactggtgacatggggcaattatgcatgggtctattatcacatggaccaactggaggaagctcagaaatataccggcaagatcggaaacgtgtgtaaaaaactatccagcccatccaactacaaactcgaatgccctgagaccgactgtgagaaaggctgggctctgctgaagttcgggggaaagtactatcagaaagctaaagctgcttttgagaaggcccttgaggtggaacccgataatcccgagtttaatatcggctatgcaatcaccgtgtaccgtctagacgatagcgatcgagagggatcggtgaagagtttcagccttggccccctgcgcaaagccgtcacattgaatcctgacaatagctacattaaggtcttcctggctctgaagctccaggatgtccacgctgaagctgaaggtgagaaatatatagaggaaattctggatcaaatctcgagccagccttacgtcttacgatacgccgccaagttttaccgccggaaaaattcatggaacaaggccctcgagttgcttaagaaagcactggaggtcaccccgactagcagtttccttcatcaccagatggggctatgctatcgcgctcagatgatccaaatcaagaaagccacacacaacagaccaaagggaaaagacaaattgaaggtggacgaacttatatccagtgccatcttccatttcaaggctgccatggagagggacagtatgttcgcgtttgcatacactgatctggcgaatatgtacgctgaaggcggccaatactcaaacgctgaggacatattcagaaaggccctgcgactggagaatattactgacgaccacaaacatcagatacactatcattacgggcgcttccaagagtttcacagaaaatctgaaaacaccgccatccatcactacctcgaggccttaaaggtgaaggaccgatctccactacgtacaaaactgacttccgccctgaagaaactgtctactaagcgattgtgtcacaatgccttggacgtgcagagccttagcgccctcggtttcgtgtacaagctggagggggaaaagcgacaggctgcagaatattacgagaaagcccagaagattgatcccgagaatgcggagttcctgacagctttatgcgagttgcgacttagcatttag

SEQ ID NO: 30582 - DNA, 1305 bp, Artificial Sequence
  Description of Artificial Sequence: Synthetic coding sequence
atgagcgagatccgaaaagacacgctaaaagcgatcctcttggagctggaatgccactttacttggaatcttttaaaggaagatatagacctgttcgaggtcgaagatacaattggtcaacagttggagtttctgaccactaagagtagattagcactgtacaacctgctcgcttatgtcaaacacttgaaaggacagaataaggacgctctagagtgcttagaacaggccgaggagattatccaacaggagcactcagataaagaggaagttcggtccttagttacctggggaaactatgcttgggtgtattaccacatggatcagcttgaggaagctcagaagtacacaggaaagataggcaatgtgtgcaaaaaactgagttccccatcaaactacaaactggagtgccctgagaccgactgtgaaaaaggatgggctctgcttaaattcggcggcaaatactatcagaaggccgtgaccctgaaccccgataactcctatattaaggtgtttctggccctgaagctccaggatgtacacgccgaagccgagggcgagaagtatattgaagagatcctcgaccagatctcaagccagccctacgtgctgcggtacgcggcaaagttctatcgaaggaagaacagttggaacaaagccctcgaactgctgaaaaaggcactggaagtcacacccacatctagttttctgcatcatcaaatgggactctgttatagggcccagatgattcagattaagaaggcaacacataataggcccaaaggaaaggacaaattgaaagtggacgaactgatttcttcagccatatttcactttaaggccgcaatggaaagagactcaatgttcgccttcgcatacaccgacctggcaaacatgtatgcggagggcgggcagtactccaacgcagaggacatcttccggaaggcactcagactggagaatattaccgacgaccacaaacatcagatccactaccattatggacgcttccaggagtttcatcgaaagagcgagaatactgcaattcaccattatctcgaagcactgaaggttaaggacagatcaccattgcgcactaagctcaccagtgccctaaagaagctgtctacgaaacgactgtgccacaacgcattggatgtgcagtcgctgtctgcattaggctttgtttataaactcgagggcgagaagcgacaggcagccgagtattacgaaaaagcacaaaagatcgacccggagaacgctgaattccttaccgccctttgtgagctgcggctgtccatatag

SEQ ID NO: 30583 - DNA, 2061 bp, Artificial Sequence
  Description of Artificial Sequence: Synthetic coding sequence
atgaagccacccttcctgctcgccctggtcgtgtgctcagtggtttcaactaatttaaagatggtcagcaaacgcaatagcgtcgacggatgtatcgactggtccgtggatctgaaaacatacatggcactggctggtgagcctgtccgcgttaagtgtgctctattctactcgtacattaggaccaactacagcaccgcacaatccaccggtctcaggctgatgtggtataaaaacaaaggcgacctggaggagccaatcattttcagcgaagtgagaatgtctaaagaagaggattccatctggttccattccgccgaagcacaagactccggcttttacacttgcgttctgcggaattcgacttactgcatgaaggtctctatgagcctgacagtcgccgaaaatgaaagcggcttatgctacaattccaggatacgatacctggagaagagcgaggttaccaagcggaaggaaattagctgtcccgatatggacgatttcaagaagtcagatcaagagcctgatgtagtctggtataaagaatgcaagcctaagatgtggcggtccatcattattcagaagggaaacgcccttctgatccaggaggtgcaggaggaagatggcggcaattacacctgtgagcttaaatatgagggaaaacttgtccgcaggactactgaactaaaagtgactgccctgttaaccgataaacctcccaaaccactgtttccgatggagaatcagccatcagttattgacgttcagcttggcaagccactcaacatcccatgtaaggccttttttgggttctctggtgagagcggccccatgatctattggatgaaaggcgaaaagttcattgaggagctcgcaggccatatccgggaaggagagatccggctgctgaaggaacatctcggagaaaaagaggtggagcttgccctcatctttgacagtgtagtggaagcggatctggccaactacacctgccacgtggaaaaccgcaacgggcgcaagcacgccagcgttctgctcaggaagaaggacctgatctataagatagaactggctggcggcctgggagcaatcttccttctcctagtgctgctggtggtcatatacaagtgctacaacatagagctgatgctcttttatagacaacattttggagcagatgaaaccaatgatgataataaggaatacgacgcttacctctcgtacacaaaagttgatcaggacactcttgactgcgataacccggaggaggagcagttcgcgttagaggttctgcccgacgtcctagagaagcattacggctacaagctctttattcctgagagagacttaataccaagcgggacttatatggaagacctcacccgatatgtggaacaaagccgacgcctaattatcgtcctgacccctgattacatcctccgtagaggctggagtatctttgagctggaaagtcggcttcataatatgttagtttcaggcgaaattaaagtgattcttattgaatgcactgaactcaaaggaaaggtaaattgtcaggaggtggaatccttgaagagaagcattaaattactgtcactcatcaagtggaaggggtccaagagtagcaaacttaatagcaagttctggaagcacctcgtatacgaaatgcccattaagaagaaagaaatgctgccccggtgccatgtcctggactcagctgaacagggactctttggggaactgcagcctatcccctctatagccatgaccagcacctccgcaacactggtctcaagccaggctgacttacctgagttccacccctccgatagtatgcagatacggcactgttgccgcggatataagcatgagatcccagcgactactctaccagtaccgtccttagggaaccaccacacatactgcaaccttcccctgacgttactcaacgggcagctgcccctgaataatactttaaaagatacacaggagttccatcgcaacagttctctgctgcccctgtcctctaaggagctgtcatttacgagcgatatttggtag

SEQ ID NO: 30584 - DNA, 1143 bp, Artificial Sequence
  Description of Artificial Sequence: Synthetic coding sequence
atggcctttgtctgcttagcgatcggatgtctctacaccttcctgatcagcaccacatttggctgtacctcatcaagcgataccgagataaaagtgaatcctcctcaggattttgaaatcgtcgacccaggctatctgggctatctctacctgcagtggcaacccccgttgagtctagaccactttaaagagtgcacggtagagtacgagctcaaatacaggaatataggtagtgaaacctggaagaccattattacaaagaatctccactacaaagatggcttcgacctcaataaaggaattgaggcaaagatccacaccctccttccctggcagtgtaccaacggatcggaagtccagagttcatgggccgagaccacatactggattagcccgcaaggtataccggagaccaaggttcaggatatggattgcgtgtactataactggcagtatttgctttgttcctggaagcctggaatcggcgttctgctggacactaattacaatctcttttactggtacgagggcctggatcacgcactccaatgcgtagattacatcaaggccgacggccaaaatataggttgccgattcccttacctcgaagccagtgactataaagatttttacatatgtgtaaacgggtcatcagagaataaaccgattagatcatcctatttcacctttcagcttcagaacatagtgaagcccctcccccctgtctacctcactttcaccagggaaagttcatgcgaaattaagctcaagtggagtattccacttggcccaatcccagctcgctgtttcgactatgagatcgaaattagagaagacgatactacattagtgacagccaccgtagagaatgagacatataccctcaaaactacaaacgagacaagacagctctgttttgtcgtccgcagtaaagttaatatctactgcagcgacgatggcatttggagcgagtggtctgacaaacagtgctgggaaggggaggatctatccaaaaagactctcctgagattctggctgccttttggattcattctgattttggtgattttcgtgacgggcctgctcctgcgcaagccaaacacgtaccctaaaatgattcctgaatttttctgcgacacttag

SEQ ID NO: 30585 - DNA, 1011 bp, Artificial Sequence
  Description of Artificial Sequence: Synthetic coding sequence
atgagtcgctctgtcttagaggctcttacctccagtactgccatgcagtgtgttccctccgacggctgtgccatgctgctccgagtccgcgcctcgattaccctgcacgagagactgcggggtcttgaggcatgtgccatgtccctggacacgcaggaaacacagtgtcagtcagtatgggtggccagagcgagccataggcagcaaggtggccagcaactgcaggtgcacttcggatgttttgccgtttctgtggcacagcacctgtatgtgaccctgcgcacaatcccccacttctgcggcgtccaattagatcagcggcatttggtggaagcaggaaaacttagttattgggtggatagaaggcgcaaagctattctggttcaagttccccgggcctccggcagccccgactattaccttaggctgtgtcttaagcgctttacctgcgaagacgctggggctccagtccgtgtcactgctaacagtgtcagccaggcagtgtttctaccttactcccaggagttaccctgtctctgtctagagggctggagtgctacacctgacgccgtccggatccagatttgtccgtttgagaacgacacggaggccctggaggtgctctgggacacagtgtattaccacccagagtcccagactctttcttgggaaccagcttgcccagtttctggacatgtgtccctgtgttggagacctggacctggcgccggatgccgcaagctgcagcagagctcccaactggttcacaggcgggtgcaatatcctctggtcgacactcaaccccaattgtgcctcaaattttctacaagttggggatcctgggtccgttgtccctttgaacagagacgctttccgacccctcccacttctcgctgcacttgcgtgacaggggggtcacattcctccctcccagccaacgctcacagccgccccgctaggtcacttcaacctcaggttacctggcagccccccctactgctgccttcatag

SEQ ID NO: 30586 - DNA, 1011 bp, Artificial Sequence
  Description of Artificial Sequence: Synthetic coding sequence
atgtcaagatctgtcttagaagcactgaccagctcaactgccatgcagtgcgtgccttcggatggctgtgctatgttactgagggtgagagctagcatcacactgcacgaacgcctgcgcggattagaagcctgcgccatgtccctggatacgcaggagacacagtgtcagagcgtctgggtggccagagcgtcacaccgccagcagggcggccagcaattgcaggttcatttcggatgtttcgcggtaagtgtcgcacaacacctctacgtcaccctaaggactataccccacttctgtggagtgcagctggatcaaagacacttagtcgaagcaggcaaattgagttactgggtcgatcgtaggcgaaaagcaatactggtccaggttcctcgcgctagtggctctccggactattacctgcgactctgccttaaacgtttcacttgtgaggacgcaggagcacctgtgcgagtcaccgcaaactctgttagtcaagctgtgtttttgccctatagccaggaactgccctgcctgtgcctcgaaggatggtcggccacccctgacgcggtgcgaatacagatttgcccttttgagaatgataccgaggcactcgaagtcctgtgggatactgtgtactaccacccagagtcgcagactctatcatgggaacctgcatgccccgtgagtggtcatgtcagtctgtgttggagacctggtccaggagccggatgcaggaagttgcagcagtcctctcaactggtccataggagagtgcagtacccactggtggacacccagccacagctttgtctgaaatttagtacatcttggggctcctgggtccgctgcccatttgagcagcgccggttcccaacaccgcccacatcacgttgcacctgtgtcacaggagggagtcactccagcctcccagccaatgcacactccaggcctgccaggtcactccagcctcaagtcacctggcaacctcctcttttactcccttcatag

SEQ ID NO: 30587 - DNA, 471 bp, Artificial Sequence
  Description of Artificial Sequence: Synthetic coding sequence
atgaggggcgggggaggagtcccactcatccacttctcattgccagtgtgttctcccttcctctacctctcactgcccgaaccacaggcaaaacaccagagaagacctggatcagaacagggggcccatgtggcttcggttgatcatccacccgcctgtaccgctttaggggggcccagaaatgccaggccatccgccgggggcagtctctttacatcattgcaaccatcggaagacacaagcgagtggggtgcagagcctgccgacggtgaaaataagaatgacgacacattatacacgcctgatgacctttccattccgggtcacttcgtacctacagtatgtccagcagagaccctgggatgcagtcggctcgaattgtctgtgatcggctttgaagaaggcccctccatggggactgctgtcttccaacttcagtacctgctcgacctcctggggtccagactttag

SEQ ID NO: 30588 - DNA, 1386 bp, Artificial Sequence
  Description of Artificial Sequence: Synthetic coding sequence
atggccctggcatttggttgtccccctggcggcgggggaggggggtgccccggaggcggagggggtggcggcggagctggccctgggccgtcaccagtgacagcagccttgcgagatgatctgggctccaatatacacttactgaaaggcctgaatgtgaggtttcgttgctttctcgctaaggtacatgagctcgaaagacgtaaccggctcctcgagaagcagcttgagcagcagcaatccgaacgggagcgccgtttgaggtataaaacctttagcagagaacaggccgtccagacgggtccagaactgctccgcccgcctgctccaggaggcggccacggtttgagttccggagcagccgcgggggccaacgcaaatgctgtggctcttggtggcctgcccccagggggcggatcccacccccaacactatggacggctgccagggactatttggagttacactcaggttaggaggaccgggggaggaggagtggagactgtgcagggtccgggtgtctcgtgggttcaccccgatggtgtgggcgttcagatagacacaattacaccagaaatccgcgcactctacaacgtacttgcaaaggtcaaaagagaacgagacgaatacaaacgcagatgggaagaggagctggctaaaagaatgaacctgcagacaatggtggacaccctacaggaggctgcccaggaggccgacgccatccaggaggagatgaacgagaagatcgaaagactgaaggccgagttggtggtgtttaaggggctgatgtccgacgtcgtacctaaaaagaaggagcggaaagtcgctagcgacgacgatatttccgagcaagatggtgaggtgaatcgcttctccgatgacgaagtcggaagtatgaacataactgatgaaatgaaacgcatgttcaatcagctgagagagacatttgactttgatgatgattgtgattccctgacctgggaggagaatgaagacacactactcctttgggaggattttacaaactgcaatccaactattgacctacagggagagcaggaggaaaacctgggcaatctcattcatgaaaccgagtcttttttcaaaactagagataaagagtaccaggaaaccatagggcaaatagaattggagctggccaccgccaaatccgatatgaatcgtcatttgcacgaatacatggaaatgtgctccatgaagcgggggttggatgtccagatggagacttgtcgccgcctgattaaaggttctgctgacagaaattcaccctctccctccagcgtcgcctcctccgatagtggaagtactgacgagattcaggatgagttcgagcgggaggcagatgtggagcctatggtctcatag

SEQ ID NO: 30589 - DNA, 1554 bp, Artificial Sequence
  Description of Artificial Sequence: Synthetic coding sequence
atggtgaacagcctgctctttggagagatggctctggcctttggttgtcctcctggggggggggggggcggctgcccaggtggcggtggtggcggtgggggggctggtcccggtccatctccagtgacggccgccctaagagacgatttaggatcaaatatacaccttctgaaagggctgaacgtccgcttcaggtgttttcttgccaaggtgcacgaactggagaggcggaaccgcctgctcgaaaagcagctggaacaacaacagtccgaacgcgaacgcaggctccggtataagacgttttccagagaacaagccgtgcagactggacccgagctcctgcgcccccccgcgccgggcggggggcacggtctgtcgagcggggctgccgctggcgccaatgctaacgccgtcgcgctgggtggcctacctcctgggggcggctctcacccccaacactacggtagactgccagggactatttggtcctacactcaggtgcggcgaaccggcggagggggagtagagaccgtccagggtcctggtgtgtcctgggtacacccagacggcgtgggagtgcagatcgatacaattacacctgagatccgtgctctgtacaatgtcttggctaaggtgaaacgggagcgtgacgaatacaagcggcggtgggaagaggaactcgccaagaggatgaacctacagacaatggttgataccctgcaagaagctgcacaggaggcagacgccatccaagaagagatgaacgaaaagattgagagactcaaggccgagctggttgtatttaaaggactgatgtctgatcccatgacagacctggatacgaagatccaagaaaaggccatgaaagtggatatggatatctgccgaagaattgatattacagcaaagttgtgcgatgttgcccagcagagaaattctgaggacgtgagtaaaatttttcaggttgtcccgaaaaagaaggagaggaaggtggcctccgatgacgatatcagcgagcaggatggcgaagtgaacaggttctccgacgatgaggttgggtccatgaatataaccgacgagatgaagagaatgtttaaccagttaagagagactttcgactttgacgatgactgcgactctcttacttgggaggagaatgaagacacacttcttctgtgggaggacttcaccaattgcaaccccacgattgacttgcaaggtgagcaggaagagaacctcggcaatttgatccatgagacagaatcctttttcaagacacgggacaaagagtaccaagagaccattgggcagatcgagctggaactggcaactgcaaagtccgacatgaaccggcacctccatgaatacatggaaatgtgctctatgaaacgcggcctcgacgtgcagatggagacttgtaggagactgattaaaggatctgctgacagaaattctccgtcaccgagcagcgtagcctcatcggacagtggtagtactgacgagatccaggatgagtttgagagagaagctgacgtagaacccatggtgagttag

SEQ ID NO: 30590 - DNA, 1971 bp, Artificial Sequence
  Description of Artificial Sequence: Synthetic coding sequence
atggccaggatgtgcgtgaagacccagcgactggacgtggccaaggtgtgtctaggaaatatgggacatgctaggggcgcccgggcgctccgtgaagccgagcaggagcccgaattggaggcccgggtggcagtcttggccacccaattggggatgctcgaggacgccgagcagttatatcgaaaatgtaaaagacacgaccttttgaacaagttctaccaggctgctgggcggtggcaggaggcccttcaagtggcggagcaccatgatcgggtccatcttagatcgacctatcatcggtatgcagggcatctagaagcctctgccgactgtagtcgcgcactgagctactacgaaaagtccgacacacacaggttcgaagtccctcgcatgctttccgaggatttaccctccctggaattatatgttaataaaatgaaagacaagactctgtggagatggtgggcacagtacttggagtcgcaaggggagatggatgctgctctccattactacgagctcgcgagggatcatttttccctggtccgaatacactgttttcaggggaatgttcagaaagcggcccagattgctaatgagacagggaacctggcagcgagttatcatcttgccaggcagtacgaatcacaggaggaggtgggtcaggctgtgcacttctataccagagcgcaagccttcaagaatgccatcagactatgcaaggagaatggccttgatgatcagctaatgaatctggccttattgtccagccccgaagatatgatcgaagcggcccggtattacgaggagaaaggggtccaaatggacagggctgtgatgttgtatcataaagccgggcacttctcaaaggccctggagttagcctttgccacccaacagtttgtagctctacagctaattgctgaagatttggatgagaccagcgaccccgccctgttagcaaggtgctccgactttttcattgagcactcccaatatgaacgggccgtggagttgctcctggcagcaaggaagtatcaagaggctttacaactatgtttaggccagaacatgtccatcactgaggagatggccgaaaaaatgaccgttgcaaaggactcctcggacctgccagaggaatcaaggcgggagctgctggagcagattgctgactgttgtatgcggcaggggtcatatcatctggcaaccaagaagtatactcaggcgggcaataagttgaaagcgatgcgggccctgctcaagagtggtgatactgaaaagatcactttcttcgcctctgtgtcaagacagaaggaaatatacattatggcagccaattacctgcaatcgttggactggcgcaaggagcctgaaatcatgaagaatattatcgggttctacactaagggacgcgcgctggacctgttagccggtttttatgacgcttgcgcgcaggtcgagattgacgagtaccagaattacgataaggcacacggggccctaacagaagcctataaatgcctcgccaaggccaaagctaaatcaccattggaccaggagacccgcctggcccagctccaaagtcggatggcgctagtgaagaggtttattcaagctcgccggacgtacaccgaagatcctaaagagagcattaagcaatgcgagctgctgctggaagagccagatctggattccacaattcgcattggtgatgtgtatgggttcctggtggagcattacgtaaggaaggaagaatatcaaaccgcttacaggtttttagaagagatgcgccgccgcctacctttagccaacatgtcctactacgtgtccccacaggccgtggacgctgtccaccgtgggctgggcctgccactgccgcgtaccgtcccagagcaggtgagacataattccatggaggatgcccgggaattggacgaagaggtggtggaagaggctgacgatgatccctag

SEQ ID NO: 30591 - DNA, 4389 bp, Artificial Sequence
  Description of Artificial Sequence: Synthetic coding sequence
atggccctgtattacgatcatcagatcgaagcacccgacgcagcgggctccccatccttcattagctggcaccccgtacacccatttttagctgtggcatatatctctacaacctcaacaggcagcgtggatatatacctggagcagggagaatgtgtgccagacactcatgtcgaacggcctttccgcgtggcgtctctgtgttggcatcccacccgtttggtccttgccgtgggttgggagacaggtgaggtaacagtgttcaacaagcaggacaaagagcaacataccatgccacttacgcataccgccgacatcacagttcttcgttggtcaccttctggtaactgcttacttagcggagacaggcttggggtgctccttctgtggcggctcgaccagagaggcagagtacaagggactccactgctgaaacacgagtatggaaagcatctaacccattgtatcttcagattacctccccccggggaagacttagtccagctggcgaaagctgctgtttccggagacgagaaggccttagacatgttcaattggaaaaagtcctctagcggctctctgctgaaaatgggaagccatgaaggattgttgttttttgtcagtctcatggatggcaccgttcattacgtcgatgagaaaggcaaaaccacacaggtggtgtctgctgattccactattcagatgctgttttacatggaaaaaagggaggctctcgttgtcgtgactgaaaacctgcgtctgtcactctatactgttccgccggaaggcaaggctgaggaggtgatgaaagtgaaactgagtgggaagactggtaggcgcgcagacatcgccctgattgaaggcagtctgctggtgatggctgtgggcgaggcagctttgagattttgggacattgagagaggggaaaattacattctgtctcccgatgaaaagtttggatttgaaaagggagagaatatgaattgtgtatgctactgtaaggtgaagggactcctggccgccggaacagatcgaggaagagtggctatgtggaggaaagtgccggactttctcgggagtccgggtgctgaagggaaggacaggtgggctttgcagacacctacagagctacagggaaatatcacacagattcagtggggcagccgcaagaatttgctcgctgtgaattctgtaatctcggtggctatccttagcgaaagggcaatgtcctcacacttccaccaacaagttgctgctatgcaggtttcacccagtctcctgaacgtatgtttcctgtccacaggagtcgcacattccctcaggacggatatgcacatatcaggcgttttcgccactaaagatgccgttgctgtctggaacggtaggcaggttgctatttttgagttgtccggggcggccattcgctctgccggtacctttctctgtgaaacacccgtattagccatgcatgaggaaaatgtgtatacagtagagtctaatagagtgcaggttcgaacttggcagggaacagtaaaacagctgctgttattcagcgaaacagaaggcaacccatgcttccttgatatttgcggaaatttccttgtagtgggcactgatctggcccacttcaaatcatttgacctgtctcgccgcgaggccaaggcgcactgctcttgccgctctcttgcggaactggtaccgggagttggggggatcgcctccctgcgttgcagctccagtggatcgactataagcatcttgcccagcaaagctgataactctcctgactccaaaatttgcttttatgatgtggagatggatactgtgactgtttttgactttaagaccgggcaaatcgacagaagagagaccctgagcttcaacgaacaggaaaccaataaatctcacctctttgtggatgaaggcctgaagaattacgttcccgttaaccatttttgggaccagagtgaaccccgcctgtttgtgtgtgaagccgtccaagaaaccccccgcagccagccccagtcagccaacggacagccacaggacgggagagccgggcccgccgccgatgtcctgattctcagtttttttatatcagaagaacatggattcctcctgcacgagagcttccccagaccagcgacctcccattctctccttggcatggaggtgccctattactactttacacgaaaacccgaagaggccgaccgagaagacgaagttgaaccagggtgccaccacattcctcagatggtctctcgcagaccactccgagacttcgtcggactggaggattgcgacaaagccaccagagatgccatgttgcacttttcctttttcgtgaccattggggacatggacgaggccttcaagagcattaagttgattaagtctgaggccgtatgggagaatatggcacggatgtgcgtcaagacccaacggctcgacgtggctaaggtgtgtctcggcaacatgggccacgctaggggtgccagggcactgagagaagcagagcaggagccggagttagaggcaagagtggccgtcctggcaacacagttggggatgctcgaagacgctgagcagctataccggaagtgtaaacggcacgacctactgaataagttctatcaggccgctggacgctggcaggaagcacttcaggtggccgaacatcacgaccgtgtacatcttcgcagtacctaccaccggtacgctgggcatctcgaagcgtccgcagactgttcccgcgcattgagctactacgaaaaaagtgacacccataggttcgaggtgccacgcatgctcagtgaagacttgccctccctggaattgtatgtgaataaaatgaaggacaagaccctttggagatggtgggctcagtacctcgagagccagggagaaatggatgcggccctgcattactatgaactcgcccgagaccactttagcttggttaggatccactgctttcagggcaatgtgcagaaggcagctcaaattgctaatgaaaccggcaacctggccgccagttatcatctcgcccgccagtatgaaagccaggaggaagtcggccaggcagtgcatttttacacccgggcacaagcctttaagaacgctatccgcctgtgcaaagagaacggcttggatgatcagttgatgaatctcgcactgctttccagccccgaggacatgatcgaagctgcccgttattatgaagaaaagggggtgcagatggatcgagccgtcatgctgtaccacaaggctggtcattttagcaaggcactggaattggcttttgccacccagcaatttgtcgccctccagctgatcgccgaagacttggatgagacatctgacccagcactgctggcccggtgctcagatttcttcatcgagcactcccaatatgagcgcgccgtcgagctactacttgccgcgagaaagtaccaggaggctttgcagctgtgccttggacagaatatgagcattaccgaggagatggcagaaaagatgactgtcgctaaggactcctctgacctgcccgaagagtccagaagagagctcctggagcagatcgccgattgttgcatgagacagggctcttaccacctcgcaactaagaaatatacacaggccggaaataagttaaaggcaatgcgcgccctgttgaaaagtggcgacacggaaaaaattaccttcttcgcttcagtcagccgacagaaggagatctatattatggctgcaaactacctgcagtcccttgactggcggaaggagcccgagataatgaaaaatattatcggcttctataccaagggcagagccttggacctgctggcggggttttacgatgcttgtgctcaggtggaaattgatgagtatcagaattatgataaagcccatggcgccctcacagaagcctataaatgtcttgctaaggcaaaagccaagtcccctctggaccaggagacgagactcgctcagctccagagccggatggcgctggtgaaacgtttcatccaggcccgcagaacctataccgaggaccctaaggaatctatcaagcagtgcgaactgttgttggaagagcctgacctggactcaacaatccggatcggtgatgtgtatggtttcttggtagagcattacgtgaggaaagaggaataccagactgcatatagatttctagaggaaatgaggaggaggctgcctctcgccaacatgagttattacgtgtctccacaggccgtcgacgccgtgcaccggggtctgggacttcctctgccccggacggtgcccgaacaagttcggcacaactcgatggaagacgcacgggagcttgatgaggaagtagtggaggaggctgatgacgatccttag

SEQ ID NO: 30592 - DNA, 4389 bp, Artificial Sequence
  Description of Artificial Sequence: Synthetic coding sequence
atggccctgtactatgaccaccaaattgaggccccggacgccgccggcagcccaagtttcatttcctggcaccctgtgcacccttttcttgcagttgcctacatttctactacgagcaccggatctgtggacatctatctggagcaaggcgagtgtgtgcccgatactcatgtcgaacgccctttccgggtggccagtctctgctggcatccaacgcgcttggtgttggcggtgggttgggaaaccggagaagtgacggttttcaataagcaggataaggaacagcataccatgccactgactcataccgctgacattactgtgcttaggtggtccccgagtggcaattgtctcctttccggggaccgcctcggggtgctcctattatggcggctcgatcagagagggcgcgtacaagggacccctttactaaaacacgaatacgggaaacatcttacgcactgcattttccgcctgccccctccaggtgaggacctggtgcagctggctaaggctgccgtttccggcgacgaaaaagcactggacatgtttaattggaagaagtcctcttctggatcgctcctgaagatgggcagccatgagggactcttgttttttgtctccctgatggatggaactgtacactatgtggacgaaaaagggaaaactacccaggtggtctcagccgactccaccattcaaatgttgttttacatggagaaaagggaagccttagtcgtggtcaccgagaatcttcgcctgtctctgtacacagtaccacccgagggcaaggctgaggaggtcatgaaagtgaagctgagcggcaagactgggcgccgggcagacatcgctcttattgagggaagccttcttgtaatggccgtgggggaggccgcattgagattttgggacatcgaaagaggcgagaactacattctgtcccccgatgaaaagttcggtttcgagaagggtgagaacatgaactgtgtgtgctactgcaaggtcaagggactcctcgcagcaggaaccgacagaggacgagtggccatgtggagaaaagtgccagattttctcggctcccccggagctgagggtaaggatcggtgggctctccaaacccccacagagctgcaggggaatatcacacaaatccagtgggggagcaggaagaaccttctggcagtcaattcagttatcagcgttgcaatcctctcggaaagagcaatgagttctcactttcaccagcaggtcgctgccatgcaggttagcccatcactgctgaatgtgtgttttctatctactggcgtcgcgcatagcttgcgtaccgatatgcacattagtggcgtttttgccaccaaggacgcagttgccgtgtggaacgggagacaggtggctatattcgagctgtccggcgcagcaattcgatcagcaggtactttcttgtgtgagacacctgtgctcgctatgcacgaggaaaacgtgtacacggtcgaatccaatcgggtgcaggttaggacatggcaggggacggtcaagcagctactcctcttttcagagacagagggaaatccatgcttcctggacatctgtgggaatttcctcgttgtcggtaccgatctggcgcacttcaaaagttttgacctctctagacgggaggcaaaagctcactgcagctgcaggtccctggctgagctggttcccggggtggggggcatcgcatctttgcggtgtagctctagcggctccaccatctccatactgccttctaaggccgacaactccccggatagcaaaatctgcttctatgacgtggagatggacacagttacagtcttcgactttaagacagggcagatagatagaagagaaaccctgagttttaatgaacaagaaacgaataaatcccacttatttgtggatgaaggtctcaagaattatgtgcccgtgaaccacttttgggatcagtccgagcccagactgtttgtctgcgaagcagtacaggagacaccacgtagccaaccacagagcgctaacggacagccccaggatggtagggccgggccagccgcagacgtgcttatcttaagcttcttcatttcagaggagcacggatttttgttgcatgaatccttcccccgccccgcaacgagtcattctttgctgggaatggaagtaccttattattactttacacggaagcctgaggaagcggacagagaggacgaggttgaaccggggtgccatcatatacctcaaatggtgtctagacggcccctgagagatttcgtgggcctggaagattgcgataaggcaaccagagacgccatgctccatttctctttttttgtgaccatcggagacatggatgaagcttttaaatctatcaaactgatcaaatctgaggcagtgtgggagaatatggcgagaatgtgcgtaaaaacccagcggctggacgtagctaaagtgtgtcttggcaacatgggtcacgcgcgcggggcgagagcactcagagaggcagagcaggagcctgagctcgaggctcgcgtggcagttctggccactcagctgggcatgctggaagacgccgagcagctctatcgaaaatgcaaaagacacgatctgctaaacaaattttatcaggcggcaggtagatggcaggaagccctgcaggtcgcggaacatcatgatagggtccacctgaggagcacataccatcggtacgccggtcatctggaggcttcagcagattgttcccgggcattatcctactatgaaaaatccgacacgcaccggtttgaagtgccccgtatgttgtccgaagatttaccatctttggaactgtacgtgaacaagatgaaggacaagacactttggaggtggtgggcccagtatttagagtcacagggggaaatggatgccgccctccactactacgaactggccagggatcactttagcctagtgcgcattcactgcttccagggcaacgttcagaaagctgcccagattgctaatgaaacaggcaatctcgccgcttcttaccatctagctaggcagtatgagtcacaggaagaggtgggacaagcagtccacttttatacacgggcacaggcattcaagaacgcaatcaggctgtgcaaagaaaacggtctagatgaccagctgatgaacctagcccttcttagctcccccgaggacatgatcgaggcggcccggtattatgaggaaaagggagtccagatggaccgggccgtaatgttatatcataaagcgggccatttctctaaagccctggagctcgccttcgccacacaacagtttgtcgccctccagctcattgcggaagacctagatgaaacgtccgaccccgccctcctggcacgctgtagcgacttcttcatagagcactcccaatatgagagagcagtggagttgttgttggccgcacggaagtatcaagaagcccttcaactctgtttggggcagaacatgtccataaccgaagaaatggctgagaagatgacggtggccaaggattcctccgacctgcccgaggagtctcgtcgggagctgctggagcagatcgccgattgctgcatgcgacagggaagctaccacctcgccacaaagaagtacacacaggctggcaacaagctgaaagcaatgcgcgcccttctgaagtcaggagatacagagaagattaccttctttgcttccgtgtcaagacagaaagaaatatacataatggcagcaaactacctccagagcctcgattggcggaaggagcctgagattatgaagaatatcatcggcttttacaccaaaggaagggctctagacttactggctggattctatgatgcttgtgctcaggtggaaatcgacgagtaccagaattacgataaagcgcatggagctctgacagaggcctacaagtgccttgcaaaggccaaagcaaagagccctcttgaccaggaaacacggctcgcccagctccagtcaagaatggccctcgtcaaacggttcattcaggctaggagaacatacacagaagatcctaaggaatcaatcaagcagtgtgagctgttactcgaggagcccgatctcgactccacaattcggattggggatgtgtacggcttcctggttgagcactacgtgcgcaaggaggagtatcagacagcctaccggtttctcgaggagatgaggagacgcctgccactcgctaatatgagctactacgtgagtccacaggccgtggacgccgtacaccgcggactcggcttaccattacctcggactgtgccagaacaggtcaggcacaattctatggaggatgcaagggaacttgacgaggaggtggtcgaggaagccgacgatgatccgtag

SEQ ID NO: 30593 - DNA, 2406 bp, Artificial Sequence
  Description of Artificial Sequence: Synthetic coding sequence
atggccctgtactatgaccatcaaattgaggcccctgatgcagccgggtcgccatcattcatctcttggcatcctgtacacccattcttagccgtggcctacatctcaactacaagtacaggctcagttgacatttacctggagcagggcgaatgcgtcccagacacgcatgtggagaggccatttcgcgtcgcatctctctgctggcaccccacccggctggtgctggcagtcggctgggagacaggcgaggtaactgtgttcaataagcaggacaaggaacagcacaccatgcctctcacacacacggcagacatcacggttctgcgatggtccccctcaggtaactgtctgctttccggggacaggctgggcgtgttgcttttgtggcggcttgatcaacgggggcgagtacaagggacgccccttctcaagcacgagtatgggaagcatctaacgcactgcatctttcgactccctccccccggggaggatctcgtgcagctggccaaggctgctgtctctggtgatgaaaaggcactcgacatgttcaattggaaaaaaagctcgtccgggtcgctgcttaagatggggagccatgaagggctcctgttctttgtgagccttatggatgggactgtccactatgtggacgagaaaggaaaaaccacacaagttgttagcgccgattcgacgattcaaatgttattttatatggagaagagggaggctttggttgtagtgacggagaacttgcggctgtccttatatacagtgcccccagaaggcaaggcagaggaggttatgaaggtcaaactctctggaaaaacaggtagacgagccgacattgccctgatcgaggggagtctgctcgtgatggcagtgggggaggctgccctgcgcttctgggatatcgaacggggggagaattatatcctcagccctgatgagaaattcggattcgaaaagggcgaaaatatgaactgtgtttgctactgcaaagtgaagggactcctggccgcgggcacagacagaggtcgcgtggccatgtggcgtaaggtgcccgatttcctgggcagtcccggcgccgagggcaaggacaggtgggcgctgcaaacgccaaccgagctgcaaggcaacatcacgcaaatccagtggggaagccgcaaaaatcttctggccgtcaactcagttatttctgttgcaatcctctctgagcgcgcaatgagtagccatttccaccagcaggttgccgcaatgcaggtgtctccatctctcctgaacgtctgttttctcagtaccggggtcgctcactcactgcgaaccgacatgcatatttcaggagtgttcgctacgaaagatgcggtggccgtatggaatggccgtcaggttgctattttcgagctttcaggagcagcaatcaggagcgcaggcacttttctctgtgagacccccgtcctggccatgcacgaagagaatgtatacacagttgaaagcaaccgagtgcaggtgagaacatggcaagggactgtaaaacaactactgttgttcagtgaaactgagggcaatccttgttttttggacatttgcggaaattttctggtggtcggcaccgacctggcccatttcaagtccttcgacctaagccgtagagaagccaaggcccactgctcttgtcgcagcttggccgagcttgtgcccggcgttggaggtattgcctctttacgctgtagctcgagtgggtccactatcagcatcttacctagcaaagccgataacagtcccgatagcaagatttgtttctatgatgttgaaatggacacggttactgtctttgacttcaagactgggcagatcgacaggcgggagaccctgtcatttaatgaacaggagactaataagagtcacctttttgtcgacgagggtctgaaaaattatgtcccggtgaaccatttctgggatcaaagcgaaccgaggttgttcgtttgcgaggcagtccaggagactcccaggtcacagccccagagcgcaaatggacagcctcaggatggccgagctgggccggcagcggacgtgttaattctgtctttttttataagcgaagagcacggttttctgctgcacgagagcttcccgagacctgcaacttctcactccctgctgggtatggaggttccatattactatttcacacgaaagcccgaagaggctgatcgagaggacgaagttgaaccaggctgtcaccacattccccagatggtgtcccggaggccccttagggacttcgtggggctggaagactgtgataaggccaccagggatgccatgctacacttcagctttttcgttacaattggtgatatggacgaggcctttaagtccatcaaactgatcaaacgcgcctag

SEQ ID NO: 30594 - DNA, 399 bp, Artificial Sequence
  Description of Artificial Sequence: Synthetic coding sequence
atggcgaaggacatcctgggggaagccggactgcatttcgatgaactgaacaagctgcgcgtgttagaccccgaagttacccagcagaccatcgagctcaaagaagagtgtaaagatttcgtagacaaaattggccagttccagaagatcgtaggtgggctgatcgaactcgtggatcaacttgccaaagaggcagagaatgaaaaaatgaaagcgatcggcgccaggaacctcctgaagagtatcgccaaacagcgggaagctcagcagcagcagctacaggccttgatcgccgaaaagaaaatgcagctggaaaggtatcgtgtcgaatacgaggctttgtgcaaggtggaggccgaacagaatgaattcatcgaccagtttattttccagaaatag

SEQ ID NO: 30595 - DNA, 477 bp, Artificial Sequence
  Description of Artificial Sequence: Synthetic coding sequence
atgacccatctgctgctgacagctactgtgaccccaagcgagcagaattcatctagagaaccgggatgggaaaccgcaatggccaaggacatcctcggtgaggctgggctgcattttgatgagcttaataaactccgcgttctggaccctgaagtgacccagcaaacaattgaattaaaggaggaatgcaaggacttcgtcgacaagattgggcagtttcagaagattgtgggtggactgattgaacttgtggaccagctcgctaaggaggccgagaacgagaagatgaaggctattggcgctcggaatcttctgaaatctattgccaagcagcgagaggcgcagcaacagcagctgcaggccctgattgccgagaagaaaatgcagttggagcgttatcgggtagagtacgaagccctgtgcaaggtggaagccgagcagaatgagttcatcgatcagttcatcttccagaaatag

SEQ ID NO: 30596 - DNA, 345 bp, Artificial Sequence
  Description of Artificial Sequence: Synthetic coding sequence
atggccaaggacatcttgggcgaggccggcctgcactttgacgaacttaataagctgagggtgctggatccagaggtgacacaacagacaatagagttgaaggaggagtgcaaagacttcgttgataagatcgggcagttccagaaaatcgtgggcggattgatcgagttagtcgaccagctggcaaaagaggcagagaacgagaagatgaaggcgataggggccagaaatttactcaaatctattgctaaacagagggaggctcagcaacagcaactgcaggccctcatcgcagagaaaaagatgcagctggagaggaacgagctgaaaatcagcttgctttag

SEQ ID NO: 30597 - DNA, 399 bp, Artificial Sequence
  Description of Artificial Sequence: Synthetic coding sequence
atggctaaggatattttgggagaagcgggccttcatttcgacgagcttaataaactgagggtgctagatcctgaggtgacgcagcaaaccattgaactaaaggaagagtgcaaagatttcgttgataaaatagggcaattccaaaagatcgtgggaggattgatcgagctggttgatcaactggcaaaagaggccgaaaatgaaaagatgaaggctattggagcacgcaacctgcttaaatccattgcaaagcagcgcgaggcccagcagcagcagcttcaagcacttatcgccgagaaaaagatgcaacttgagcgctatcgcgtcgagtacgaggccttgtgcaaggttgaagccgagcagaatgaatttatagaccagttcattttccagaaatag

SEQ ID NO: 30598 - DNA, 216 bp, Artificial Sequence
  Description of Artificial Sequence: Synthetic coding sequence
gacatcctgggcgaagccggcttgcatttcgatgagttgaataagctccgcgtcctggatcccgaggtgacacagcaaacaatagaactgaaggaagagtgtaaggactttgtggacaaaattggacaatttcaaaaaatagtcggaggacttattgaactggtggatcaactggctaaggaggccgaaaacgagaagatgaaggtttctggctag

SEQ ID NO: 30599 - DNA, 558 bp, Artificial Sequence
  Description of Artificial Sequence: Synthetic coding sequence
atggtgaaattagccgctaagtgtatcctggcagatcccgcagtgggcaaaaccgctctggcccaaatctttcgtagtgacggagcccatttccaaaaatcatataccctgacaaccggaatggacctggtggtgaaaactgtacccgtcccagacacaggggatagcgtggagctctttatctttgactcagccggaaaggagctattctctgagatgctcgataagctgtgggagtcgcctaacgtgttgtgtttggtctacgatgtcaccaatgaagaaagtttcaataactgcagtaaatggctcgagaaggcacgatctcaggcacctgggatctcactgcccggcgttcttgtggggaacaaaacagatctcgccgggcgacgcgccgtggatagcgctgaagctcgagcctgggcactgggacagggtctcgaatgtttcgaaacctctgttaaggagatggaaaacttcgaggcccctttccactgtttggccaagcagtttcaccagctttaccgggagaaagtggaagtgttccgggccctggcttag

SEQ ID NO: 30600 - DNA, 390 bp, Artificial Sequence
  Description of Artificial Sequence: Synthetic coding sequence
tgatctgacggcgcccacttccagaagtcatatactcttaccacaggcatggacctggtcgtaaagacagtgccagtgcctgacacgggagactcagtcgaattattcatctttgatagcgccggcaaagaacttttctcagagatgctggataagctttgggaaagccctaatgtgctgtgtcttgtttacgatgttaccaacgaagagtcatttaacaactgttccaaatggctggagaaagcccgctctcaagcccctggtatatcgctcccaggcgtgctggtaggaaataaaacagacctagctggccgcagagcagtggactccgccgaggcgcgggcttgggcactgggccagggccttgagtgcttcgaaaccagcgtctag

SEQ ID NO: 30601 - DNA, 552 bp, Artificial Sequence
  Description of Artificial Sequence: Synthetic coding sequence
atggtaaagttggccgccaaatgtatcctggccgttcccgttgataagagactgagccgggctgaggtgtgtagtggctgttgtgaagtctgtcggtccgtgagctggacctgcgccctgcccgcggcgagtgagcaagttcctgtaaggggtgatccagccgtgggtaagactgctttggcacaaatttttcgatctgacggagctcacttccaaaagtcgtatacactaacgaccggcatggacctggtcgtgaagacagtccctgtgccagacaccggagactcagtggagctgttcatttttgattctgccggtaaagaactcttcagtgagatgcttgacaaactgtgggaatcacccaatgtgctgtgcctcgtgtatgatgttacaaacgaagaaagcttcaataattgcagtaaatggttggagaaggcccggtctcaggcccctgggatctcactgcccggtgtgctggttgggaataagacagacttagctggcagacgggctgtggattcggctgaagccagggcatgggcactaggatag

SEQ ID NO: 30602 - DNA, 351 bp, Artificial Sequence
  Description of Artificial Sequence: Synthetic coding sequence
atggtgaagctggctgctaagtgtattcttgctgatccagccgttggtaagaccgcattagctcagatattccgatcagatggggcacattttcaaaagtcctacacactaactactgggatggacttagtggtgaagaccgtgcccgtccccgataccggtgactccgtggaactcttcatcttcgactcagcggggaaggagctattttctgagatgcttgacaagctctgggagtcacctaacgtgctctgtttggtctacgacgtgaccaacgaggaatcttttaacaattgctccaaatggctcgagaaggctcgatctcaggcccccggcatctctctgccgtag

SEQ ID NO: 30603 - DNA, 561 bp, Artificial Sequence
  Description of Artificial Sequence: Synthetic coding sequence
atggtgaagctcgcagctaagtgtattctggccggtgatcccgccgttgggaagacagcactggctcagattttccgatcagatggagcacatttccagaagagttatacgcttactactggaatggatctggtggtgaagacagtcccagtacccgacacaggagactctgtggaactttttatattcgactcggcaggtaaagagctcttttccgagatgctggacaaactttgggagtcgcccaatgttctgtgcttggtgtacgacgtcaccaatgaggaaagttttaacaactgctctaagtggctggagaaagcaaggtcacaagcaccagggatctccctgccaggtgtgctcgtgggtaataagacggatcttgcagggcgtagagccgtggattcagccgaagcacgagcatgggctctgggtcaaggcctggagtgcttcgaaacatctgtgaaagaaatggagaatttcgaggctccttttcactgcctggccaaacagtttcaccagctgtatagggagaaggtggaagtgttccgggcgctcgcgtag

SEQ ID NO: 30604 - DNA, 156 bp, Artificial Sequence
  Description of Artificial Sequence: Synthetic coding sequence
atggacctggtggtaaaaacagtgcccgttcctgataccggcgacagtgtcgaattatttattttcgactcggccggaaaagaacttttttctgagatgctagacaaactctgggagtcccccaatgtgttgtgcctagtgtatgacgtgacctag

SEQ ID NO: 30605 - DNA, 438 bp, Artificial Sequence
  Description of Artificial Sequence: Synthetic coding sequence
atggatctggtcgttaaaacagtccccgtgccagacaccggcgacagtgtggagttatttatttttgatagcgccgggaaagaattattctcagagatgttagacaagctgtgggagagtccaaatgtgctgtgtcttgtgtacgacgtgactaatgaagagagcttcaacaactgttcgaaatggctcgagaaagcacgcagtcaggctcccgggattagcttaccaggagtattagtcggaaacaagaccgatctcgccggtagaagagccgtcgattcagccgaagccagagcatgggcattaggtcaaggactggaatgctttgagacatccgtgaaagaaatggagaattttgaggctccttttcattgcctggccaaacagtttcaccagctctatcgtgagaaggtcgaggtctttagagccctggcctag

SEQ ID NO: 30606 - DNA, 1314 bp, Artificial Sequence
  Description of Artificial Sequence: Synthetic coding sequence
atggaaaaggagctaagatccactatcctcttcaatgcctataaaaaagaaatattcacgactaataacggctataaatctatgcaaaaaaagctccgaagcaactggaagatccaaagtttgaaggacgaaattaccagtgaaaaacttaacggagtgaagctctggataactgcgggccccagggagaaattcacagcagccgagtttgagattctgaagaagtacctagatactggaggagacgttttcgtgatgcttggtgaaggaggcgagtcacgctttgacacaaatattaacttcctgctggaagagtatggaattatggtaaataacgacgccgtcgtgagaaacgtgtaccataaatactttcacccgaaagaggcactggtctcaagcggtgttctgaaccgagagatatcccgcgccgccggtaaggccgtccccggcattatcgatgaggagtcctcaggtaataatgctcaggctcttacgttcgtgtaccctttcggcgcaactctgtcagtcatgaaaccagcagttgctgtgctgagcaccggcagcgtttgctttccactgaaccgcccaatcctagccttctatcactcaaagaatcaggggggcaagctggcagtcttaggatcctgccacatgttttccgaccagtatctcgataaagaggaaaactctaaaatcatggatgtagttttccagtggctgacaactggcgacattcatctcaatcaaatcgacgccgaagacccagagatatcagactacatgatgctcccctacacagccacgctcagcaaaaggaacagggagtgtctgcaggagtcagatgagattccgagagacttcactaccttatttgacctatccatattccagcttgacacgaccagctttcactccgtgatcgaggctcatgagcagcttaacgttaaacacgaacctttacagctgatccagcctcagtttgagacgcctcttcccaccttgcagccagccgtattcccaccatcattccgcgagctcccccccccccctctggagcttttcgatctggacgaaactttcagcagcgagaaggcccggctggcccagataacaaacaagtgcaccgaggaggaccttgaattctacgtgcggaagtgcggcgatatattaggcgtcacttcaaaactgccaaaagaccagcaggacgccaaacatatacttgagcacgttttcttccaggtcgttgaatttaaaaagttgaatcaggaacacgacatcgacactagtgagactgctttccagaataatttctag

SEQ ID NO: 30607 - DNA, 1314 bp, Artificial Sequence
  Description of Artificial Sequence: Synthetic coding sequence
atggaaaaagagctgcgcagcacaatcttattcaacgcgtataaaaaggagatatttactactaataatggttacaagtcaatgcagaaaaagcttaggagcaattggaagattcagagtcttaaagatgagattacttcagagaaactgaacggagtgaaactttggatcaccgccggaccacgcgaaaagttcaccgcagccgaattcgaaatcctgaagaaatatttagacaccggcggggacgtcttcgtgatgctaggagagggaggagaaagcaggtttgataccaatataaacttcttgctggaggagtatggaattatggtcaacaatgacgccgtggtcagaaatgtttaccacaagtatttccaccccaaggaagccctggtcagctccggagtattgaatagggagatcagtcgcgccgccggtaaggcggtgcccgggatcatcgatgaggagagttccggaaataacgcgcaggccctgacatttgtgtatccgtttggcgcgaccctgagcgtaatgaagccggctgtggctgtcttatcaaccggcagcgtgtgcttccccctgaaccggcccatcttagcgttctaccactctaagaatcaggggggcaaactcgctgtgttgggctcctgtcacatgtttagtgaccagtatttggacaaggaagagaactctaaaattatggatgtcgtgttccagtggctgacaactggggatatacacctgaatcaaattgatgctgaagatcccgagatttccgactatatgatgctgccgtacaccgcgacgctgagcaagcgcaatagggagtgtctccaggaatccgatgaaatcccaagagacttcacaaccctcttcgatctcagcattttccagctcgacactactagttttcacagtgtaatcgaggcacacgaacagctaaatgtgaagcatgagccacttcagttgattcaaccccagttcgaaacgcccctgcccaccctgcagcctgccgttttccctccaagctttcgtgaattgccaccaccgccacttgagctgtttgacctagacgagaccttttcaagtgagaaggccagactggcccagataaccaacaagtgtactgaggaagacctggaattctacgtccggaagtgtggagatatcttgggcgtgacctccaagctgccgaaggatcagcaggacgccaaacatatcctagaacatgtgttcttccaggtggtcgagttcaaaaagcttaaccaggagcacgacatcgacacaagtgaaaccgcattccagaacaatttttag

SEQ ID NO: 30608 - DNA, 1401 bp, Artificial Sequence
  Description of Artificial Sequence: Synthetic coding sequence
atggagccagaacttttggtgaggaaggtgtcagcccttcaggcctgtgtccgaggatttctggttcgccgacagtttcaatcattacgggccgaatatgaggccattgtgcgagaggtggagggtgacctgggcaccttacaatggaccgagggccgcatcccacgtccccgattcctgccagaaaaagcaaagtcccaccagacgtggaaagctggagaccgggtggccaacccagaacagggcctctggaatcacttcccctgtgaagagtctgagggagaagccacatgggaggaaatggtgctcaagaagtccggcgagtcgagtgctaaccaagggagtctatgccgagaccattcctcttggctgcagatgaaacagaatcggaaaccaagccaggagaagactcgcgataccactaggatggagaacccagaggctactgatcagcgactgcctcatagccagccacagctgcaagagctgcagtaccatcgctcgcatctggcaatggaattgctgtggcttcagcaggctatcaatagtcgaaaggagtacctgctcttaaagcaaaccctccgaagtcctgaggcgggacctattagggaggaaccacgcgtgttcctggaacacggtgagcaggcctgcgagagggaccagagccagccttccgccccgttggaggaccaatcttaccgcgatagaacgaccggcgagctcgagcaggaggatgattcctgccacagagtcaagtcccctcaccgatctccggggtctctcgcaacaacccaaaagaatattgccggcgccaagtgcagggagccatgctactccaaatccggtccacccagctcaatcccatccaattcgcaggctctgggcgataggctcaccaagggcccggacgatggccggcagacttttggcggcacctgccttctgcaaatgaaaatattggaagaccagacacctaggggcctcaaaccacggaaccactgcccacggaagagtcgaactcaattgagcgctctgtatgaggactccaacattaaggagatgtcaccgcgaaagttagaccacaaggaacccgattgccggacagtccgcacccaggagctaggactgtcagaggaccacattatttgggatggcaccctgggaggcccagagcactcggtgctagatctttggaggaccaagcccccaaagggccaggcccctactgataggtctagcagggacgggacatccaacgaaccaagccacgaagggcagaagaaacagagaactattccgtggcggtctaaatcgccagagatcctgagttcaacaaaggcgggatgcacaggagaggaacagtggcggggaagaccttggaagacggagcctccaggatag

SEQ ID NO: 30609 - DNA, 1641 bp, Artificial Sequence
  Description of Artificial Sequence: Synthetic coding sequence
atggaacccgagctgctcgtcaggaaagtctccgctttacaggtccgaggacgcgctcggggctcacaagacttttcttttcgggagataatgggatcccgcacctggacaagccagcgtgacgccacaaccttctcccctctcacagcccggcaacccttagagatccctgcagtccctaatagagccgaggaaagttgggaccccaggactccctgccctgctcgacctcatagtcatcataccctcgccccagaccagggcaacgggaagagcctgaaggcttgcgtccgcgggttcctggtgaggagacagttccagagcctgcgcgcagagtacgaagctatcgtgcgagaagttgagggagacctggggaccctccagtggacagagggtagaattcccaggccaagattcctgcccgaaaaagctaagtcacaccagacctggaaggctggcgatcgtgtggccaaccctgaacagggtctgtggaatcactttccctgcgaagaatctgagggagaagctacatgggaggagatggttctcaaaaagtctggtgaatcctccgctaaccaaggctctctgtgcagggaccattcgtcttggctccagatgaagcagaacagaaagccgtctcaggagaaaacgagggacaccacccggatggagaatcctgaggcgaccgatcagcgtctaccgcattctcaaccccagctccaggaattgcagtaccaccgctcacatctggccatggaactcctttggctccagcaggctatcaactccaggaaggagtatctcctgttgaagcaaactctgcgttcaccggaggccggtcctattcgggaagagccgcgcgtttttctggaacacggggagcaggcctgcgaacgggaccagtcacagccctccgcgcctctggaggatcaatcgtacagggatcgcactacaggagagctcgaacaggaggacgactcctgtcacagagtgaagagccctcaccggagcccaggcagcctggcaacgacccagaaaaacattgccggtgccaagtgtcgagaaccttgttattcgaagagtggaccgccatcatccatcccaagcaactcacaggctctgggggacaggttgacaaagggccctgacgatgggcgacagacgtttgggggtacctgtcttctgcagatgaagatcctcgaagaccagacccctcgggggttaaagccccgcaaccactgtcctagaaagagccgcacgcagctatccgccctatatgaggattcaaatattaaagagatgagcccccggaaattggaccacaaggagcccgactgcaggaccgttcggacacaggagctcggtttatcagaagaccatatcatttgggatgggaccctcggggggccagagcattccgttctggacctctggcggaccaagccacctaaggggcaggcccccactgataggagctctcgcgatggcacgtcaaatgagccctcgcacgaagggcaaaaaaagcagagaaccattccatggagaagcaaaagccctgaaatcttaagctccaccaaggctgggtgtacgggagaagagcagtggagaggaagaccatggaaaaccgaacctccaggctag

SEQ ID NO: 30610 - DNA, 1044 bp, Artificial Sequence
  Description of Artificial Sequence: Synthetic coding sequence
atggccctggatatccttgctatggcacctttgtaccaggcccccgccatcaaccggatcgggccaaagactgatccgtccaaacgccccgcagaccctctcaagcccctggtactctctagaactaaactgaccacaatagaggcaaagcgtatcatgagtatcctagacgaggctatctacaaagtggaactggtgacactcctaagctacgtagcatctaaccgagaggacatggaggggatgttgggcgaggatgtgatgagggccgtgcgcgaacatgaggacctgtgccaggtgctgctggaaaatgtcagatgtctgaaggaaaaggaacgccagctgcaggagcaaaaagaagccgaggaggagggctggcttcgggatcgcctcctcagcattgagctacagaagagttccctttcacccctaatgcaacagatcaaagatagcactaagaacgtgcttcggctgctcttaagcaatccccaggcagctaggttattacagatgcagacccagggccgctcagctgaggctcagaatttcatagatagcctgatcgagcttagaggattcctgttcgagaagcttctcaccagccccatggaggctagagacaaggcacagttcttgcaggacatcagccgccagaattcaaataaccagcagattatagatacactggagaaagagctggccgagagaatgaagaacaggaacgctgaagaggaactcgaggacctagatgcggtccatagggaagagaaaatttctctcgaggagctgcggaggagacataaggtgctcgtcggtgaattcgctcagatccgcgaagagcgtgagatcaattcaaagaagaggatggaagctgaacaggaaatggtcaggatggtccgtgctgcgactctcatccaggctctttggaaggggtacctcgtacgcagtctactccgatctaagaagaaacggggaaaaggcaaagctaaggataaagagaagggaaaacagaaagggaaagagaagggtaagggtaagaagtag

SEQ ID NO: 30611 - DNA, 1110 bp, Artificial Sequence
  Description of Artificial Sequence: Synthetic coding sequence
atggcgcttgacatccttgccatggctcccttgtatcaggctcccgctatcaatagaatcggtcctaagaccgatccaagcaaaaggccggccgatccccttaagcccctggtgcttagcaggactaagcttacgaccattgaagctaagcggattatgagtatactggacgaagccatttacaaagttgagctggtgaccctgctgtcatatgtggcttccaatcgggaagatatggaggggatgttgggcgaagatgtaatgagggccgtccgcgaacatgaggacctgtgtcaggtccttttggagaacgtaagatgcctcaaagagaaggagcgacaattgcaggagcagaaagaggccgaggaggaaggctggctccgggaccgactactaagcattgagctgcagaaatcttccctgtccccactaatgcagcagataaaggactctaccaagaacgtcctgcgcctgttgctgagcaacccacaggccgcccggcttttgcaaatgcagacacaaggtcggagcgcggaggcccagaacttcatcgacagtctgattgagctccgtggcttcctttttgaaaagctgcttacctctcccatggaggctagagacaaagcccaattcctacaggatatttccaggcagaattccaacaaccaacagattattgacacccttgagaaggaacttgccgagcgaatgaagaatagaaatgcggaagtgctttttcattccattgccgagataactgaagaggcgacccaaatcttttgttggctgggattctcttccatgattgatttctttttcaagatggaaagtcggtctgtggtacagactagggttcagtggtgtaatctggattcgctccagccactcccacctcgtttcaagcgattctctcatcattctctcccttcatcctgggattatcgccgaatgcctcctagacccgccaacttctgcatatttagtcgcgaccgggtcaccccattctcctgcctttctctgcctagctcctgggactaccgctgcccccccctatattcctcactggcggccgaacaggacccagtgtccaagaagaaaggcaagcaatag

SEQ ID NO: 30612 - DNA, 1350 bp, Artificial Sequence
  Description of Artificial Sequence: Synthetic coding sequence
atggccctggacattctggccatggctccactataccaggcccctgctattaatagaatcggaccgaaaaccgatcccagtaagagaccggctgacccactgaaaccactggtgttgtcccggacaaagctaaccacgatcgaggcaaagaggataatgagcattctcgatgaggctatttacaaggtggaattagtgacacttctgtcatacgtggcgagcaacagggaggacatggaaggtatgctgggtgaagatgttatgagagcagtgagggagcacgaggacctctgccaagttctgttggagaatgtgaggtgtcttaaagagaaggagagacaactgcaggagcagaaggaagcggaggaagagggttggctacgcgatcggcttctgagcattgagctgcagaagtcgtcgttgtcgccacttatgcaacagattaaagactccacaaaaaacgtgctgcggcttttactgagcaatcctcaggcggccaggctactgcagatgcaaacacaaggacggagcgccgaggctcagaatttcatcgacagcctgatagagctcaggggatttctcttcgagaagctgctgacatctcctatggaggctagggataaggcccaatttcttcaggatatctctcgacagaactccaataaccagcagattattgatactctggagaaagagctggccgagcgcatgaagaacagaaacgctgaagtggaaaaggagaacttcgtcatccaggagctgaagaaccatctccaccaggtgctcaaattttctgagaattcactcgtcaggacaaaacaggaggccgaaaagcagcagaaagccgactttcgggcaagtcaggctcgggtggcaaagattcagcaggaaatacttcagctgcagagccagttttacaacctggtcatggagaatcgggaagccgagcaggccttacgaaagaagaagtacaaggtggaaactgaaattgagaactggatacaaaaatatgacactgagatgggggagaagcaggaagagctggaagacctggacgccgtccaccgggaggagaagatcagcctggaggaactgcggaggcgccataaggtccttgtgggagagttcgcccaaattagagaagagcgcgaaataaactcaaaaaagcggatggaggccgaacaagagatggtcagaatggtgcgagctgctacactaattcaggcgctatggaaagggtacctggttcggtctctgttgaggtctaagaaaaaaagagggaaggggaaggccaaagacaaggagaagggcaagcagaaggggaaagagaaaggcaaagggaagaagtag

SEQ ID NO: 30613 - DNA, 618 bp, Artificial Sequence
  Description of Artificial Sequence: Synthetic coding sequence
atggaggagaagcagcctcagaaaacaaaagagccatcaaaagaggacgaaccccagcagaaggagatgccgactcacttgagcctgggggcagaaagcaaggccgaggccaaaacacctgtgctcgttgaaacgcaaaccgtggataatgctaatgagaagagcgagaagccccccgagaaccagaagaaactatctgacaaggatacagtcgcgaccaaaatccaggcatggtggcgtggcacactagtgcggcgagccctcctgcatgccgccctgtctgcttgcattattcagtgctggtggcgactgattcttagcaagatcctgaagaagcgacggcaagccgcactggaagccttttctagaaaggaatgggctgccgtgacactgcagagccaggcccgcatgtggcgcattagacgccgatattgtcaagtgctgaacgctgtcaggatcatccaggcgtactggcgctgtagaagctgtgcctctcgtggtttcattaaagggcagtaccgagtcactgccaaccagctgcacctgcagcttgaaattttgctggatagtggcccttgcattgttaccgaatgcattcccttttccattaaggagtag

SEQ ID NO: 30614 - DNA, 249 bp, Artificial Sequence
  Description of Artificial Sequence: Synthetic coding sequence
atggaagagaagcagcctcaaaagacaaaagaaccctcaaaggaagatgagccccagcagaaggagatgcccacccacttgtctttaggggctgagagtaaagccgaggctaagaccccagtgctagttgagacacaaacagtagacaatgccaatgaaaagtctgagaaacgggtgtgccaatggaacatggtcattgtctccatggactggaagtctttagagagcgaagacctccggaatctgtag

SEQ ID NO: 30615 - DNA, 495 bp, Artificial Sequence
  Description of Artificial Sequence: Synthetic coding sequence
atgcgtgttaggttctgtacaaaagggaacctgatcctcgtgatcatcgaggatgttgaagagagtatcgagtggaagaccctgcaaaaaaaaaaacagcagaagattaaagaaaaactccgaatccgcactaaagccgctgttaagatccaggcttggtggcggggcaccctcgtgcgccggacgctgctgcacgctgctctgagagcgtggatcattcagtgttggtggaggatgacactgtccagggtgttagaaaagaagcgccaggccgccctcatcgcttacgcgacccgggagcgggccgtgattaagctccagagtctcgttaggatgtggagagttcggtggaggtattgccaggtgcttaatgccatttatattatccaggggcactggcagtgtcacaattgtcagacatgcgcacttctgcagggacactgtgtcgttactgccacgcacctccagttccatatcgagatcatcaacagttag

SEQ ID NO: 30616 - DNA, 465 bp, Artificial Sequence
  Description of Artificial Sequence: Synthetic coding sequence
atggggagtaagtgctgcaaaggtgggccggatgaggacgctgtcgaacgacaacgacggcaaaagctcctcctggcacagttgcatcaccgcaagagagtgaaggcagcagggcaaatccaagcttggtggaggggagtattggtccggcgcaccctattggttgccgcccttagggcttggatgatccagtgctggtggaggacgttagtgcagcggagaatcagacagcgccggcaggccctcctgagggtgtatgtcattcaagagcaggccacagtcaagctccagagttgcatccgtatgtggcagtgcagacagtgttacaggcaaatgtgtaatgctctctgcctttttcaagtccccgaaagtagcctggcctttcagacggacggttttctgcaggtgcaatacgctataccctcgaaacagccggagttccatattgaaatcctgtccatttag

SEQ ID NO: 30617 - DNA, 465 bp, Artificial Sequence
  Description of Artificial Sequence: Synthetic coding sequence
atgggctccaagtgctgcaagggcggacccgacgaggacgccgtggagcgtcagcggcggcagaagctgttgttggctcagctgcaccacagaaagcgggtgaaggcggccggacagattcaggcctggtggcggggggtcctagtcagaaggactctattggtggctgcacttcgcgcttggatgatccagtgttggtggaggacactggttcaaagacgaattaggcagaggcgccaggctctgctgcgagtatatgttatccaggagcaggctactgtgaagctccagagttgtatcagaatgtggcagtgtaggcagtgctaccgacagatgtgcaacgctctatgcctatttcaagttcccgagagctccctcgcatttcaaacggacgggtttttacaggtccaatacgccataccttcaaagcagcctgaattccacatcgagatcctcagcatatag

SEQ ID NO: 30618 - DNA, 465 bp, Artificial Sequence
  Description of Artificial Sequence: Synthetic coding sequence
atgggttccaagtgttgtaagggggggcctgatgaagatgctgtggaaagacagagaagacagaagctgcttcttgctcagctccatcatagaaaacgcgtcaaggcagctggccagatccaggcctggtggcgtggcgtgcttgtgagacggacgctgttagtggccgcactgcgtgcctggatgatacagtgctggtggcgcaccctcgtccagagaagaatccggcagaggcggcaagccttgctgcgggtctacgtgatccaggaacaggccaccgtaaaacttcagagctgcattagaatgtggcaatgccggcaatgttaccggcaaatgtgtaatgcgctctgcctctttcaggtgcccgagagcagtctggctttccaaaccgacggcttcctgcaggttcagtatgctatccccagtaagcaacctgagttccatatcgagatcctatcgatttag

SEQ ID NO: 30619 - DNA, 465 bp, Artificial Sequence
  Description of Artificial Sequence: Synthetic coding sequence
atgggctcgaagtgttgcaaaggcggccctgatgaggatgcagtcgaacggcaacgcaggcagaagttactgctcgcacagctccaccatagaaagcgagttaaggctgctggtcagatccaagcgtggtggcggggcgttttagtccggaggactctgttggttgccgctctacgcgcctggatgattcagtgttggtggcgtacactggtccagcggcgcatacgccaaaggaggcaggctctgcttcgcgtatacgtgatccaggaacaagctacagtgaagctgcagtcttgtatcaggatgtggcagtgtcgccagtgctatcggcagatgtgcaacgccctgtgtctatttcaggtgcctgaatcgtcactggccttccagaccgacggatttctccaagtgcagtatgccatccctagtaagcagcctgaatttcacatcgagattctttccatttag

SEQ ID NO: 30620 - DNA, 366 bp, Artificial Sequence
  Description of Artificial Sequence: Synthetic coding sequence
accaagaagaagaagaagaagaaaaagcgaaaagaaaaaaagctgagagagagatcggccgcagtcttcatccaggcctggtggcgcggcatgcttgtcagacgaaccctactccatgccgcactccgtgcttggattatccagtgttggtggagacaggtgctcgagaagcttctggcaaagcgcaggagaatggttctggagttttacgtgcaacaggaatgggctgctgttcggttacagagttgggtgcgaatgtggtgcgttcggcaaagatattgcaggttgctgaatgccgttagaatcatacaggtgtattggcgctggcattcttgtcacagcagggtctttatagaagggcattag

SEQ ID NO: 30621 - DNA, 447 bp, Artificial Sequence
  Description of Artificial Sequence: Synthetic coding sequence
atgggccccgaggaaaagacaatcatgacggagcgctccgcagcggtgttcatccaagcctggtggcgagggatgcttgtgaggaggaccctgcttcacgctgccctgcgagcttggatcattcagtgttggtggcgacaagtattagagaaacttctggcaaaacggaggcgaatggtgctggaattctacgttcagcaagagtgggccgctgtacgtctccagtcatgggtccggatgtggtgtgtgcggcagcgctattgtaggttgctgaatgcagtgcgaatcatccaggtgtactggagatggcacagttgtcacagtcgtgtgttcatcgaagggcattatgaacttaaggagaaccagctgaatatccaactggagatttcactcggactgcaggcctgtaaagtgcagcagtgtatcccactcccgctgaaagaatag

SEQ ID NO: 30622 - DNA, 324 bp, Artificial Sequence
  Description of Artificial Sequence: Synthetic coding sequence
atggtcagacggactttactgcaggccgcactgagagcctgggtgattcagtgctggtggcgctccatgcaggcaaaaatgttagagcagagacgccggttggcattacgattgtacacctgtcaggagtgggcagtggtcaaagtgcaggctcaggtgcgcatgtggcaggcccggagacgttttcttcaggctaggcaggcagcctgtatcattcagtcacactggcgctggcacgccagccaaacccgggggctgatccgtgggcactacgaagtacgggcttcccgtcttgagctggatattgagatcttgatgacttag

SEQ ID NO: 30623 - DNA, 570 bp, Artificial Sequence
  Description of Artificial Sequence: Synthetic coding sequence
atggcggcgccaagacagatcccctcacacattgtccggctgaaaccctcatgctccaccgatagcagctttactagaactcctgtcccgaccgtgtcattagccagcagggaactccctgtgtcatcctggcaggtcacggaaccaagttcgaaaaacctttgggaacaaatttgcaaggaatatgaagctgagcagcctccgttccctgaggggtataaagtcaaacaggaaccagtcattaccgtcgcacccgtggaagagatgctgtttcacggttttagtgccgaacattacttccccgttagtcattttactatgatttcacgcacaccatgcccccaagataaatctgagacaatcaatcctaagacatgctcccccaaagaatatctggagactttcatttttccagttctgctgcctggaatggccagcctccttcaccaggccaagaaggaaaaatgttttgaacccacggccgctaacccaacactggctcccgccgaccgaaggggctcctctccattgcatagtattttactggagtctctctgcggtagcctctag

SEQ ID NO: 30624 - DNA, 864 bp, Artificial Sequence
  Description of Artificial Sequence: Synthetic coding sequence
atggcagcccccaggcaaattcccagccatattgtgcggctgaagccctcttgttccactgattctagttttacaagaacacccgtgcctaccgtatctctcgcaagtcgagagctccctgtgtcttcctggcaggtgactgagccctctagcaaaaatctgtgggagcagatttgtaaagaatatgaagccgaacaaccaccattcccggaaggatataaggtcaaacaggagcctgtgattactgtcgctcctgtggaggagatgctcttccatgggtttagtgcggaacattacttcccagtgtctcacttcaccatgatttcgcgaactccatgccctcaggacaaaagcgagaccatcaatccaaagacatgctcccccaaggaatatttggagacttttatctttcccgtgcttttgcccgggatggcgagccttttgcatcaggcaaaaaaagagaagtgcttcgagcgcaagagaacaaagttcatcgcctgtgactttctgacagagtggctatataaccaaaacccaaaaagagcgggggaaccgttcacagagttctttagcatcccatttgtcgaggaaagactgaaacagcatcctaggccccctattccactgagcctccttttaaccgaggaggaggctgctttgtacattcagtcattctggcgcgcatgcgttgttcgatgcgaccctgaaattcaggagcttaggcaatggcagaaaaagcttagggaggccaagcacatccaccagcaggtaaagatcttctgggctaaacaagaacagaaggtgaagtgtaaaatggaggacgacgcggtgccggccgcaaaaatgaagataccatcttcttag

SEQ ID NO: 30625 - DNA, 600 bp, Artificial Sequence
  Description of Artificial Sequence: Synthetic coding sequence
atgctctttcatgggttctcagcagagcattatttcccagttagccactttacaatgatctctagaactccttgcccgcaggataagtctgagacaattaaccccaaaacttgcagcccaaaagagtatctggagacttttatcttcccagtgctgttacctggcatggcgagtctgctccaccaggccaagaaggagaagtgtttcgaaaggaaaagaaccaagtttatagcgtgtgacttcctgactgaatggctctacaaccagaacccaaagagagccggagagcctttcacggaatttttctcaatcccctttgtcgaagaacgattaaaacagcaccctcgcccaccgatcccactctcgcttcttctgacagaggaagaagcggccttatatatccagtccttctggcgggcctgcgtggtcaggtgcgatcccgagattcaggagcttaggcaatggcagaagaagctgcgggaggccaagcatatccatcagcaggtcaaaattttctgggcgaagcaagaacagaaggtgaaatgtaagatggaagacgatgcagtacctgcggccaagatgaaaatccccagctcctag

SEQ ID NO: 30626 - DNA, 720 bp, Artificial Sequence
  Description of Artificial Sequence: Synthetic coding sequence
atggccgctcctagacagatcccctcacatatagtgagattaaaaccatcttgttccaccgatagctctttcaccagaactcctgtgcccacagtgtccttggcaagtagggagctgcctgtttcgtcctggcaggtgaccgagccaagtagcaagaacctctgggagcagatttgtaaggaatatgaagccgagcagccaccctttccagagggatacaaagtgaaacaggaacctgtgattacagtcgcacccgtggaggagatgctgtttcacggattctccgccgaacattacttccccgtaagccactttaccatgatttctaggacaccttgtccacaggataaatcagagaccatcaatcctaaaacatgtagcccgaaagaatacctggaaacatttatcttccctgttcttctgcccgggatggcctcactcctccaccaggccaaaaaagagaagtgctttgagcggaagcggacgaagttcatagcctgtgatttcctgactgagtggctgtacaaccaaaatcccaaacgcgcaggtgaaccatttacagaatttttttctataccatttgtggaggagagattgaagcaacagttcgctgtgatcctcagatttaagaactgcgtgagtggccgtcgaaattttgcccgtccgtcgacgtttacgtctaaatctaagtttagcggaccctcaaaaaacaagaagtag

SEQ ID NO: 30627 - DNA, 2460 bp, Artificial Sequence
  Description of Artificial Sequence: Synthetic coding sequence
atgtataataagatgtggcatcagacccaagaggctttgggagctctcctggacaaggagcctcagaaaatgatcgaacctcaacgaaaccaggtgtttattttccagactcttgcaaccttttacgtcaagtacgtccagatttttagaaatctagagaacgtttacgatcaattcgtgcaccctcagaagcgaatcttaatcagaaaagtgctggacggggtaatgggacgtatactggaactgaaaaatgaaatggtcgagcttgagctgaccgaatttcattacttcgatgatatcttgcaggatctcaagctggccccccagcaactggatattccaatccctaagtatttcctgaaagagaagttggaggttatcaaagggcgggagaagatcctggctcagatcctggctgatagtgggattgacacttcggacatgaagtaccctgtgaaaagtattccgttcgacgaggccgtgaagctgatccagatcgctgagagggctcgacaggggagactgcgcgctcttttcatgaaacaaatctacctgcaggaataccgagccaagcagtccaaaatgctggggaaaaaggtgaccgatacatgggccgccgccctcagaatccagaaagtatggcggcggttccaccagcgtaaagagacagagaagctgcgggaagaggaaatgatctttctgggcatgaatccacccccgctttttaacgaggtctcagcaaccgtcattcaagcggagaaagttgaccgcttgcggaatgaagtgcaaatcaagcacgaagaggattatcgggaggctctggttactatcaagaatgacttgaaactgattgaaggggttgacattaaagaaaacctgcaagaccaaattaggcattggttcattgagtgtaggaatctaactggcactttcccagattaccctgacgtagaggagggcggaagcgcgataatcttctctgacaagacaatacagcaggtgattgaggacatcatcgccaaccaggaggaggaagagaaaaacaagaaaaaaaagaagaaaaaagagaagcagccaaagaaagcaaaaaagcagaaaaaaggaacaaaggagaagaataaggaggaggacgagaagtggaaaatgtcacccagtctgttcctgccagcaatgaaagagggttgtaacgcctacaaggagatctggatgaagaaagacgagtcctggaacttcagtcaggactatgatcccgaactgattaaggaagagaagcggaaagagcttcagagtgagattaggattcaggtggatgaactgatgcgtcaggagctcaagaatcttaaattggcagtggatcgggagagagaaagacctgtcaaggccggaaagaaaaaggacaagaagaagggaaaaaagggaaagaaaaaggaaaagaaagccaagaaagataaggatttgacagccgaccggactatcgagagtctatataaggagcttgtcgaggaaggcttgcttatacaggccctgaaagtgaacctcagtgactacattggagagtattcatacttgggtactactctcaggcaagtctcaattgaaccgatgccaagtcttttggatgtgcggcagctgataacactgtacggcatctggcctctgggctccgctgcggtgcatgagaaggctcccctggtgaaatccctcctgttggccggtccctcaggagttggtaaaaagatgctggtgcatgcgatatgcacagagactggagcgaatcttttcaacttgtcctcttcaaatatcgccggcaaatatcccggtaagaatgggcttcagatgatgctgcatgcagtcttcaaagtcgcaaggcagttgcaaccctcagtcgtctggattgaggatacagagaagacattttataagaaagtgccgaatgccgagaagatgaacgagcccaaacggctgaagaagcacctccctcaaattctgaagctgctgaagccggatgacagaatcctcatagtggggactacgcgccgcccattcgacgccgagttacagtccttttgtaaagtctatcagaaaattattctggtcccgaggcctgactatgcctctcgatatgttctctggaagcagatcattgagcgaaacgggggggtgctgacatcagcattaaatgtgtcttgtctcgccaaggtgacagatggctttacccagggacatattgttgaggtggtcaagggggtcctaacggaccaacgtatacgccgacagatccacaagcccttgactgcggtggagttcatcacggccattacctcaatgaatccggtctacaaagaagaggaagagtcattcaaaaactggtacgcaaagacccctctaggcaagaagagagccctcgccatcaccgggggctcaaccgaaaaagctaaagataaagggaaaagaaagtag

SEQ ID NO: 30628 - DNA, 2469 bp, Artificial Sequence
  Description of Artificial Sequence: Synthetic coding sequence
atgagcaatgccatgtacaataagatgtggcaccagacacaggaagcactcggcgcactgttggacaaggaaccccagaaaatgatagagccacagcgaaatcaggtgtttatcttccaaacgttggccacgttctacgtgaaatatgtccagattttccggaatttagaaaatgtgtacgaccagtttgtgcatcctcagaagcggattctaattcggaaggtcctggatggtgtgatgggccgcattctggaactgaagaacgaaatggtggagcttgaacttaccgagtttcattacttcgacgatattttgcaagatctgaagctcgctccccagcaactcgacatacccatccctaaatactttctgaaggagaagttggaagtgatcaaaggaagggaaaagatactcgctcagattttggccgattccggaattgacacttctgatatgaaataccccgttaaaagtatcccttttgacgaagcggtgaaattgatccagatcgccgaacgcgcgcgacagggccgactcagagcactgttcatgaagcaaatataccttcaagagtatagagccaagcagtccaaaatgctcggtaaaaaagtgacagacacctgggctgccgctttacggatccagaaagtctggcggagatttcatcagcgcaaggagaccgaaaaattgagagaggaagagatgatattcctgggtatgaatccgccccctttgttcaacgaagtgagcgcaactgtaattcaagcagagaaggtggatcggctgaggaacgaggtgcaaataaagcacgaggaggattatcgggaagctctcgttacaatcaaaaatgatctcaagctgatcgagggcgttgatatcaaagaaaatctccaggaccagattaggcattggtttatcgagtgccggaacctcacaggcacattcccagactatccagacgtagaggaagggggttcggccatcatcttctctgacaaaacgatacagcaagtgatcgaggatataattgctaaccaagaggaagaagagaaaaacaagaagaagaagaaaaagaaagaaaagcagccaaaaaaggcaaagaaacagaagaagggaactaaagaaaagaataaagaggaggatgaaaaatggaaaatgagtccatccctgtttctgcccgcaatgaaggagggctgtaacgcctacaaagagatttggatgaaaaaggatgagagttggaatttttcacaggattacgatccagaactaataaaagaggagaagcgcaaggagctgcagtctgagataagaatccaggtggatgagctcatgcgacaggagttaaagaacctgaaacttgccgtggatcgggagcgggagcgtccagtgaaggctggaaaaaagaaagacaaaaagggcaaaaaggggaaaaaaaaagaaaagaaggcgaaaaaggacaaagacctgactgccgatcgaactattgaatcactgtacaaggagttggtggaggagggactgctcatccaggcactcaaagtgaacctgtccgattacataggggaatattcctacctgggcacaactcttcggcaagtaagtatcgaaccaatgccatcgttgctggacgtgaggcagctcatcacgctgtatggtatatggcctctgggctctgccgctgttcacgaaaaagcccccttagtgaagagcttgttgctcgctggtccttctggcgtagggaagaaaatgctcgtgcacgccatctgtacagagacaggtgccaacctgttcaatctgtccagctctaacattgcaggcaagtaccctgggaaaaacgggctccaaatgatgcttcatgccgtgttcaaggtcgccagacagctccagcccagtgtggtatggatagaagacaccgagaaaaccttctataagaaggtgccgaacgctgaaaagatgaatgagcccaagagacttaaaaagcacctgccacagatcctgaaacttcttaagccagacgataggattctaatagtaggaaccacaaggcgacccttcgacgctgagctgcagtctttttgtaaagtatatcagaaaatcatcctggtgccacgcccagattatgcctcgaggtacgttctgtggaagcaaattattgaacgaaatggaggggtgttaacgtctgccttgaacgtaagttgtctcgccaaggtgactgacggtttcacgcagggccacattgtggaggtagtgaagggagtgctgaccgaccagcgtattcgccgacagattcacaagccactcacggcagtagagtttattaccgctattacaagtatgaatccagtttataaagaggaggaggaatcgtttaagaactggtatgccaagacacccttggggaagaagcgcgccttggccatcaccggcggcagcaccgaaaaagccaaggataaggggaagcgtaagtag

SEQ ID NO: 30629 - DNA, 2013 bp, Artificial Sequence
  Description of Artificial Sequence: Synthetic coding sequence
atgtataataaaatgtggcatcagacccaagaggccctgggcgcgttgctcgacaaagagccccagaagatgatcgagccccagcggaaccaagtcttcatcttccaaacgcttgctacattctatgtgaagtacgtacagatattccggaatctcgagaacgtttacgaccaatttgttcaccctcagaagcgcatactgatccgaaaggtcctggatggagtgatgggccggatcctggagctcaagaacgagatggtcgagttagaactgacagagtttcattactttgatgatatcctccaggacctgaaactcgctccccaacagctggacataccgattcctaagtatttcttgaaagaaaagctcgaagttattaaaggaagagaaaaaatcctcgcccagatcctagcagacagcggcatagacacgtcggatatgaagtaccccgtgaagagtatcccgttcgacgaggccgtgaagttgatacagatcgctgaaagagcacgtcagggccgcctgagagccctgttcatgaagcagatttacctacaagagtaccgtgccaagcagtctaagatgctgggcaagaaggtcacggatacatgggcagctgccttgcgaatacaaaaggtttggaggcggttccatcagaggaaagagactgagaagctccgggaggaagaaatgatctttctgggaatgaatcccccccccctgtttaatgaggtgagcgctactgtcatccaggcagagaaggttgataggttaaggaacgaagtgcagattaaacacgaggaggactaccgtgaggccctggtaacgataaagaacgacttgaaacttatcgagggggttgatatcaaggaaaacctgcaggaccaaatcagacactggtttatagaatgccgcaaccttaccgggaccttccccgattatccagatgtggaggaaggtggttcagcgatcatcttctcagataagaccattcagcaggtgatcgaagacattatcgccaaccaggaagaggaggagaagaacaaaaagaagaagaagaagaaagaaaagcagcccaagaaggctaagaaacaaaaaaagggaaccaaggagaagaataaggaagaggatgagaagtggaaaatgtcaccgagtctgttcctgcctgcgatgaaggagggctgcaacgcatacaaagaaatctggatgaaaaaagatgaatcatggaatttttcccaggactacgatccagaacttatcaaagaggagaaaaggaaggaactgcagtcagagattagaatccaagttgatgagttaatgaggcaggaactcaaaaacctgaaattagccgtggaccgagagagagagcggcccgtcaaagcaggcaaaaaaaaggacaaaaagaagggaaaaaaaggaaagaaaaaagagaagaaggcgaaaaaggataaggacctgacggccgaccgaacaatcgaaagcctttacaaggaactggtcgaggagggactgctgattcaggctttgaaggtcaacctgtcagactacattggtgaatactcataccttggcacgacattgcgacaggtgtctatagaaccaatgccctccctgctcgacgtccgtcaactgattacgctgtacggaatctggccactagggagcgccgctgtccacgagaaggcaccactggttaagtcattgcttttggctggaccttccggcgtgggcaagaagatgcttgtgcacgcgatatgcacagaaacgggggctaatctgtttaatctttcatcttcaaacatagctgggaagtaccccggtaaaaacggcttgcagatgatgctgcacgctgtcttcaaagtggccagacagctccagccctccgtggtgtggatcgaagatacggagaagactttttataagaaagtacccaatgccgaaaaaatgtttaccccctccgccggcgaagtcgcagcacttcaaaaaaatcttaaacgaagcacatcaaggtag

SEQ ID NO: 30630 - DNA, 2346 bp, Artificial Sequence
  Description of Artificial Sequence: Synthetic coding sequence
atgagcaacgcaatgtataataagatgtggcatcagacacaggaggcactcggtgccctgctggacaaggagcctcagaagatgattgaacctcagcgtaaccaagtcttcatcttccaaacacttgccacattttatgtcaagtatgttcagatcttccggaatctggaaaacgtgtacgaccagttcgtccaccctcaaaagcggatcttaataagaaaggtgctggacggggtaatgggtcgcatacttgaattaaaaaatgagatggtggaacttgagctcaccgagttccactacttcgacgacatccttcaggatctgaagctggccccccagcagctggacatccctattccaaagtacttcctgaaagagaaactggaagtgatcaaggggcgcgagaagatactcgctcaaatcctggccgatagcgggatagataccagcgatatgaagtaccctgtcaagtcgattccattcgatgaggccgtgaaactgattcagattgcagaaagagcgagacaagggcggctgcgtgccctgttcatgaaacagatttaccttcaggagtatcgcgccaagcagtccaagatgctggggaagaaggttaccgacacttgggctgctgctttgaggattcaaaaagtatggcgcagattccaccagcggaaagagaccgagaaactcagggaggaggaaatgattttcctggggatgaacccgcccccgttattcaacgaagtaagtgccaccgtcatccaagccgagaaagttgataggctacggaacgaagtacagattaagcacgaagaagattatagagaagcactggtgacaatcaaaaatgacctgaagctgatcgaaggggtggatattaaagagaacctgcaagatcagatccgacactggttcatagaatgccgaaatttgacaggaacctttcctgattacccagacgtggaggagggaggaagcgccatcatcttctcggacaagaccattcagcaggaggaggacgagaagtggaaaatgagtcctagtctgttcctgcctgctatgaaggaagggtgcaacgcatacaaggaaatttggatgaaaaaggatgaatcgtggaatttcagtcaggattacgacccggagctgataaaggaggagaaacgaaaggaactccagtcagagatccgaatccaggtcgacgagctgatgcgccaggaacttaagaatctcaagctggcagtagacagggaaagagagagaccagtaaaagctggtaaaaagaaggataaaaaagggaagaagggcaaaaagaaagaaaaaaaggcaaagaaagacaaggaccttacagctgatcgtactatcgaatcgttatacaaggaactcgtagaggagggcttgctcatccaggcactaaaggtgaatctcagtgattatattggagagtactcatatctcggtacgacgctgcggcaggtttccattgagcctatgccttcccttctggatgtccggcaactcattaccctttatggcatatggccgctgggcagcgctgcggtgcacgagaaagcacccctcgtgaaaagcctgctgctcgcagggccctctggtgtgggcaagaaaatgctggttcacgcgatctgtacagagaccggtgccaatctatttaacctctcctcaagtaacatcgctggcaagtatcccggcaagaatggattgcagatgatgttacatgccgtgttcaaggtggcccgccagctgcagcctagtgtcgtgtggatcgaggacacagagaagacattctataaaaaagttccaaatgccgagaagatgaatgagcctaaacgcctcaagaagcatctgccacaaatccttaagctgttaaagcctgacgaccgcattttaatagttggcaccacacggaggccatttgatgccgagctgcaatctttttgtaaggtttaccagaagattatcctagttcctagaccagattatgcttccagatatgttttgtggaagcagataattgagaggaatggtggcgtgctcacttcagcactgaacgtaagttgcctcgccaaagtgacagacggttttacacaaggtcatatcgtcgaagtcgtcaaaggagtacttacagaccagagaattcgccgacagatccataagcccttgaccgcggtcgagttcatcaccgccattacatccatgaaccccgtgtataaggaggaggaagaatcctttaagaattggtatgctaagactccacttggaaagaaacgcgcactggccataactggcgggtcaaccgagaaggcaaaagataaaggaaaacgaaagtag

SEQ ID NO: 30631 - DNA, 2493 bp, Artificial Sequence
  Description of Artificial Sequence: Synthetic coding sequence
atgactccgtccttatcggctgaggaaaaccggatgtacaacaagatgtggcaccaaacacaggaggcattaggcgccctcctagacaaggagccccagaagatgatcgaaccccagcgcaaccaagttttcattttccagaccctggcaaccttttacgtgaaatacgtgcagatcttccgaaacctcgagaatgtctacgaccaatttgtccatccacaaaagaggatcttaattcgcaaggtgttagatggtgtgatgggacgtattttggagctaaagaatgaaatggtagaactcgagctgaccgagttccactacttcgatgacatcctacaagatctcaagctcgcaccacaacagctggacatacctataccgaagtacttcctgaaagagaagctggaggttattaaaggtagggagaaaatcctcgcacagattctcgctgacagcggtatcgatacctctgatatgaagtaccctgtgaaatccattccatttgacgaggccgtaaagctcatccagattgcagagcgcgcccgccaagggaggctgcgggcactgttcatgaagcagatttacctacaggagtacagggcaaagcagtcaaagatgttaggaaagaaagttacagatacatgggccgctgctttacggattcagaaggtgtggcgtcgcttccatcaacgaaaggaaacagagaaactgcgggaggaggaaatgatctttttaggtatgaaccctcctcccctgtttaacgaggtgagcgccactgttattcaggcggaaaaagtggataggttgcgaaacgaggtgcaaatcaaacacgaggaggattatcgtgaggcactcgtgactatcaaaaacgatctgaagcttattgagggagtcgacatcaaagagaatcttcaggaccagatcaggcattggtttatcgagtgcagaaaccttactggaacatttcccgattatccggacgtggaagaaggtggctcagcgataatattttctgataagacaatccagcaggtgattgaagacattatcgcaaaccaggaagaggaggaaaagaacaaaaaaaagaagaagaagaaagaaaagcagcccaaaaaagcaaagaagcagaagaagggaacgaaggaaaagaacaaggaagaggacgaaaaatggaagatgagtccgtccctgtttctccctgccatgaaagaaggttgcaacgcctacaaagaaatctggatgaaaaaagatgagagctggaatttctcccaggattacgatccggaactgattaaggaagaaaagaggaaggaactgcagagcgaaatccggatccaggtcgacgaactcatgaggcaggagctgaagaacttaaagcttgccgtcgacagagagagggaacggccggtaaaagctggaaagaagaaagacaaaaaaaaaggcaagaagggtaaaaaaaaggagaaaaaggcaaaaaaggacaaagacctgaccgctgatcggacaatcgaaagtctgtataaggaactggtggaggagggactgcttatccaagctctgaaggtcaacctcagcgactacatcggggaatactcgtacttggggactacattgagacaggtctccatcgaaccaatgccgtcattgttggatgtgagacagctgatcacactgtatggcatatggcccttgggtagcgccgcagtccacgagaaggcccctctggtgaagagcctgctactggccggcccttctggggtcggcaagaaaatgctcgtgcacgccatctgtacggaaacaggagccaacctcttcaatctgagtagcagcaatatagcaggtaaatatccaggcaaaaacggtctgcaaatgatgcttcatgccgtgttcaaggtggccagacagttgcagccaagcgtggtgtggatcgaggacaccgaaaagaccttttacaagaaggtccctaacgcagagaagatgaacgagcccaagcgtctcaaaaagcatctgccccaaattctcaagctcctgaagccagacgatagaatactcatcgtcgggaccacgagaaggccctttgacgccgaactacagtcattttgtaaagtctatcagaagatcatactagttccaaggcccgattatgcctcgcgctatgtgctctggaaacagatcatcgagcggaacggtggagtgttgacctctgcgctgaatgtgagctgtttagccaaggtgaccgacggattcacccaggggcatattgtagaagtggtcaaaggagtgttgaccgaccagagaattagaaggcagatacataagcccctgactgcagtagagttcattacagcgattacctccatgaaccccgtatataaggaagaggaagagagctttaaaaattggtatgccaaaactccgctgggtaaaaagagagcgctggcgatcacaggagggtctacggagaaagcaaaagataaagggaaacgaaagtag

SEQ ID NO: 30632 - DNA, 1449 bp, Artificial Sequence
  Description of Artificial Sequence: Synthetic coding sequence
atggactcattcggccagccacggcctgaggacaatcagtctgtggtcaggcggatgcagaaaaaatactggaagacgaaacaggtgtttattaaagccacgggcaagaaagaggacgaacacctggtggcctctgatgcggaactagatgccaagctagaagtgttccatagcgtgcaggagacttgcacagagctgctcaaaataatcgagaagtaccagctccgcctgaacgtgatatcagaggaggaaaacgagctgggtttgtttttaaagtttcaggccgaacgcgatgcaacacaggcaggcaaaatgatggacgcaactggcaaagccctctgcagctccgcaaaacagagactcgccctgtgcacacctctctctagactaaagcaagaggtcgccaccttctctcagcgagccgtgtctgacaccctcatgacaatcaacaggatggagcaggcccgcactgagtatcggggggcgctactgtggatgaaagatgtgtcccaggagttagatccagacaccttaaagcagatggagaaattcaggaaagtgcagatgcaggtgagaaatagtaaggcatcctttgacaaactgaaaatggacgtgtgccagaaagtagatctcttgggagcatcccgctgcaacatgctgagccactccctcacaacatatcagagaacactcctcggattttggaagaaaacggcacggatgatgagccagattcatgaggcgtgcatcgggttccacccatacgatttcgttgcgctgaaacaactccaggacacacctagcaaaatcagcgaggacaataaggatgaacagatcggaggtttcttgaccgagcagctgaataaactcgtgctgtccgacgaggaagccagttttgaaagtgaacaggctaacaaggatcacaatgaaaaacattcccaaatgagggagttcggagccccccagtttagcaatagcgagaatgtcgcaaaagacctgcctgtggacagccttgagggtgaagattttgagaaggaatttagcttcctgaataacctgctgagttctggaagctcctctacgtccgagttcacccaagagtgtcagaccgcttttggttctccctccgccagccttacttctcaggaaccaagtatgggctcagaacctctcgcgcattcttctaggtttctaccgagtcaattgtttgatttaggctttcatgtggcgggcgcttttaacaattgggtgagtcaggaggagtccgagttgtgtctgagtcatacggataatcaaccagtgccgtcccaatccccaaaaaagctgacacggtctccaaacaacggcaaccaggacatgagcgcttggttcaacctgttcgccgacttagaccctcttagcaatccggatgccatcgggcacagcgatgacgaactgctcaatgcgtag

SEQ ID NO: 30633 - DNA, 1449 bp, Artificial Sequence
  Description of Artificial Sequence: Synthetic coding sequence
atggatagttttggacagccgcgacccgaagataaccaatccgtggtccgcagaatgcaaaagaaatattggaagacaaagcaagtatttattaaggctaccggaaaaaaagaggatgagcatctggtggccagcgatgcggagctagacgccaagcttgaggtgttccactcagtgcaagagacctgcacagagctcctgaaaatcatcgagaaatatcagctacggctaaacgtcatcagtgaagaagaaaacgagctcggactgttcttgaaattccaagctgaacgtgatgctacgcaggcgggtaagatgatggacgctaccggtaaagctctttgctcatctgccaaacagcggctggccctttgtaccccattaagtcggctgaaacaggaggtggctaccttctcacagagggccgtgtcggacaccctgatgaccataaatcggatggagcaagcgaggacagagtaccgtggagcgctcctgtggatgaaggatgtttcccaggaacttgaccccgataccctcaagcagatggagaagtttagaaaggttcagatgcaagtaaggaacagtaaggcttctttcgataaattgaaaatggatgtttgccagaaagttgatctgctgggggcaagccgctgtaacatgctgtctcactcactcaccacctaccagcgaactcttttagggttttggaaaaaaaccgctaggatgatgtcccagatacacgaggcttgtatcggctttcatccttacgatttcgtagccctcaagcaattgcaggacacaccttccaaaatcagcgaagataataaggatgagcagattggtgggttcttaactgagcagcttaataagcttgtgctcagcgatgaggaggcatctttcgagtctgaacaggctaacaaagaccacaatgagaaacactctcagatgcgcgaattcggtgctccgcagttcagtaactctgaaaatgtggccaaagatcttccagttgatagccttgagggggaggacttcgaaaaggaattctcctttctgaacaacctactgagttcaggctcatctagtacgagtgagttcacacaggagtgtcaaaccgcctttggctctccatcagccagcctcacctcacaagagccctccatgggaagtgagcctctggcacattcaagtagattcctgccatcacagctgtttgacttgggatttcacgtagccggagcgttcaacaattgggtctctcaagaagagtcagagctttgtctgagccacacagacaatcagcctgttcctagccagtcccctaaaaaactgacccgctccccaaataacggcaaccaggatatgagcgcatggttcaacctcttcgccgatctcgatcctctgtctaatccagacgcgatcggacacagcgacgacgaattactgaacgcatag

SEQ ID NO: 30634 - DNA, 237 bp, Artificial Sequence
  Description of Artificial Sequence: Synthetic coding sequence
atggactcatttggccaaccacgccctgaggacaaccaatccgtcgtccgacgaatgcaaaagaaatactggaagacaaaacaggtctttattaaggctacaggaaaaaaagaagacgaacaccttgttgcctccgatgccgagctggacgccaagttggaggtattccacagtgtgcaagaaacctgcactgaacttctgaagattattgaaaaatatcagttgcgtctgaattag

SEQ ID NO: 30635 - DNA, 360 bp, Artificial Sequence
  Description of Artificial Sequence: Synthetic coding sequence
atggacagcttcggccaaccaaggcccgaggacaatcagtccgttgtgagacggatgcagaaaaaatattggaaaaccaaacaggtctttatcaaagccactggaaagaaagaggacgagcatctcgttgcctccgacgctgagcttgacgctaaattagaggtgttccattcagtacaggagacttgtaccgagttgctgaagattatagagaagtaccagctgagattgaacgttatctcagaggaggagaatgagctggggttattcctgaaatttcaggccgaaagggatgctacacaggccggaaagatgatggacgctaccgggaaggcactgtgttcctccgcaaagcagtag

SEQ ID NO: 30636 - DNA, 297 bp, Artificial Sequence
  Description of Artificial Sequence: Synthetic coding sequence
atggatagttttggccagccccggcccgaggataatcagagtgttgtgcgccggatgcaaaagaaatactggaagaccaaacaggtctttatcaaagctaccggcaaaaaagaagatgagcacttggtggctagcgatgcagaacttgacgctaaactggaagtcttccactcggtccaagaaacttgtactgagctacttaagattatcgaaaagtaccaactgaggttgaacgtgatttctgaggaagaaaacgagcttggcctcttcctcaagtttcaggcagaacgggactag

SEQ ID NO: 30637 - DNA, 375 bp, Artificial Sequence
  Description of Artificial Sequence: Synthetic coding sequence
atggattcctttggacagcctcggccagaggataaccaatcagtggttcgaagaatgcagaaaaaatactggaagacgaaacaggtgttcatcaaggcaactgggaagaaggaagacgagcacctggtggccagtgatgccgagctcgatgcaaaacttgaagtctttcacagcgtacaggaaacctgtacagaactgctgaagattatcgagaagtatcagctgaggctgaatgtcataagtgaagaagaaaacgaattgggcctttttctcaagtttcaggcagaacgggatgctacgcaggcaggcaagatgatggacgcaaccggtaaagccctgtgttcatcagctaaacagcgcctggctttatgctag

SEQ ID NO: 30638 - DNA, 129 bp, Artificial Sequence
  Description of Artificial Sequence: Synthetic coding sequence
atggattccttcggccaacctagacccgaagataatcagtctgtggtgaggagaatgcagaaaaagtattggaaaactaagcaggtttttatcaaggccaccggcaagaaagaggacgagcacctgtag

SEQ ID NO: 30639 - DNA, 300 bp, Artificial Sequence
  Description of Artificial Sequence: Synthetic coding sequence
atggattcctttggccagcctcgccctgaagacaatcagtctgtggtacgccgcatgcagaaaaaatactggaagaccaagcaggtcttcataaaagcaacgggaaagaaagaggacgagcatctcgtggcatccgatgccgagttggacgccaaactggaggtctttcattctgtacaggaaacgtgcactgaactgttgaagataattgaaaaatatcagcttcggctcaacgttatatcggaagaggaaaacgagctggggctgtttctcaaatttcaggcagagcgcgatgcatag

SEQ ID NO: 30640 - DNA, 405 bp, Artificial Sequence
  Description of Artificial Sequence: Synthetic coding sequence
atggacagcttcgggcaaccacggcctgaggacaaccaaagcgtagttagaagaatgcagaagaaatactggaaaacaaagcaggtgtttatcaaagcaactggcaagaaagaagacgagcacctcgtcgcttcagatgctgagctcgacgcaaaactggaagtgttccacagcgttcaagagacttgtaccgagctgttaaagatcattgaaaagtatcagctgcgactgaatgtgattagcgaagaggagaatgaactcggcctctttctcaagtttcaagccgagagagacgccactcaagccggaaaaatgatggatgccaccgggaaggctctgtgctctagtgctaagcaaagactcgccctgtgtacacccttgtcaaggttgaaacaggaggtctag

SEQ ID NO: 30641 - DNA, 360 bp, Artificial Sequence
  Description of Artificial Sequence: Synthetic coding sequence
atggatagctttgggcaaccccgccctgaagataatcagtcagttgtgcggaggatgcagaagaagtactggaaaacaaaacaagttttcatcaaagctacaggcaaaaaggaagatgaacatctggttgcttcagatgctgagttggacgcaaagcttgaagttttccacagtgtgcaggagacttgcacagagctcctgaagatcatcgaaaagtaccagttaaggctcaacgtcatttcagaggaagaaaacgagctaggactgttcctgaaattccaagccgaaagggatgcgacccaggcggggaagatgatggacgcaactggcaaggcactatgtagctccgcgaagcagtag

SEQ ID NO: 30642 - DNA, 456 bp, Artificial Sequence
  Description of Artificial Sequence: Synthetic coding sequence
atggacagcttcgggcaaccgcgtccagaggacaaccagtccgtcgtcagaaggatgcaaaagaaatactggaagaccaaacaagtgtttatcaaagccactggcaagaaggaagatgagcatttggttgccagcgatgccgagttggatgcaaagctggaagtatttcatagcgtgcaggaaacctgtacagagttgctcaagatcattgagaaataccagctgagactgaacgtcatttcggaagaggaaaacgaactggggttgtttctgaagttccaggccgaaagggatgcaacccaagccggcaaaatgatggacgccaccggtaaggccctatgtagctccgcaaagcagcggctggctctctgtactcctctctcaaggctcaaacaggaagtcgcaacattctcacaacgagctgtatcggacactctaatgactatcaatcggtag

SEQ ID NO: 30643 - DNA, 294 bp, Artificial Sequence
  Description of Artificial Sequence: Synthetic coding sequence
atggattccttcgggcagcctaggcccgaggacaatcagtccgtagtgagacgtatgcagaagaaatattggaaaaccaaacaagtgttcattaaggctacgggcaagaaggaggacgagcacctcgttgcctcggacgccgagctcgacgctaaactcgaagtgtttcactctgtgcaggagacgtgtaccgaattgttgaagattatcgaaaaatatcagcttcggctgaatgtgatcagtgaggaggagaacgagttgggattatttttgaaatttcaggccgaaagatag

SEQ ID NO: 30644 - DNA, 303 bp, Artificial Sequence
  Description of Artificial Sequence: Synthetic coding sequence
atggactctttcggccaacctaggcctgaagacaatcaaagcgtggtccgtagaatgcagaagaagtattggaaaacaaagcaggtgttcattaaggctaccgggaagaaggaagatgaacatctggtggcctcagacgctgagttggacgctaagctcgaagtttttcattctgtgcaagaaacatgtaccgaactgctgaaaattatagagaagtaccagctgagactgaacgtgataagtgaggaggaaaatgaactgggtctctttcttaagttccaggccgagagagacgctacatag

SEQ ID NO: 30645 - DNA, 408 bp, Artificial Sequence
  Description of Artificial Sequence: Synthetic coding sequence
atggtacagtacttaaaaagtgtagacatccctgaaaacagagtcatactcatcacaccaacccctctgtgtgagaccgcgtgggaggagcagtgtataattcagggttgcaaactaaatagactcaatagtgtagtcggtgagtatgcaaacgcctgcttacaggtggctcaagactgcggaactgatgtacttgatctgtggactttgatgcaggattctcaggacttctcctcttacttaagtgacgggctgcatttgagccccaagggtaacgaattccttttcagccacttatggcccctgatcgaaaagaaagtgtccagtcttccactgcttctcccttattggcgcgacgtagcagaagcaaagcctgaactttcactgttgggggatggggatcactag

SEQ ID NO: 30646 - DNA, 747 bp, Artificial Sequence
  Description of Artificial Sequence: Synthetic coding sequence
atggccttgtgcgaggcagcagggtgcggtagtgccctcctgtggcccagactgctgttgttcggggactctattactcagttctccttccaacagggagggtggggtgctagtttggctgacaggctggtgagaaaatgtgatgttctcaacagaggattttccggttacaatacacgctgggcaaagatcatcctcccacggctgatccgaaaaggcaattctctggatatacccgttgcggttaccatcttctttggtgccaatgattcggccctcaaggatgaaaatcctaaacagcatatccccctcgaggagtatgcagcaaacttaaaatccatggttcaatacctgaagagcgtggacattccagaaaatagagtgattctcatcacaccaacccctctctgtgagaccgcctgggaggaacagtgcattattcagggctgtaagctaaatagactcaacagcgtagtgggggagtatgccaacgcctgcctgcaggtagctcaagactgtggcacagacgtcttggacctttggacgctgatgcaggattctcaggatttctcctcctacctaagtgatggactgcatctgtccccgaaaggaaacgaattcttatttagtcacctttggcccctgatcgaaaagaaggttagcagtttgccgttgctcctcccttactggcgcgacgtggccgaagctaagcctgagttgtccctcctcggcgacggggaccattag

SEQ ID NO: 30647 - DNA, 408 bp, Artificial Sequence
  Description of Artificial Sequence: Synthetic coding sequence
atggtgcagtacctaaagtccgtggatataccagaaaatcgggtaatcctcattacaccgacccccttgtgcgagacggcttgggaggagcagtgcatcatccagggttgcaagctgaacagactcaactctgttgtgggagagtatgccaatgcctgcctacaggttgctcaggattgtgggaccgatgtgcttgacctttggaccctaatgcaggactcgcaggattttagttcatacctctctgatggcctgcatttgagtccaaaaggcaatgagttcctgttctctcacctgtggccactaatcgaaaaaaaagtcagctccctcccactcttactgccatactggcgagacgtggctgaggcgaaacccgagttatctctgttgggcgacggagaccactag

SEQ ID NO: 30648 - DNA, 1356 bp, Artificial Sequence
  Description of Artificial Sequence: Synthetic coding sequence
atggaagccggccctccagggtcagcccgccccgccgagcctggcccgtgtctctcaggacagcgcggcgctgaccataccgcaagcgcatcactgcagtctgttgccggtactgaacccggccggcatccacaggcagtggcggccgttctccccgcaggtgggtgcggagagcggatgggtgtccctacaccaaaacagttttgtcccatattggaaaggcctctgatctcgtatactctgcaggccctcgaaagagtttgctggatcaaggatattgtcgtggctgtgacaggtgagaatatggaagttatgaagtccatcatccaaaagtaccagcacaagaggatatccctcgtggaggctggcgtcaccagacatcggtccattttcaacggtcttaaggccctcgccgaagatcagatcaattctaagctgtctaagcctgaggtggtaattattcacgatgccgtgagaccttttgttgaggaaggcgtgctcctcaaggtggtgacagcagctaaagaacacggcgcggcaggtgccatcagaccgctggtcagtactgtagtctctccttcagcggacgggtgcctggactattccctggagcgggccaggcacagagcctctgagatgccacaggcctttctgttcgacgtgatttatgaggcttaccagcagtgtagcgactacgaccttgagtttggtacagaatgcttgcagcttgccttaaaatactgctgcacaaaggccaaactggtggagggttcacccgacctgtggaaggtgacatacaaacgcgacttgtatgcggctgagtcaatcattaaagagagaattagtcaggaaatctgcgtggtaatggatactgaagaggacaacaaacatgttggtcatctgctcgaagaagtgctgaaaagtgagttgaaccatgtgaaggtcacttccgaagcattagggcatgccggcaggcacttgcagcagatcatcctggaccagtgctataatttcgtgtgcgtaaatgtgaccacctccgattttcaagaaacgcaaaagctcttgtcaatgctggaggagtcctctttatgtatcttgtaccccgtagtggtggtgtcggtgcatttcctggacttcaaactcgtacccccctcccaaaagatggagaatctgatgcagatacgggaatttgccaaagaagtgaaggaacgaaacattctgctctacggacttctcatcagctacccgcaggacgaccagaaacttcaggaatctctcaggcaaggtgcaataatcattgccagcctcatcaaggaaaggaacagcgggttgattggccagctcttaatagcatag

SEQ ID NO: 30649 - DNA, 996 bp, Artificial Sequence
  Description of Artificial Sequence: Synthetic coding sequence
atggcacggaacgccgaaaaggcaatgaccgcactggccagattccgacaggcccagctggaggagggaaaagtcaaggagaggcggccgtttttagcttccgagtgtactgaactgcctaaagccgagaaatggcgtcgccaaatcattggtgagatttctaagaaggtggctcagatccagaatgctggattgggcgaatttaggattcgggatttgaacgatgagatcaacaagctactgagagagaagggccactgggaggtccggatcaaggagcttggcgggccagattatgggaaggtgggtcccaagatgctggaccatgaaggcaaggaggtgcctgggaaccgcgggtacaaatatttcggcgctgccaaggatctcccaggagtgcgagagttatttgaaaaggagcctctgccgccccccaggaaaacccgagccgaactgatgaaggccatcgactttgagtactacggttaccttgacgaagatgacggggtgatcgttccccttgaacaagaatatgaaaagaaattacgggctgaattagtggagaagtggaaggccgagagggaggctagacttgctaggggcgaaaaggaagaagaggaggaggaagaggaggagattaatatatatgccgtgacggaggaggagagcgatgaggaaggctcacaggaaaaagggggtgacgactcccagcagaagtttattgctcacgtaccggtcccaagccagcaggagattgaggaagcattggtgagacggaagaaaatggaattgcttcagaaatatgccagcgagaccttgcaggctcaatccgaagaagcgaggagacttctcggatgccgctccgggactagacccgctcgaagcggcagcgcaccttcacctagggctacaacggccgtgcctatgggccctagtctgcccactacatccccaaggggcgctccctcgtgccgatgtctaacaggactcaggatgtag

SEQ ID NO: 30650 - DNA, 1671 bp, Artificial Sequence
  Description of Artificial Sequence: Synthetic coding sequence
atggctagcaaacctgctgccgggaagtctaggggcgaaaagcgcaagagggttgtgttgactctcaaagagaagatcgacatttgtacgcggcttgagaagggagagtctaggaaagccttgatgcaggagtacaacgttggtatgtcgaccctctatgacattcgagctcacaaggcccagctccttcgtttcttcgcctcctccgatagcaacaaagccttggaacaaaggcgcactctccacacgccaaagctggagcacttggaccgagtcttgtacgagtggttcttgggaaagcgcagcgagggcgttcccgtgtccggtccaatgttgattgaaaaagccaaagacttttacgaacaaatgcagctgacggagccctgtgtgttctccggaggttggctctggagattcaaggctcggcacggcattaagaaactggatgccagctcagaaaagcaatcagctgaccatcaagctgcggagcagttttgtgccttctttcggagcctagcagcagagcatgggctgtctgctgagcaggtttacaatgctgacgagacaggcctgttttggcggtgccttcctaatcctactccagagggcggagcagtgccaggtcccaagcaaggcaaggacaggttgacagtactgatgtgcgctaacgccacaggttctcacagactgaagcctctggcaattggcaaatgctctggaccacgagcttttaaggggatccagcatctgccagttgcgtataaggcccagggaaatgcgtgggtggataaagagatattcagcgattggttccatcatatttttgttccatcagtgagagaacacttccgcaccataggattgcccgaggattccaaagccgtcctattactggattcctcccgggctcacccacaggaagccgagctggttagtagcaatgtgttcaccatctttcttccggcatcagtcgccagtcttgtccaaccgatggaacagggcatacggagagatttcatgcggaacttcattaatccgccggttccactgcagggccctcacgcacgttacaacatgaatgacgcaatctttagtgtggcctgcgcctggaacgcagtgccttctcacgtatttaggcgtgcctggcgtaagctctggccgagtgtggcattcgcagaaggatcctctagcgaagaggagttggaggcagagtgttttcccgttaagcctcacaacaaaagcttcgcccacattctcgagctggtcaaagagggcagttcttgcccaggacaactgagacaaagacaggcagcctcatggggtgtggctggcagggaggccgagggcggcaggccacccgctgctactagtccagccgaggtcgtgtggtcctctgaaaaaaccccaaaagcggatcaagacggacgtggcgatccaggcgaaggtgaagaagtggcctgggaacaggccgctgttgcttttgacgccgtactgcggtttgctgaaaggcaaccgtgtttttccgctcaggaagtggggcaactgcgggccctgagggcggtgtttcgctctcagcaacaggaaactgtggggttggaggatgtggtcgtaacctccccagaagagctcgccatccctaaatgttgtctcgaggcctcaacggaaacctag

SEQ ID NO: 30651 - DNA, 1707 bp, Artificial Sequence
  Description of Artificial Sequence: Synthetic coding sequence
atggccagtaagccagccgccggcaaaagtaggggggaaaagcggaaaagagtcgtccttactcttaaggaaaaaattgacatatgtactaggctggaaaagggggaatcgcggaaagcactcatgcaggaatacaacgtggggatgagcactctatacgacatccgcgcccacaaggctcagctactgaggttctttgcatcctcggatagtaacaaggcactcgaacaaagacgcaccttgcacacccccaaactagagcatctagatagagtgctgtacgagtggttcttgggcaaaagaagcgagggcgtgcctgtgagtgggcccatgcttatcgagaaagccaaggatttttacgaacagatgcagttaactgagccttgcgtgttttccggaggatggctatggcgcttcaaggccaggcatgggattaagaagctcgacgcttcatccgagaaacagtccgctgatcatcaggctgccgaacagttttgcgccttcttcagatccttagccgccgagcatggcctgagcgcagagcaggtctacaatgccgatgagacaggtctcttctggaggtgtctcccaaaccctacgccggaaggaggtgcagttcctgggcccaagcagggaaaggatcggctgactgtccttatgtgtgccaatgcaacgggcagccacaggctgaaacccctggccattgggaaatgcagcggcccaagggcgttcaaaggaattcagcatctccccgtagcatataaggcacaggggaatgcatgggtggataaagagatcttttctgactggtttcaccacatctttgttccatctgtgcgagagcactttcggactatcggtcttcccgaggatagcaaagctgttctcctacttgattcatccagggctcacccccaggaggctgaactcgtgtcgagtaatgtgtttaccatttttcttcccgcgtcggtggcatcattggttcagcctatggaacaggggatacgacgcgattttatgagaaatttcattaaccctccagttccactccaggggccccacgcaagatataacatgaacgatgcgatttttagtgtagcatgtgcgtggaatgcagtgccatcacacgtattccgcagagcatggcggaaattgtggcctagcgtcgcctttgccgaggggtcatcctctgaggaagaacttgaggcggagtgttttccagttaagccccataacaaatcgttcgctcacattctggaacttgtgaaggagggctcgtcctgtcctggtcagctccgacagcgccaagcagcctcctggggagtggcgggccgcgaggccgaaggggggcgacctcctgctgcaacaagtcccgcagaagtcgtgtggagcagtgagaaaacaccgaaggctgatcaggatggtagaggcgaccccggcgaaggcgaggaggtcgcctgggaacaggccgccgtcgcgttcgacgctgttcttcgctttgccgaaagacagccctgtttctccgctcaggaggtgggccagttaagggccctccgcgctgtgttcaggtctcaacagcaggtcaggcggcgtcgcggtgctctgggtgctgttgtcaaagtcgaggcactacaggagggccctggtggatgtggcgccaccgctcagtcgcctctaccttgtagcagcaccgccggggataactag

SEQ ID NO: 30652 - DNA, 960 bp, Artificial Sequence
  Description of Artificial Sequence: Synthetic coding sequence
atgaagggagagatccagcagtctttgggagcttgggtgctgctgacatgccttggtctgtactgcgggaagacgcttttgttcaaaaacggctcgactgagatctacggcgagtgtggagtgtgcccaagaggccagcgaaccaatgctcagaagtactgccagccatgtaccgaaagtccagaactctatgactggctctatctcggatttatggcgatgctgccacttgttctgcattggttctttatcgaatggtatagcggaaaaaagagcagctctgctctgttccagcacatcactgctttatttgaatgctcaatggcggccatcattaccctgctcgtgtcggatccagtcggcgtcctatacatacggagctgccgtgtgttgatgttgtctgactggtatacaatgctctataatccctcacctgattatgtgaccacagtccattgtacccacgaagcagtctaccctctgtatacaatcgttttcatatactatgccttttgtctcgtgctaatgatgctcttgcgacccctgctggtgaagaagatagcatgtggtctcgggaaatccgaccggttcaaatctatctatgccgctctgtatttcttccctatcctgaccgtgcttcaggctgtgggcggcgggcttctctattacgctttcccctatattattttagtgctctcacttgttacccttgctgtctacatgtccgctagcgaaattgagaattgctacgacctcctcgttaggaagaaacgcttgatagttctgtttagtcactggttgctgcatgcttatgggatcatttcaatctcacgcgtggataagctggaacaggatctgcccttgttggcccttgtcccgaccccagcactcttctaccttttcaccgctaagtttacagagccttcaaggatccttagcgaaggggccaacgggcactag

SEQ ID NO: 30653 - DNA, 936 bp, Artificial Sequence
  Description of Artificial Sequence: Synthetic coding sequence
atggctgtggacatacagccagcgtgcctgggcctttactgcgggaagactctgctgttcaagaacggtagcactgagatttacggtgaatgtggagtgtgcccaagggggcagagaacaaacgctcaaaagtattgtcaaccttgcacagaaagtcctgagctgtacgactggctatatctaggtttcatggctatgcttcctctggtgctacactggttctttatcgagtggtactccggaaagaagtcttcttcagctttgttccagcatatcactgccttatttgagtgttcaatggcagccattataacactgctcgtgtcagaccctgtgggtgttctgtatatccgctcgtgccgagtgttgatgttatccgattggtatacaatgctgtacaacccgagccccgattacgtgactacagtacattgcacacatgaagcggtgtaccccctgtacaccatcgtcttcatttactatgcattctgccttgtgctcatgatgctgttacggccgctgctcgtcaagaagattgcgtgtgggctgggtaagtcagacaggtttaaaagtatctatgcagctctgtacttctttccaatcctgacagttctccaagcagtgggtggtggcctcctatactatgcctttccatacatcatccttgttcttagtctagtcaccctggccgtctatatgtctgcttcggaaatcgagaattgctacgatttactcgttaggaagaagaggttgatcgtgttgttttcccactggcttcttcatgcctacggaataatcagcatcagcagggtggacaagctggaacaggatctgcccctcttggctctggtccctacacccgctcttttctatttgtttactgctaagttcacagagccttcccgcatcctgagcgagggcgctaacggacactag

SEQ ID NO: 30654 - DNA, 918 bp, Artificial Sequence
  Description of Artificial Sequence: Synthetic coding sequence
atggcctgcctgggactgtattgtggcaagaccctgctgttcaaaaatgggagtactgaaatttatggcgaatgtggggtgtgcccaagaggtcagcgaacgaatgcccaaaaatattgtcagccatgcactgagagtcccgagctgtacgattggctgtatctggggttcatggccatgctgccgcttgtcctgcactggttttttatagaatggtatagcggtaaaaagagcagtagcgccctttttcagcacatcaccgctctgttcgaatgtagcatggccgcaataataacactgctggtgtcagaccccgtgggcgtgctgtatatcagaagctgccgggtattaatgctgtccgattggtatacaatgctttataatcccagcccggactacgtaacgaccgtgcactgtacgcacgaagctgtgtatccactgtacaccattgtttttatctattatgccttttgcctggtgcttatgatgctcctgagaccattgctggtgaagaaaattgcttgcgggctgggcaagagtgacaggtttaaatccatttacgcggcactttacttcttcccgattctcaccgtgctccaggccgtgggtggaggactgctgtattatgcattcccatatattattctggtgctgagcctggtgacactggccgtgtatatgtctgccagtgagattgaaaattgctacgatttgctagtgagaaagaagagactaattgtgctgttttcccactggctgctgcacgcctatggaatcatctcgatctcaagggttgacaagcttgagcaagatctccccctgcttgcccttgtgccgactccagcgttgttctacctgttcactgcgaagtttacagaacccagccggatactctcggagggtgcaaacggccattag

SEQ ID NO: 30655 - DNA, 1518 bp, Artificial Sequence
  Description of Artificial Sequence: Synthetic coding sequence
atgagccgcagctacaacgatgagttgcagtttctcgagaaaattaacaagaattgttggagaattaagaaggggtttgtgcccaatatgcaggttgagggcgtcttctatgtgaacgatgcgctggaaaagctcatgttcgaagagctgagaaatgcttgtcgaggagggggcgtggggggctttctgcctgccatgaaacagattgggaatgtggctgctctccccggtattgtgcacagatctataggattgcccgacgtgcacagcgggtacgggttcgccattgggaatatggctgcgttcgatatgaatgatccggaggctgtggtgtcgcctgggggagtgggctttgatatcaactgtggagtgcgtctgcttagaaccaacttggacgaaagtgacgttcagccagtgaaggaacagctggctcaggctatgtttgatcatatacctgtgggcgtgggtagtaaaggcgtgatccccatgaacgccaaagacctcgaggaagcactggaaatgggggtcgattggtcgttgagagagggttatgcctgggccgaagataaagaacactgtgaggaatacggacgaatgctccaagctgaccccaataaggtaagcgctagggctaagaaaaggggtctgccacagctgggaacgttaggcgccggaaaccactacgctgagatccaggtagttgacgagatcttcaacgagtatgcggctaagaagatggggattgatcataagggtcaggtgtgcgttatgatccatagtggttcgcgaggcctgggccatcaagtggccactgacgccctggtggcaatggaaaaagctatgaagcgtgataagattatagtgaatgaccggcaactggcatgcgcacgaatcgcatcacccgagggccaagattacctgaaggggatggccgcagctggtaactacgcatgggtcaaccgatcatctatgacgttcctgacccgccaagcctttgcaaaagtgttcaatacaacacctgacgatctcgacctgcacgtcatatacgatgtttcgcataatatcgcaaaggtggagcagcacgttgtggatggaaaggagcgaaccctactggtgcacagaaagggatctactcgggcatttcctccgcatcaccctcttatcgctgtggattaccaacttaccggacaacccgtgctcattgggggcacaatgggcacctgtagctatgtgctgacaggcaccgaacagggaatgactgagacgttcggcactacttgccacggtgccggaagagccctcagccgggccaagagccgacgcaatttagatttccaagacgttctagataagctggctgacatggggatagccatccgggtggcctccccaaagctcgtgatggaggaagctccagaatcctataaaaacgtcaccgatgtagtcaatacatgccacgatgccggaatttctaaaaaggctatcaaactgcgtcctatagctgtcatcaagggatag

SEQ ID NO: 30656 - DNA, 315 bp, Artificial Sequence
  Description of Artificial Sequence: Synthetic coding sequence
atgtcatgcgtgccttggaagggcgataaggccaaatctgaatccctggaacttcctcaggcagcgcccccgcagatttatcatgaaaaacagaggagggagctatgcgccctgcacgcactcaataatgtctttcaagatagcaatgcctttacccgcgatacactacaagagatctttcagcgtctgtcacctaatacaatggtgacgcctcacaaaaaatctatgttggggaacggcaactatgatgtcaacgttatcatggccgctttacagaccaaaggctatgaagcagtatggtgggataaaaggtag

SEQ ID NO: 30657 - DNA, 189 bp, Artificial Sequence
  Description of Artificial Sequence: Synthetic coding sequence
atgtcatgcgtcccatggaagggcgataaggccaaatccgagagcctggagttgccgcaggccgcacccccacagatttaccacgaaaagcagcggagagaattgtgtgccctgcacgcccttaacaacgtatttcaggacagcaatgccttcaccagagacactttgcaggaaatcttccagaggtag

SEQ ID NO: 30658 - DNA, 186 bp, Artificial Sequence
  Description of Artificial Sequence: Synthetic coding sequence
atgagctgtgttccttggaagggcgataaggcaaaatcagaatcacttgagttgccacaggctgctcctccccagatctaccacgagaaacagagaagagaactgtgcgcccttcacgctctgaacaatgtgttccaggactccaacgcttttaccagggacacactgcaggaaatatttcagtag

SEQ ID NO: 30659 - DNA, 627 bp, Artificial Sequence
  Description of Artificial Sequence: Synthetic coding sequence
ggcgacgcagagacaccaggcagcgtcgagcgaaggggccggcggggtgccgaggatggcatgagccaagctcctggagcccaaccaagtccccctaccgtgtaccacgaacgtcagcgcctagagctctgtgcagtccacgctctgaacaatgtccttcagcagcagctcttctcccaggaggctgccgacgagatctgcaagagattggccccagattcaagactgaatccccatcggagcttgctagggaccggcaactatgatgtcaatgtcatcatggctgccctgcaggggctggggctggcagccgtttggtgggaccgacgccgtcccctatcacaactggctcttccccaggttttagggctaatccttaaccttccatctcctgtgagtctggggctcttaagccttcccctacgccgccggcattgggtcgccttgaggcaggtcgatggtgtatactataatcttgatagcaagctgcgtgccccggaggccttaggcgacgaagatggggtccgagccttcctcgcagctgccctggcacaggggctgtgcgaggtactcttagtcgtaacaaaagaggtggaggagaagggtagctggctcagaactgactag

SEQ ID NO: 30660 - DNA, 567 bp, Artificial Sequence
  Description of Artificial Sequence: Synthetic coding sequence
atgagccaggctcccggagcacaaccctccccacctacagtatatcacgaacggcagaggctggaactgtgcgccgtgcatgccctgaacaatgtgctgcagcagcaacttttttctcaggaagccgctgatgaaatatgcaagcggctggcgcctgattctcgcttgaatccacaccgttccctgttaggaaccgggaattatgacgtgaatgtgatcatggcagccttgcagggtctgggcctcgctgcggtgtggtgggaccggcgccgccctttgtcacagttagctctgcctcaggtgctgggacttatactgaacctaccctcaccagtgtctcttggtctgctcagcttgccactgagaagaaggcactgggtggctctcagacaggtcgacggggtatactacaacctcgactccaaattacgagcgcctgaggccctcggagacgaggacggggtgcgagcctttttggctgcagccctggcccaggggctttgtgaagtgctgttagtggtaacgaaagaggtggaagaaaagggctcatggctgaggaccgactag

SEQ ID NO: 30661 - DNA, 441 bp, Artificial Sequence
  Description of Artificial Sequence: Synthetic coding sequence
atgagtcaggcccctggagcacagccgtctcctccaaccgtgtatcacgagcggcagagactggagctgtgcgccgtccatgctctgaataatgtgctgcagcagcagcttttctcccaagaggccgctgacgaaatttgcaagcgccctctgtcccagctcgccctccctcaagttctgggcctgattctcaacttaccttctccggtaagccttggcctccttagtctccctctgcggcggcgtcactgggtggccctgcgccaggtggacggtgtttactacaacctggattcgaaactcagggcacctgaagctctcggggacgaggatggggttagggcctttctggctgctgctctcgcccagggactgtgtgaagtgcttcttgtcgtgaccaaagaggtggaagagaaagggagctggctgaggacggattag

SEQ ID NO: 30662 - DNA, 567 bp, Artificial Sequence
  Description of Artificial Sequence: Synthetic coding sequence
atgagccaggcaccgggggctcagccttcacctcccacagtctatcatgaacgccagcgcttggagttgtgtgccgtgcacgcccttaacaatgttctgcaacagcagctattcagccaagaggctgccgacgagatctgtaagagactggctcctgatagcagactgaatccacatagaagcttactgggaaccggaaattacgatgtgaacgtcataatggcagcactgcaaggcctgggcttggctgcggtgtggtgggatcggaggcgtccattatcccagctggcccttcctcaggttctggggctgatccttaacctgccatcacccgtgtctctcggactactgtctctgcctttacggcgaagacactgggtagcattgagacaagtggacggggtgtactacaatctggacagcaagctgagagcccccgaggctttgggggatgaggacggcgtgagggccttcctagcagccgctttggctcagggcctgtgtgaggttttactcgtggtgaccaaggaagttgaggagaaaggaagctggttaaggactgattag

SEQ ID NO: 30663 - DNA, 1392 bp, Artificial Sequence
  Description of Artificial Sequence: Synthetic coding sequence
atgagagcagggcccgagccacaagccctggcggggcagaagagaggagctctgaggttgttggtgccaaggctggttcttactgtgtctgcgcccgctgaggtacggagacgcgtgctcagaccagtcctctcctggatggaccgcgaaacaagagcgcttgcagattcccacttccgtggtctgggagttgacgttcctggggtaggccaggccccggggagggtggccttcgtaagcgagcccggggcattttcgtacgcggattttgtgcggggcttcctcctgccgaatctgccgtgcgttttttcttcagcctttacgcaggggtgggggagtaggaggaggtgggtaactcccgctgggagaccggatttcgaccacctgttgcggacatatggggacgtggtggtcccagtggctaattgcggagtgcaggaatataatagtaatccaaaagagcacatgacgctgcgcgattacataacatattggaaagagtatattcaggcgggttatagctcaccacgcgggtgtttgtacctgaaggattggcacctgtgtcgtgattttcccgtggaggatgtatttacacttccagtctatttttcttcagattggctgaatgagttttgggatgcgctggatgtcgatgattatcggttcgtttacgccggtcccgccggttcttggagcccgtttcatgctgatatctttaggtcattttcatggtctgtcaacgtctgcggacggaaaaagtggcttttgttcccgccaggtcaggaggaggcactcagggaccgtcatggaaacctgccttacgacgtaactagtcctgccctctgtgatacccatttgcatccccgaaaccagctggctgggccgcctctcgagattactcaggaggctggtgaaatggtcttcgtgcccagcggctggcatcaccaggttcataacttggacgacaccatcagcataaaccacaattgggtgaatggcttcaaccttgccaacatgtggcgatttctgcaacaggaactgtgcgccgtacaggaggaagtctcagaatggagggactccatgccagattggcaccaccattgccaggttattatgcgaagttgctctggcattaatttcgaagagttttaccatttcctcaaggtgattgcagagaagaggttgctcgtgcttagagaagccgcggctgaagatggagctgggctgggtttcgagcaagcggccttcgatgttgggcgcattacagaggttttagcatctcttgtcgcacatccggactttcagagggtggacacctcagcttttagcccacagcccaaggaactgctccagcagctgcgcgaagccgttgatgcagccgccgcgccttag

SEQ ID NO: 30664 - DNA, 1323 bp, Artificial Sequence
  Description of Artificial Sequence: Synthetic coding sequence
tgagccttagcaggccagaaaagaggggccctgcgactccttgttccacggctcgtcctcaccgtgtctgccccagcggaggttagacgtagggtcctcaggccggttctgtcatggatggatagggaaacaagagcactcgctgactctcattttaggggtctgggagtcgatgttccgggcgtcgggcaggcccctggcagagtcgcattcgtgagtgaacctggagcgttctcatatgccgattttgtgcggggctttcttctccctaatctcccttgtgttttcagtagcgcattcacacagggttgggggtcccggcgccgctgggtgactcctgccgggcggccagactttgaccacctgctgagaacatacggcgacgttgtagtgcccgttgccaattgcggtgttcaggaatacaattccaatcctaaagagcatatgacattgagggattacattacttactggaaggagtacatacaagccggctactcctcaccgagaggatgcctttaccttaaagactggcatctgtgccgtgacttccctgtggaagatgtttttactctgcccgtctacttttcctctgactggctaaacgagttctgggacgcactggatgtggatgactaccgctttgtctacgcgggacccgcaggttcctggagccccttccacgccgacatcttccggagtttttcatggagtgtgaatgtttgtggacgaaaaaaatggttgcttttccctccaggacaggaagaggccctcagggatagacacgggaatcttccttatgacgtgacaagtcccgccctatgtgatacacacctgcaccctaggaaccagctcgctggaccacccctggagattacgcaggaagccggcgagatggtgtttgtgccaagtggctggcaccatcaggtgcacaacctcgacgatactatctctatcaaccataactgggtgaatggctttaacctggcaaacatgtggaggttcctccagcaggaactctgcgccgtacaggaagaagtgatcatgagaagttgctccggtataaacttcgaggagttctatcatttccttaaggttatagctgagaagcggcttctggtgcttagggaagccgccgcagaggatggtgcgggcttgggcttcgagcaggccgcttttgacgtcgggagaatcactgaggtgctggcttctctcgtggcccatcccgattttcaaagggtcgacacatctgccttctcccctcaaccgaaggagcttctacagcagctacgggaggcggtggatgccgctgctgctccatag

SEQ ID NO: 30665 - DNA, 951 bp, Artificial Sequence
  Description of Artificial Sequence: Synthetic coding sequence
atggctgaggccgcattagaagctgtgaggtccgaactaagggagtttccggccgctgctcgagagctgtgtgtccccctagccgttccatacctggataagcctccgaccccactgcacttttaccgcgattgggtttgccctaatcgtccatgcattatcagaaatgccctccagcactggccagccctgcagaagtggtccctaccctattttagagctaccgtggggtctacagaggtgagcgttgccgtgacgcccgatggttacgccgatgcagtcaggggcgaccgattcatgatgcctgctgagcggaggctccccctttcgtttgtgttggacgtacttgagggtagagcccaacatccaggggtcctgtacgtgcagaagcagtgttctaacctcccctcggaactaccccaactgctccctgatctcgagtcccatgtgccatgggctagcgaggctctgggcaagatgcccgacgctgtgaatttctggctgggcgaggccgccgccgtgacctcactgcacaaagaccattatgaaaatctttactgtgtggtgtccggggagaagcactttctgttccacccccccagtgacaggccattcattccttatgaattgtacactccagcgacttaccaactcactgaagagggaacctttaaagtcgtcgacgaggaggcaatggaaaaggttccctggatccccttggatccactggcacccgacttggcacggtatccatcttatagccaggcccaggctttacggtgtactgtgcgcgctggcgagatgctgtacctacctgccctgtggttccaccatgtgcagcagtcgcaaggttgtattgcagttaacttttggtacgacatggaatacgatctgaagtacagctactttcaattgctggactctctgaccaaagccagcggcctggattag

SEQ ID NO: 30666 - DNA, 1005 bp, Artificial Sequence
  Description of Artificial Sequence: Synthetic coding sequence
atggtgactggaggtgcccactctaggtcacggggcggactgccgtccgcatcccgccggggactctttaggggcggcccaaaggaagtgaccagcggagtgcgtccaggatcacgccctcttcctcgccggaggtcgtgtaggcccatggccggcggatgggcccaagggagtaggcgtgccgctcggttaccagagggaggcagactgatggcacctgccagcaggctgctcgctctgtgggctttggccgctgtagctctgcccggctctggcgccgaaggcgatggtggatggcgcccaggcggcccaggagctgtagccgaagaagagcgatgcaccgtcgaaaggcgagcagaccttacctacgcagaatttgtccagcaatacgcatttgttcgaccagtgatccttcaggggctgaccgataattccaggttcagggcgttatgtagtcgcgaccggctcttagcaagcttcggggatagggtcgttcgattgtctaccgcaaatacgtatagttaccacaaagtggatctgccttttcaggagtacgtcgagcagttactacatcctcaggatcccacgagcctgggaaacgatacactttacttctttggagataataattttaccgaatgggcatccttgtttaggcactattccccccccccatttgggttgctcggcaccgccccagcctacagctttggaattgcaggtgccggctcaggagtcccgtttcactggcacggtcctgggtacagtgaagtgatctacggccgtaaacgctggttcctctacccgccagaaaagaccccggaattccaccctaacaaaacgactctcgcctggcttagggatacatacccagccctcccccccagcgctagaccgcttgagtgcacaatccgcgcaggtgaggtactatattttccggatcgttggtggcacgccaccctgaatctcgacacttccgttttcatttcaacatttctcggatag

SEQ ID NO: 30667 - DNA, 858 bp, Artificial Sequence
  Description of Artificial Sequence: Synthetic coding sequence
atggccggtggatgggcgcaaggttcccgaagagctgctaggcttccagagggtggccggctgatggcccccgcaagccggctcctggccctgtgggccctcgctgcggtggccctccccggaagcggggccgagggggacggtggctggcggcccggtggccctggtgccgtcgctgaggaggagcggtgcactgtggagaggagggctgatctgacgtacgccgagtttgtccagcagtacgccttcgtcagacctgtgatcctacagggcctcaccgacaacagtcgctttagagccctttgctctcgggatcgtctcctcgcttccttcggggaccgagtggtccgcctctctaccgctaacacatactcttatcacaaggtggacctgcccttccaagagtacgtagagcaactccttcatccccaggatcctaccagtctgggcaacgatactttatacttcttcggtgataacaacttcacagaatgggcctcactgtttcggcactattcaccccccccatttgggttgctgggcacagctccagcctactcattcggaattgccggggccggctccggtgtcccattccactggcacgggccaggatactcagaagtgatttatggacgtaagaggtggtttttgtacccaccagagaagactcctgagttccaccccaacaaaactaccctagcctggttgagggacacttatcccgccttgccaccatcggctcgaccgctggaatgcaccatacgagctggggaggtgctgtacttccctgaccggtggtggcacgcgaccctcaacctggacacatcagtattcatctcaaccttcctggggtag

SEQ ID NO: 30668 - DNA, 915 bp, Artificial Sequence
  Description of Artificial Sequence: Synthetic coding sequence
atggttacaggcggggcacactctaggtccaggggtggactgccttcagcatcccgaagaggactgttcaggggaggtcctaaggaggtgacctctggggttaggcctgggtccaggcctcttcctcggagacggtcatgcagacctatggcagggggctgggcacagggatctagaagggctgccaggctgccagaaggtggccgcttaatggcccctgcaagtcggttgctggccctttgggctctggcagcagttgcgcttcccggctcaggagcggagggcgatgggggatggtatgccttcgtgagaccagtgatcttgcagggcctgacagataactcaaggtttcgggccttgtgcagccgggacagactgctggctagttttggggacagggtcgtgcgtctgtcaaccgctaacacctacagttaccacaaggtcgacttgcccttccaggagtatgtcgagcagctgctacacccccaggatcctacttccctgggtaacgataccctttatttttttggcgacaacaacttcactgagtgggcatccttgttccggcactatagcccccctccattcggcctgttagggaccgctccggcctactctttcggcatcgccggggccggcagtggcgtaccattccattggcatgggcctggttacagcgaagtcatctatggccggaaacggtggtttttgtatcctcctgagaagaccccggaattccacccgaataagaccaccctcgcctggttgagggacacctacccagccctgcctccatcagccagaccgctggaatgtaccattcgcgccggcgaggttctctacttccccgacagatggtggcacgcaactcttaacctcgatacgagtgtttttattagcactttccttggctag

SEQ ID NO: 30669 - DNA, 2238 bp, Artificial Sequence
  Description of Artificial Sequence: Synthetic coding sequence
atggaagttatgaatctgatggagcaacctattaaagtcaccgagtggcaacagacttacacatatgactcaggtatacatagtggggccaacacatgtgtacccagcgtctctagtaaggggattatggaagaggacgaggcatgcggacgccaatacacactgaagaagactactacttacacacagggcgttcctccatcacagggggacctggagtatcaaatgtccactactgcgagagctaaaagggtgcgggaagctatgtgtcctggcgtcagcggcgaggacagtagtttactgcttgccacacaggtcgaagggcaggcaactaatcttcagcgccttgccgagccctcccagctcctgaagtccgcaatcgtccacctgatcaactatcaagacgacgccgagctggctacccgggccctgcctgagctcaccaagctgctgaatgacgaagatccggtggtggtcacaaaggctgcgatgattgtaaatcagctctcaaaaaaagaggcaagccggagagcactgatgggatccccacagctggttgccgccgtggtgcgcaccatgcagaacacaagcgatctggacacagcccggtgtacgacttcaatactgcataacttgtctcatcacagagaggggctgcttgctattttcaagtccgggggcattcctgccttggttaggatgctctcatcccccgtggagtctgtgctgttctacgccataacaaccctgcataacttgttattgtatcaggagggcgcaaagatggccgttaggctcgctgacggacttcagaagatggtgcctcttctgaataaaaataatcctaaatttcttgcaattacaaccgactgccttcagcttctcgcctacgggaatcaggagagtaaattgataatccttgctaatggggggccccaggcgctggtgcagataatgcgcaattattcatacgagaaactcctgtggactacctcaagggttctgaaagttttatctgtttgtccaagcaataagccagcgatagtcgaagctggaggtatgcaggcactgggaaagcatctgacgtctaactctccacgcctcgtgcagaactgtctgtggacactccgcaatctgagtgatgtggccacaaaacaggaaggcctggaaagtgtgctgaagatcttagtcaatcaactgtctgtggacgatgttaatgtccttacttgtgcaacaggcacactgagcaacctgacttgtaacaatagtaaaaacaagacactggtgacacaaaattctggagtcgaagctttaatccacgccatcctccgcgcaggggacaaagatgacatcaccgagcccgccgtgtgcgctctcagacacttgacctcacgacatccggaagccgaaatggctcagaattcagtgcgactgaattatggaattcctgctattgtaaagctgctcaatcagccaaaccagtggcccttagtcaaggctacaattggcttgatccgcaatttggcactgtgccctgctaatcatgctcccctccaggaggccgccgtcattcctaggctggtgcaactcttagtgaaagcccaccaagatgcccaacggcacgtagccgctggtactcagcaaccttatactgacggcgttcgcatggaggaaatcgtggagggttgcacaggagccttgcatattctggctcgtgatccaatgaataggatggagatattccgactcaacacgataccgcttttcgttcagctgctgtacagctccgtcgaaaacatccagagggtggccgccggagtgctgtgcgaacttgcacaagacaaggaagcagccgacgctattgatgcagagggagccagtgcgccgctcatggagctgttgcattctcggaacgagggaacggccacgtatgcagctgccgtcctgttcagaatttccgaagataagaatccagattacagaaaaagggtgtctgttgagctgacgaactctctttttaagcacgatccagctgcttgggaggcagcacaaagtatgattcctatcaatgagccctacggtgacgatatggacgccacctacaggcccatgtactcctcagatgtaccacttgatccactggaaatgcacatggacatggatggggactatcccatcgacacctattctgacggtctgcgtccaccatacccaactgcagaccacatgttggcttag

SEQ ID NO: 30670 - DNA, 2238 bp, Artificial Sequence
  Description of Artificial Sequence: Synthetic coding sequence
atggaggtgatgaaccttatggagcagcccatcaaggtgacagagtggcagcagacttacacctatgattcagggatacacagcggcgctaacacgtgtgtgccatcagtgtctagcaagggtatcatggaggaggatgaggcatgcggccgccagtatactctcaaaaagaccactacctatacacagggcgtgccaccatcgcagggcgatcttgagtatcagatgagcaccacagctagggccaagcgagttagggaagctatgtgtcctggcgtctctggagaggatagcagcttgttgcttgccacgcaggtcgaaggtcaggccacaaacctacagcgactggccgaaccctcacagcttctgaagtctgccatcgtccatctgattaactaccaggatgacgctgaattagctacaagggcactccccgagctaacaaagctgctgaacgatgaggatccagttgtggtcacaaaggccgccatgatcgtgaaccagcttagcaagaaggaggcaagtagaagagctctgatgggatccccccagctcgttgccgcagtggtgaggaccatgcaaaatacgtctgatctggataccgcccgttgcactacctcgattctccacaatttgtcacaccaccgtgaaggccttctggccattttcaaaagtggcgggatccccgccttggtccgaatgctcagttcacctgtcgagtcagtacttttctacgctattactaccttacacaacctcctgctctaccaagaaggtgccaaaatggcggtgcgcctggctgacgggctccagaagatggtgccacttctgaataagaataacccaaagtttctagctatcaccacagactgccttcagctgcttgcttatggcaaccaagagtctaagttgattattctggccaacggtgggcctcaagcactcgtccaaatcatgcgcaactatagttacgaaaaactactgtggacaactagtagagtgctgaaagtactgtcagtgtgtccatcgaacaagcctgccatagttgaagctggggggatgcaggcactggggaagcacctgacatctaactccccacggttggttcagaactgtctttggacactgcgaaacctgtcagatgtggccacaaaacaagaggggcttgagtccgtgttaaagattctggtgaatcagttatcagtggacgatgtgaatgtactgacatgcgctaccggcacattgtctaacttgacctgcaacaatagcaagaataaaactttagtcacccagaactctggggttgaagcattaatccacgccatactgagggccggggataaagatgatattaccgaaccagccgtgtgcgctcttaggcacctgacttcgcggcatcctgaggcagagatggctcagaatagtgtccggctgaactacgggattcccgcaattgttaaactgctgaatcaaccaaaccagtggcccctggttaaggccaccataggactgattcgtaacctggccctgtgccccgctaatcacgcaccgctgcaagaagcagcggtgatacctcggctcgtgcagctactggtgaaggcacaccaagatgcccaaaggcatgtggcagctggcacccagcagccttatacagacggagtccgaatggaggagattgttgaaggctgtaccggcgccctccacatcttagcccgcgaccctatgaatcgcatggaaatttttcgcctaaatacaatcccactatttgttcagctgctgtacagctcagtggaaaacatacagcgtgtggcagcaggcgtgctgtgtgaactcgcccaagacaaagaagccgccgacgcaatcgacgccgaaggtgcatcggcacctctcatggaactgctccatagccgtaacgaagggacagccacgtatgcagccgccgtcctcttccgcatcagcgaagacaaaaatcccgactaccgaaaaagggtatctgttgagctgacaaatagtctctttaaacacgaccccgccgcttgggaagcggcccaaagcatgataccgattaacgagccttacggtgacgacatggacgccacctacagacccatgtactcatcagacgtgcctctcgaccccctggagatgcatatggacatggacggtgactatccaatagacacttatagcgacgggcttcgccctccctaccctacagcagatcatatgcttgcttag

SEQ ID NO: 30671 - DNA, 1890 bp, Artificial Sequence
  Description of Artificial Sequence: Synthetic coding sequence
atgcacgtcccagggggcaagttcgacttcgacgacggaggctgctatgtaggaggttgggaggctggccgagctcatggttatggtgtgtgtaccgggcctggagctcaaggcgagtactctggttgttgggctcatggatttgagagtctcggagtattcaccggtcccggggggcactcttaccagggccattggcagcagggcaagcgcgaagggttgggcgttgagagaaagtctagatggacttatcggggagagtggttaggcggactcaagggccggtccggagtgtgggagtctgttagtgggctgcggtatgcaggcctctggaaggacggcttccaggatggatacggaactgaaacctactcagacggtggcacctaccagggccagtggcaggcaggaaaaagacacgggtatggggttaggcagtcggttccataccatcaggctgccctcttgaggtcccctcgccgcacttccctggattctggacacagcgatccaccaactccacccccacccctcccgctccccggggatgagggaggctctccagcctcaggctccagaggaggcttcgtccttgctggaccgggtgacgcggatggagcttcaagtcgtaagcggacccccgctgctggaggtttcttccggcgttcattactgctctccgggctgagggctggcggtaggcggtccagcttaggatcaaagcgcggcagtctgcggagtgaagtgtctagcgaagttggaagcacaggcccgccaggcagcgaggctagcggcccgcccgcagcggctccaccggccctgattgaggggtccgctaccgaagtttacgcgggagagtggcgcgccgaccgcagatccgggttcggagtgtctcagagatctaacggactccgatatgagggcgagtggctggggaatagaagacacggttatgggcgcacaactcgacctgacggaagccgagaggagggaaaatacaaaaggaaccgtttggtgcatgggggacgtgtgagaagtctgctgccgctggccctgagacgcgggaaagtaaaagagaaggttgaccgggccgtagaaggcgcccgaagagctgtgagcgctgcgcggcagaggcaggaaattgcagctgcccgggctgctgacgcactgctcaaggctgtggcagcctcctcagttgctgagaaagccgtggaagctgcgcgtatggccaagctcatcgcccaagaccttcagcccatgcttgaagcccccggaaggcgaccaaggcaggattctgagggcagcgacaccgagcctctggacgaagattctccgggagtctacgagaacggtttgacgccttctgagggatccccggaattgccttcatctcccgcatccagccgccagccttggcggcctcccgcttgtcgctcccctctcccgccagggggagatcaggggcctttttcttccccgaaggcttggcccgaggagtggggcggagctggggcgcaggccgaagagctggcgggctacgaggccgaagacgaggcagggatgcagggaccaggtcctcgggatgggagtccactcctggggggttgcagtgactcgagtgggtccctgagggaggaagagggcgaggacgaggaacccctgcctcccctcagggcacccgccggcacagaaccggagccaattgccatgctcgtgctgcgggggtcttcgtctcggggtccagatgcgggttgtttgaccgaagagcttggggaacctgccgctacagaacgccctgcccagcctggggcggccaatccattagtggtgggtgctgtggctctgctagacctcagtctggcattcttgttctctcaattactgacttag

SEQ ID NO: 30672 - DNA, 1590 bp, Artificial Sequence
  Description of Artificial Sequence: Synthetic coding sequence
atgtccacaaacgagaatgccaatacacctgccgctcggctccatcgattcaagaataaaggtaaggacagcactgagatgaggaggcgacggattgaagtgaatgtggaacttaggaaagcaaagaaggatgatcagatgcttaaaaggagaaacgtgtcctctttccctgacgacgccacctcccctctgcaagaaaatcgcaacaaccaggggacagtcaattggagtgtcgacgacatagtcaaaggcatcaactcctccaatgttgagaaccaactgcaggccacccaagccgcccgcaagctcctctcgcgggagaaacagcctcccatagacaatatcatccgggccggactgatccccaagtttgtaagcttcctaggccgtaccgattgctctccgattcagtttgaatctgcctgggcactgaccaacatagcctcggggaccagtgaacaaacaaaggcagtcgttgatggaggggcaattccagctttcatctcacttctggcaagtccccacgctcacatctccgagcaggctgtctgggcattaggtaacatcgctggagacggcagcgtgttccgcgatttggttattaaatacggtgctgtggatcctcttctggctctgcttgccgtgcctgacatgagctccctcgcatgtgggtatctcaggaacttgacatggaccctgagtaacctttgtagaaataaaaacccagctccccccatagatgcagtagagcagattttacccactctcgtgcgcctgttgcaccacgatgaccccgaagtcttggcagatacatgttgggcaatcagctatctaacggacggtcccaacgagaggataggcatggtggtcaagaccggagtcgtccctcagcttgtaaaactgctgggcgccagtgagctgcctattgtgaccccggccctcagagccataggaaacatcgtaactggaacagacgagcagactcaggtggtgattgatgcaggggccctcgccgtgtttccgtcgctgctcactaaccccaagactaacatacagaaagaagccacatggacaatgtccaatatcacagctggtagacaggatcagattcagcaagttgtgaatcacggactcgtgcctttcctggtgtctgtcctgagtaaggctgattttaagacccagaaagaagcagtctgggctgtgacaaattatacctctggtggcacagtggaacagatcgtctacttagtgcattgtggcatcattgaacctctgatgaaccttctgaccgctaaggatactaaaattattctcgtgatcctcgatgccatatcaaacatctttcaggcggcagaaaagctgggtgaaaccgagaagctgagtattatgattgaggaatgcggcggcctggataaaattgaagctttgcaaaaccacgagaatgaaagcgtgtataaggcatccctgtccctcattgagaaatacttcagcgttgaagaagaggaggaccaaaacgtcgtgcctgagactacatctgaaggatacaccttccaggtacaggatggagcgccaggaaccttcaatttctag

SEQ ID NO: 30673 - DNA, 459 bp, Artificial Sequence
  Description of Artificial Sequence: Synthetic coding sequence
atgcgtgagaaactaattcgcttgcaatcgctatacatcgatcagttcaaacgattacaacacctgctaaaggagaagaagcgccgttatctccacaacagaaaagttgagcatgaggccttggggtcttccctgctaacaggcccagagggacttctggccaaggagagagagaaccttaaacgtttgaagtgcctgcgcaggtaccggcagagatacggggtggaagctctactacacaggcagctaaaggagcgtaggatgcttgccacagatggagccgcccagcaggctcacacaaccagaagttcacagcggtgtttggctttcgtggacgatgttcggtgcagcaaccaaagcctgcccatgaccaggcattgccttacccaaaaagatgccactgctattggagacctcctaacgctctactgcggcttgatggagactgccctggattag

SEQ ID NO: 30674 - DNA, 1479 bp, Artificial Sequence
  Description of Artificial Sequence: Synthetic coding sequence
atgaaccgcatccgaattcacgtgctcccgaccaacagggggcggatcacccctgtaccacggagccaagagccactaagctgtgcctttacgcaccgaccatgctctcatcctcgcctggaaggccaagagttctgcataaagcacatattggaagataaaaacgccccatttaagcaatgctcctacatcagcaccaaaaatggaaaacgctgcccaaatgccgctccaaagcccgagaaaaaggacggcgttagcttctgcgctgagcacgtgcgcaggaacgctcttgcgctgcacgctcagatgaagaagaccaaccccggcccagtaggggagacccttctatgtcagctgtcatcatatgccaagacggaactggggagccaaacaccagagtcatctagatcggaggcgagccgtatactggatgaagattcatggagtgacggtgaacaggagccgataactgtggaccagacctggaggggcgacccagatagcgaagccgacagcatcgattcggaccaagaagatccgctcaaacatgcaggcgtgtacactgctgaagaggtcgcactcataatgcgagaaaagctcatcaggctacagtctctctatatcgatcagttcaagcgactgcagcacctcctgaaggagaaaaagcgtcggtatctgcacaaccgcaaagtagaacatgaggccctcggctcgtcgttactgactggaccagaaggcctgctggctaaagaaagggagaatttaaagcgcctaaagtgtctgaggagataccggcaaaggtatggggtcgaagctctccttcatagacagcttaaggagcgccggatgctcgccacggacggcgctgcccagcaggcacatacaaccagaagttctcagaggtgcctcgcattcgtagacgatgtccgttgcagcaaccagtcgctaccaatgacccgccactgtctgactcatatctgtcaggataccaatcaagtcctatttaagtgttgtcaagggagcgaggaggtgccctgtaacaagcctgtcccagtttcactctcagaagacccttgctgtccacttcactttcagttacccccgcagatgtataagccagagcaggtgctctctgttccggacgatctcgaggcgggcccaatggacctgtacctgagcgccgctgaactgcagccaaccgagagcctgcccctagaattctctgacgacttagatgttgtgggagatggcatgcagtgtcctccaagcccactgctgtttgacccatctctcactctagaggatcaccttgtgaaggaaatcgcagaagaccctgtggatatcctcggtcagatgcagatggcgggcgatggctgtcggtctcaggggtctcggaattccgaaaaggcctccgccccgctgtcccagtcaggactcgcaactgctaacgggaagcctgagcctacatcaatatcatag

SEQ ID NO: 30675 - DNA, 210 bp, Artificial Sequence
  Description of Artificial Sequence: Synthetic coding sequence
atgaatcgaatccggatccatgttttgcccacgaatagaggccgaattacccccgtgccacggtcccaggaaccgctaagctgcgcttttacccacaggccatgttctcatcctcggctggagggccaggaattttgcattaaacacatcctcgaagataagaatgctcccttcaaacagtgctcttacatatcaacgaagaacggatag

SEQ ID NO: 30676 - DNA, 2376 bp, Artificial Sequence
  Description of Artificial Sequence: Synthetic coding sequence
atgccactgtatgacaaccaaaaggctcgctcagtgatgaacgagtgtgagcgccatgtgatcttcgcaaggaccgatgctgatgcgccacctcctccagaagattgggaggaacatgtgaatcgtactggatggactatggctcagaataaactgtttaataagatactgaaggcgcttcagtcggatcgcctggccaggcttgcgaacgagggtgcctgcaatgaacccgtgctcaggcgggttgcggttgataagtgtgccagaagggtgcgacaggccttagccagcgtgtcctgggacactaagttgatacaatggttgcacaccacactggtagagacactcagtctgcccatgttggcagcatatttagacgctctgcagactctgaaggggaagattcctaccttaattgacaggatgctcgtttcatctaacaccaagaccggcgctgccggggctgaagctctctcccttctgttaaaaagaccttgggacccagctgtgggcgtcctgagtcacaacaagccttcgaagcttccagggagcccactcattctcattgcttcatcagggcccagcagtagtgtgttccctaccagccggaggcatcgcttttggcagtcacaactgtcctgtcttggcaaagttatccccgttgccacgcaccttcttaataatggaagcggcgtcggcgtcctccagtgtttagaacatatgatcggggccgtacgcagcaaagtgttagaaatacatagccatttccctcataaacccataatactcatcgggtggaacaccggagctttagtggcctgtcatgtgagcgttatggagtacgtgactgccgttgtttgcctgggctttccccttctcactgtcgacgggccccgcggagatgtagatgatcccctgttagacatgaaaacgccagtgctgttcgtaattggccagaatagtctgcagtgccacccagaggccatggaagatttcagggagaagatccgagctgagaattctttagtggtggtcggtggagccgatgacaatttgaggataagcaaggccaaaaagaaatcggaggggctaacccagtctatggttgatcggtgcatacaggacgagattgtggatttcttgaccggcgtgctgacacgcgccgaaggtcacatgggcagcgaacctagagaccaagacgcagagaagaagaaaaaaccccgagacgtcgctagaagggacctggcattcgaagtgccggagcgcggcagtcgacccgcctcaccggctgccaaactcccagcttccccatcaggctccgaggacttatcaagtgtgtctagttctcctacatcttctcctaaaacaaaggtgactaccgtcacctctgctcagaaatcctctcagataggatcatcgcagttgttgaagagacacgtacagcggacagaggcagttttaactcacaaacaggctcaggtccccatttccagcgaacccccagaagagggcgagaaggaagatttgagagtgcagttaaagagacatcatcctagcagcccgctccctgggagcaagacctccaaaaggcctaaaatcaaggtatcactgatttcacagggcgatactgccgggggaccatgcgctccctcccagggatccgcccccgaagcagccgggggcaaacccatcacgatgactctgggacaagcctcagcaggtgcgaaggagttgactggcttgctgacgacagccaaaagcagcagtagcgagggaggggtctctgcctctcccgtaccctccgttgtcagtagctctacggccccctccgctttgcatactctccagtctagactcgtggccacgagccctggtagttcattacctggtgcaactagcgcgagctcattgctgcaaggcttgtctttttcactgcaggacattagctctaagacctccggcctgcccgcaaatccgtcaccaggtccagcccctcaggctacgtctgtcaagctgcccactcctatgcaatctctcggggccattaccacgggaacctccacaatcgtgaggactattcccgtcgccaccacactaagtagcctgggcgctactccgggcgggaagcctactgctattcaccagctccttactaacggcggcctagccaagctagcttcttcactgccgggactggcgcagatatcgaaccaagccagcggtttgaaagtgcccactactatcactttaactcttagagggcagcctagccgcataactacactgtctcctatggggtcaggcgctgcccccagtgaggagtcatcaagtcaggtactgccgagcagcagccagcgcctgcctcccgcaccttag

SEQ ID NO: 30677 - DNA, 2637 bp, Artificial Sequence
  Description of Artificial Sequence: Synthetic coding sequence
atggcccataggggcggtgagagagatttccagacctccgcacgacggatggggactagcctcctctttcagctgagcgttcacgaacgagaacttgacttagtcttcctggatcattcttacgctaagccctggagcgcccaccctgatgcttcttccgcacggcccaccaggatgttgttcgtaacccctcgacggcaacacgagtccactattgaatctgatgtgcccattgacgtcgaaacggtcacttcaaccccaatgcctttgtacgataaccagaaggctagatcagtcatgaatgaatgcgagagacacgtcatttttgctcggacagatgcagatgctcctccccctcccgaagattgggaagaacatgtaaatcggacgggctggacaatggcccagaataagttgtttaacaaaattttgaaggcactccagagcgaccggctggcgaggttagcgaatgagggcgcctgcaatgagcctgttttgcgcagggtggccgtcgataagtgtgccagaagagtccggcaggcgctcgcgtcggtcagctgggatacaaaacttatccagtggctacatacgactctcgtagagacgctaagtttgcccatgctggctgcctacctcgacgcactgcaaaccctgaaaggtaagattccgactcttatcgacagaatgcttgtatctagtaacaccaaaacaggagccgccggcgccgaagctctgtccctgctgctgaaaagaccatgggacccagctgtgggcgtcttgtctcataataagcccagtaagctgcctggaagccccctgatcttgattgccagcagcgggccatcatcaagcgtgtttccgacttctcggcggcaccgattctggcagtcgcagctaagctgcctgggaaaggtgattccagtcgctactcatttactcaacaatggcagcggggtcggtgtgctgcaatgtctggagcacatgatcggggccgttaggagcaaggtgctggaaatccattcacattttccccacaaaccaatcattctcattgggtggaatacgggggccctggttgcttgccacgtttctgtgatggaatacgtgactgctgttgtgtgccttggctttcctctgctcaccgtggacggcccaaggggcgacgtggatgatcctctgttagatatgaaaactcctgttctgttcgtgataggtcaaaattccctccagtgccatcctgaggccatggaggatttccgcgagaaaataagggcagagaattcgctcgtcgtggtgggcggcgccgacgacaacttaaggatatctaaggccaagaagaagagtgagggcttgacgcagagtatggtggataggtgcatccaagacgagatcgtggattttttaacgggcgtcctcactcgcgctgagggccatatgggaagcgaacccagagaccaggatgccgaaaagaaaaagaagccaagagacgtggccagacgcgacttagcttttgaggtcccggaaagaggatctagaccagcaagccccgctgccaagctgcctgcatctccctctggatctgaagacctgtcctctgtgagcagctcccctacaagctcgccaaagactaaagttacaaccgttactagtgcacaaaagtcctcccagatcgggtcgtcacagcttcttaagagacatgtacaacggacagaggcagtactgacccataagcaagctcaggtgcctatttctagcgaacccccagaagagggagaaaaggaggatctgagagtccagttgaagagacatcatcctagctcaccgctgcctggaagtaagacgtccaaacgccctaagattaaagtgtccctgattagccagggagatactgccggcgggccctgcgccccttcccagggctccgccccagaggcagccgggggcaaacccataacaatgaccctaggacaggcgtctgctggcgctaaagaattaacgggtctgttaaccactgccaaatctagctccagcgaaggaggagtgagtgcaagtccagtacctagcgttgtgtcctccagcaccgccccttccgccctgcacaccctgcaatcacgtctggttgcaacatctcccggctcttcgctgcctggggccacaagcgcttcttcattactgcagggtctgagcttctcactccaggacatttcatctaaaacaagcggcctgcctgccaacccttcaccaggtcccgcccctcaggccactagcgtcaagctgcctacccccatgcagagcctcggtgccatcactaccggaacaagtaccatagtgaggactatcccggttgccactaccctgagctctctgggggctacccccggcggaaagcccacagccattcaccagttgctcaccaacggtggtctggcaaaactcgcatctagtctgccgggcctcgcccagatctccaaccaagcatcaggtctgaaagtgcctacaacaattactctgacactgcgtgggcagcctagccggattaccacactcagtccaatgggtagtggcgcggcaccgagcgaagagtcttccagccaggtgctcccgagctcctctcagcgactccctccagccccgtag

SEQ ID NO: 30678 - DNA, 426 bp, Artificial Sequence
  Description of Artificial Sequence: Synthetic coding sequence
atgccactgtatgacaaccagaaggcgcgatccgtcatgaacgagtgtgagaggcatgtcattttcgcaaggacagatgccgatgcgccgccaccacccgaggattgggaggagcacgtcaataggactgggtggactatggcccagaacaaactctttaataaaattctgaaagccctgcagtccgatcggctggcccgcctggccaacgagggcgcttgcaacgagccagtgttgcgccgcgtggcagtggacaagtgtgcaagacgggtgcgtcaggccttggcctccgtgtcctgggatacgaaactaatacagtggttacatacaacccttgtagagacactgtctctgccgatgctggcagcctacttagacgccctgcagacactgaaggggaaggtcattctgaccttttgtggctag

SEQ ID NO: 30679 - DNA, 1593 bp, Artificial Sequence
  Description of Artificial Sequence: Synthetic coding sequence
atgcccctgtacgacaaccaaaaggctaggagcgtgatgaatgagtgtgaacgacatgtcatcttcgcccgtacagatgccgatgcaccacctccgccagaggactgggaggaacacgttaatcggaccggatggaccatggcacaaaataagctgttcaacaagattctgaaggccctccagagcgaccggttggcacgactggctaatgagggagcctgcaatgagcccgtgctccgtcgcgtcgctgtcgacaagtgcgcccgacgcgttagacaggcccttgcaagcgtgagctgggatacaaaactaatccaatggctccacaccacgctcgttgagactctttccttacccatgctggcagcttacctggacgccttacaaacactcaaaggcaaaatccctaccctgatcgatagaatgctcgtgtcgagcaataccaaaacgggtgcagccggcgccgaagctcttagcctgctgttgaagcggccgtgggatccagccgtcggcgtactttcccataacaagccatccaagctccctggctctccactgatcttaattgcctcttcaggaccctctagctccgtgttcccaaccagtagaagacatagattctggcagtcccaattatcttgtttgggaaaagtcatccctgtcgccacccatctcctaaataacggaagcggggtcggcgtcctgcaatgcctggaacacatgattggggctgtgcgcagcaaggtgttggagatccacagccatttcccccataagccaattatcctcattggatggaacaccggcgcactggttgcttgtcatgtctccgtgatggaatatgttacagcagttgtgtgcctgggctttcctcttctcacagtggacgggccgcggggtgacgtggatgaccccctgctggacatgaaaacacccgtgctattcgttattggtcagaatagtcttcagtgtcacccagaagccatggaggacttccgagagaagatccgagctgaaaactcactggtggttgttgggggtgccgacgacaatctgcgaatttctaaagcaaagaagaagtcagaagggctcactcaaagtatggtggatcgatgtatacaggatgaaatcgtggatttcctcacaggagtgctgaccagagcagaaggacatatggggtccgagccacgagaccaggatgccgaaaagaaaaaaaagccccgcgatgttgccagaagagacctcgctttcgaggtgcctgagcgagggtcgcgccccgccagccccgcggccaagttgcctgcaagtccctccggatccgaggatttgtcttccgtcagcagctctcccacatcgtctccaaaaactaaggtcacaaccgtgactagcgcccagaaaagctctcaaataggttcaagtcagttattgaagaggcatgtccagcgcactgaggccgtgctgacccataaacaggcacaggtcccaatctcctcggagccccccgaagagggcgagaaggaagaccttcgggttcagttaaaaagacaccaccctagtactcctctgcccgtctacagctggttccaccactag

SEQ ID NO: 30680 - DNA, 2295 bp, Artificial Sequence
  Description of Artificial Sequence: Synthetic coding sequence
atgaccctgccacactgtcacaggctcatgctgacacaccatttattttggacaggatggactatggcccagaataagcttttcaacaagatccttaaggccctccagtccgacaggctcgcgagattggctaacgagggggcgtgtaacgagcctgttctgaggcgcgtggcagtggataagtgtgccaggcgcgtgcgccaagccctagccagcgtttcctgggacaccaagcttattcaatggttgcatacaaccctggtggaaaccctgagtttgcctatgctcgccgcatacctggacgcactgcaaactctgaaagggaagatcccaacgctgatcgatcgcatgcttgtgtccagcaatacaaagaccggggccgccggtgccgaggcccttagtctacttcttaaaagaccgtgggaccctgccgttggcgtgttgtcccacaacaagcccagtaaactccccggaagtccacttatcctcattgcctcctcaggaccttctagcagcgtgttcccgacttctagaaggcacagattttggcagagtcagcttagttgtttggggaaggtcattcctgttgctacccatctgttaaataacggaagcggagtgggagtcttgcaatgtctcgaacatatgatcggtgcagtgaggagtaaggtcttggagattcacagtcatttcccccataaacctattatcttaattggctggaacactggtgcgttggtcgcatgccacgttagtgttatggagtacgttaccgccgtggtctgccttggctttcctctgctgacagtcgacggtcccagaggcgatgttgacgaccccttactggacatgaaaacacccgtgctctttgtgataggccagaacagcctgcagtgtcaccctgaggctatggaggatttcagagagaagatccgggcagagaattcattagtcgtggtcggcggagctgacgataatctgagaatttcaaaagccaagaagaagtccgagggactcacacagagcatggtggatagatgcatccaagacgagatagttgactttctgactggagtcttaacccgtgccgaaggacacatggggagtgagcctagagaccaggatgccgaaaaaaaaaaaaagccacgagatgtggcacggcgggatttagccttcgaggtgcccgagagggggagtcgccccgcttcgccagccgcgaaacttcccgcttcgccatctggaagcgaagacctgtcctctgtttccagttctccaacttcatcccccaaaaccaaggtcaccacagtgacctccgcccagaaaagcagccaaattggttcgtctcaactgctcaaacggcatgtgcagcggacagaagcagttttgacccacaagcaggctcaggtgccaatctcatccgaacctcctgaggagggggagaaggaggatctacgcgttcaactgaaacgccatcatccctcttcacccctgcctggaagtaagacctctaagcgccccaagatcaaagtaagcctaatcagccaaggcgacacagccggcggaccttgcgcacccagccaaggatcagccccagaggggggaaagccaatcacaatgactttaggccaggcctctgccggcgcaaaggagctaacgggcctccttaccaccgctaaaagcagcagcagcgagggaggcgtctcagcctcacccgtaccatctgttgttagctcatccacggcacctagtgccctgcatacactgcaatcccgcctggtggcaacttccccgggatcatccctccccggtgctacgtcagctagttccctgctgcagggcctgtctttcagtctgcaggacatctcatcgaagacttcaggactccctgccaatcctagtcctggaccagctccccaagcaacatccgtgaaactaccaacacctatgcaaagcctgggcgctatcaccactgggaccagtacgatcgtgagaacgattcccgtggccaccaccctttcatccttgggtgctacccctgggggcaagccgaccgctattcatcagctgctgacaaatggagggctggctaagctcgcctcctccctccctgggttagcgcagatcagtaatcaggctagtggtttgaaagtgccgactaccattactctgacccttcgcggacagccaagtagaatcacgaccctctcccccatgggatcaggcgcggccccctctgaagagtcctcatcccaagttcttcctagttcctctcaacgcttgccgcccgcaccttag

SEQ ID NO: 30681 - DNA, 1059 bp, Artificial Sequence
  Description of Artificial Sequence: Synthetic coding sequence
atgcctctttatgacaaccaaaaggctcgaagcgtaatgaacgaatgcgagagacatgttatcttcgctcgaacagatgccgacgcaccccctccaccagaggattgggaagagcatgtcaatcggaccgggtggacaatggcccaaaataaactgttcaataaaattctgaaggctttacaatctgatcgactggccaggctggcaaatgagggcgcatgcaatgaacctgttctccgtcgggtcgcagtagacaagtgcgctagaagggttaggcaggctctggccagcgtttcctgggatacaaagctaatacagtggctgcataccaccctggtggagacactcagcctacctatgctcgccgcatacctggatgcattgcagactctcaaagggaaaattcctacccttatcgacaggatgcttgtctcctctaacaccaaaaccggagctgccggcgcagaagccctgtcattgcttctgaagcggccttgggatcctgccgtgggggtacttagccacaacaagccatcaaagttgccaggatcacccctaattctaattgcaagctcaggtccctcttcttccgtgttccccaccagtaggaggcaccgattttggcaaagtcaactgtcctgcctaggaaaagttattcccgtggcaacccatttgttgaataatggatccggggtcggggtcctgcagtgcttagagcacatgattggggcagtgaggagtaaagttctggagatccattctcactttccacacaaacccattattctgatcggctggaatactggcgcactcgttgcttgtcacgttagtgtaatggaatatgtgaccgcagtagtctgtctgggttttccattgctgaccgtcgacggcccgaggggcgatgttgacgatcctctgctcgacatgaagacacccgtgctcttcgtgatcggccagaactcactgcagtgtcaccccgaagccatggaagactttagggaaaaaattagagcagaaaactcactcgtcgtggtgggtggtgccgacgacaatctttag

SEQ ID NO: 30682 - DNA, 1329 bp, Artificial Sequence
  Description of Artificial Sequence: Synthetic coding sequence
atgtccgccgcccagggatgggaccggaaccgacgccgtggcggcggagccgcaggggccggggggggcggatcgggggctggaggcggttctgggggttctggaggacgagggacaggccaattgaaccgctttgtccagctctccgggcgcccgcatcttcctggaaaaaaaaaaatacgatgggaccccgtccgcagacgatttattcagtcctgccctattatccggatacccaacagatttttgagggggcaccgcccacctccagctagatctgggcaccgttgcgtggccgataatactaatctctatgtgttcggtggctacaaccctgattatgatgagagcggcgggcccgacaacgaggactacccactgttccgtgagttatggcggtaccacttcgctacgggggtgtggcaccagatgggcactgatggttatatgccgagagagctagcttctatgtctttagtgttgcatgggaacaacctgctcgtattcggtggcacggggataccattcggagagagtaatgggaacgatgttcatgtttgcaatgtgaagtacaagaggtgggcattattgagctgtaggggcaagaagccgtcaaggatctatgggcaggcaatggctatcatcaacgggtccctatacgtctttggtgggaccaccgggtacatttacagcacagacttacataagctggatctgaatactagagagtggacccagctcaagcccaacaacttatcctgcgacctgcctgaggagcggtatcgccacgagatcgcacacgacggccagcgaatttacatcctaggtggcggtacatcttggacggcgtattcactgaacaagatccacgcgtacaatctggagactaacgcctgggaggaaatagccacaaagccacacgagaaaatcgggtttccagctgccaggcggtgccacagctgcgtccaaatcaaaaacgatgtatttatttgtggcggctacaatggagaggtcattctcggggacatttggaaactgaaccttcagacctttcagtgggtgaagctccccgctaccatgccggagcctgtgtacttccactgcgcagccgttacacccgccggatgcatgtatattcacgggggagtggttaatatccacgagaacaagcggactgggagccttttcaagatttggctcgtcgttcctagcctactggaattggcctgggagaaactgttggccgccttcccaaacctggcaaacctgtcccgaacccagctcctccacctgggtttgacccaggggcttatcgaacgccttaagtag

SEQ ID NO: 30683 - DNA, 1563 bp, Artificial Sequence
  Description of Artificial Sequence: Synthetic coding sequence
atgggtaagaaaggcaaaaaggagaaaaaggggcgtggcgccgaaaaaactgctgcgaagatggaaaagaaggtcagtaagcgtagccgaaaagaggaggaggatctggaggccctgatcgcccactttcaaacactcgacgccaaaagaacccagacggtggaacttccatgtccaccgccatctccacgtttgaacgcgagcctgtctgtgcaccctgagaaggacgagctcattctcttcgggggagaatacttcaatggtcagaagacctttctgtacaacgaactgtacgtctataacactcggaaggacacttggactaaggtggatatccctagtccgcctcctagaagatgcgcccaccaggccgtggttgtgcctcaaggcgggggccagctttgggtgttcggcggcgagttcgccagcccaaacggcgagcagttttatcattataaagatctgtgggtgctgcatctggccacaaagacatgggaacaggtcaaaagcacggggggaccctccggtcggtccggtcataggatggtcgcttggaaacggcagctcattttgttcggcggctttcatgaaagcacaagggactatatttactacaatgacgtttatgcttttaatcttgatacttttacatggtcaaagctctccccttccggcacaggtcctaccccgcgatcaggctgccaaatgtcagtgacaccccaagggggaattgtcgtctacggcggttacagcaaacaaagggtgaaaaaagacgtggataagggcacccgccattctgacatgtttctgctgaaacccgaggacggtagggaagataagtgggtatggacacgcatgaatccaagcggcgtaaagcctaccccccggagcggcttctccgtagcaatggcgccaaatcaccagaccttgttctttggcggagtctgcgatgaggaagaagaggagagcctgtccggggagttcttcaacgacttatatttttacgatgctacgcgcaatcggtggttcgagggccagctaaaagggcccaagagcgaaaagaaaaagaggcgccgtggcagaaaggaagaacccgagggcggtagcagacctgcgtgcggtggagccggtacccaaggtccagtgcaacttgtgaaggaagtggtcgccgaagacgggactgttgtcactataaagcaagttctgactgcccctggtagcgccgggcaaccacgatcggaggacgaggattcactcgaggaggctggatcccctgcacccggcccctgcccaagaagcaacgccatgctggccgtgaagcacggggttctttacgtttatggcggcatgtttgaggccggcgacagacaggtgacacttagtgatctccattgcttggatttacaccggatggaggcttggaaggcacttgttgagatggatccagagactcaggagtggctggaggagacggactccgaagaagactctgaggaagttgagggagcagaaggcggcgtggacgatgaagactcgggtgaagagtcgggtgctgaagactag

SEQ ID NO: 30684 - DNA, 777 bp, Artificial Sequence
  Description of Artificial Sequence: Synthetic coding sequence
atggtcgcctggaagcgccagctgatcctcttcgggggttttcacgaaagcacgagggactatatctattataatgacgtttacgcctttaaccttgacacctttacatggagtaagttgagcccttctggaactgggcctactcctagatccggatgtcagatgagcgttacgccccagggcggtatagttgtgtacggtggctatagcaagcagagagttaagaaagacgtggataagggcactagacacagtgatatgttccttctcaaaccggaggacggcagggaggataagtgggtatggacccgaatgaacccatccggcgtgaagcctaccccaagaagtggtttttccgtggccatggcccctaatcatcagaccttgttcttcggcggggtttgcgatgaagaggaggaggagtcccttagcggcgaattcttcaatgacctgtacttctatgatgccactagaaatcggtggttcgaaggtcagctcaaaaaattaagaagcggatggaggagacggaccaggaagcggacagtgagacgccttagagctccacgcgtaggatccaccactaagacggcggaaaggagagccgtgagacgcaccgagtctccttgtcagggaaggttggcgagcgccgtgcctacttctgcccaggaccccgccgtgctttctgaggctttgggtgcatccgttcgccccgacgcccaagaaagagccgaaggagggtggccacggccgggctgtgagctgtctccaatggtttag

SEQ ID NO: 30685 - DNA, 1470 bp, Artificial Sequence
  Description of Artificial Sequence: Synthetic coding sequence
atgggaaagaagggaaagaaagaaaagaagggtcgaggcgcagaaaagaccgccgccaagatggagaaaaaagtgtcgaagcgctcaaggaaagaagaggaggatttggaagctttgattgcgcacttccaaacgttagatgctaaaaggactcaaactgtggagctgccatgtcctcctccgtcccctcgtctgaatgcatcactgagcgtccacccagaaaaggacgagctcattctgtttggaggcgagtatttcaatggtcaaaaaacttttctgtataatgaactgtacgtgtacaacacacggaaggacacctggaccaaagtagatatcccgtctccccccccgagaagatgtgcacatcaggccgttgttgttccccagggtggaggccagttgtgggtctttgggggggagttcgccagccctaatggagagcagttttaccactacaaagacctttgggttctgcacctggcgactaaaacctgggaacaggtgaaggactacatatattacaatgatgtttacgcatttaaccttgacacatttacttggagcaaattgagcccttcagggaccggccctacccctaggtcgggatgccagatgtcagttactccacagggcgggatcgtggtgtacggagggtactctaaacagagggtcaaaaaagacgtcgacaaggggacacgccactccgacatgttcctcctcaagccagaggatggccgtgaggataagtgggtgtggacccgaatgaatccatccggcgtgaagccgactccccggtccggcttttcagttgcaatggctcccaatcaccagactctattcttcggcggggtgtgcgacgaggaagaagaagagtcactgagcggtgagttctttaatgatctttacttctacgatgctaccagaaacagatggttcgaaggccagcttaaggggccaaagtccgagaaaaagaagcgaaggcgaggcagaaaagaggagcctgagggtggatcccgccctgcgtgtgggggcgcaggcacgcagggtccagtccagttggtaaaagaagtggtggcagaggacgggactgttgtaacaattaaacaagtcctcacggccccaggctccgcggggcagccgcggagcgaggacgaagacagtctcgaggaggccgggtcccctgctcccgggccctgtcctcggtctaacgcgatgctggccgttaaacatggcgttctgtacgtgtacggtgggatgtttgaggctggcgatagacaagttaccctgtcagatctgcactgcctggatttgcatcggatggaggcgtggaaggcactggtcgaaatggatcccgaaactcaggagtggctcgaggaaactgactcggaggaagattctgaagaggtcgaaggggcggaaggaggagtggacgatgaggattccggtgaggagagcggcgccgaggactag

SEQ ID NO: 30686 - DNA, 1392 bp, Artificial Sequence
  Description of Artificial Sequence: Synthetic coding sequence
atgggaaaaaaaggaaaaaaagaaaaaaagggtcgcggggccgaaaaaactgccgcaaagatggagaaaaaggtcagcaagaggagccgcaaggaagagacgttcctgtacaatgaattatacgtgtacaacacacgcaaggatacctggaccaaagtagatatccccagtcctccaccacgtcggtgcgcccaccaggccgtggtggtaccccagggtggtgggcagttatgggtctttggcggagaattcgccagccccaacggggagcagttttatcactacaaagatctctgggtgctccacttggcaactaagacgtgggaacaggtgaagtccactgggggaccaagtgggcgatcgggccacaggatggtggcttggaagaggcaactgattctgtttggagggttccacgaatcaaccagggactatatctactataatgatgtgtatgcttttaacctggacactttcacctggagcaagctgagtccaagcggtacgggcccaacacctagatccggctgtcaaatgtccgtgaccccacagggaggtattgtggtctacggcggctattccaagcagcgggtcaagaaggacgtggacaagggaaccagacactccgacatgtttctcctcaagcctgaggatggacgcgaagacaaatgggtgtggacacggatgaacccctcaggggtcaaacccacgcccaggtctggcttcagcgttgccatggcccctaaccaccagaccctctttttcggcggagtgtgtgatgaggaggaggaagaatccctgagtggtgaatttttcaacgatctgtacttttacgatgcaacaagaaatcggtggttcgaaggacagctgaaaggccccaaatcagaaaagaagaagaggcgcaggggcaggaaggaagaacccgagggcggaagtcggcccgcctgcggtggggctgggacccagggcccagtgcagctcgtcaaggaagtcgtagcggaggacggtacggttgtgacaatcaaacaagtactgacagctcccggttctgcaggacagcctaggtccgaagatgaggacagcctagaagaggctggctcccccgcccctggcccatgcccccgctccaatgccatgttggccgtgaagcatggagtcctgtatgtgtacggggggatgtttgaagccggggatcgccaagtgacgctgagtgacttacactgtttagacctgcacaggatggaagcctggaaggctcttgtggagatggaccctgagacgcaagagtggctcgaagaaacagattccgaagaagattccgaggaagtcgagggggctgagggcggagttgatgatgaagactctggtgaggagagcggcgccgaggactag

SEQ ID NO: 30687 - DNA, 1518 bp, Artificial Sequence
  Description of Artificial Sequence: Synthetic coding sequence
atgtctgcagaggaaatggtgcaaataagactcgaggatagatgctacccagtaagcaaaagaaaactgatagaacagagtgactactttagggcactctaccggtccggcatgagagaggccctgagccaagaggccggaggccccgaggtgcagcagctgcgggggcttagcgcacccggcctgagactggtgctagattttataaatgctggcggcgcacgcgagggatggctcttagggccccggggagagaagggtggcggagtggatgaggacgaagagatggatgaagtctcactgttgagcgagctggtcgaggcagcatcttttctgcaagtgacgagcttgctgcaactgctgctctctcaggtgcgcctgaacaattgcttggaaatgtatcgcctggctcaggtttacggactcccagaccttcaggaagcctgtctacgcttcatggtcgtacacttccacgaggtcctctgcaaacctcaatttcacctgctgggctcccctccacaggctcctggagacgtctctcttaagcaaaggctgcgcgaagctcgaatgaccggcacccccgttcttgtcgctttaggggattttcttggcgggccattggcacctcatccataccagggcgaacccccttccatgttgaggtacgaagagatgacagagaggtggttcccattggcaaacaacctgccaccagacctagtcaacgtcagaggctacggctccgccatcctagataattacctgttcattgtgggcggttatcggattacttcacaggaaattagtgctgcgcatagctataatcctagcacaaatgagtggcttcaggttgcctcaatgaatcagaaaaggtcaaacttcaagctggtagctgtcaactcgaagctgtatgctattggggggcaggcagtgagcaatgtggaatgttataatcctgagcaggacgcgtggaattttgtcgccccgctcccgaatcctctggccgaattcagtgcctgcgaatgcaagggcaaaatatacgtgatcggcgggtacactaccagagatagaaacatgaatatcttgcagtactgtccatcctctgacatgtggaccttgtttgagacttgcgatgtacacattcgcaagcagcagatggtctctgtggaggagactatctatattgtcggcggatgcctccacgagctcggccctaatcgccgatcaagccaatcagaggacatgctcacagtgcagagctacaataccgtgactaggcagtggctgtatctcaaagaaaacacatccaagtccggactcaacttgacatgcgccctccacaacgacggcatttacataatgagtcgcgatgtgaccctgagtacctcccttgagcacagagtgtttctgaaatataatatttttagtgatagttgggaagcatttcggcggttcccggcttttggtcacaatctgctggtctcaagcctgtatctgccaaacaaagctgaaacttag

SEQ ID NO: 30688 - DNA, 1785 bp, Artificial Sequence
  Description of Artificial Sequence: Synthetic coding sequence
atggtgctgagatcccaccccttcccacgccaagacaggccacaagggagcgtccctagggccgtaccaggctcccccgtggggcctagcacatctacacacagtgaggatcggcacggaccctcatcttcagtgggtacggtcatcgggaccggtactggcggactcgtcgaagccggcgggcaaccccagcctcggtcctcagaaacaaacggcagtccaagtcccgatccacctcccggactgcggggcgagggaactcgggaaaaatccctggaccctctgcctcaagccgccatgcctcggggccccgcccagccgccggcccagcggcctccgggcccagctgcatcctcttcagcacgaagatcgcagccggtgcctcagctcaggaagcgttccaggtgcgaaatcgcgcctagctccgagcaggaggtgcgacccgctgcctccggcgacccgcagggtgaagcccctggagaggggggctcccccgctggaagatccggggcattgacagagaaacaggaggaggcccgtaagcttatggtattcttacagcggcctggaggttggggcgtggttgaagggcccaggaagcccagtagcagagccttggaacccgctacggccgcggccctgcgaaggcgcttggatctgggaagctgcctggacgtactggccttcgcacaacagcacggggagcctgggctagcacaggaaacgtatgcactaatgagtgataacctgctgcgtgtgctgggcgacccttgtttataccggagactgtccgctgctgatcgggagcggattctcagcctaagaacgggcagaggaagggctgtgcttggcgtactggttctacctagtctgtaccagggaggccgttctggcctgcctcgtggaccacgcggggaggagcccccagccgctgcgcccgtctcattgcccttacctgcacacctgcacgtgttcaacccacgagaaaatacatggagacctctgacgcaagttcccgaggaagcacccctccgcgggtgcggcctgtgtactatgcataactacctctttctggccgggggaatccggggttccggcgccaaagcagtttgttctaacgaagtcttttgctataacccgctgactaatatttggagtcaggtgcgtccaatgcagcaggctcgggcccaacttaagttggtcgccttggacggcttactgtatgccattggaggggagtgcctgtactcgatggagtgttatgacccacgcactgacgcctggactcctagggccccattgccggcggggacttttcctgtggctcatgaagctgtggcatgccggggcgatatatatgtaacggggggtcatctgttctacaggcttctgagatacagtcctgtgaaggacgcatgggatgagtgcccctattccgccagccacagacggtcaagtgatatcgtcgccctgggcggattcctttatcgattcgatctcctccggggggtgggggcagcagtgatgcgttataatactgtgacaggaagctggtccagggccgcaagcctgccactcccggctcccgccccgctgcattgtactacactcggtaatacgatttactgtctgaacccacaggtaaccgcaactttcacggtgtccggagggaccgctcagttccaggccaaagagctgcagccatttcccctgggttctaccggcgtcctctcacccttcatccttacgttgcctcccgaagaccggttgcagaccagcttatag

SEQ ID NO: 30689 - DNA, 1053 bp, Artificial Sequence
  Description of Artificial Sequence: Synthetic coding sequence
atggaagtgcccaacgtgaaagactttcagtggaagaggctggccccgcttccctcccgtcgagtctattgttctctgctggagacaggcggacaggtctacgctattggggggtgtgatgacaatggagttcccatggactgctttgaagtttattccccagaagcggaccagtggaccgcccttcctagactccccactgctcgcgccggggtcgctgtgaccgccctcggtaaaagaattatggtgattgggggcgtcggaaccaatcaattgcctctgaaagtggtggaaatgtacaatatcgacgagggcaagtggaaaaagaggagcatgctgagggaagcagccatggggatatcagtgacagctaaggattacagggtctatgctgccggcgggatgggattagacctcagacctcacaatcacctccagcactacgacatgcttaaggatatgtgggtctccttggccccgatgccaacccctcgctacgctgccaccagcttcctgcgcggcagcaaaatctacgtgcttggcgggcggcaaagcaagtacgctgtgaatgcctttgaggtgtttgacattgaaactaggtcttggacaaagtttccaaacattccatataagagggctttttctagttttgtgacattggataatcacctttactctcttgggggtctgagacaaggaagactctatcgtcagcccaagtttctgagaactatggatgtttttgacatggaacagggtggatggctaaaaatggaacgtagctttttcctcaagaagcgccgggcggatttcgtcgccggtagcctcagcggaagggtgattgtcgctggcggactgggaaaccagcccacagtgttggaaaccgctgaggcttttcacccggggaagaacaagtgggagatcttaccagctatgcctacccctcgctgcgcctgttcaagcatcgttgtgaaaaattgccttctggctgtgggcggtgtaaatcaaggactgagtgacgcggtcgaggcactatgtgtgtctgactcatag

SEQ ID NO: 30690 - DNA, 1053 bp, Artificial Sequence
  Description of Artificial Sequence: Synthetic coding sequence
atggaggtgcccaacgtgaaggactttcagtggaagcgccttgctccattacccagtcgacgcgtatattgctcacttctagaaacaggcggacaggtttacgccatcggtggatgcgacgacaacggtgtgccgatggattgtttcgaggtctactctccagaagccgatcagtggacagcccttccacgactccctaccgctagagcaggggtggctgtaactgcgctcggaaagcgcatcatggtgataggcggtgtgggtacgaaccaactccctctcaaagtcgtcgagatgtataacatcgatgaggggaagtggaaaaagaggtcgatgctgcgcgaggcagctatgggaatttccgtcaccgcaaaggattatagggtttatgctgcgggtggaatgggactggacctgcggccacataaccacctgcagcactatgacatgttaaaggatatgtgggtttccctggctccgatgccgactccccggtacgctgccacttctttccttcgtggcagtaagatctacgttctggggggacgccagagcaaatatgccgtgaacgccttcgaggtgttcgatatagagaccaggtcgtggacaaagttccccaatattccctacaaacgcgcgttttcctctttcgttaccctggacaatcacctgtattcactcgggggcctccggcaggggcgcttatatagacaaccaaagttcctgagaacgatggacgtgtttgatatggaacaggggggctggctcaagatggaacgaagttttttcctcaagaagcggagagctgatttcgtggccggttctctgtctggcagggtgatcgtggccggggggctaggaaaccagcccactgtcctggaaacagccgaggcatttcatcctggcaagaacaagtgggaaatcctcccagcgatgcccactccccggtgtgcctgttcctctattgttgtgaagaactgtcttcttgccgtcgggggagtcaatcaggggttatccgatgccgtggaagccctttgtgtctccgactcctag

SEQ ID NO: 30691 - DNA, 714 bp, Artificial Sequence
  Description of Artificial Sequence: Synthetic coding sequence
atgatagcagggtgtcggtctttcagcctgcagtctgactacagggtatacgccgctggcggtatgggcctcgatctgcgccctcataatcacctgcagcactatgatatgctgaaagacatgtgggttagcctggccccgatgcctacccctcgatacgccgcaacttcattccttagagggagcaaaatctatgtcctgggaggtaggcagtctaaatacgctgtgaatgcctttgaggtgtttgacatcgaaacacggagttggacgaagttccctaatatcccatataagcgggcatttagcagcttcgtcaccctcgacaatcacctctatagcctaggaggattaaggcaagggaggctgtataggcaaccgaagttccttaggaccatggacgtgtttgatatggaacaagggggctggcttaagatggaacgcagctttttcttgaaaaagagaagagctgatttcgtggcggggtccttgtccgggcgggttatcgtcgctgggggtctgggaaaccagccaactgtgctcgaaacagccgaggcatttcatcctggcaagaacaaatgggaaattctgccagctatgcctactcctcgctgtgcatgcagttctatcgtagtgaagaattgcctgctggcggttggaggtgtgaatcaggggctttccgatgccgttgaagccctgtgcgtctcagactcttag

SEQ ID NO: 30692 - DNA, 1053 bp, Artificial Sequence
  Description of Artificial Sequence: Synthetic coding sequence
atggaagtacctaacgtgaaggattttcagtggaagcgcctcgctcccctcccgtccagaagggtgtattgctctttactggaaacaggaggtcaggtttatgccatcggggggtgtgatgacaacggcgttccaatggactgcttcgaggtgtattctccagaggccgatcaatggactgcactgccacgattgcctacggccagggccggagtcgcagtgacagcgcttggcaaacgcatcatggtgattggtggggttgggacaaaccagctgcccctgaaagtcgtggagatgtacaatatcgatgagggtaaatggaagaaacgcagtatgttacgagaagctgccatgggtatcagcgtcactgctaaggactaccgcgtctatgcagcagggggaatggggctggacctgaggcctcataaccacctacagcattatgacatgctcaaagacatgtgggtgtcattggcacccatgccaaccccccggtacgcagccacaagctttctgagaggctcaaaaatttacgtacttggaggccggcagagtaagtatgctgtgaacgcctttgaagtgttcgatatcgaaacacgatcctggactaagttcccaaatatcccgtacaagcgcgctttctcatcctttgtgactctggacaatcacctgtactcccttggtggcctgagacagggtcgcctttatcgacagcctaagttcttgaggactatggatgtatttgacatggagcagggtgggtggcttaagatggagcgtagcttcttcctgaagaagcgacgcgctgattttgtggccggctccttatcagggcgggtgattgttgcaggcggacttggaaatcagcccactgtcctcgagaccgccgaagcttttcatccagggaagaacaaatgggaaattctgcccgcgatgccaacaccccggtgtgcgtgctccagcatagtggttaaaaactgtttactggccgttggcggcgtcaaccaggggctgtcagacgccgtcgaggccctttgcgtcagtgactcctag

SEQ ID NO: 30693 - DNA, 1050 bp, Artificial Sequence
  Description of Artificial Sequence: Synthetic coding sequence
atggctgtagccgtgcccccagggagggctgctgggtcgggatgggcctggcggccggtggccagggacgccctgctggcacgcgctttccactcctgcactgaactgcgtggccgattctatttggtggggggtctactggcggggggcgctagggagcccagttccgataccgttgtgtttgatccagcgaggggacaggcagtgaggctgggggcccgcggcagccctccccgtagtcatcatgatgccgcccctgtggacggtcgctggctatgcgtcgtgggcggatgggacgggtcgaggaggttagcaacagtgaccgcattggatacggagagaggagtctgggaagcctggacagggaccccgggtgattgtccccctgctggcctttcctctcatacatgcacgagaatcagcgatcgggagcttcaagtggcaggacgtgaaggggggattcacactcaaagacgctatgggtcaatctatacactgaggctggacccatccgccaggacttactgctacaagcaagaggggtgtcacacagcttcgagaagcgggcactgcgcggccttattgcaaacgccgggcccccatcctggccatcaacttctgctgttcggggggtgcaacctcgcagagcctgaagtggcaggccattggagccatggaaaaatcaaggaggagcctcccgtcgccccccacctgatggagcagctggccaggctggtctcgtcagggcaagggtcccagaaaggaccacacggcctgcgtcaccacagctgttctgttgtggggcctttcgcagtcttatttggcggtgagacactgacaagggcacgcgacaccatttgcaacgacctgtacatctatgataccaggacttcgccccccctgtggttccactttccctgtgctgataggggcatgaaacgaatgggccaccggacatgtctatggaacgaccagctttacctggtgggcggtttcggcgaggatggtcgtactgcaagtccacaggtttgtatcctcgactttatttag

SEQ ID NO: 30694 - DNA, 867 bp, Artificial Sequence
  Description of Artificial Sequence: Synthetic coding sequence
atggcggttgcagtcccccctggtcgggctgccgggtcggggtgggcttggaggcccgtggctcgtgacgctctcctcgcccgcgccttccattcatgcacggagctgagaggaaggttttaccttgttggaggtctgttagcagggggcgcgcgagaaccttcgtccgacactgttgttttcgatcccgcacgcggccaagccgtcagactcggcgcccgcggatccccccccaggtctcatcacgacgcagcccccgtcgatggaagatggctttgtgtcgtgggaggatgggacggctctcgtaggttagcgacagtgaccgccctggacacggaacgtggcgtgtgggaagcatggactggcacacctggggactgccctccagcaggcctttcatcccatacatgcacccgaatctccgaccgcgagctgcaggtagctggcagagagggcggcatccacactcagcgacgctacggctctatctatacacttcggctcgaccccagtgcgagaacctactgctacaagcaggaaggttgtcacacagcatcgcgcagcgggcactgcgctgcattgttgcagacgcccgggcctcatcctggccaccagttactcctgttcggcggttgtaacctagccgagccggaggtggctggtcattggagccatggaaagatcaagtcttttttgtcaccccagggcggaactacatgctgttcaagcttcgacgggacagcctgcaaggcctgtgagcaatgggctggcgtgccggaaggggccccatggacaaccgctagtctgatgttctgcggtagagcactgtgttgcgctgtctggtggcgcaatagcgaccagagttag

SEQ ID NO: 30695 - DNA, 1872 bp, Artificial Sequence
  Description of Artificial Sequence: Synthetic coding sequence
atggagcatgccgttgctccttgcgtactctatcccgggactgagcccggggcagctggcgaatccgagtcggagggtgctgcgtctccggctcaaacaccatgctccttgggcgcctcgctttgtttctctagcggagaagaatctcctcctcagtctctggcctcagctgcggagggcgcggctacctctcctccgagcagcggaggtccccgcgtcgtggagaggcagtgggaagcaggatcagcaggtgcagcttcccccgaggaactcgcaagtcctgaggagcgggcctgtccggaggaaccagcggctccttctcccgagccgcgagtgtggctagaggatcctgctagcccagaagagcccggcgagcccgcccctgttccccccggttttggggctgtgtacggagaaccggacctggtcctggaggtgagtggaagacgattacgggcacacaaggctgtgctggcagcacgctctgactactttagagcccgggctagcagggatgtcctcagagtgcagggagtgagcttgactgccctacgcttgcttctagccgacgcttactccggacgcatggctggggtgagaccagacaacgtcgccgaggttgtcgcaggcgctaggcgactgcagttgcctggcgccgctcagagagcaaccgacgccgtcggtccccagctgagcctggcgaattgctacgaagtgctgagcgctgctaaaaggcaacggctgaacgagctgcgtgacgccgcatactgtttcatgagcgatcactacctggaggtcttaagagagcccgccgtattcggccgactgtcaggcgcagagcgggaccttctcctccgcaggaggcttagagccgggagggcccacttgctagccgcagctttgggaccagccggcgagagagctggctccagaccccagtcacctagcggcgatgccgacgccaggggggacgccgccgtttactgctttcatgccgccgccggcgagtggagggaactgacaagactaccagagggcgctcctgccaggggttgtggcctgtgcgtactgtataattacctgttcgttgccggcggagttgcccccgccgggcctgacggaagagcccgcccttccgaccaggtcttttgctataatcctgctaccgattcgtggagtgctgtgcgtccccttcgccaagctcgtagccagttgcggctccttgccctggatgggcacctctacgccgtcggcggggaatgtctcctatctgtggagcggtacgaccctagagctgatcgctgggcacctgtggcccctctacctcgcggtgcctttgcagtcgcacacgaggctaccacttgccacggggagatttacgtttctggcgggtccttattttacagattgctgaagtacgacccacggagagatgagtggcaggaatgcccctgtagcagctcacgcgagagaagcgccgacatggtagccctcgacggcttcatctatcggtttgatctttcaggaagtcggggcgaggcacaggctgccggccccagtggggtatctgtgagtaggtatcactgcctagctaaacagtggtcaccctgtgtggcccctctgaggctgcctggtgggcctacaggcctgcaaccgttccggtgtgcagctttggacggagcaatctactgcgtgtcacgggccggcacctggcgatttcagcctgcacgggagggagaagcgggaggtgatgcgggccagggcggagggttcgaggccctgggcgcccccctggatgtcaggggagtcttgattcccttcgcgctgagtcttcccgagaaaccaccaaggggcgaacagggagctccatag

SEQ ID NO: 30696 - DNA, 1872 bp, Artificial Sequence
  Description of Artificial Sequence: Synthetic coding sequence
atggaatgcaaaatagagggtaaggagaagtaccagcacagcctcaacctactgaataagatccagaatatgaaagaactggctgagatgattgacgtggttctgacagccgaaggagaaaagtttccctgccatagactggtcttagcagccttctctccatacttcaaggccatgtttacatgtggcctgcttgagtgcaatcagcgagaagtcattttatatgacataacagcggagagcgtgagcgtgttactaaattacatgtacaatgcagcactcgaaatcaataatgcaaacgtccaaaccgtcgccatggctgcctatttcatgcagatggaggaagtatttagcgtatgtcagaagtacatgatggatcatatggacgccagcaattgtcttggaatttactatttcgccaagcagatcggtgctgaagacctgtcagataggagcaagaagtatctgtatcaacactttgctgaggttagtctccatgaggagatactggagatcgaagtgcaccagttcctgacccttatcaagtctgatgaccttaacataagtcgtgaagagagtatccttgatctcgtactgcgctgggtcaaccacaataaggagttacgcactgtccatctggtagaactcctgaaacaggttcggctcgagctggtgaacccatcctttctacgtcaggctttgcgtcggaacactatgttgctgtgcgatgccgactgtgtagacatcattcaaaatgcttttaaagccattaaaacgcctcagcagcactcgctgaatctgagatatgggatggagaccacgtcccttctgttatgtatcggaaataattcaagtggaatcaggagccgtcatagatcatacggcgacgcgtctttttgctatgaccccgtatcacggaagacctacttcatttccagtcccaagtatggcgagggcctgggcaccgtgtgcacaggtgtggtcatggagaacaataccatcatcgttgccggggaggctagcgcgtcaaagctgtctcgccaaaaaaacaagaatgttgaaatatatcggtaccacgataggggcaatcagttctgggagaagctgtgcacagccgagttcagagagctatatgccttgggatccatccacaacgatctttatgttataggcggtcagatgaagataaagaatcaatatttgattaccaattgtgtcgacaagtactccgtggaaagggataactggaaacgggtgtcacctctgccgctgcagctcgcttgccacgcagttgtgacggtgaacaataagttgtacgtgattggagggtggaccccccagatggatctgcctgatgaagaaccagaccggctgagcaataagttgctgcagtatgatccatcgcaagaccagtggagcgttcgggcacccatgaagtattccaagtaccggtttagcactgcagtggtaaatagcgagatctatgtgcttggcggaattggctgcgtgggtcaagataagggacaggtgaggaaatgtctggacgtggtggaaatttataacccggatggggacttttggcgggaaggaccccccatgcctagccccctgctgtcactgcggactaattccactaacgccggagcagtggatggtaaactgtatgtgtgcgggggtttccatggagccgaccgccatgaggtaataagcaaagaaatcttggagctggacccctgggaaaatcagtggaacgttgttgctatcaacgtgctgatgcatgactcatatgatgtgtgtctggtggctcgcatgaacccccgggacctgatcccaccaccctccgacctcgtggaagaagggaacgaacattag

SEQ ID NO: 30697 - DNA, 1872 bp, Artificial Sequence
  Description of Artificial Sequence: Synthetic coding sequence
atggaatgtaagatcgaaggtaaagaaaagtaccagcattccctaaatctgcttaacaagatccagaatatgaaggagttagctgagatgatcgacgtggttctaacagcagaaggggagaaattcccttgtcacagactggtgctggcggcttttagtccatactttaaagcgatgttcacatgcggtttgctggagtgcaatcagcgcgaggtaatactttacgacattactgcggagagcgttagtgttctgctaaattatatgtacaatgccgccttggagatcaataatgccaacgtacagactgtcgcgatggccgcctactttatgcagatggaagaggtgttctcagtgtgccagaagtatatgatggatcacatggatgcctccaactgtctgggaatatattacttcgcaaaacaaattggcgccgaagatctgagcgaccggagcaaaaagtacctctaccagcactttgccgaagtctcacttcacgaggagatcctcgaaatcgaggttcatcagttcttaaccctcatcaagtccgacgatctcaatatatccagagaagagagtatccttgatttggttctgcgttgggtaaatcataacaaggagcttcggacagtccatctcgtggagttactgaagcaggtgcgattagaactcgtgaatccttccttcctcagacaagctctgcgccgcaatacaatgttgctctgtgatgctgattgcgtggatattatccagaacgcatttaaggctatcaaaactcctcagcagcatagtctcaacttgcgctacggcatggagaccacgagcctactgctctgcatcgggaacaactccagcggcatccgcagccgccatcgatcatacggcgacgcctccttctgttatgatccagtctctaggaagacctatttcatttcctctccgaagtacggagagggcttggggactgtctgcacgggggtggtcatggagaataacaccattattgtggctggggaggcatccgcctccaaattgagtagacagaagaataaaaatgtggaaatctataggtaccacgacagagggaaccagttttgggagaaactgtgtaccgccgaattccgggagctctacgccctcgggtccatccacaatgatctgtacgtgatcgggggacaaatgaagattaaaaaccagtacctgattacaaattgcgtggataaatacagtgtggaacgggataactggaaacgcgtgagcccgctccccttacagcttgcctgtcatgccgtggtgacagtaaataacaaactgtacgtcatcggcggctggacaccccagatggacctgccagatgaggaacctgatcgcctgagcaacaagctcctgcagtacgatccctcacaggaccagtggtctgtcagggctccaatgaaatattcaaaatatcgcttttccacagctgtggttaattctgaaatttacgtactgggcggtatcggttgcgttggccaagacaaagggcaggttagaaagtgcctagatgtggtcgaaatttacaacccagacggtgatttctggcgagaggggccacccatgccttctcccctactgtcccttaggactaattcaacgaatgcaggcgccgttgacggaaagttgtacgtatgcggtggctttcatggcgccgaccgccatgaggttattagcaaagaaatcctggagctggatccttgggagaatcagtggaatgtagttgcgatcaacgtcctaatgcatgactcgtacgatgtctgtctagtggctcggatgaatccacgggacctgattcctccgcccagtgacctggttgaggaagggaatgaacactag

SEQ ID NO: 30698 - DNA, 1872 bp, Artificial Sequence
  Description of Artificial Sequence: Synthetic coding sequence
atgagtacgcaggatgagaggcagataaataccgaatatgccgtgtcattattggagcagctcaagctcttttatgaacaacaactgttcaccgatattgtattgattgtggaaggaaccgagttcccctgccataagatggtcctggcaacttgttcaagttactttagagcaatgtttatgtctggtctgagcgagtccaagcagacccacgttcacctaaggaatgtggacgctgcaactctccagatcatcataacgtacgcttacaccggcaacctcgcaatgaatgattctaccgtggaacagctatacgagaccgcatgttttctgcaagtcgaggacgtgctccaaagatgtcgagagtaccttatcaagaaaatcaacgcggagaattgcgtcagacttttaagctttgccgatctattttcatgtgaagaactcaagcagagcgcaaagagaatggtggaacacaagttcacagccgtgtatcaccaggacgccttcatgcagctgtcgcatgatcttttgatcgacattctgagttctgataacttaaacgtggaaaaggaagaaacagtccgagaagccgccatgttgtggctcgaatacaataccgagagtaggagccagtacctatccagtgtcctctcccagatccgaattgatgccttgtccgaagtgacccaacgtgcatggttccaggggcttccacccaatgacaagtctgtagtcgtacagggcctgtacaagagtatgcccaaattttttaagcccagactcggcatgacaaaggaggagatgatgatttttattgaggcatcatccgagaacccctgcagtctgtactcatcagtatgctattccccacaggcggagaaggtgtacaagttatgcagtccacccgctgacctgcataaagtgggcactgtggtgacaccagacaacgatatctacattgcaggtggtcaggtacctctcaagaataccaagacaaatcactccaagacatctaagctacagaccgcattcaggactgttaattgcttttactggttcgacgctcaacaaaacacatggttccctaagactccgatgctctttgtgcgtatcaagcctagtctggtgtgttgtgagggctacatatatgccatcggtggtgattcagttgggggtgaactgaaccggaggaccgtggagcgctacgataccgagaaagacgagtggactatggtctctcctctgccatgcgcttggcaatggtccgcagctgtagtcgtccatgactgtatctacgtaatgacactgaatctgatgtattgctatttccccagaagcgacagctgggtcgagatggctatgcgccagaccagtcggagtttcgccagcgccgccgcttttggagataaaattttctacatcggcgggctccacattgcgaccaactcaggcataagactgccaagcggtaccgtggatgggtcttcagtgactgtggagatctacgacgtcaacaaaaacgagtggaaaatggccgcgaatattcccgcaaagcgatatagtgatccatgcgtgagggccgtcgtcattagcaacagcctgtgcgtttttatgcgcgagacacacctgaacgagcgtgccaaatatgtgacataccagtatgacctggaactcgataggtggagcctgagacagcacatttctgagagagtactgtgggacttgggacgagacttccggtgcaccgtaggtaaactctatcctagctgcctcgaggagtccccttggaaacctcccacctacctgtttagtacggacgggacggaagagttcgagctggacggggaaatggtcgcgctgccacctgtgtag

SEQ ID NO: 30699 - DNA, 45 bp, Artificial Sequence
  Description of Artificial Sequence: Synthetic coding sequence
atgagtacccaggacgaaaggcaaattaatactgagtatgcctag

SEQ ID NO: 30700 - DNA, 15 bp, Artificial Sequence
  Description of Artificial Sequence: Synthetic coding sequence
atgtccacccagtag

SEQ ID NO: 30701 - DNA, 147 bp, Artificial Sequence
  Description of Artificial Sequence: Synthetic coding sequence
atgagtacacaggatgagcgccaaatcaatactgagtacgctgtcagcttgctagaacaactcaaacttttttatgagcagcaattgttcactgacatagttctgattgttgaagggacggaatttccttgccacaaaatggtctag

SEQ ID NO: 30702 - DNA, 90 bp, Artificial Sequence
  Description of Artificial Sequence: Synthetic coding sequence
atgtctacacaggatgagaggcagattaacacggaatacgcagtgagcctgctagaacagcttaagttgttttatgagcagcagctgtag

SEQ ID NO: 30703 - DNA, 1050 bp, Artificial Sequence
  Description of Artificial Sequence: Synthetic coding sequence
gtgagagaggccgctatgctctggctggaatacaacaccgagtcccggtcccagtacctgagctcggtgctcagccaaatcagaattgatgccctgtctgaagtgacacaacgcgcctggtttcagggcctaccccccaatgataagtcagttgtggtccagggactctacaaaagtatgcctaaattcttcaagccccgtcttggtatgaccaaagaagaaatgatgatctttatcgaggcctcatctgaaaatccttgctcgctgtattcttccgtctgttactcccctcaggccgagaaggtatacaagctgtgctctccacccgcagatctccacaaagtcgggaccgttgttaccccagacaatgatatttacattgctggaggccaggtaccattgaagaacaccaagaccaaccatagcaagactagtaagcttcaaactctgcagaactgcgagttactcctgttggacgcccagcagaataccagtaaagatcccaatgctttctgcccccacaaggctatcttctgctgtgagggatatatttatgcaatcggcggcgactccgtaggaggcgaactcaacaggcgtacagtcgagcgatatgataccgaaaaagacgaatggacgatggtgtcacctctcccttgcgcatggcagtggagcgcagcagtggtggttcatgactgcatttacgtgatgacacttaatctgatgtattgctactttccaagaagcgattcatgggtcgaaatggccatgcggcagacgtctaggagtttcgcctccgcagccgcattcggtgacaaaatattttacatcgggggcctccacattgcgactaactctggcattcggctcccctcggggaccgttgacgggtctagtgtcaccgtcgaaatctacgatgtcaataagaatgaatggaaaatggccgccaacatacccgctaaacgctactctgacccttgcgttagggccgtggtgatttcaaattcactgtgcgtgttcatgcgtgagacgcatctgaatgagcgggcttag

SEQ ID NO: 30704 - DNA, 1839 bp, Artificial Sequence
  Description of Artificial Sequence: Synthetic coding sequence
atggagttggccatggataactcttacgcctttaaccagagaagtacttgcaatgggatcccttcagaaaaaaagaataatttcttggtgagcgaggaccacggccaaaagatccttagcgtgctacagaatttccgggaacagaatgtcttttacgacttcaaaattatcatgaaggatgaaattatcccctgccaccggtgcgtattagcagcttgtagcgacttttttcgggctatgtttgaggttaacatgaaagaaagggatgacggctctgttactatcacgaacctgtcatccaaagccgttaaggccttcctggactatgcatacactgggaagacaaagattaccgatgataatgtcgaaatgttctttcagctcagcagttttcttcaggtgtccttcctgtcaaaggcgtgttctgatttccttatcaaaagcatcaatctcgtgaattgtttgcagctcctatccatctctgatagttacggatctacctcattgttcgatcacgcgctgcacttcgtgcagcatcacttcagtctgctgttcaagtcaagtgatttcctcgagatgaattttggggtgctgcagaaatgccttgaaagcgacgagctaaatgtgccggaagaggaaatggtgcttaaggttgtcctctcgtggacaaagcataacctggagtcaaggcagaaataccttccacatcttattgaaaaagtccggctccaccaactgtcggaggaaacgttgcaggactgtctctttaacgaagaaagcctgctcaagtctactaactgctttgatattattatggatgcaatcaagtgtgtgcagggcagcgggggactcttcccagatgcacgaccgtccacaacagaaaagtatatatttatccacaagacagaggagaacggcgaaaatcagtataccttctgttacaacataaagagtgactcatggaaaattctcccacagtctcatctaatagacctcccaggctcctctctgagctcctatggggagaaaatcttcctgaccggcggctgtaaaggaaaatgctgtagaactgtccgcctgcacatcgcggaaagttatcacgatgccaccgaccagacatggtgctactgtcctgttaagaacgactttttcctcgtgagcacaatgaagacccctaggaccatgcatacgtccgtgatggcgttggatagattgtttgtgatcggcggtaaaacccgcggctctcgggatataaagtccctgttggacgtggagtcgtacaatcccttgagcaaagagtggatcagtgtgtctcccctgccccgcggcatctattaccccgaggcctctacatgccagaatgtgatctatgtgctggggtccgaagttgagatcacagacgcttttaaccccagtcttgattgcttcttcaaatacaacgccactaccgatcagtggtccgagcttgtagcagagtttggccagttttttcatgccaccctgattaaggccgtgcccgtcaattgcaccctgtacatctgtgacctttctacatacaaagtctacagtttttgccccgatacctgcgtctggaagggcgaaggtagcttcgaatgtgctggctttaatgccggcgcgatcggcatagaggacaagatttacatcctgggcggtgattatgcacctgacgagatcactgatgaggtccaggtgtatcacagtaaccggagcgaatgggaagaggtctctccaatgcccagggcactgacagagttctactgtcaggtcatccaattcaataagtaccgcgacccctggtttagcaacctatgcgcctag

SEQ ID NO: 30705 - DNA, 1839 bp, Artificial Sequence
  Description of Artificial Sequence: Synthetic coding sequence
atggagctcgccatggacaacagttacgctttcaaccagcggagtacttgcaacgggatcccaagtgagaagaaaaacaatttcctggtgtctgaggaccatggccagaaaatcctgtcagtgttgcagaactttagggaacaaaacgtgttttacgatttcaaaatcattatgaaggacgagatcatcccttgccacaggtgtgttctggcagcctgttctgactttttccgtgcaatgtttgaggtaaacatgaaggaaagggatgacggctctgtaacaataacgaacctgagcagtaaagctgttaaagccttcctggattatgcctataccggaaagaccaagattaccgacgataacgtggaaatgtttttccaactgagctcttttctgcaggtttcgttcctgagtaaagcctgctctgacttcctgatcaagtccatcaatctggtgaactgtctccaacttctgagtatcagtgacagttatgggtcgacctccctcttcgatcacgcgctgcatttcgttcagcatcatttcagtctgttgttcaaatcttccgacttcctggagatgaattttggagtgctgcagaagtgtctggagtctgacgaactcaacgtacccgaggaagagatggtgttgaaagttgttctctcctggactaagcacaacctcgagtccagacagaagtatttaccgcacctcattgaaaaagttcgccttcaccagctcagtgaagagactctgcaggactgtttgttcaatgaagagtccttgttaaagagcactaactgcttcgatatcattatggacgctataaagtgtgtgcaggggtctggcgggctctttcccgatgccaggcctagcacaacagagaagtatatctttatccacaagaccgaggagaatggtgagaatcaatataccttctgttacaacattaagtccgacagttggaagattctgcctcagtcacacctgattgatcttccagggagttcactgtcttcctacggtgagaagattttcttaaccggcggatgtaaaggcaaatgctgcaggaccgtgagacttcatatcgcggagtcttaccacgacgccacggatcagacttggtgttactgccccgtaaaaaacgacttcttccttgttagcacgatgaaaacccctcggactatgcatacttccgtcatggctctagatagactgttcgtgatcggcggcaagacccggggctcccgggacatcaagagcttactggacgtcgagtcatacaacccgctatctaaggagtggatcagcgtgagtcctctgcccaggggaatctattatcccgaagctagcacatgtcagaatgtcatctacgtccttggatctgaggtcgaaattactgatgccttcaatccgagcctggattgcttcttcaagtacaacgccactactgaccaatggagcgaactggttgccgagttcgggcagttctttcatgctaccctgatcaaggccgtccctgttaactgcacactatacatctgcgatctatccacctacaaagtgtattccttctgtcccgacacctgtgtgtggaagggggagggatcctttgagtgtgctggattcaacgctggggcgatcggtatcgaggataaaatctacatcttaggcggcgactatgctcccgatgagatcaccgatgaagtccaagtgtatcactccaatcgctcagagtgggaggaggtatctcccatgcctcgtgctctgacagaattttactgccaggtgatccagttcaataagtatcgagacccatggttctctaacttgtgtgcttag

SEQ ID NO: 30706 - DNA, 957 bp, Artificial Sequence
  Description of Artificial Sequence: Synthetic coding sequence
atgaagggtggcaatgcggactcctggcagcgagagaaactcgcttccatggagagcccagaagaacccggggcatccatggatgagaattacttcgtaaactatacctttaaagatagaagccattccggcagggttgcccagggtattatgaaattgtgtcttgaggaggagctttttgccgatgttacaatctctgttgaaggaagagagttccagctccacagactggtgctgagcgcacagtcttgtttctttaggtccatgttcacatccaatttaaaagaggcacacaatagggtaatcgttcttcaggacgtctctgagtcagtatttcagctgctggtggactatatctatcacggaactgtgaaactgcgagcggaagagctccaggaaatctacgaagtttccgatatgtatcagttgacttcattgttcaacgctctgggcttttggcctgctcagtgcaaatgggagacagctttccgcgccgatagacatagtgattcttctatcagactgccatcgtgcgcaaaaactcacctggcccaattgcagaatacggaggagttcctccacctgcctcatagactgctcacagacattattagcgatggcgtgccctgttctcaaaaccctactgaggccatagaggcctggatcaatttcaacaaagaagaacgagaggcatttgccgaatcactgaggacatctctgaaggaaattggggaaaatgtgcacatatatctgatagggaaggaaagttcccgcacccacagcctagcagtttccctccactgtgcggaggatgactccatctcagtgagcggacagaactcgctgtgccaccagattacagcagcctgcaagcatggaggagacctctacgtcgtgggtggctctatccctcggagaatgtggaaatgtaataacgctactgtggactgggaatag

SEQ ID NO: 30707 - DNA, 1557 bp, Artificial Sequence
  Description of Artificial Sequence: Synthetic coding sequence
atggagtctcccgaagagcctggggctagcatggacgaaaactatttcgtcaactataccttcaaggataggagtcactccggtcgtgtggctcaaggcatcatgaaactgtgcttagaagaggagctctttgccgatgtgacaatttccgtcgagggaagagagtttcagctccatcgccttgtgctgtcagctcaaagctgcttctttaggagtatgtttacgtctaacctcaaagaagcccataacagagtgattgtacttcaagatgttagtgagtccgtgtttcagctgcttgtcgattacatctatcacggcacggtgaagctcagagccgaagagctgcaagagatctacgaggtatctgatatgtaccagctgaccagcttgtttgaggaatgttccagatttttggcacgaactgtccaggtgggcaactgtctccaggtcatgtggcttgccgacagacacagcgaccccgagctctataccgccgcaaaacactgcgctaaaacccacctcgcccagctccaaaacactgaagagttcttacatctaccacacaggctccttaccgatataatcagcgatggagttccctgtagtcaaaatcctactgaggccatcgaggcgtggatcaattttaataaagaggagcgcgaggccttcgctgagtcactgcgcacatctctgaaggagattggagagaatgttcacatttatctcattggcaaggagtcatccaggactcacagccttgccgtctcactgcactgtgctgaagacgattcaattagtgtgagtggacagaatagtctctgtcatcaaattaccgcagcctgtaagcatggcggtgacctgtatgtggtgggaggaagtatccccaggcgcatgtggaaatgcaataacgctaccgttgactgggagtggtgtgcccccctgcctcgagatcgtctgcagcacacccttgtcagtgtacccgggaaagatgctatctacagcctcggcggtaagacattgcaagatacattgtcaaacgctgtgatttactacagagtgggcgacaatgtgtggacagaaactacccaactggaggtggcagttagtggggccgccggcgccaatctgaatggcatcatatatctgctgggtggagaagagaacgacttagattttttcaccaagccttcaaggcttattcagtgtttcgatacggagacagataaatgtcatgtgaaaccctacgtgttaccattcgctggcagaatgcacgccgccgtccataaagacctggtgtttatagtagccgagggcgactcgttggtatgttacaatccattactcgattcatttacccgactctgcctgcctgaggcttggtcttccgctccaagcctgtggaaaatcgcctcctgcaatggctcaatttacgtgtttagggatcgctataaaaagggggacgcgaatacctataagctggatccggctacaagtgcagtgacggtcactagaggcatcaaggtgctcctgacaaatctccagtttgtgctcgcttag

SEQ ID NO: 30708 - DNA, 1605 bp, Artificial Sequence
  Description of Artificial Sequence: Synthetic coding sequence
atgaagggcggtaatgctgactcttggcagagagagaagctcgccagtatggagagccccgaggaaccgggagcttccatggacgaaaattatttcgtcaactacacctttaaggatcgctctcattctgggcgggtcgcccaagggatcatgaagctgtgtcttgaggaggaactgttcgctgacgtgaccattagtgtcgagggtagagaatttcaactccaccgcctggtcctgtctgcccagagctgcttttttcgcagcatgttcaccagcaacctgaaagaagcacacaatcgtgtgatcgttctgcaggacgtttccgaatcggtgttccagttgctcgtggactacatctatcacggtaccgtcaaacttcgggcggaagagctccaagaaatttacgaggtgtccgatatgtaccagctgacatccctgtttgaggagtgttccagatttctggccaggaccgttcaggttgggaactgcctgcaagttatgtggctcgcggaccgacattctgatcctgaattatatactgcagcgaagcactgtgccaaaacgcacttggcccaactccagaatacagaggagttcctacatctccctcatagactgctgacagatataatttctgacggcgtcccttgttcacagaatcctacggaggctatcgaggcttggatcaacttcaataaagaggagcgggaggcatttgcagagagcctgaggaccagcttaaaggagataggggaaaatgtccacatttatctgatcggcaaagagagctctcgcacacactccctagcggtttccttgcattgtgctgaggacgattcgatctcggtttctggccagaattcactctgtcaccagatcactgctgcttgtaaacatgggggcgatttgtacgtagtgggagggtctatcccccggcgtatgtggaagtgtaataacgcaaccgttgactgggagtggtgtgcacccctcccacgcgaccggttgcaacacaccctggtatctgttcccggaaaagatgcgatatacagcctgggcgggaaaacccttcaggacacattgagtaatgcagtgatctactacagagttggtgataatgtctggaccgaaactacccagctggaagtcgcagtctctggggctgcaggtgcaaacctgaatggaatcatctacctgctaggcggggaagagaatgatttagactttttcacaaaaccaagtcgtctcatacagtgtttcgacaccgagactgataaatgccacgttaaaccgtacgtattgcccttcgctgggcggatgcatgctgcagtccacaaagacctcgtgttcattgttgctgaaggagactcattagtctgctacaatcccctgttggattcctttactcgactgtgcctgcctgaagcgtggtcttccgcaccctctctttggaagattgcatcttgcaacggttccatctacgtgttcagggatcgctacaagaagggtgatgcgaatacttataagctggatcccgcaacatccgccgtgactgtgacccgcggtattaaggttctgctgaccaatctccagtttgtgcttgcctag

SEQ ID NO: 30709 - DNA, 1866 bp, Artificial Sequence
  Description of Artificial Sequence: Synthetic coding sequence
atggctctggggttggagcaagcagaggaacagcgactctaccagcagactctccttcaagatgggcttaaagacatgcttgaccacggcaaatttcttgactgcgtggtacgcgccggagagcgcgagtttccctgccatcggttagttttggcagcctgcagtccctattttagggccaggttcctggcagagccggaacgagctggagaactacatttagaagaggtatcaccagacgtggtagcccaggtgctgcactacttgtacacaagcgagattgctcttgacgaggcttccgttcaggatcttttcgccgccgctcaccgtttccagattccttccatttttacaatttgcgtgtcatttctacagaagagactgtgcctcagcaattgtctggccgtctttcgcctgggactgctgctggattgcgccaggttggccgttgccgcacgggactttatttgcgcacacttcaccctggtggcacgagacgcagatttcctcggactaagcgcggatgagcttatcgccatcatcagttccgacggacttaatgtggaaaaagaggaggcggtcttcgaggcagttatgaggtgggcaggttcgggtgacgcggaagctcaagcagagaggcaaagggccctgccaactgtatttgagtcggtgaggtgtcgcctgctgccaagggcctttctcgaatctcgtgtggagcgccatccactcgtgagggcacagcctgaactgctccgtaaggtacagatggtcaaggatgcccatgaggggcgcattactactctgcggaagaaaaaaaagggcaaggacggcgccggcgccaaggaggctgacaagggcactagtaaggcaaaggccgaagaagatgaggaagccgagcgcatcctccccgggatccttaacgatactctccgctttggaatgtttctgcaagatctaatctttatgatttccgaagagggcgccgtagcgtatgatcctgctgctaatgagtgctactgcgccagcctgagtaaccaggtgccaaaaaatcatgtgagtttagtaacaaaggaaaaccaggtgttcgtggcaggaggcctgttctataatgaagataataaggaagacccaatgagcgcctattttctacagttcgaccatctcgacagtgagtggttaggtatgcctcctctcccatccccccgctgcctgttcggcctcggtgaggccttgaattcaatctatgtggtcgggggtcgggagataaaggacggcgagagatgtctagattcagtcatgtgttatgaccgactctccttcaagtggggtgaaagcgatcccctcccctatgtcgtgtacgggcacactgtgctgtcacacatggatctggtatacgtaatcgggggaaagggctccgacagaaagtgcctgaataaaatgtgtgtgtacgatccaaaaaagttcgaatggaaagagctcgcccctatgcagaccgctcgctccttgttcggagcgaccgtccatgatggccggatcattgtcgctgcaggcgtcacagatacaggtctgacctctagcgcagaagtttacagcattaccgataacaagtgggcaccctttgaggcctttccacaggagagatcttcgctgagcctggtgtccctggtgggaacgctgtatgccatcgggggattcgcaacgctcgagacggagagtggggagctggtgcctacagaactgaatgatatatggagatacaatgaagaagaaaagaaatgggaaggtgttctccgggagatcgcttatgctgcaggggccaccttccttccagtccgcctgaacgtgctttgcctgactaagatgtag

SEQ ID NO: 30710 - DNA, 1101 bp, Artificial Sequence
  Description of Artificial Sequence: Synthetic coding sequence
atggtgaaggacgcgcacgagggtcgtatcaccactctgcggaagaagaagaagggtaaagatggtgccggggccaaggaggccgataagggtacctcaaaagccaaagcagaggaagatgaggaggcagaacgcatcctccccggcatcctcaacgatactcttagattcggtatgtttttacaggacctgattttcatgatttctgaggaaggagcagtggcatatgatcccgcggctaatgaatgctactgcgcgagcctaagtaatcaggttcccaaaaatcacgtgtcactggtcacaaaggagaatcaggtcttcgtggccgggggactgttttataacgaagacaacaaagaagacccgatgtctgcctacttcttgcagtttgatcatctggattcggagtggctggggatgcctccactgccctccccacgatgtctattcggtctgggcgaggccctcaattccatttacgtggtgggaggccgggagattaaagacggcgagcggtgtttggatagcgtgatgtgttacgatcggctgtcattcaaatggggagagtctgatccactgccatacgtggtctacggtcacactgtgctgtcccacatggaccttgtatacgtcattggcgggaagggatccgaccggaaatgcttaaataaaatgtgcgtatacgaccccaaaaaatttgagtggaaagagcttgcacccatgcaaacagcacggagtctcttcggagctaccgtacatgatggccgcatcatagttgctgctggggtgaccgacaccgggctgacttccagcgccgaggtatattctataacggacaataagtgggcaccttttgaggccttcccccaagaaaggtccagcctctcactggtgtccctcgtggggaccttgtatgcaatcggcggtttcgctacactggagacagagtcgggtgaactggtgccaaccgaactgaacgacatttggaggtataacgaggaagaaaagaaatgggagggcgttttacgtgaaattgcttacgctgctggcgccacttttcttcccgtgcgcctgaacgtcctctgtctaactaagatgtag

SEQ ID NO: 30711 - DNA, 2025 bp, Artificial Sequence
  Description of Artificial Sequence: Synthetic coding sequence
atgcaatcgagggaggacgcaccgagatctagaaggctggcctcccccaggggcggaaaaagaccaaagaaaattcataagcctaccgtctcagcattctttaccgggcctgaggaactgaaggataccgcgcacagtgcagcattattagcccagctcaaatcgttttacgatgcccggctgctgtgcgacgtcaccatagaagtggtgactcctggcagcggaccaggcactggcagactgtttccttgcaataggaacgtgctggccgccgcttgcccttactttaaatccatgtttacaggcggcatgtatgagagccagcaggcgagtgttactatgcacgacgttgacgccgaaagctttgaagtgctggtcgattactgctacaccggccgagtgagtctctccgaggctaacgtagaacggctgtatgctgcttctgatatgctgcaactggagtacgtgagggaggcttgtgctagtttcctagcccgacgtctggacctgacaaactgcaccgccatcctgaagttcgccgatgcctttggacaccgaaagttacgttcccaagcccaaagttatatcgcccagaatttcaaacagttgtcccacatgggttcaatcagagaagagacccttgctgacctgacattagcccagctgctggctgtcctgcgcctcgattcactggacgtggagtcagagcaaacggtctgtcacgtcgctgtccagtggcttgaagccgcacccaaagaaaggggaccctcagcagccgaagttttcaaatgtgtgcgctggatgcactttacagaggaggaccaagactacttggaggggctcctgactaagcccatagtaaaaaagtactgcctggacgtgatcgagggagcactgcagatgcgatacggggatcttctgtataaaagcctagtacccgtccctaatagttcatcttcctcatcttcctctaattccctggtgtctgctgccgaaaatccaccccaacgactgggaatgtgcgccaaagagatggtaatctttttcggacatcctcgagatcctttcctctgttgcgatccctattccggagacctatacaaggttccctcccctctgacctgcctcgctcatacccgtactgtgacaacattggccgtgtgcataagccccgatcacgacatctaccttgctgctcagcctcgcaccgatttgtgggtatataagccagcacaaaattcctggcagcagcttgctgaccggctgttgtgccgagagggcatggacgtggcttatcttaacggttacatttatatactgggcggaagagatccaattacaggagttaagctgaaagaggtcgagtgttataacgtgaaacgcaatcagtgggccttagtggcccctctgccgcatagttttctgagctttgacctcatggtcatcagagattatctgtacgctctgaactctaaaaggatgttttgttacgacccgtcacacaatatgtggctgaaatgtgttagcctgaaacggaacgactttcaggaagcgtgtgtttttaatgaagagatctactgtatctgtgatatcccagttatgaaggtctataatcccgtccgcgccgaatggagacaaatgaacaacatccccctcgtcagcgaaaccaataattatcggataatcaagcacggccagaaacttcttctgatcacttcccggacacctcaatggaagaaaaatagagtgaccgtttatgaatatgacatcagaggagaccaatggattaatatcggaactacactggggcttctgcagtttgacagcaactttttctgcttgagtgcgcgagtttacccaagctgtctggagccaggccaatcctttctgaccgaggaggaggagatcccttctgaatcctctacagaatgggatttgggtggatttagcgagcccgattctgagtctggcagttcctcttccttgagtgacgacgacttttgggtgcgtgtggctccccagtag

SEQ ID NO: 30712 - DNA, 1827 bp, Artificial Sequence
  Description of Artificial Sequence: Synthetic coding sequence
atgcaatctagggaggacgctccccggtcaagaagactggcctccccaagaggcggcaagcgccccaagaaaatccacaagcccacggtcagtgcatttttcaccggaccggaggaactgaaggataccgcctcagttaccatgcacgatgtagatgctgagtcttttgaagttctagtagactactgctacacaggtagagtctctctctctgaagccaacgttgaaagactgtacgctgctagtgacatgttgcaactggagtacgtgagggaggcttgcgcttcattcctcgcaaggcggcttgacctgaccaactgtacggcaatccttaagttcgccgacgcctttgggcatcgaaaattgcgcagtcaggcccagtcctatattgcacagaattttaagcaattatcccatatgggctccatccgggaggaaactctggctgacctcacgttagcgcagctgttggccgtcctgagattagactcgctcgacgtagaaagcgagcagaccgtgtgccacgtggcagtccagtggctggaggccgcacctaaagaacgtggacctagtgcagcagaggtgttcaaatgcgttcgatggatgcatttcaccgaagaggaccaggactatctggaagggctgctgactaagccgattgtgaagaagtattgcctggatgttattgaaggagccctgcagatgaggtatggggatctgctctataagtctctagttccagtccctaactcatccagcagctcatcctccagcaattcactcgtgagcgcagctgagaaccccccacaacggttaggaatgtgcgccaaagagatggtaatcttttttggtcaccctagagacccatttctctgttgtgatccatactcgggcgacctttacaaggtccctagtccactgacctgtctggcgcacaccaggacagtgaccaccctagctgtctgtatcagccctgaccatgacatctacctggccgcacagccacggaccgatttgtgggtgtataagcctgcacaaaatagttggcagcagctggccgatagattgctgtgtagagaaggtatggacgtagcctatctgaacggatatatctacatattggggggccgcgatcctattacaggcgtcaagcttaaagaagtcgagtgttacaatgtaaagaggaatcagtgggctttggtcgccccgctgccccattcatttttgagcttcgatctcatggtcattagagactacctgtacgcactgaattccaaaaggatgttttgctacgacccgagccacaatatgtggctgaaatgcgtgagtcttaagcgcaacgactttcaggaagcgtgcgtgttcaacgaagaaatctactgtatatgcgatatacccgtgatgaaggtgtataacccagtgcgagcagaatggaggcagatgaacaacataccgctggtttctgagacaaacaattaccgaattatcaagcacggtcagaaactattgctgattacttcccgtaccccacagtggaaaaagaatagggtaaccgtgtacgagtacgacatccgtggcgaccagtggattaacatcggcacaaccttgggactattgcagtttgatagtaactttttttgcttgagcgctcgggtgtaccctagttgtctagagccgggacagtcctttttgacagaagaagaggagattccatctgagtctagcaccgaatgggacctggggggatttagcgagccagactctgagtccgggtcgtcaagtagcctgtctgatgatgatttctgggtcagggttgccccccaatag

SEQ ID NO: 30713 - DNA, 2055 bp, Artificial Sequence
  Description of Artificial Sequence: Synthetic coding sequence
atgcagagcagagaggacgtgccccggtctaggaggcttgcgtcacctcgtggcgggaggagacctaagcggatcagcaagccgtcagtaagtgctttctttaccggaccagaagagttaaaagatactgcccacagcgcagcacttctggcccagttgaagagcttttatgatgcccgcctgctctgtgacgtgaccatcgaagtggtcacacctggatcggggcccggtacgggtcgcctgtttagctgtaataggaacgtgctggcagctgcctgtccgtattttaaatccatgtttaccggtggcatgtacgaatctcaacaggctagcgttaccatgcatgacgtggatgccgaatcttttgaggttctcgtggattactgttatacagggcgggttagtctgtccgaggcaaacgtgcagcgcctgtacgcagctagcgacatgctccagctagaatacgtgagagaggcctgtgcctccttcctggcacggaggttagacctgacaaattgtacagcgatccttaagttcgccgacgcttttgaccaccataaactccgctcccaagcccagtcttacatcgcccacaactttaagcagctgagccgcatggggagcattcgggaagagactctggcagatctgacactcgcgcagctcctggctgtcctccgcctcgacagtctggatatcgagtccgaacgaaccgtgtgccatgtggcagtgcagtggctcgaggccgcagccaaagagaggggcccttctgctgctgaggttttcaaatgtgttaggtggatgcactttacagaagaggaccaggactatctcgagggactcctgactaagccaatagtaaagaagtattgtctggatgtaatcgagggtgcgttgcagatgcggtatggtgatctgctttacaagtcactcgtgcctgtgccaaattcttcctcttccagcagttctagcaacagccttgtctctgctgcagaaaacccgccacagcgattggggatgtgcgcaaaggaaatggtgatcttctttggacaccctagagatcccttcctctgttatgatccctatagtggcgacatctatacaatgccctcccccttgacctctttcgcacacaccaagacggtgacatccagtgcagtctgtgtttcaccagaccacgatatatatctggctgctcagccaaggaaggacctgtgggtctacaaacccgcgcagaatagttggcagcagctggctgataggctgctgtgtagggagggcatggatgtggcgtatttaaacggctatatttatatcctcggggggagagatccaatcacaggtgtaaaactcaaggaagtggaatgttattctgtccaacggaaccagtgggcactggtagcccccgtgccccactccttttattcttttgagctcatagtcgtgcagaactatctttatgccgtcaactcgaagcggatgctgtgctacgaccccagtcacaatatgtggttgaattgtgcgtccctgaaacgttcggattttcaagaggcgtgcgtatttaatgatgaaatctactgcatctgcgacattcccgtcatgaaagtatataatcctgcaagaggagagtggagaagaatctcgaatataccactggacagcgaaacccataattaccagattgttaaccacgatcagaagctgctgttaattacaagcaccacaccacagtggaagaaaaatcgggtgactgtctacgagtacgacactcgagaagatcaatggattaacattggtacgatgctgggtctcctccagttcgattccggatttatctgtctgtgcgcacgagtctatccctcctgcctggagcccgggcagtctttcattacagaagaggatgacgcaaggagcgagagttccacagagtgggacctggatggcttctcagaactggattctgaatcaggctccagctcctccttcagtgatgatgaggtgtgggtgcaggtggccccacagcgcaacgcccaggaccaacaggggtcactctag

SEQ ID NO: 30714 - DNA, 1761 bp, Artificial Sequence
  Description of Artificial Sequence: Synthetic coding sequence
atgtttacagggggcatgtatgagagccagcaagccagtgtgaccatgcacgacgttgacgctgagtcctttgaggtcctggtggattattgctacaccggacgagtctccctgagcgaggctaatgtgcagcgcttgtacgctgctagcgacatgctccagttggagtacgtgcgggaagcgtgtgccagctttctggctagaagactggatctcactaattgcacggcaattttgaagtttgcagacgccttcgatcaccacaagctgaggagtcaggcgcagtcctacattgctcataacttcaagcagctatcaagaatgggaagtatccgggaggagactttggcagacctcacgctagcccagctcctagcagtgcttagactagactctttggatattgaatccgagagaactgtgtgccacgttgcagtgcagtggctagaggcagctgccaaagagcgcggtccgagcgcggccgaggtgttcaagtgcgtacggtggatgcacttcactgaagaggaccaggattacctagaggggcttctcacaaagccaatagtgaaaaaatactgcttggatgtcattgagggcgcactgcagatgcgttatggcgatctgttatacaagagcctcgttcctgttcctaacagttcaagtagttcctcctcctccaatagccttgtgtccgccgccgagaaccccccccaacgattgggtatgtgcgctaaagaaatggtgatcttttttggtcacccacgagaccccttcctctgctatgacccatactctggcgatatatataccatgccctctccactgaccagcttcgcgcacaccaaaaccgtaacctctagtgccgtgtgtgttagccccgaccatgacatatatttggcagcacaacctagaaaagacttgtgggtgtataagccggcacagaattcatggcagcagctggcagatcgtttgctgtgtcgcgagggcatggacgtagcctacttgaacggctacatttacattctgggtggaagggaccccatcacaggggtcaaattaaaggaggttgaatgctattccgttcagcgcaaccagtgggccctggtggcaccagtaccccactccttctactcttttgagcttattgtggtccagaattacttatatgccgtgaatagcaagcggatgctgtgttacgacccaagtcacaacatgtggctgaattgcgcgagcttgaagcggtcagactttcaggaagcatgtgtgtttaatgatgagatctactgcatttgcgatattccagtcatgaaggtgtacaacccagcccggggggagtggcgtcgtatttccaatattccccttgattctgagacccataattatcagatagtgaaccacgatcagaaactattgctgattacctcaacaacaccccagtggaagaaaaacagggtgactgtctatgagtatgataccagggaggaccagtggatcaatatcgggaccatgctgggcctgctacaatttgattcaggattcatttgtttgtgtgcccgggtctaccctagttgcctagaacccgggcagtccttcatcaccgaggaggatgacgctcgatcggagtctagcaccgaatgggacctagacggcttttcagagctggatagcgagtccgggagcagctcaagcttttccgatgacgaagtctgggtgcaggtcgccccacagcgcaatgcacaggaccagcagggatcgctgtag

SEQ ID NO: 30715 - DNA, 1728 bp, Artificial Sequence
  Description of Artificial Sequence: Synthetic coding sequence
atggaccccttccacgcgtgttctattttgaaacagctgaagacgatgtacgatgagggacagctaaccgatatcgtagtagaggtggaccatggaaagacttttagttgtcatcgcaacgtgctggcagctatctccccttatttcaggtcgatgtttactagtggtctgaccgaatcaacacagaaagaagtccgaatcgtcggggttgaggccgagtcgatggacctggtgctcaactatgcctacacaagccgcgtgatcttgaccgaagctaatgtgcaggcactgttcacagccgcctccattttccagattccatcgatacaagaccagtgcgctaagtacatgatatcccacctcgatccacaaaattctatcggggtcttcatttttgccgatcactacggccaccaggaattgggagaccgtagtaaggagtatatcaggaaaaagttcctatgtgtcactaaggagcaggagttcctacaactgactaaggatcagctgatctccattctggactccgatgacttgaatgtggatcgcgaggagcacgtctatgagtccattattagatggtttgaacacgagcaaaacgagagggaggtgcatctgcctgagatcttcgccaaatgcatccggttcccactgatggaagacactttcatcgagaagatccctcctcagtttgcacaggctatcgccaaatcctgtgtcgagaagggcccttccaataccaacggctgcactcagcggctgggcatgactgcctccgagatgatcatttgcttcgatgccgctcataagcactccggtaagaagcaaacggtcccatgtcttgatatcgtaaccggaagagtgttcaagctttgtaagccccctaatgacttgcgggaggtcgggattcttgtcagccccgacaacgatatttacattgccggaggctatcggccgagttcctccgaggtgtccattgatcacaaagcagagaatgatttctggatgtacgaccactccactaatcgctggctgagcaaaccgagcctcctacgggcaagaattggctgcaagctcgtttactgctgcggaaagatgtacgccattgggggccgggtgtatgaaggggacgggcgtaattcactgaaaagcgttgagtgttatgactctagggagaactgttggactaccgtttgcgccatgcctgtggccatggagttccacaatgctgtggagtacaaggagaaaatttatgtcctccaaggggaatttttcctcttttacgagccccagaaggactattggggtttcttgacacctatgacagttcctaggatccagggactcgcagccgtatataaggacagcatctattacatagcaggcacatgtgggaaccaccagaggatgttcacagtcgaagcctatgacatcgagctgaataaatggactcgtaagaaggactttccgtgcgatcagagtatcaacccttatctcaaattggtgttgttccagaacaaattgcatttattcgttagagccacacaagtcacagtggaggaacacgtattcagaacctcacgcaagaactcactgtaccagtatgatgacatcgcagatcagtggatgaaagtttatgagaccccagaccgcctgtgggacctgggtaggcacttcgagtgcgctgttgccaaactctacccccagtgcctgcaaaaggttttatag

SEQ ID NO: 30716 - DNA, 1806 bp, Artificial Sequence
  Description of Artificial Sequence: Synthetic coding sequence
atggcagcgagtgcagatctcagcaagtctagccccacacctaatggaattccttcctcggaccctgctagcgatgccatggacccttttcacgcttgctcaatattgaagcaacttaagactatgtatgacgagggccaactaacagacatcgtcgtggaggtggatcatgggaaaactttctcttgccaccgcaacgtgctggccgccatcagtccctattttagatctatgttcacgtcaggactcacagaatccactcagaaagaagtgcgtattgtaggagtagaggccgaaagcatggacctcgttctcaactatgcatacacctctcgcgttattctgacagaggcaaacgtgcaggctctctttactgccgcctcgatcttccagattccgtcaattcaggaccagtgtgccaagtacatgattagccacctggacccgcagaattcgattggggtgtttatcttcgcggatcactacggacatcaggaactgggggacaggtcgaaagagtatatacggaaaaaattcctttgtgtgactaaagaacaggaatttttgcagttgacaaaggatcagttgatttctatcctcgattcagacgatttaaacgtggatagagaagagcatgtttatgagtccatcattagatggttcgaacacgagcagaatgagagagaggttcaccttccagaaatctttgcgaaatgcattcggtttccactgatggaagacactttcatcgaaaaaatcccaccacagttcgctcaggcaatagctaaaagttgcgtggagaagggaccaagtaatacaaacgggtgtacccagaggcttggaatgactgccagcgagatgattatctgttttgacgctgctcacaagcattcgggtaagaaacagacagtgccatgcctcgatattgtaaccggtcgcgttttcaaactatgtaaaccacctaatgatcttagggaggtcggcatcctggtatccccagacaatgacatttacatcgccggcgggtataggccctctagtagtgaagtgtccatcgatcataaagcagagaacgatttttggatgtatgaccactcaacgaatcgatggctctctaagccaagtttgctgcgtgcccgaatcggctgcaaactggtgtattgctgtggcaagatgtacgccataggcggcagggtgtacgagggcgacggtcgcaatagcctgaaatccgttgaatgttacgattcacgggaaaattgttggactacagtctgtgctatgcctgtcgccatggagttccacaatgccgtagaatacaaagaaaaaatttatgttttacagggtgagttttttctgttctacgagccacagaaggattactggggatttcttacccccatgaccgtgccccgcattcagggactcgccgccgtatataaggactctatttattacatcgctggaacatgcggcaaccaccagcgtatgttcacagtagaagcctacgacatcgaactgaacaaatggaccaggaaaaaagatttcccctgtgaccagtctattaacccctacctgaagctcgtcctctttcagaacaagctgcacctatttgtgagagccacacaggttaccgtcgaggagcatgttttccgcacaagtaggaaaaactccttgtaccagtacgacgatatcgcggaccaatggatgaaagtttatgagacacccgataggctatgggacttaggtaggcatttcgagtgtgcagtagccaaactctacccgcaatgtttgcagaaagtcctttag

SEQ ID NO: 30717 - DNA, 948 bp, Artificial Sequence
  Description of Artificial Sequence: Synthetic coding sequence
atggatgtgaacaagtttgaggcatccgtagggtttctagacgtgaagaagtttctctcgacttggaagcttcagaatcctcgaacccattttgtgctgtcaccgcattgctttatgggaggaattatggctcccaaggatataatgacgaacacccatgccaagtcaatattgaactccatgaactcgcttcgcaagtccaacacgctttgtgacgtgaccctgcgagtggagcaaaaagatttcccagcgcacagaatcgtgctggccgcctgctcagattatttctgtgcgatgttcacaagcgaactgagcgagaaggggaaaccgtatgtcgatatccaaggactgaccgcctcaactatggaaatcttattggacttcgtctacacagaaacagtgcacgtgaccgtcgaaaatgtccaagagctgttgcccgctgcatgtttattgcaattaaagggtgttaagcaggcctgctgtgaattcttggagtcccaattggacccctccaattgtctcggtatacgagatttcgctgaaacccacaattgtgtggatctgatgcaagccgcagaggtgttcagccaaaagcacttcccagaggtggtccaacatgaagaattcattcttttgtcccagggtgaagtcgagaagcttattaagtgcgatgagatacaggttgattccgaggagcccgtgttcgaggccgtgatcaattgggtgaaacacgccaagaaggagcgtgaagaaagcctgcctaacctgctccagtatgtgaggatgcccctgctcactcctagatacatcaccgatgttattgacgcagaaccattcatccggtgcagcttgcaatgtcgtgatttggtcgacgaggccaagaagtttcacctgcgcccagagctgcggagccaaatgcagggccctaggactagggcaagactttag

SEQ ID NO: 30718 - DNA, 615 bp, Artificial Sequence
  Description of Artificial Sequence: Synthetic coding sequence
atgcaaggcccaagaacgagggccaggctcggggcaaatgaagttcttctagtcgtgggaggcttcggtagccagcagtcgcctatcgatgtcgtcgaaaagtatgaccctaaaacgcaagagtggagctttttgccatcaatcacccgcaaacgacgatacgtcgctagcgtgtccctccacgacaggatttacgtgatcggtgggtatgatggccggtccagactatcgagcgtcgaatgccttgactacactgctgacgaagacggggtttggtactccgtagcacctatgaacgtgcgccgagggctggcgggagccaccaccttaggggatatgatatatgtgtcgggggggttcgacggatcccgtagacataccagtatggagcggtacgaccctaacattgaccaatggtccatgttgggagatatgcaaacagcacgagagggggcaggactggttgtcgccagcggcgtgatctactgtcttggaggatatgacggattaaacatcctcaacagcgtggagaaatacgatcctcacacaggacattggaccaacgtaacacctatggcgacaaagcggtctgacatgatggtgatcccttgctag

SEQ ID NO: 30719 - DNA, 1707 bp, Artificial Sequence
  Description of Artificial Sequence: Synthetic coding sequence
atgggcgggattatggccccgaaagatattatgacaaacacacacgccaaatcaatactcaactcaatgaactccctcagaaagtccaatacattgtgtgacgtgactttgagagttgagcaaaaggatttccctgcccaccggattgtgctcgctgcctgcagcgactacttttgtgctatgtttacctccgaactgagcgagaaagggaaaccttatgtcgatatccagggcctgacagcatctactatggagatactgctcgatttcgtgtacacagagacagtccatgttacggtcgagaacgtgcaggagcttctacctgctgcatgtctccttcagctcaaaggcgtgaaacaagcctgttgcgaatttttggaatcccagctggacccctccaattgtctcggaatccgcgatttcgctgaaacacacaattgtgtggaccttatgcaggctgccgaagtatttagccagaaacattttccggaggtggtgcaacacgaggagttcatcttgctgtcgcaaggggaggtggagaaactgatcaaatgcgacgagatacaggtggatagtgaggagcctgtgtttgaggcagtgatcaattgggttaagcacgccaagaaagagagagaagagtccctgcctaatctgctgcaatacgtacgcatgcccttactgacaccaagatacattacagatgtgattgatgccgagccgttcatccgatgcagtcttcagtgccgcgacctggtggacgaggccaaaaaatttcatctccggccagaattgagatcacaaatgcagggtcccagaactcgtgccaggctgggagctaacgaagtgttactggtggtcggcggcttcggcagccagcagtcccccatagacgttgtcgaaaaatacgaccccaagactcaggagtggagtttcctcccatccattacaaggaaaagacgatatgtagctagtgtgtcattacacgatcgtatctatgtgatcggaggttatgacggtcgttctcgcctttcatctgtggagtgcctggactacacagcagacgaggacggagtttggtattcagtggcgcccatgaatgtccggaggggtctcgccggtgcaactacccttggggacatgatttacgtgtcaggaggcttcgatggcagccgaaggcacacaagcatggaaaggtacgaccctaacatcgaccaatggtctatgctgggagatatgcagactgcccgggaaggagctggactggtggtcgcatcaggcgtaatttattgccttggtggttatgatggcctgaatatccttaactctgtggagaagtatgaccctcatacaggtcattggacaaacgtaacacctatggccaccaagcggtccggtgctggcgtggcactattaaatgatcacatatatgtggtcggaggctttgacggaactgctcatttgagcagtgttgaagcttacaacatcagaacagacagctggacaacagtgacatcaatgacaacaccgaggtgttatgttggtgcaaccgtactccgaggccggctgtatgctatagcaggctacgatgggaactcacttctgtcttccatcgagtgctacgaccccattatcgacagctgggaggtggtcacctccatggggacgcagagatgtgacgcgggtgtgtgtgtcctgcgcgaaaagtag

SEQ ID NO: 30720 - DNA, 1821 bp, Artificial Sequence
  Description of Artificial Sequence: Synthetic coding sequence
atggacgttaataaatttgaggcaagcgtagggtttctggatgttaaaaagtttctgtcaacttggaagctgcagaatccgcggacgcattttgtcctaagtccacattgtttcatgggtgggataatggcaccaaaagacatcatgactaacactcatgcgaaatctatcctcaattctatgaattccttgcgcaagtctaacacgttgtgcgatgtgactctgcgtgttgaacagaaggattttcccgctcatagaattgtgctcgccgcttgttctgactatttctgcgctatgtttacttctgagttgagtgagaagggaaagccgtacgtcgacatccagggtcttactgccagcaccatggagatattgctggattttgtgtacactgagacagtacatgtgactgtggagaatgtacaggaactcttgccagctgcttgcctgctgcaacttaaaggtgtaaagcaggcctgctgtgagtttctggaaagtcagctggaccctagtaattgcctagggattagggatttcgctgagacccacaactgcgtagatcttatgcaggccgccgaggtgttctcccagaagcattttccggaggtcgttcagcacgaagaatttatcttgttgtcccagggagaagtggagaaactgatcaagtgcgatgagatccaggtcgacagcgaagagcccgtctttgaagcagtaatcaattgggtaaagcatgcaaagaaggaaagagaggaaagcctaccgaatctgctgcagtatgtgcggatgccactcctgactcctaggtatataacggacgtcattgacgccgagccgtttatccgatgttccttacagtgtagggacctcgtcgatgaagctaagaaatttcatttgcggccagagctgcggagtcaaatgcagggtccacggactagagcaagactcggcgccaatgaagtgctacttgttgttggaggctttggcagtcagcagtctccaatcgatgtggtggaaaaatacgacccgaaaacccaagaatggtccttcctaccttctatcacgcggaagcggcgctacgtcgccagtgtgtctctccacgataggatctacgtgatcggtggctacgacgggcgttcaaggcttagctctgttgaatgcctggactacaccgcagatgaagacggagtatggtactctgtcgcgcctatgaacgtgagacgtgggctggccggagctacaacacttggcgacatgatatatgtgagtggcggattcgatggatccaggcgccacacctcaatggagagatatgatccgaacatcgaccaatggtcgatgctcggcgacatgcagaccgcacgagagggcgcgggcctggtggtggcttcaggagttatatattgcctgggaggatacgacggtctcaatattttgaattctgtggaaaaatacgaccctcacactggccactggaccaatgtcacgcccatggccactaagcgttccggagccggcgtggcattgctcaacgaccacatctacgtggtcggtggatttgacggtacagctcacctgtcttctgttgaggcctacaacatccgtacagacagctggaccaccgtgacttctatgactacaccgcgctgctatgtgggtgctactgtacttcggggacgcctctacgccattgcaggctacgatggcaatagcttactctcaagcatcgaatgctatgaccccattatcgatagttgggaggtggtcacaagcatgggaacccaaagatgtgatgccggggtgtgcgttcttcgtgaaaagtag

SEQ ID NO: 30721 - DNA, 1815 bp, Artificial Sequence
  Description of Artificial Sequence: Synthetic coding sequence
atggcaggtgatgtggaaggcttctgttcctctatccatgatacatccgtgtccgcaggatttagagccttatacgaggaagggcttcttcttgatgtcaccctggtcatagaggatcatcagtttcaggcccacaaggcgctcctggcaactcagtccgactactttaggataatgttcactgcagatatgcgggagagggaccaggacaagattcacttgaaaggcctgacagcgactgggttcagtcacgtgctgcaattcatgtactacgggactattgagctgagcatgaacacagttcacgagatcctgcaagccgctatgtatgtgcaactgatcgaggtcgtcaaattctgttgcagcttcttgctagccaagatctgcttggagaattgtgcagaaatcatgcgccttctggacgatttcggggtgaacatcgaaggtgtgcgggagaaacttgacacctttcttctggacaattttgtcccgctgatgtccaggccagattttctgtcatatctcagttttgagaaactgatgagctatctggataacgaccatcttagtcgctttcccgaaatagagctctatgaggcagtccaatcttggttacggcatgatcggagaagatggcgacacaccgatacgataatacagaacatccggttttgtctgatgacacctaccagcgttttcgaaaaggtgaagactagtgaattctatcggtattcaaggcagctccgatatgaagtggaccaggctctgaactattttcagaatgtacatcaacagcctctgctggatatgaaatcctccagaatcaggagtgccaagccacagaccactgtgtttagagggatgattggccattctatggtgaacagtaaaatactgcttctgaagaagcctagggtgtggtgggagctcgaaggccctcaggtgcctttgcgcccagattgtttggctattgtcaataattttgtgttccttcttggaggggaagagctcgggccagatggtgaatttcacgctagctccaaggtgttcaggtacgatcctagacagaatagttggctgcagatggccgatatgtctgtgccccggtctgaattcgctgttggcgtaatcgggaagtttatttacgctgtggctgggcggactagggatgagacgttttattctactgagagatacgatatcaccaatgataagtgggaatttgtggatccctatcctgtgaataaatatggtcatgagggcactgtgctgaataacaaactgtttattactggcggtatcacatcaagcagcactagtaaacaggtgtgcgtatttgacccctccaaggagggcacgattgagcaacggacacgacggactcaggttgtaaccaactgctgggagaataaatcaaaaatgaattatgctagatgtttccacaagatgatctcatacaacggaaaattatatgtgttcggaggggtgtgcgttatcttaagggcctcattcgaaagccaggggtgccccagtacggaagtctacaaccctgaaactgaccagtggacaatcctggcgagcatgccaattgggcggtcaggtcatggagtcacagtccttgataagcagatcatggtgctcggaggactgtgttataatgggcactacagtgacagcattctgacatttgatcctgacgaaaacaagtggaaagaggacgagtatccacggatgccctgcaagttggacggcctgcaggtatgcaatctgcattttccagactatgtccttgatgaagttcggcgatgcaactag

SEQ ID NO: 30722 - DNA, 1437 bp, Artificial Sequence
  Description of Artificial Sequence: Synthetic coding sequence
atggacacatctgacctgtttgccagttgccggaagggggacgtgggaagggtgaggtacttactcgaacagcgggacgttgaggtgaacgtgagagataagtgggacagtacccctctgtattatgcctgcctatgcggccacgaggagctagtgttgtacctcctggccaacggagccagatgcgaggctaatacgttcgatggcgagcggtgtctatatggggctctgtccgatcctatcaggagggcgctcagagattataaacaagtgactgcctcttgtcgccgtcgcgactattacgatgattttctgcagcggctgctagaacagggtatccactccgacgttgtctttgtggtgcatgggaaaccatttcgggtccacaggtgcgttctgggtgcacgatccgcttattttgctaacatgcttgacaccaaatggaagggaaagagtgtggtggtactgcgccatcccctaattaaccctgtggcctttggcgccctgctgcagtacctttacacaggtcgattggatatcggagttgaacatgtgagcgactgcgaaagacttgctaaacaatgtcaattgtgggacttgctttctgacctggaggctaaatgcgagaaggtgtccgagttcgtcgctagtaaacccgggacctgcgtcaaagtgctaaccatcgaaccgccacctgccgaccctcgtctccgtgaggacatggctctgctggctgattgcgccttaccacccgagcttagaggcgatttgtgggaacttcctttcccctgccccgatggattcaacagttgcccggacatatgtttccgagttgcaggatgctcattcctgtgtcacaaggccttcttctgcggtcggtctgactactttagggcccttctggatgatcatttccgggaaagtgaggaaccagctacctcaggaggaccgcccgcggttacactgcatggaatctcgcctgatgttttcacgcacgtattgtattatatgtattctgatcatactgaactctctccagaagcagcttacgacgtgcttagcgtcgccgatatgtatctactcccaggtctgaaaagactgtgcggccgcagtttggctcagatgctggatgaggacactgtcgttggcgtttggcgggtggcaaaacttttcagactggcacggctcgaggatcagtgcaccgaatacatggctaaggtgatcgagaaacttgttgaacgcgaagattttgtcgaggcggtgaaagaagaggctgcggcggtcgccgcccgtcaagagacagattccatccccttggtagacgatattaggttccacgtcgcatccacggttcagacatactctgccattgaagaagcccaacagaggctgagggctcttgaggatctcctcgtctccatcggactggactgctag

SEQ ID NO: 30723 - DNA, 1389 bp, Artificial Sequence
  Description of Artificial Sequence: Synthetic coding sequence
atgggcgcatcatttctgcagctccaaagcattaaggatgcttgctgtacctttctcagagaacgcttacatcctaagaactgcttgggggtcaggcagttcgcggaaactatgatgtgtgctgtcctctatgatgccgccaactccttcattcaccaacactttgttgaagtctccatgtctgaggagttcttagctctgcccctggaagatgtcctcgaactagtgtccagagacgaacttaatgttaaatcggaggagcaagtatttgaagcagcccttgcttgggtgcgctatgacagggagcagcgcggcccctacctgccagagttgctgtcaaacatccggctcccgctctgtcgaccacagtttctctctgacagggtccagcaggatgatcttgtcaggtgttgccacaagtgtcgggatctcgttgacgaggctaaagactatcacttaatgcccgaacgcagaccccacctccctgcctttaggacacggcccagatgctgcacctctattgcaggtttgatctacgcagtgggtggactcaactctgcgggagactccctcaacgttgtggaggtattcgacccaatcgccaactgctgggagaggtgcaggccgatgactactgccagaagccgggtcggagtggcagtggtaaacggactactctatgctataggcggttacgacggacagctccgcctgagcacagtcgaagcttataatccagagacggatacctggacgcgggtcgggtccatgaacagtaagaggtccgctatggggactgtggtactagacgggcagatctacgtgtgtggcgggtacgatgggaacagctctctaagctcggtggagacatactctccggaaactgataagtggaccgtggtcacttccatgtctagcaacagatctgctgctggagtgaccgtgttcgaagggcgtatctatgtctctggcgggcatgacgggctgcagatattctcctctgtcgaacactacaatcaccacaccgctacatggcatcctgccgccggaatgttaaacaagcgctgtcggcatggagctgcttccctgggcagtaaaatgttcgtttgtggcgggtatgatggaagtgggtttctgagcattgccgaaatgtattccagtgtggccgaccaatggtgccttatagttccaatgcatactaggcgatcaagggttagtctggtggctagctgcggaaggctatacgctgtggggggttacgacggacaatctaacctgtccagcgtcgagatgtatgatcccgaaactgattgttggactttcatggcccctatggcatgtcatgagggcggggtaggcgtcggatgcatcccactcttaacgatctag

SEQ ID NO: 30724 - DNA, 1905 bp, Artificial Sequence
  Description of Artificial Sequence: Synthetic coding sequence
atggcagaggagcaggagttcacccagctttgtaaactgcctgctcaaccttcccacccacactgcgttaataacacatataggtccgctcagcactctcaagccctacttagagggctacttgcactacgggactcaggtatcttgttcgatgtggtgcttgtcgtggaaggtcggcacattgaggcacataggattcttctcgctgcaagctgcgattactttcggggaatgtttgccggcgggctgaaggaaatggagcaggaggaagtccttattcatggcgtgagctataacgcaatgtgccagatcctgcacttcatttacacaagcgagctggaacttagcctctctaatgtgcaggaaacactggtggccgcctgtcagttacagattccagaaataatacatttctgttgcgactttttaatgagttgggttgacgaggagaacattctcgacgtttatagactggccgagctgtttgatctatcacggctgaccgagcagttggacacgtacatccttaaaaacttcgtcgctttctcacggacagataaataccgccagcttcctctcgaaaaagtttactccctcttgtcttctaatcggctggaggtcagctgtgagaccgaggtgtatgagggggctctactctatcactattcgctggagcaggtccaggccgaccagatcagccttcacgaaccacctaagctgctggagactgtccgctttccactgatggaagcagaggtcctgcagcggctccacgacaaattagacccctctccccttagggacacagtggcaagcgcgctcatgtaccacagaaacgagagccttcagccaagcctgcagtctcctcagaccgagcttcggtccgatttccagtgcgtcgtcggcttcggtggaatccactcaacccccagcaccgtgctatccgaccaggccaagtaccttaaccccctgcttggcgaatggaagcatttcacagccagtctggcccccaggatgtccaatcaaggaattgccgtacttaataatttcgtttacctgattggcggagacaataacgtgcagggatttagggccgaatccagatgctggcgttatgatccccgccataaccggtggttccagatacagtcactgcagcaggaacatgctgacttaagtgtctgcgtggtcgggcgctatatttatgcggtggccgggcgggattaccacaatgacttgaatgccgttgagaggtacgaccctgccacaaattcatgggcttacgtcgccccgctgaagcgtgaagtgtatgcccatgccggtgcaacgctcgaaggaaagatgtacattacctgtggacggcggggggaggactatctgaaggaaactcactgttatgatccgggctcaaacacatggcatactctggccgatggccccgtgcggagagcgtggcatggaatggcaaccctcctcaataagctgtatgtgattggaggatccaataatgatgcaggttacagacgagacgtgcaccaggttgcatgttatagttgcacttctggtcagtggagctccgtgtgcccactccctgccggacacggggagccagggattgctgttcttgacaatcgcatttacgttctcggtggacgatcccataaccgcggcagtcgcacgggatacgtccatatttatgatgttgagaaagactgctgggaagaaggaccccaacttgataactcaatttctgggcttgcagcttgcgtactgactcttcccagatccctcctccttgaaccccctcgaggtacacctgacaggtcccaggccgaccctgacttcgcttctgaagtgatgtccgtatctgattgggaagagttcgataactcctcggaggactag

SEQ ID NO: 30725 - DNA, 1476 bp, Artificial Sequence
  Description of Artificial Sequence: Synthetic coding sequence
atgagttgggtggatgaagagaatatcctggatgtgtaccggcttgccgagctgttcgatttaagtcgcttgacagaacagctggatacttacatccttaagaacttcgtcgctttctcgcgaacggataaatatagacagctccccctggaaaaagtgtacagtctgttgagttcgaatcggctggaagtgtcctgcgagacagaggtgtacgagggagccctgctgtatcattactcgctcgagcaagttcaagcagaccagatcagcctacacgagccacccaagctgctggaaacggtgcgcttccctctcatggaggcggaagtgttgcagcgactacacgacaagctcgatcctagtcctctcagggatactgttgcttccgccttgatgtatcataggaatgagtctttgcagccttcacttcagtctccccaaacggagctgcgctcagattttcagtgtgttgtgggcttcgggggcatccattccactccttctacagtcctcagcgatcaggccaaatatttaaatccccttctaggagagtggaagcacttcaccgcttctctggccccacgaatgtccaatcagggtatcgccgtcctgaacaatttcgtctatcttattggtggtgacaataatgtgcagggctttcgcgctgagtctcgatgttggcgctacgaccctcgtcataacagatggtttcagattcaatctctccagcaggaacatgctgatctttccgtgtgcgtggttggccggtatatttatgccgtggccgggcgcgattaccacaacgacctgaacgccgtggagcggtacgaccctgccaccaatagttgggcatacgtcgcacccctgaaaagagaagtctatgcccacgccggcgccacactcgagggcaaaatgtacataacctgcggtcgcaggggcgaggactatctcaaggagacgcactgctacgaccccggctcaaacacctggcacaccctggcagatggcccagttagaagagcctggcacggcatggccactctactgaacaagctttacgtcattggcgggtcaaacaatgatgcaggctacagacgtgatgtgcatcaagtggcgtgctactcttgtacctccgggcaatggtcttcagtttgtcctttacctgctggccacggcgaaccaggcattgctgttcttgacaaccgcatatacgtgcttgggggtcgcagccacaaccggggatcgcgaaccgggtacgttcatatctatgatgtagagaaagattgttgggaagagggaccacagttagacaattcgatctcgggactggcggcttgcgtgttaactctgccacgcagccttttgttggaaccacctaggggcacacctgatcgctcccaggctgaccccgatttcgcgtccgaggtcatgtctgtgtctgactgggaagaattcgacaattcttccgaggattag

SEQ ID NO: 30726 - DNA, 708 bp, Artificial Sequence
  Description of Artificial Sequence: Synthetic coding sequence
atggccgaggagcaggagttcacgcagctctgtaagctgcccgcccagccctcacacccccactgtgtgaacaatacctacagatctgcccagcattcccaggccttgctccggggactcctggcgttgcgagattccggcatattgtttgacgtggtgctggttgtcgaagggaggcacatagaggctcatcgcatccttttggccgcttcatgcgactacttcagagggatgtttgccggaggcctgaaagaaatggaacaggaagaggtgctaatccatggagtgtcctacaatgctatgtgtcagattttacacttcatctatacctctgaactggaactgtccttatccaatgttcaggagactttggtcgccgcctgccagctgcagattcctgaaatcatccacttctgttgcgactttctaatgtcctgggtggatgaggagaatatcctggatgtgtataggctggccgagttgttcgacctgagcaggttaactgaacagttggatacctacatactgaaaaactttgtcgccttcagccggaccgacaaataccgccagctccccctggagaaggtctactctctgctgtcgtcaaacaggctcgaggtaagttgtgagaccgaagtgtacgagggtgccctgttataccactattcgctggagcaggtgcaggcagatcagatatccttgcactag

SEQ ID NO: 30727 - DNA, 1677 bp, Artificial Sequence
  Description of Artificial Sequence: Synthetic coding sequence
atggccctgaaaggacaagaggactatatatatcttttcaaagacagcacccatccagtcgactttctggatgcctttcggactttttatttggatggtctgtttactgacatcacacttcagtgtccgtctggtatcatcttccattgccaccgtgctgtactggccgcttgttcaaactacttcaaggctatgttcaccgccgatatgaaggagaaattcaagaataaaataaagttaagtgggattcaccatgatatactggaggggcttgtcaactacgcctacacatcgcagatcgagattaccaagcgcaacgtccagagcttgctggaggccgccgacctgctgcaattcctgagtgtcaaaaaagcttgtgagcgctttctggttcgtcacctggacattgacaactgtattggaatgcattccttcgccgagttccacgtctgcccagagctggaaaaagaatcccggagaattttgtgcagcaagtttaaggaggtatggcagcaagaggaatttcttgagatttccctggagaaatttttgtttattctgtcccgaaaaaatttgagtgtttggaaagaggaagcaattatcgaaccagttatcaaatggacggcccatgacgtcgagaatcggattgagtgcctttacaatctgctgtcatatattaatattgacatcgaccctgtttacctgaaaactgcattgggtctgcagaggagctgtcttcttacagagaataagattcgctcactgatttacaatgccttgaacccaatgcataaggagattagccagcgcagcactgctaccatgtacattatcggcggctactactggcaccctttaagtgaggtgcacatatgggaccccctcacaaatgtttggattcagggcgccgaaattcccgactataccagagaatcgtatggggtcacatgtctcgggcccaatatctacgtcaccggcggttatcggaccgacaacatcgaagcactagatactgtttggatttacaattccgagagtgacgaatggaccgagggcctgcctatgctcaatgcacgctactaccactgcgccgtcactctaggcgggtgcgtatacgctttgggaggatataggaagggagctcccgcagaggaggcagagttttacgacccgctgaaggagaaatggattccgatagcaaacatgatcaaaggtgttggcaatgcaacggcatgtgttctacacgacgtgatctacgtgattggaggccattgtgggtacaggggaagttgcacctacgacaaagtgcaatcttacaactcagacattaacgagtggtccctgataacaagtagccctcacccagaatacggcctctgttcagtgccattcgagaataagctctatttggtggggggtcaaaccactatcaccgaatgctacgatcctgagcagaacgagtggcgggagatcgcccccatgatggagcgacgaatggagtgcggcgctgtgattatgaacggctgtatctatgtgacaggtggctatagctacagtaaaggaacatacttacaaagcatagaaaaatatgatccggatctaaataagtgggaaatcgtggggaacctgcctagcgctatgagatcccacggctgcgtgtgcgtgtacaacgtatag

SEQ ID NO: 30728 - DNA, 1677 bp, Artificial Sequence
  Description of Artificial Sequence: Synthetic coding sequence
atggccctgaaaggccaggaggactacatttatttatttaaggattccacacaccccgttgacttcttagacgcgtttagaaccttttacttggatggactgttcaccgatatcaccttgcagtgtccttcaggcattatttttcactgccaccgtgctgttcttgcagcatgcagtaattacttcaaggccatgtttactgccgatatgaaagaaaaatttaagaacaaaataaagctttccggcatacatcacgatatcctggagggcctggtgaactatgcttatacttctcagatcgagattacgaagcggaacgtgcagagtctgttggaagcggctgacctgctgcaattcctgtcggtgaaaaaggcctgcgagcgcttccttgtcagacatctggacatcgacaactgtattggtatgcactcctttgcagagttccatgtctgtcccgagttggagaaagaaagtcgccgcattctgtgctccaaattcaaagaagtgtggcaacaagaagagtttctggaaatatctctcgaaaaattcctctttatcttatccaggaagaacttgtccgtctggaaggaagaggcgatcatagagccggtcattaagtggactgctcacgacgtagagaatcgtatcgaatgcctctacaacctgctgagctacatcaatattgacatcgaccccgtgtacctcaagactgcactaggcctgcagcggtcttgtttgctgaccgagaacaaaattaggtctcttatctataacgcactgaatcctatgcataaggaaatatctcagagaagcacagccacaatgtatatcataggggggtactattggcaccctctgtcagaggtacacatctgggatcctctcacaaacgtgtggatccaaggcgccgaaattcccgattatacgagggagtcttatggagttacatgtctggggccaaacatttacgtcaccggaggctaccgtacagacaacatcgaggcccttgatacagtgtggatctataacagcgagtctgacgagtggaccgaaggactgcccatgctgaacgcccgttactaccactgcgccgtgacactgggaggctgcgtatatgcccttggtggctaccgtaaaggcgctcctgccgaggaggccgagttctacgaccctctgaaggaaaagtggataccaattgctaacatgattaaaggggtgggcaatgcaaccgcctgcgttcttcatgatgttatttacgtgatcggcggacactgcggatacagaggatcctgcacctacgacaaagtccagtcctataactcagacatcaacgaatggtccctaataaccagctccccccatcccgaatatgggctgtgcagtgtccctttcgaaaataagctgtacctggtgggcggccaaaccaccattacagagtgttatgaccccgagcaaaacgaatggagagagattgctccgatgatggagaggaggatggaatgcggcgcggtgatcatgaacggatgtatttatgtgactggcggctattcatactctaaggggacatatctgcaatctatcgaaaaatatgaccctgaccttaacaaatgggagatagtgggtaaccttccgtctgctatgagatcccacggatgtgtatgtgtatacaatgtgtag

SEQ ID NO: 30729 - DNA, 1848 bp, Artificial Sequence
  Description of Artificial Sequence: Synthetic coding sequence
atggcagaaagcgggggcagtagcggcggagccggtggcggaggcgcatttggagccggacctggccccgagagaccaaattcaacggcagacaaaaacggcgccctgaagtgtacattcagcgccccttctcactcaacttccctgctccagggtcttgctacactgagggcccaaggccagttattggatgtggtgctgacaataaacagggaagcctttcctgcacacaaggtggtgctagccgcttgctctgactacttccgcgccatgttcacaggcggcatgagagaggccagccaggacgtgatcgaattaaaaggcgtgtctgcaaggggtctgcggcacattattgattttgcatatagcgcggaggttaccctggacctggattgcgtgcaagacgttcttggcgcagccgtgttccttcagatgctgcctgtggtggagctatgtgaggagtttctgaaggccgccatgagcgtggaaacttgtcttaacatagggcagatggccaccacctttagtcttgctagtctcagggaatctgtcgacgcctttactttcagacacttcctgcagattgcggaggaggaggatttcttgcgattgcccttggaacggcttgtgttcttcttgcagtctaataggctgcagtcttgcgcggaaatcgatctgttccgggctgcagtacggtggctccaacatgatccagctagaagacccagggcatcacacgtattatgccatattaggtttcccctgatgcagagcagcgaactggtagattcagtgcagacgttggacattatggtggaggacgtgctgtgccgtcagtacttactcgaagccttcaactatcaagtgcttccttttcgacagcatgaaatgcagtctccccggacggcagtacgctctgatgtgccctccttagtcactttcggcggcaccccatatacggatagcgatcgaagcgtgtcttcaaaagtctatcagctccccgaaccgggggcccgacacttccgggagttgactgaaatggaggtagggtgctctcacacttgtgtggccgtgttggataacttcgtgtatgtagcaggtggccaacatctacagtaccgtagcggcgagggcgctgtggacgcttgctacagatacgacccccatctcaaccgttggctcaggcttcaggcaatgcaagagtcgagaatccagtttcagttgaacgtgctgtgtggcatggtttacgccactggcggaaggaacagagcaggaagcctggcttctgtcgagaggtattgcccgcggcgcaatgaatggggttatgcttgctctctgaaaaggagaacctggggccacgcaggagctgccagcggcggaagactctacatctcaggaggttatggcatatcagtggaggataagaaagcactgcactgttacgatcccgttgcggaccagtgggaatttaaggcacccatgtctgaacctcgggtgttacacgccatggttggagccggcggacgcatctacgccctcggggggagaatggatcatgttgaccggtgttttgatgtgctcgccgttgaatattacgtaccagagaccgatcaatggacaagtgtctctcctatgcgtgcgggccagagcgaggctggctgctgccttctcgagagaaagatatacatcgtagggggttacaactggagattgaataacgtcactgggatagtccaggtatataacacagataccgatgagtgggagcgggatctccatttccctgaaagttttgctggcattgcatgtgctcctgtgctcttgccccgagccggaaccaggcgatag

SEQ ID NO: 30730 - DNA, 438 bp, Artificial Sequence
  Description of Artificial Sequence: Synthetic coding sequence
atggccgaatcaggagggtcttccggaggagcggggggagggggcgccttcggagcagggcctggacccgagagacccaactctacagcagataagaacggagccctgaagtgtaccttttccgctccttcacatagtacctcactgctccaggggttagccaccttacgcgcgcaaggccagcttctcgatgtggttctcactattaatagggaggcatttcccgcccacaaggtcgttttggcagcctgcagtgactattttagggccatgttcaccggcggaatgagagaggcttcacaggacgttattgagctgaaaggggttagcgcccgagggctgagacacatcattgattttgcatacagtgccgaggtgactcttgacctggattgcgtgcaggaggtggcccccaaaactcccgggacgttggcgtag

SEQ ID NO: 30731 - DNA, 1716 bp, Artificial Sequence
  Description of Artificial Sequence: Synthetic coding sequence
atggatcacacatcgcccacatacatgctggctaacctgacacatcttcacagcgagcagctgcttcagggcttgaatctcttacgacagcaccacgaattgtgcgacatcattctcagggtgggtgatgtcaagattcatgcacacaaagtggtcctggcgtcagttagtccctacttcaaggcaatgtttacaggcaacttgtccgagaaggaaaactctgaagtcgagttccagtgtatcgacgagaccgctcttcaggccatcgtagagtatgcttataccgggactgtgttcatcagccaggacaccgtcgaatcactgctgcctgctgccaacctgctgcagatcaagctggtccttaaggaatgttgtgctttcctggagtctcagctcgatcccggaaattgtatcggcatttcacggtttgctgaaacatatggctgtagggacttgtatctcgctgcaacaaagtacatatgccaaaattttgaggcagtgtgtcaaacagaagagttctttgaattaacccacgccgacctggatgagatagtgagtaatgattgcctcaacgtggcgaccgaggaaactgtgttctatgcactggagtcttggataaagtacgacgtacaggaaagacagaagtatttagctcaactattgaattcagtgcggctgcccctgctgtccgtgaagttcctcacgaggctgtacgaggctaaccatctgatccgggatgaccgcacctgtaaacacctgttgaacgaagctctcaagtatcatttcatgcctgaacaccgcttgtcccatcagacagtgcttatgactagacctaggtgcgccccgaaagtgctgtgtgcagtgggaggtaagtccggactctttgcttgcctggattcagtcgaaatgtacttccctcagaatgattcttggataggcctcgcccccctgaacatacctcgttatgagtttgggatctgtgtcttggaccagaaggtgtatgtgataggagggatagctacgaacgtgcggcctggagttaccattaggaaacatgaaaatagcgtcgaatgctggaatcccgacacaaatacttggacctccttggaaaggatgaacgaatcgcgtagcactttgggagtggtcgttttggcaggggaactgtacgcactgggagggtatgatggacagtcatatctccagagcgttgagaaatatatacctaagattaggaagtggcagcccgttgctcccatgactacaactagatcttgtttcgccgctgctgtcctggacggcatgatctatgctattggagggtacgggccagctcacatgaacagtgtcgaacggtacgatccatccaaggattcctgggagatggtggcctcaatggccgacaagcgaattcattttggagttggagtgatgttaggcttcatctttgttgtgggggggcacaatggggtttcacacttgtcatctattgagcggtacgacccccaccagaaccaatggaccgtttgtagacctatgaaagagccaaggacaggagtgggcgccgccgtcatagacaattatctctatgttgttggaggtcattctggaagctcttacctaaatacagttcagaaatacgacccaatcagcgacacatggctcgatagcgccggcatgatttactgcagatgtaactttggcttgacagccctctag

SEQ ID NO: 30732 - DNA, 255 bp, Artificial Sequence
  Description of Artificial Sequence: Synthetic coding sequence
atggaccacacttcaccaacatatatgctcgctaatctgacacacttacactcagaacaacttctgcaaggtctaaacctgctgaggcagcatcatgagctctgcgacatcattctgagggttggggatgtaaaaattcatgcacataaagtagtgctggccagtgtgtccccctacttcaaagctatgttcacaggaaacctctccgagaaagagaacagcgaggtcgagttccagtgtatcgatgaaacatag

SEQ ID NO: 30733 - DNA, 489 bp, Artificial Sequence
  Description of Artificial Sequence: Synthetic coding sequence
atggaccatacctctcctacttacatgcttgctaatcttacacatctccattccgagcagcttctgcagggactaaatctcctgagacagcatcatgagctgtgcgatatcattctcagagtgggcgacgtcaaaattcacgcgcacaaggtggtcctggcttcagtgtcaccttacttcaaagccatgtttacaggtaatcttagtgaaaaggagaatagtgaagtcgaattccagtgcatagacgaaaccgctcttcaggccatcgtggagtacgcatacaccggcactgtattcataagccaggataccgtcgagtccctgctgccagcagccaacttactccagatcaagctggtcctcaaggagtgctgtgcctttttagaatcccagctggaccccgggaactgcatcgggatcagcagatttgccgaaacttatggctgccgtgacctctacttggccgctaccaaatacatttgccaatag

SEQ ID NO: 30734 - DNA, 138 bp, Artificial Sequence
  Description of Artificial Sequence: Synthetic coding sequence
atggaccatacctcgcccacctacatgctggctaacttgacgcatctgcacagtgaacagcttttacagggtctgaacctgttgagacagcatcacgagctttgcgacattatactcagggtaggtgacgtcaaatag

SEQ ID NO: 30735 - DNA, 2628 bp, Artificial Sequence
  Description of Artificial Sequence: Synthetic coding sequence
atgtccagacatcacagccgctttgaacgagactatcgggtagggtgggaccggcgtgaatggtctgtgaatggaacgcatggcaccacatcgatctgttcggtgacctccggggccggaggcggcacagccagttcgctctcagttaggccagggctgctgccactacctgtggtcccatctcgtctgcccacaccggctacagctcctgccccgtgtaccacgggaagcagcgaagccataacgtccctagtggcatccagtgcttcagccgtcaccacaaaagcaccaggtatctcaaaaggggacagtcagtcccagggactggctacaagcattagatggggccagactccaattaaccaaagcactccgtgggatacggacgaaccaccaagcaagcaaatgagagaatcagataaccctggcacaggaccctgggtgacaacggttgccgctggcaatcagccaacgctcattgcccattcatatggggtggcacaaccacccaccttcagcccagcggtcaacgtccaagctccggtgattggcgttacaccctcactgcctccacacgttggaccacagctccctctgatgccgggacactatagccttcctcagccaccatctcagccacttagctctgtggttgtcaatatgccagcccaggcgctctatgcgtcaccgcagccactggccgtcagcaccctgccaggggtgggccaggtggcacggccaggccccacagctgtggggaatggtcatatggcagggccattgttacccccaccgcccccagcccagccttccgcaaccttaccctctggagccccagccaccaacgggccgcctaccacagactctgcacatggattacaaatgctacgaacaatcggcgtgggaaagtacgaatttaccgatccgggccacccccgagaaatgcttaaagaacttaaccagcaacgacgcgcaaaggcttttacagatctgaagatcgtggtggaagggcgggaattcgaggtgcaccaaaatgtgcttgcttcctgtagtctgtacttcaaagatcttatccagcgatccgtgcaggatagtggtcaggggggccgggaaaaactggagcttgtgctttcaaatctgcaggcagatgtcctggagctgctccttgagtttgtttacaccggctctttagtgatcgattcggccaacgctaaaaccctactcgaagctgcaagtaaattccagtttcacacattttgtaaggtctgcgtctccttcctggaaaagcagctcactgccagcaattgtctcggggtcctcgctatggcagaagccatgcagtgtagtgagttataccatatggccaaggcgttcgccctacagatcttccctgaggtggccgcccaggaggagatcctctccatctctaaggatgacttcatcgcgtacgtgtctaatgatagtctgaacaccaaagcagaagaactggtttacgaaactgtcatcaagtggattaagaaggatccagcaacacgcacgcaatacgcggccgaattgttagcagtcgtcaggttgcccttcattcatccttcttatctacttaatgtggtggataatgaagaactgataaaaagttcggaggcttgtagggatttggttaacgaagcaaagcgctatcacatgttgccccatgcacggcaggaaatgcagactccgcgcactcgtccacggctgagcgccggggtggcggaagttattgtgctcgttgggggtcgtcagatggtaggaatgactcagagaagcttggtagcagttacctgctggaaccctcagaacaataagtggtaccctctggcctcccttccattctatgacagagaattcttttcagtagtcagtgccggtgacaatatttacctgagtggaggcatggagagtggagtcactttggcggacgtctggtgctacatgtcccttctggataactggaatctcgtctcccgcatgacagtgccccggtgcaggcacaattctttagtgtatgacggtaagatctacaccctaggcggcctcggtgtggccggaaacgtggaccacgtcgaacgttacgatacaatcactaaccagtgggaggcagtcgctcctctgcccaaggcggtgcattctgcagctgccacagtctgtggaggtaagatttacgtgtttggcggtgtcaatgaggctggcagagctgctggcgtcttacagagttacgtgcctcaaactaacacatggtcatttatcgaaagcccaatgatcgacaacaagtacgcccctgcagtgacattgaatgggttcgtgttcatcttgggtggtgcatatgctcgggctaccaccatttacgatccagaaaaagggaatatcaaggctggtcccaacatgaatcactcaaggcagttctgtagcgcagtggtgcttgacggaaaaatctatgccacaggtggcattgtgagctcagaaggccctgctttaggcaatatggaggcctatgagcccacgacgaacacgtggactctgctcccacacatgccctgccctgtgtttagacatggctgcgtggttatcaaaaagtacattcaatcaggctag

SEQ ID NO: 30736 - DNA, 1683 bp, Artificial Sequence
  Description of Artificial Sequence: Synthetic coding sequence
atgctggacggtctccagcgccttcgcagccagcccaagttagcggacgtgacactgttggtcggtgggcgtgagctgccttgtcaccgtgggttgctcgcattgagttccccatacttccatgctatgtttgccggagatttcgcagaatctttctcggccagagtcgagttgagagatgtcgaacctgcagtggtcgggcagctggtggacttcgtttacacaggccgtctaacgataactcagggcaatgtcgaggcacttactaggaccgctgctcgactccactttccatccgtgcagaaggtctgtgggaggtacttgcaacaacagctggatgccgccaactgcctggggatctgcgagttcggagagcagcaggggctattaggggtggctgcaaaggcctgggcttttctgagggagaacttcgaggctgtcgctcgagaggacgagtttcttcagctccccagggaaagactcgtgacctgccttgccggcgacctgctgcaggtgcagcctgaacaatcgcgcttggaggccctgatgagatgggtgaggcacgaccctcaggctagggcagctcatctgcccgaactgctgtcgttggtgcacctggacgccgttccacggccctgcgtgcagcaactccttgcgagtgagcccctgatacaggagtcagaagcttgtcgcgccgccttaagtcagggtcacgacggagctcctcttgctttgcaacaaaaactggaggaggtgctggtggtcgtgggaggccaagccttagaagaagaagaggccggggaagaaccgactcccggtctggggaactttgccttttacaattctaaagctaagcgttggatggcactgcccgatttcccagactatcacaagtggggcttttctctggccgccttgaacaacaacatctacgttacgggcggcagcagaggcacaaagactgatacttggtcgactacacaagcctggtgctttcctttgaaggaggcttcttggaagcccgtggcccccatgctgaaacctagaaccaatcacgcaagcgctgcgttaaacggcgaaatttatgtgatcggaggaaccacgctcgacgtagtggaggtcgaatcttacgacccatatacagattcttggacgcccgtgtcacctgctttgaagtacgtcagcaactttagcgctgccggctgtcgcggacgactgtaccttgtcggatcctcagcgtgcaagtataatgcactggcccttcagtgctataatcccgtcacagatgcttggagtgtaatcgcctctccttttctgccaaaatacttgtctagtccacgatgcgctgccctccatggcgagctctatctgatcggcgacaacacaaagaaagtgtatgtctatgatcccggcgcaaatctgtggcagaaggtacagtcacaacattccctgcacgagaacggtgccctggtgcccctcggcgacgccctctacgtcactggaggccgatggcaggggatggagggtgattaccacgttgagatggaagcctatgacacggtcagggatacttggacccggcatggggcattgcccaggctgtggctataccatggtgccagcactgtcttcctcgatgtttccaaatggacccaaccctccggcccgacccaggagcactag

SEQ ID NO: 30737 - DNA, 1737 bp, Artificial Sequence
  Description of Artificial Sequence: Synthetic coding sequence
atggtgcggaatgttgatgacttagacttccacttgccaagtcatgcccaagatatgctggatgggctgcagcgattacgttctcaacccaagctggccgatgttacgctgctggtaggggggagagagttgccctgccataggggcttactagcgctatcctctccatatttccatgcgatgtttgccggagacttcgcggagtctttttcagcccgggttgaactgcgggacgttgaacccgctgttgttggtcaactggtcgacttcgtgtatacagggcggctcaccatcacacaaggaaatgtcgaggcgctcactcgcacggccgcaaggctccatttccccagcgtgcagaaggtgtgcggaaggtatttgcagcagcagctagatgcagccaattgcctcggcatttgcgaatttggtgagcagcagggtctgctgggagtggccgccaaagcctgggcgttcctgagggaaaattttgaagcagtggcccgcgaagatgaatttctacaactcccacgtgaacgactggtcacttgtctagccggtgacctgcttcaggtgcagcccgagcagagtaggctggaggctctcatgcggtgggtccggcatgacccccaagccagggccgcccacctccctgagctgttgagcttggtccatctggatgccgtgcctcgcccatgtgtgcagcagcttctggcctctgaaccactcatacaggaaagcgaggcttgccgggctgccctgtcccaggggcacgacggggcgcccctggccttgcagcagaagttagaagaagtgctggtggtcgtgggggggcaggctcttgaagaggaggaagccggcgaagaacccacaccaggcctgggcaattttgctttctataactccaaagcgaaaagatggatggccttgcctgacttcccagactaccataaatggggctttagtctcgctgcactgaataacaatatatacgtcacaggcggttccaggggcacgaagacagacacatggagcaccacccaggcctggtgttttcctcttaaggaagcctcatggaagcctgttgcgcctatgctgaaaccacggacgaaccatgccagcgcggccctcaatggagaaatttacgtgattggaggcacaaccttggacgtagtcgaggtggaaagctatgatccctacactgatagctggacccctgtaagtcccgcgctgaaatacgtgtctaatttttcagccgcgggctgtagagggagattatacctggttgggtccagcgcttgtaaatacaatgccctcgccctccagtgttataatccagttactgacgcttggagtgtgatcgcctcgccatttctgccaaagtacctctccagtcctcgatgtgcagcactgcatggcgaactgtatctgatcggtgacaataccaagaaggtttatgtatatgaccctggggcaaatctgtggcagaaggtacaaagtcagcacagcctgcatgagaacggcgcgcttgtccccctgggagacgcgctatacgtcactgggggtcgttggcagggaatggagggtgactatcatgttgaaatggaggcgtacgacactgttcgagacacttggacacgccacggtgcactgccccgcctgtggctttatcatggagcatctaccgtgttcctggacgtcagcaaatggacccagcctagcggacctacccaagaacactag

SEQ ID NO: 30738 - DNA, 420 bp, Artificial Sequence
  Description of Artificial Sequence: Synthetic coding sequence
atgccaagcgaaagatgtctctctattcaagaaatgctgactgggcagcggctgtgtcactcggagtcccataatgattctgtgctggcagcactgaaccagcagagaagcgacggcatcctctgcgacattaccttgatcgccgaagaacagaagttccacgcccataaggctgttctcgccgcctgctctgactatttccgggcaatgttcagcctgtgcatggtggaatccggcgccgacgaagtgaacctgcatggggtaacaagcttgggcctaaaacaagccctggagtttgcttacacagggcagattttgctcgaaccgggagtcatccaggacgtgctggcagcaggatctcatttacagttactcgagctccttaacctctgctcacactacttgattcaggtggagtag

SEQ ID NO: 30739 - DNA, 621 bp, Artificial Sequence
  Description of Artificial Sequence: Synthetic coding sequence
atggtagagtcaggagccgacgaagttaacttacatggagtaaccagcctcggcctgaaacaggcattagagtttgcctacaccggccagatcttgctggaaccaggtgtgatccaggacgttctcgctgcgggtagtcatctccagctgctcgaactgctaaacctgtgcagccactacctgatccaagagctgaatagctttaattatcttgacctgtacagactggcagacctctttaatctgacccttctagagaaagcagtgatcgattttctggtcaagcacctgagcgagttgctcaagtcccgcccggaggaggtgctgaccctgccatactgcctgctccaggaagttctgaaatctgacagattgaccagcttatccgaggagcagatttggcagaaatgcggtatttgcgccgctttttgcgccttacgcggcgattggtgtccaggactaccccagtgggatgacaagaccgcttcttgcgaggtggtgggcacccagctgccacttcccgtacatggcagagcgccagcaattcatcccttgtggccaaatggatgcggctacagcccttacagctgcccagtgccacctccatgtcctagtaaatag

SEQ ID NO: 30740 - DNA, 1863 bp, Artificial Sequence
  Description of Artificial Sequence: Synthetic coding sequence
atgccctctgagcggtgcttaagcatccaggaaatgctgaccgggcagcgactatgccacagtgagtctcataatgacagcgtcctagctgccctcaaccaacagaggagcgacggaatactgtgtgacattacacttatagctgaggaacaaaaatttcatgctcataaggccgtcttggctgcttgtagtgactatttccgggccatgttttccctgtgtatggtggaatcaggagctgatgaggtgaatctgcatggagtgacttccctgggccttaaacaagctcttgagtttgcttatacagggcagatcctgcttgaacccggcgtgatacaggacgttctggccgccggatcgcacttacagttgctggagttgctgaacctgtgctcgcattatctgatccaggagctgaattccttcaattacctagacttgtacaggcttgctgatttatttaatctgaccctgcttgaaaaagccgttatcgactttctggtcaagcacctgagcgagctgttaaaatcgaggcctgaggaagtcctgacccttccctactgcttgcttcaggaggtgctgaagtcggaccgcttgacttctctgtccgaagaacagatttggcaactcgccgttaggtggcttgagcacaactgccattaccagtacatggacgagctgctgcagtatattcgtttcggactaatggatgtggacacccttcacactgtggcactgtcccatcctctggtgcaggcctctgaaaccgcaacagcccttgtgaacgaggctttggagtatcatcaatcaatctacgctcaacccgtgtggcagacacggcgaacaaaaccacgcttccagagtgacactctttacattataggtggaaagaagagggaggtgtgcaaggtgaaagagctgaggtactttaaccccgtggaccaggagaacgctttgattgccgctatcgcaaattggagtgagttggccccaatgccagtggggcgctctcatcattgtgttgccgtcatgggagactttctgtttgtcgcaggcggcgaggtggagcatgcttccggtaggacctgcgctgtccggactgcctgtaggtatgatcctagaagtaacagctgggcagagattgccccaatgaagaactgtcgcgagcattttgtgctcggagccatggaggaatatctctacgctgtgggagggcgcaacgaattaagacaggtccttcccacagtggagaggtactgcccaaaaaaaaataaatggacatttgtgcagtcttttgataggagccttagctgtcatgctgggtatgttgcggacggcctcctgtggattagtggaggagtgaccaacactgcacagtatcaaaatagattgatggtctacgagcccaaccaaaataagtggattagcaggagcccgatgttgcagagaagagtgtatcattccatggcggcagtgcagaggaagctgtatgttctgggcggaaatgatctggactacaacaatgatagaatcctggtccgacacattgactcttataatattgatacagaccaatggacaaggtgtaattttaacctgttgaccggccaaaacgagagcggcgtggccgtccacaacggtcgcatctatttggtaggaggctactctatctggacaaacgaaccgttagcttgtatccaagtgctcgacgtgagtagggagggaaaggaggaggtcttctacgggccgacacttccatttgcttcaaacggaatcgcagcttgtttccttccagccccttattttacctgccctaacctacaaacgttgcaagtcccacatcatcggatcggcaccatctag

SEQ ID NO: 30741 - DNA, 531 bp, Artificial Sequence
  Description of Artificial Sequence: Synthetic coding sequence
attttgctggagccaggggttattcaggacgtgcttgccgccgggtctcacctgcaactgctggagttgttgaatctgtgctcacattacctcattcaggaactgaacagctttaactacctggatctgtaccgtctggcagatctgtttaatctaacattgttagagaaggccgtaatcgacttccttgtgaaacacctgtctgagctgctgaaatcgcgccccgaggaggtgctcaccttgccatactgtctgcttcaagaggtgttgaaatccgacagactgaccagcctcagcgaagagcagatctggcagaaatgcggcatttgtgcagccttttgcgccctccgcggggactggtgccccggcctgcctcagtgggatgataaaactgcaagctgcgaggtcgtggggacacagctccccctgcctgtacacgggcgggctccggccatccatcccctgtggccaaacggctgcggctactcgccatatagctgcccagtgcctccaccatgccctagcaagtag

SEQ ID NO: 30742 - DNA, 1755 bp, Artificial Sequence
  Description of Artificial Sequence: Synthetic coding sequence
atgccaagtgagaggtgtctgtccatccaggaaatgctgactgggcagcgtttgtgccactccgagtcccataatgattctgtgttagcagctctgaatcagcagcggtcagatggaatcctgtgtgacataacccttatcgcagaggagcagaaattccatgcacataaagccgtactggccgcctgttctgactatttccgaatcttgctggaaccaggcgtgatacaggatgtcttagccgcgggttctcaccttcagttgctggagctgcttaatctgtgtagccactacctgattcaggaactcaacagtttcaattatctcgacctgtaccggctggcagacctttttaacctcactctgctggaaaaagcagtgatcgatttccttgtgaaacacttgagcgaactgctgaaaagccggccggaagaagtgctcaccctgccatattgtttgctgcaagaagtacttaagtcagaccgcctcacttccctgtcagaggagcaaatctggcagctcgcagtgcggtggctggagcacaattgccactaccagtacatggatgaactgttacagtacataaggtttggcctgatggacgttgataccctacataccgtggctcttagtcatcctctcgtgcaggcaagcgaaacggcaaccgccctggtgaacgaagctttggaataccaccagtcaatttacgcacagcctgtgtggcagacccgccgtacaaaaccgcggtttcaatccgataccctctacataattgggggtaaaaagagagaagtttgtaaggtgaaggaactcaggtatttcaatcccgtcgaccaggagaacgccctcatagccgctattgccaactggagtgaactggctcccatgcccgttggaagatctcatcattgtgttgcggtcatgggcgactttctgtttgtggctgggggggaagtggaacacgcttccggcaggacatgcgcggtgagaacagcctgtcgctatgaccctcgctcaaatagttgggcagaaattgctcctatgaaaaactgcagagaacacttcgtgctcggagcgatggaggagtatttgtatgcagtggggggccgcaacgagctgaggcaggtgctgccaaccgtggaacgctattgtcccaagaagaacaaatggacctttgtgcagtcattcgaccgctctttgtcatgtcacgccggctacgtggctgatggacttctgtggattagtggcggggtgacaaatacagcgcagtaccagaataggctgatggtgtacgagcccaatcaaaataagtggattagccggtccccgatgctgcaaaggagagtgtatcatagcatggccgctgtgcagcgaaagctgtacgtcttgggcggcaacgacttggattacaacaatgacagaattctggtgcgccacattgatagctataatatagacaccgaccagtggactcgctgcaatttcaacctactaactggccagaatgagtccggcgtcgccgtccacaatggccgcatttacctcgtaggggggtactctatttggaccaatgaaccactggcctgcatccaagtgctggatgtgagcagagaggggaaagaggaggttttttatgggccaaccttgccctttgctagtaatgggattgccgcttgtttcctccctgcaccttactttacttgtccgaatctgcagactctccaggttccgcatcaccgcatagggacgatctag

SEQ ID NO: 30743 - DNA, 1656 bp, Artificial Sequence
  Description of Artificial Sequence: Synthetic coding sequence
atgccctcagagcgctgcctgtcaattcaagaaatgttaactggtcaaagactctgtcacagcgagtcccacaacgacagtgttctggcagcactgaaccaacagaggagcgacggcattctctgtgatattaccttgatcgccgaagaacagaaattccacgctcataaggctgttttagccgcctgttcggactatttccgcgaattgaactcctttaactaccttgatttgtaccgactcgccgatttgttcaatctaacactcttggaaaaggccgttatcgatttcctggttaagcacctttcagagctactgaagtcccggcctgaggaagtccttactctgccgtattgtctgctccaggaggtgttgaaatcggaccggctgacaagtctgtctgaggaacaaatatggcagctggccgtccggtggctggaacataattgtcattatcagtacatggacgaactgctccagtatattagattcggcctgatggacgtggatactctccacaccgtggccttgtctcaccccctcgtgcaagcatccgaaacagcaactgccttggtcaatgaggccctggaatatcaccagagcatttacgcacagcctgtttggcagacccggcggaccaagccacgttttcagtcagacacactgtatattattggcggtaagaagcgcgaggtgtgcaaggtgaaggaattgcgatattttaaccccgtagaccaggaaaacgcattgattgccgcgattgctaattggtcagagctggcacctatgcccgtgggcagaagccaccattgtgtggctgtcatgggtgacttcctctttgttgccgggggcgaagtcgagcacgccagcggcagaacttgcgccgttagaactgcttgtcggtacgaccctcggtcaaatagctgggctgaaatcgcaccaatgaaaaattgtcgcgagcacttcgtcctgggggcgatggaagagtacttgtacgccgttggcggccgaaatgagcttcgacaggtgctgccaacagtggagaggtactgtcccaaaaaaaataaatggacattcgtgcagagcttcgaccggagcctgtcttgccatgctggctacgtggcggatggcctgctatggatctcaggcggggtgaccaacaccgcacagtatcagaaccgccttatggtgtatgaaccgaatcaaaacaaatggatatcgcggtctcccatgttgcaaaggagggtgtaccacagtatggcggccgtgcagcgcaagctgtacgtattaggcggcaatgatctcgactacaataacgacaggattctcgtccggcacattgacagttacaacattgacaccgatcaatggaccagatgcaacttcaacttgctcactggacaaaacgaaagtggcgtggctgtgcacaacggcaggatctatctggttggcggctatagtatttggactaatgaacccctagcatgcattcaggtgctcgatgtgagtcgtgaaggcaaggaagaagtgttttacggccctacactcccattcgctagcaatggaattgccgcatgtttccttcccgctccgtacttcacctgtccaaacctccagactttacaagtcccacaccatcggattggcactatctag

SEQ ID NO: 30744 - DNA, 531 bp, Artificial Sequence
  Description of Artificial Sequence: Synthetic coding sequence
atgttgcctctgtctcacccaggtggcgttaccaatacagcccagtaccagaatcgcctgatggtctacgaacccaatcagaacaagtggataagtcgcagtccaatgctgcagagaagggtataccactcaatggccgctgtgcagaggaaactatatgttcttggagggaacgacctggactacaataacgaccggattctggtgcggcacatagatagttacaatatagatactgatcagtggacaaggtgtaacttcaaccttctcaccggtcaaaatgaatcaggtgtggctgttcacaatggcagaatttacctggtaggcggttactccatttggactaatgagcccttggcctgcatccaggtgctggatgtctctagggaaggaaaggaagaggtgttctatggcccaaccctccccttcgcaagcaatggaatcgctgcatgcttcctccccgccccatacttcacctgccccaacctgcagacccttcaggttcctcaccacaggataggaaccatatag

SEQ ID NO: 30745 - DNA, 1602 bp, Artificial Sequence
  Description of Artificial Sequence: Synthetic coding sequence
atgttgctcagcggaatgagagagagtcagggtacagaagtatccctgcggacaatttccactcaggacctgaggttgctcgttagcttcgcgtacagtggtgttgtgagagctcggtggcctggattgcttagagccgctcaggcagcccttcagtatcagagctcatcctgcctggacctgtgtcagaagggcctcgcccgcggcttaagcccagcccggtgtttagcactgtttcccatggcagaggcccctggcctggagcgcctgtggtccaaagcccggcactatcttcttacacatctgcccgctgtagccctctgccctgctttcccgtcactgcctgccgcttgtctagccgagctgctggattctgatgagttgcacgttcaagaggagtttgaggccttcgtggccgcgcggtgttggctggccgccaatccggagactcaggagagcgaggctaaggccctccttcggtgcgtgcgctttggcagaatgtccaccagagagcttagacgggtccgagccgctggtctactacccccactgacacctgacctgctccaccagctgatggtcgaagcagacgtcccaggccaggagcggcggcgtgaaccagatcgcgccctggtcgtgatcggaggagatggactgcggccggacatggccctgcgtcagccttctagggccgtttggtgggctcgcgcgttcaggtgcggcgtgggattggtgcggactgtcgaatggggacagttgcctgcgctgcctgccccgggaaggtttcggcacggtgcagcctctctagcggggtcagagctatacgtctgcggaggtcaagatttttattcccatagcaacaccctcgcgtctacactcaggtgggaaccaagccaggaagattgggaggaaatggccccattgtcacaggccaggtccctgtttagcttggtggctttggatggcaaactttacgcattgggcggcagacacaacgatgtggctctggattctgtagagacatataatcctgagttgaacgtttggagacccgcccccgcactgccggccccttgctttgcccatgccgcagctatcctcgaaggtcagctgtatgtcagcggcgggtgcggcggcacaggacagtatttggccagtttaatgcattacgaccctaagctggagaagccaggcacattcttgagtcccatgggcgtgcccagagcaggccatgtgatggccgcactgggtgggcggctctacgtagctgggggactgggagagaccgaagaccttctgtcgtttgaagcatatgagctccgcaccgatagctggacacatctagctcccctgccatcaccacacgtgggggccgcctcagcagtgttacagggggaactgttagtgctaggtggatacagccacaggacttacgctctatcacacctgattcacgcttactgcccaggtctaggacgctggttgtgcctgggaaccctcccacgtcccagggccgaaatgcccgcctgtattttgaccctccccgccgtgcagcatattgccctggtgcccacaccccatcaaacgaagccagcgggttag

SEQ ID NO: 30746 - DNA, 1935 bp, Artificial Sequence
  Description of Artificial Sequence: Synthetic coding sequence
atgagttattttctgagctactgtaaagctcatggaggcgccctgttaacgggctaccaggctctaagagcagaaggctttctatgcgacgtgacactagagaccgaaggctcggagtttcctgcccaccgatccctgctggcctgttctagtgactacttccgcgccttattcaagagtcatactcaggagagccgggcacgagtgattcaccttcacgttcccagcgctgccggcctccaaaggctgctggatttcatttacacagcttggctgtcgttatccatggatacggtggaagataccctggaggcggcttcgtatctccaggtgacagaagctctcggactgtgcgggaggtatctggaaagacaactggcccctgagaactgctgttttgctgcgaatgtggctgccaggtttggcctggcccacaccttagatgcagccgaacgatgcatagtttctcatttgcaggaactgctggcacgaggggctggtccagccggcctgctcgaactcaaccccacaagtttgagggcggtgttgggagccccagatgttgccagggtgcctgaagcgcggttgctgggattagctctggcctggctgaggcaggagcccactaccgagcgactggcacactgcaccgagttactcgaaagagtccgcttcggcctggttccagcagacgtccttcgccgggtgtactctggtagcggattagtcctgcctgctagggttaaggggctcatcatacaggctctaaactaccatacaacgcctagtcgacaaccattgatgcaaggggagcagacatcaataaggagcccgcagacgcgcattcttcttgtgggaggtcggagagcccgcgaagtggtgatcgaggaagttgctgcccctcagcgcgccgcccgtggtcaggtagctgcccctgaacccgaagaagaggaagaggagctggaggaggaggaggaagaagaagagtgggaactgactcagaatgtggtggcgttcgatgtctacaaccacaggtggcgaagcttaacccaactccctaccccgctgctgggccactccgtctgcaccgccggtaactttctgttcgtgttaggcggagaatcaccttcagggtccgcgtcaagccccctcgctgacgacagcagagtcgtaacagcacaggtgcaccgatacgatcctagattccacgcctggactgaggtgcctgcaatgcgggaggctcgcgcccatttttggtgcggagcggtaggcgagcggctgctggccgtgggtggtttgggagcgggcggcgaggtactggcaagtgtcgaaatgtacgatcttagacgagaccggtggactgcggccggtgccctgcctcgggccctgcacggccatgctggggctgttggagataggggcgtggtctatatctcagggggaaaagctggcagaggagaaggcggcgcttctagtcttagggacctctatgtcttgggtccagaggaacaggtgtggtccaaaaaggctcctatggggaccgcccgctttggacaccatatggcggtcctgcggggcgctgtgttcgcatttctggggaggtacgaaccattctcagagatcgagcgatacgacccgggagcggatcagtggacaagattgcgccctctgccctacgacaggttttgttacggtctcgcggtggttgaagagaccgcccttcttctggggggcctgaagtggcgagactctcgacaggtgccaacacgcaatgtagtcggatacgacctggacttggataggtgggaggacattggatgcgctctgccttgggcgtggagcgggcttcgctgcgcagtcctgcagctcgccgaggggggagacgacgagcgtgaaggcgaagttggcgaggcccttgacctggttctcggttag

SEQ ID NO: 30747 - DNA, 1092 bp, Artificial Sequence
  Description of Artificial Sequence: Synthetic coding sequence
atgcgttgggttcgtcatgacgctccagctcggcgcggacagctgaggcgcctcctggagcacgtgagactgccactactcgcgccagcctactttttggagaaggtcgaagcagacgagttacttcaagcctgtggtgagtgcaggccactgttgttggaagctcgcgcatgtttcatcctgggaagggaagccggggcattgagaacaagaccccgccgcttcatggatctcgcagaagtgatagtcgtgattggcggctgtgatcgaaaggggctgctgaagctcccattcgcggatgcctatcacccagagtcccaacggtggacaccactccctagcctcccaggatacacgcgttctgaattcgctgcttgcgctttaaggaatgacgtgtacgtctcaggtggccatattaatagccatgacgtctggatgtttagctcacaccttcacacatggattaaagtcgcctccttacacaagggcagatggagacacaaaatggccgtcgtacagggccagttatttgctgttggcgggtttgacggattacgacgcctgcacagcgttgaaaggtatgaccctttcagtaacacctgggctgccgcggcgcccctccccgaggcagtgtcgtcagccgccgtagcaagctgcgccggcaagctgttcgtaattggcggggccagacaggggggcgtgaatacagataaagtgcagtgctttgatccaaaggaagacagatggagtctgaggagccccgcaccatttagccagcgctgcctggaggcagtgtcgctagaggatactatatacgtgatgggcggtttaatgagtaagatttttacgtacgatcctggaactgatgtatggggagaggctgctgttttgccatcccctgtagaatcttgtggggtcacggtctgcgatggtaaggtgcatattctgggcggccgagatgatcgaggggagtccaccgacaaagtgttcaccttcgacccctccagtgggcaagtagaagtgcagccctccttacagagatgcacgtcctctcacggatgtgtgacgatcatacagtccctgggaagatag

SEQ ID NO: 30748 - DNA, 1752 bp, Artificial Sequence
  Description of Artificial Sequence: Synthetic coding sequence
atgagacagggacacgcacccgaagagagcgagccaggctgcgaggcaccgtgtgctggaccttgccacgctcagagagtgctccaggctctaaatgcgtatagacgcagcgggactctgacagacgtggtgctgcgggccggaggtagggacttcccctgtcaccgagctgcactgtctgcaggatctgcctactttaggtctctttttgccgccggacggccagagaggggacccgccgtggtgccagtcgtgcccgtcgcaccggaggcacctggtacaagccctgctggggctgcggctgccctggcagtcgtcttggattacgtctacggcgccggggtgcgcctgagagccgaggatgaggcagcagcagtgcttgcactggcagaaaggctgggggttgccggactcagggaagcctgtgtgagattcctggaggggcgtctgcgggccgccaacagcctggctcttcggcgggtagcagctgcgttttctttggcgccccttgccgaacgttgtggccgcgtcctacgccaggcatttgcagaggtggccagacacgcagacttcctcgagttagcgcccgatgaggtggtagcactgcttgccgaccctgccctgggtgttgcgcgggaggaagccgtgttcgaagccgccatgcgctgggtcagacacgatgcaccagcgaggagagggcagctgcgcagactcctggagcacgtccggctgccactgcttgcacctgcctatttcttggagaaagtcgaggcggatgagctccttcaggcatgcggggaatgcaggcccctcctgctcgaagcgcgagcctgcttcatcctgggcagggaagccggagcactccgaacaaggccaaggcgctttatggacctcgcagaggtcatcgttgtgatcgggggctgcgatcgcaagggcctgttgaagttaccgttcgcagacgcctaccaccctgagtcacagcggtggaccccgctcccatctctacccggatatacaagaagtgagttcgctgcatgcgcactgcggaatgatgtctacgtcagcgggggccacattaatagtcacgacgtttggatgttttcctcacatctccacacttggatcaaagtcgcgtccctacacaaggggagatggcgccacaaaatggccgtggtccaaggccagctgttcgccgtagggggtttcgatggtctcagacgcttacatagtgtggagcgctacgatccattctcaaatacctgggcagctgccgcaccgttgcccgaggccgtgtcgtccgccgctgtagctagctgcgccggaaagcttttcgtgatcgggggagcccggcaggggggtgtcaatacagacaaggttcaatgtttcgaccctaaggaggacagatggagtctcagatcccccgctccattctcccagcgttgtctggaagccgtcagcttggaggacaccatctacgtgatgggcgggctgatgtccaaaatcttcacctacgaccccggtacagacgtatggggggaagccgcagtgttgccgagcccagttgagtcctgtggtgtgactgtgtgtgacggaaaagtccatatccttggcgggagagatgatcggggcgaatctacagataaggttttcaccttcgaccccagttcgggacaggtcgaagttcagcctagcctacagcgttgcacttctagccacggctgcgtaaccatcatccagagtctgggacgctag

SEQ ID NO: 30749 - DNA, 1662 bp, Artificial Sequence
  Description of Artificial Sequence: Synthetic coding sequence
atgatggaaggtagccgtcagactcgggtcagtcggccatacaaaatttcagagtcttccaaggtttaccgctgggctgaccacagctcgacggtacttcagcggctgaatgagcagagacttcgagggctgttttgcgatgtggtgttagtcgctgacgagcaacgagtgcccgcccatcgaaacctcctcgctgtttgctcagattacttcaattctatgtttaccatcggaatgcgggaggcatttcagaaggaggtggagcttatcggtgcctcatatatcggactgaaagccgtcgttgattttctgtacggaggcgaactcgtgttagatgggggcaatattgattatgtgctcgaaacggcccacctgcttcagatatggaccgtcgtggacttttgctgcgagtatttagaacaagaagtgtcagaggataactatctttacctgcaggagcttgcctccatttattcattaaagcgccttgacgctttcattgacggttttattcttaaccactttggtaccctctcattcacccccgattttctccagaatgtctctatgcagaaactttgtgtttatctgagttcttctgaagtccaacgtgagtgtgagcacgacctcctacaggccgccctgcagtggctcacccagcagcctgagcgcgaagcccatgcacgacaggtcttggaaaacatccatttccctcttatccctaagaacgatttactccaccgggtgaagccagccgtgtgttccctcctaccaaaagaagccaactgtgagggtttcatcgaggaagctgtgcgttaccacaacaatctggccgcacagccagtgatgcagacgaagcgaacggccctgagaactaatcaggagaggttacttttcgtgggcggcgaggtatccgagagatgcctggaactgagcgacgacacttgctacctggacgcaaagtctgagcagtgggtgaaagaaaccccacttccagccagacggagccaccactgtgtcgccgtcctagggggttttatctttattgctggcggaagctttagccgagacaacggaggagatgctgccagcaacctgctgtaccggtttacctatggacatgccgggactatctataaagatttcgtctatataagtggcggccacgactaccagattgggccctacaggaagaacttgttatgctacgaccatcgcaccgacgtatgggaggaacggcgccctatgactaccgctaggggctggcactccatgtgctcccttggcgattctatttactccatcggcggaagcgatgataacattgagtcaatggagcgatttgacgtcctgggtgtcgaagcatatagcccccagtgcaatcaatggacacgagtcgcccccctgctgcacgccaacagtgagtcaggggtagccgtgtgggaggggaggatatacatcctcggtggttattcttgggagaacaccgccttttcgaaaacagtgcaggtatatgatagagaggccgataaatggagtcggggcgttgacttgccaaaagctattgcgggaggatcagcctgcgtgtgcgccttggaaccacgccctgaggacaagaaaaagaaggggaaaggcaaacgccaccaggacaggggacaatag

SEQ ID NO: 30750 - DNA, 1851 bp, Artificial Sequence
  Description of Artificial Sequence: Synthetic coding sequence
atgatggagggaagcagacaaactcgggtcagtagaccgtacaaaatatcagaaagttctaaggtgtaccggtgggccgatcactcaagcactgtgctgcagcggcttaatgaacaacggttacgggggctgttctgtgacgtggttcttgtggccgacgaacagcgtgtccctgcccatcgcaatctactagcggtttgctccgattacttcaatagcatgtttacgattggaatgagagaagcctttcaaaaggaggtggaacttattggcgcttcttacataggtttaaaggccgtggtggacttcttgtacgggggcgaactggtgctggatggcggaaacattgactacgtcctggagaccgcccatctgctgcaaatatggactgttgttgacttttgctgcgaatatctagaacaggaagtgtcagaagacaattatctgtatttgcaagagttggcatcaatctactccctgaaaaggcttgatgcttttatcgacggttttatcctgaatcatttcgggaccctgagttttacccctgattttttgcagaatgtgtccatgcagaagctgtgtgtatacctctcttcgtccgaagtacagcgagagtgtgagcatgatctcctgcaggcggctctgcagtggctaacccaacaacctgaaagggaagcgcatgcaagacaagtgctggagaatatccatttccctctcattccgaagaacgacctgctccaccgggtgaagcctgccgtgtgttctttgttgccaaaagaggccaattgtgaaggcttcatcgaggaggcggtccgttatcacaacaacctagcagcccaacccgtgatgcagacaaaacgcacagcccttcggaccaatcaagaaagactgttgttcgtgggcggggaagtcagcgaaagatgtctggaactatccgatgacacctgttacctggatgctaagtccgagcagtgggtaaaggaaaccccactacccgcccgcaggtcacatcattgtgtcgccgtcctgggaggcttcatattcattgccggaggctctttcagccgcgataatggtggcgatgctgcatcaaacctgctgtacaggtacgacccgcggtgtaaacaatggattaaagttgcttctatgaaccagagaagagtggacttttacctggcctctatcgaggacatgctggtggcgataggtggcaggaatgagaatggagccctatcctctgtggagacatattcccccaagaccgactcttggtcttacgtggcagggttgcccaggttcacctatggacacgctggcacaatttacaaggatttcgtttacatcagcggcggccacgactaccagatcggtccatatcgcaaaaatctattgtgctatgatcacagaaccgatgtgtgggaggaaagaaggccaatgacgacggccagaggatggcactcaatgtgctccctcggcgatagcatctattcaatagggggaagcgatgataacattgaaagcatggaacgcttcgacgtgttgggcgtggaggcatactcacctcagtgcaaccaatggactagggtcgcacctctcttgcacgccaattctgagtccggggtcgctgtatgggaaggccgaatttatatcctgggcgggtattcctgggaaaataccgcattcagcaagaccgtccaagtgtatgatagggaggccgacaaatggagccgcggagtggatttgccaaaggctattgcgggcggttcggcctgtgtgtgtgccctcgagccccggccggaagataagaagaaaaagggtaaaggcaaaagacaccaagaccggggccagtag

SEQ ID NO: 30751 - DNA, 1851 bp, Artificial Sequence
  Description of Artificial Sequence: Synthetic coding sequence
atgatggaaggctcacgccagacgcgcgtgagcaggccatataaaattagcgaaagcagcaaggtctataggtgggccgaccatagttctacagtgctccaaaggctgaatgagcaacgtttacggggcctattttgcgacgtggtcctcgtcgcagacgagcagagagtacctgcacatagaaacttgctagctgtctgctctgactactttaacagtatgtttaccattgggatgcgcgaggcttttcagaaagaggttgaactgatcggagcttcgtacatcggcttgaaggccgtcgtggattttctgtacggcggggaattagttcttgacggcggcaatatcgactacgttctagaaacagcccacctgctgcaaatttggacagtagtggatttttgctgtgagtatctggagcaggaagtctccgaggataactacctgtatctgcaggagctcgcctcaatttactcactaaaaaggctggacgcttttattgatggatttatcctgaaccacttcggtactctgtcatttacgcctgacttcctacagaacgtctccatgcaaaaactgtgcgtgtatctgtcgagcagcgaagtacaacgggaatgcgaacatgacctcctgcaagccgcactccagtggttgacccagcagcctgagcgggaggcccatgcacggcaagttttggagaacatccactttccactaattccaaaaaacgatctgctgcaccgtgtgaaacccgcggtctgctcgctcctgcctaaggaagccaactgcgagggcttcatcgaagaggctgtgagatatcataacaatctggccgctcagccagttatgcaaaccaagcgcaccgcactgaggactaatcaggagcgcttgctctttgtgggtggagaggtgagtgaaaggtgccttgagttatcagatgatacctgttacctggacgctaagtcagagcagtgggtaaaggaaacacccctgcccgccaggagatcccaccactgcgtcgccgttcttggcggattcatctttatcgctggcggctcttttagcagggataacggcggggatgctgctagtaatctgctgtaccgttacgacccccgttgcaagcagtggataaaggtcgcaagcatgaatcagcgccgggtggatttctatttagcctcaatcgaggatatgctggtagccatcggaggccgcaatgagaatggggcactgagttcagtcgaaacttactcccccaagaccgactcttggtcctacgtggcaggcctaccccggttcacctatggccatgcagggactatatataaagatttcgtgtatatatctgggggccacgattaccagattggtccgtaccgcaagaacttgctgtgctatgaccaccggacagatgtgtgggaagaacgacgccctatgactacagcccgaggatggcacagcatgtgctccctcggggacagcatctactctatagggggctccgatgacaatatcgagtccatggagaggttcgacgttctcggagttgaagcttacagtccacaatgtaaccagtggactagggttgccccactcttacatgcaaacagtgaatctggcgtcgccgtctgggagggaagaatctatatcttggggggctactcttgggagaacacagccttttccaaaaccgttcaggtgtatgaccgggaagcggataaatggagccggggagtagatctccccaaagcaattgctggaggctccgcatgcgtgtgtgccttggagccgcggcccgaggataaaaaaaagaaggggaaaggcaagaggcaccaagatagaggtcagtag

SEQ ID NO: 30752 - DNA, 1746 bp, Artificial Sequence
  Description of Artificial Sequence: Synthetic coding sequence
atggatgaagagtcccttgatgggctgctctttaaggaccatgacttctcttcggatctgctgagacaattgaacagtctacgccaaagcaggatcttaaccgacgtctccatctgcgctggtgctagagagattccttgtcacagaaacgttttggctagtagtagtccttatttccgggccatgttttgcagctcctttcgagagaaaagcgaggcgaaggtccaactcaagggcatcgatccacccaccctcgatcagattgtgagttacgtgtataccggcgaggctcacattgccaccgataatgtactgcccgtcatggaggcagcctccatgctccagttccctaagcttttcgaagcgtgtagctcatacttgcagtcccagctcgccccaagtaactgccttggcatgatccgactgtcagaaatattgtcttgcgagacactaaagaaaaaggcccgggaagtcgccttaacttctttccccgaggtggcagcatctgctgatctgaaagagctttgtgctctcgaacttagagactacttgggggacgacggcctatgcggggaagaagagaaagtgtttgaggccttaatggtatggatcaaacacgatctgcaagcacgtaaacgctatatgcaagagctcttcaagcaggtgcggttgcagtacatccacccagcttttttccatcatttcatcgctaacgacgctctcttgcaaagctcgccagcctgccagatcatcttagagactgccaaaaggcagatgttcagcctgtgtggtacaactgtgccggactgcaagttgcttctgcacgtgcccccacggaactcttatcaggattttctgattctgctgggggggcgcaaagacagccagcaaactacacgagatgtgctcttatactcaaagcaaaccggacaatggcagtccttggctaaattaccgactaggctgtataaggcatcggccatcacactgcatcgttccatctatgtgctgggcggaatggctgtgtctagcggacgcagcctggtgtctcacaacgtatatatcttcagcttgaaactgaaccaatggagactgggggagcctatgctggttgcccgctattctcacagaagcacagcccacaagaactttatcttctctataggaggcattggtgagggccaggagctcatgggctccatggagagatacgacagtatttgcaatgtctgggagagtatggcctcaatgcctgttggagttttgcatccagcggtcgcagttaaggaccagaggctttatttgttcggaggcgaggacattatgcaaaatcccgttaggttaattcaggtgtatcatatctcccgcaacagctggttcaaaatggaaacaagaatgatcaagaacgtgtgtgcccctgccgtcgtactgggcgaacgaatcgtgattgtcggcggttatacacggagaatcctggcctatgatccacaaagcaacaaatttgttaagtgtgctgatatgaaggaccgtagaatgcatcatggcgccactgtgatgggcaataaactatacgtgaccggagggagacgtctcaccacagactgcaacatcgaggactctgccagcttcgactgttacgaccctgagaccgatacctggacttcacaaggtcagctgccccataaactattcgatcacgcatgcttgactctccagtgcatacctcgtacatccggattaccttag

SEQ ID NO: 30753 - DNA, 1854 bp, Artificial Sequence
  Description of Artificial Sequence: Synthetic coding sequence
atgaaggtgtcattaggaaacggagagatgggagtatccgcacacctgcaaccatgtaaggcgggcacaacacggttttttactagcaacacgcattcttccgtagtgctccaaggcttcgaccagctcagaattgagggactgctgtgcgacgttactcttgttccaggcgatggtgacgagatatttccagtccaccgcgccatgatggccagcgcttctgattacttcaaagccatgtttactggcgggatgaaggagcaggacctaatgtgcatcaaactgcatggagttaataaggtgggcctgaagaagatcatcgatttcatctacacggcaaaactgtcactgaacatggacaatctgcaggacactctcgaagccgcatcctttctccagatcttgcccgtcctggacttctgcaaggtcttcctgatatcaggcgtttcattggacaattgcgtcgaagtaggccggatagcgaacacgtataatctgatagaagttgacaaatacgtcaacaatttcatcctgaaaaatttcccagcgcttctgtctacaggtgagtttctcaagctaccttttgagaggctagcattcgtgttgagcagcaattccctaaaacactgcacagagctggaactttttaaagccgcatgcaggtggttacggctggaggacccacgcatggactacgcagctaagctgatgaagaacatccggttccctcttatgacccctcaggatctcattaattatgtccagactgtagattttatgcgaaccgacaacacttgcgtaaaccttctgctcgaagccagcaactaccagatgatgccatacatgcagcccgtaatgcagagcgatcgcaccgctattaggagtgattctacccatctggttacattgggcggtgtgctgcgtcagcagctggtagtgtctaaggagctgaggatgtacgacgagcgagcacaggagtggcgctctctggccccaatggacgccccccggtaccaacacggcattgctgtgattggtaattttctttacgtggtcggcggccaaagcaattatgacaccaaggggaagactgccgtcgacacagtgttccgattcgacccgcgctataacaaatggatgcaggtggcttcgctaaacgagaagcggacatttttccatttaagtgccctgaagggacatctgtacgccgtgggcggcaggagcgccgcaggcgagctggccacggtggagtgctacaatcctcgaatgaatgagtggagctacgtggccaagatgtcagagccgcactacgggcacgccggaactgtgtacggaggacttatgtacatttccggcgggattacccacgatacttttcagaacgagctgatgtgctttgatcctgacactgataagtggatgcagaaagcccccatgactactgtccgtggtctgcattgtatgtgtaccgtaggcgataaactatatgtcataggggggaatcactttcgtggcacatcagattacgatgacgtactgtcttgtgaatactattcccctaccctcgatcagtggacacccatcgccgcaatgttgcggggccagagtgacgtgggagtcgctgtctttgaaaacaaaatatacgtggtcggaggctatagctggaacaaccggtgcatggtcgagatcgtacaaaagtacgaccctgaaaaggacgaatggcacaaagtgtttgacttacctgagagcctggggggtattcgagcctgtaccctgacagtgttcccgccggaagagaacccagggtcgccctcaagagagagccccctcagcgctccttctgatcattcttag

SEQ ID NO: 30754 - DNA, 1650 bp, Artificial Sequence
  Description of Artificial Sequence: Synthetic coding sequence
atgatggcgtccgcttctgactatttcaaggccatgttcactggaggtatgaaggagcaggacctgatgtgcattaaattacatggcgttaataaggttggtctcaagaagatcattgacttcatctacactgccaaattgtctttaaatatggataacttacaggacaccctcgaggcagcaagtttcctgcaaatcttacctgtcctggacttttgtaaggtgtttctgatctccggtgtatctcttgacaattgtgtcgaagtcggacggatcgcaaatacttacaatctaatcgaggtcgacaagtatgtgaataattttatcctgaaaaattttccagcccttctatccaccggtgagtttctgaaactgccgtttgaacgcctcgcttttgtgctctcaagcaactctcttaagcactgcacggaactcgagctcttcaaagctgcctgtagatggttgaggcttgaagaccctcggatggattacgccgctaaactgatgaagaacataaggttcccactgatgacaccgcaggatctgattaactatgtgcagaccgtggattttatgagaacagacaacacttgtgtcaaccttctcttagaggcgtctaattatcagatgatgccttacatgcaaccggtgatgcagagcgaccgcaccgcaatccgttcggacagcacgcaccttgtgacactgggcggggtcctgcgacagcagctcgtcgtgtccaaggagctcaggatgtatgatgagcgcgcccaggaatggcgcagtctggcccccatggacgcaccaagatatcagcacggaattgccgtgattggcaacttcctgtatgtcgtcggtggacagtcgaattatgacactaagggaaaaacagcggtcgatacggtatttagatttgatcccaggtacaacaaatggatgcaggtcgcgtcattgaacgagaaaagaacttttttccacttgagtgcacttaaggggcacttgtacgcagtaggaggacgtagcgccgcgggggaactggcaacagtggagtgctacaacccgcgcatgaacgagtggtcttacgtggcgaagatgtctgaacctcactacggccacgcggggacagtctacgggggactcatgtatataagtgggggaataacacatgataccttccagaatgagcttatgtgctttgaccccgacaccgacaagtggatgcaaaaagctccaatgacaacagtccgtggcttgcactgtatgtgcaccgtgggggataaactatatgtgataggcggcaaccactttcgggggacatctgactatgacgatgtgttgtcttgcgagtactactcacccaccctcgatcagtggactcctattgccgcaatgctgagaggccagtccgatgtgggcgttgccgtcttcgaaaacaaaatttacgtggtggggggttactcttggaataataggtgcatggtggagattgtgcaaaagtacgaccctgagaaagacgaatggcacaaagttttcgaccttcctgaatccctgggcggtattagggcttgtaccctgacagttttcccacctgaggagaatccgggttccccaagtagggaatctccactgtctgccccttcagatcactcttag

SEQ ID NO: 30755 - DNA, 534 bp, Artificial Sequence
  Description of Artificial Sequence: Synthetic coding sequence
atgacaacctccatcagacagttcacgtcgtcaagcagtattaagggaagctcaggtctcggcgggggcagttctcgcacctcttgccagctatcaggcggacttggtgcagggtcatgccgacctgggtctgccggcgggctgggcagtgcactcggtggtagtagctacagctcatgctattcttttggaagcgggggtggctacgggtcatccagttttgagggagtcgatggacttctggttggaggtgaaaaagctacgatgcaaaatcttaacgataggctggccagctatctcgataaagtaagagcactggaggaagccgatacagaactggaggtcaagatcagagattggtaccaaaggcaggccccaggaccagcgcgcgactactcgcagtattacaggatcatcgaagaactgcagaacaaacccccttggacaatgcccacctcatgctatatcctcacaatgcccatctggctattactcacatccgccccgaagtcttggcagaatgagggccgctag

SEQ ID NO: 30756 - DNA, 1326 bp, Artificial Sequence
  Description of Artificial Sequence: Synthetic coding sequence
atgacaacgtcaatcagacagttcactagcagttcaagcataaaaggctcaagtgggctcggcggtggctcttctcgcacctcttgccagctgtccggtggtctcggcgcaggctcttgtaggcctggcagtgccggcggcctgggcagtgcattgggaggcagtagttattcatcttgttactctttcggctccggcggtggctatgggtcttcctcgtttgagggcgtagacgggcttttggttggtggtgagaaagcaactatgcagaatctgaacgaccggctggcttcatacctggataaagttcgagccttagaagaagcagataccgagctagaagtcaaaattcgcgactggtatcagcgacaagccccaggcccagctagagactattcacagtactacaggattattgaggagcttcagaacaagatcctcactgccactgtcgacaacgcaaatattctgcttcacattgacaacgctcaccttgccgctgccgattttaggaccaaattcgagactgaacaggccctgtgtctgagcgtggaggcagacataaatgggccctgtagggtactggacgagcttaccctggctcgcgccgacctggaaatgcatatagagaacttgaaagaggagcttgcttacctaaaaaagaaccatgaggagatgaatgccccccggggacaggttgggggggaaatcaatgtggagatgggcgctgcacctggtgttgatttgagtcgcatactgaatgagatgagagagcagtacgagaaaatggctgagaagaatcggaaagatgctgaagattggtttttttcaaaaacggaggaactaaacagagaggtcgctacaaactctgagcttgtgcagtccgggaaaagtgagataagtgagctgcgctgcacaatgcaagcgctcgagatcgaactacaatcacagctcagcatgaaggcctcactggagggcaaccttgccgagacagaaaaccgctattgcatgcagctttcccagatccagggcttgatagggtccgtcgaagagcggctggcgcagctgctctgcgaaatggagcagcaaaaccaggagtacaagatcctcctcgatatgaaaatgaggttagagctcgaaatcaccacttaccacagactgctcgagggcgaggacgcccatgaaggccttcttgccccaacgcacttcaagcttccagcctcaccagcagccgtgaccacttgtcaggtgccaacgattgttgaagaggtgcaggacggaaaggtcatctcttcccgcgagcaagtgcgtcagaccacgcgatag

SEQ ID NO: 30757 - DNA, 366 bp, Artificial Sequence
  Description of Artificial Sequence: Synthetic coding sequence
atggcatcatgcagcaccagcgggacctgtggcagcagctgttgtcagccatcgtgttgtgagacctcatgttgccagccttcatgctgtcaaacttcttcttgcgggactggatgcgggatcggaggcggcatagggtacggccaggagggatccggaggatctgtctcaacacgcattagatggtgccatcctgattgtcatgtcgaaggaacgtgcttgcccccttgctatttagtttcatgtaccccgccttcctgctgccagcttcatcatgcagaagcttcgtgttgtaggccctcctactgcggtcagtcctgctgccggcccgcctgctgttgtcattgctgtgagcctacctgctag

SEQ ID NO: 30758 - DNA, 372 bp, Artificial Sequence
  Description of Artificial Sequence: Synthetic coding sequence
atgactgggtcttgctgtgggtccaccttttcctcactgagctacgggggagggtgttgtcagccatgctgttgccgcgatccttgctgctgccgtccagtgacatgtcagacaaccgtatgccggccggtgacatgtgtccccaggtgtacccggcctatttgcgagccctgtaggcggccggtgtgctgtgacccatgctccctgcaggagggctgctgccgaccaatcacgtgctgtcccagctcatgtacagccgtagtctgccggccatgctgctgggctaccacgtgctgtcagccagtaagtgttcaatcaccgtgcggtcagccaacaccatgttccactacctgccgcacctccagttgttag

SEQ ID NO: 30759 - DNA, 390 bp, Artificial Sequence
  Description of Artificial Sequence: Synthetic coding sequence
atgacaggttcctgttgcggttcaacattctcatctctcagttatgggggcggctgctgccaaccatgttgctgccgcgatccgtgctgttgcagacccgtgacgtgtcagacaaccgtctgtcgacccgtgacttgtgtgcctcggtgcacacgacctatctgtgagccttgcaggcggccagtgtgttgcgatccatgttctctccaggagggttgctgccgccctataacctgctgcccgagtagttgtaccgccgtggtgtgcagaccttgctgttgggcgacaacatgttgccaaccggtgagtgtacaaagtccctgtgggcagccttctccgtgcggtcaacccactccgtgcagtacaacttgtcggacctcttcctgttag

SEQ ID NO: 30760 - DNA, 468 bp, Artificial Sequence
  Description of Artificial Sequence: Synthetic coding sequence
atggtgagttcttgttgcggttccgtatgcagtgatcagggttgctctcaggatctatgccaggagacatgctgtagaccatcatgctgccagactacctgttgtcgcactacctgttatcggcccagttgttgcgtgtctagctgttgtcggccacagtgttgccagtccgtgtgttgtcagcctacctgctgtcgacctacttgctgtgaaaccacatgttgtcaccctcgttgctgcatcagctcgtgctgtcgcccttcatgttgtatgtcgtcttgctgtaagccccagtgctgccagtccgtatgctgccaaccaacctgctgtcgaccctcctgttgtcgcccgtgctgctgtctccgcccggtctgcggcagggtgtcttgccataccacctgttaccggccgacatgtgtgatctccacatgcccgcggcccctatgttgtgcatcgtcttgctgctag

SEQ ID NO: 30761 - DNA, 660 bp, Artificial Sequence
  Description of Artificial Sequence: Synthetic coding sequence
atgggctgttgtggctgtagcggcggttgtggctcggggtgtggtggatgtggatcaggttgtggcggctgcggctctggctgtgggggctgtggatccgggtgcggcggatgtggcagcggttgtggaggctgtgggagctcttgctgtgtcccgatttgctgttgtaaaccggtttgttgttgcgtccccgcttgctcatgcagctcatgtggaagctgtggcggcagtaaaggcggctacggttcctgcggaggaagcaaaggaggatgcgtgtcttgcggcggcagtaaaggcggatgtggctcgtgtggtgggagtaaggggggatgtggttcgtgcggcggctccaagggcggctgcgggtcttgcggcggcagtaagggcgggtgcggctcgtgtggctgcagccagtgctcttgttgtaaaccttgctgctttagctccgggtgcggcagctcttgttgtcagtcctcttgttgtaagccctcttgctgtcagagcagctgctgtaagccgtactgctgccagtcatcatgctgtaagccctgctgcagcagctccggatgtggatctagctgctgccaatcatcctgttgcaatccatgctgtagtcagagtagctgctgcgtgccagtatgctgtcagtgtaaaatctag

SEQ ID NO: 30762 - DNA, 687 bp, Artificial Sequence
  Description of Artificial Sequence: Synthetic coding sequence
atgggttgctgcggctgctctggagggtgtggatcaggatgtggcggctgcggatccggctgcggtggatgtggatctgggtgcggcggttgcggttccgggtgtggcggctgtggtagcggctgtggcggatgcggctcgtcttgttgtgtgcctatctgctgctgcaagcccgtttgctgttgcgttcctgcctgttcctgtagctcatgcgggtcttgtggtgggagcaaagggggctatgggagctgcgggggctcaaagggggggtgtgtgagctgcgggggaagcaagggtggatgtggctcatgtgggggcagcaaaggcggctgcggatcatgcggcggtagtaaaggcggctgtggatcctgcggtggttccaaggggggttgcggatcctgtggatgctcccagtgctcctgctgcaaaccttgttgttttagcagcggctgcggttccagttgttgtcagagctcttgctgtaagccttgctgtagttcctcagggtgcgggagttcttgctgccaatcaagttgttgcaagccttactgctgccagtcctcttgctgtaaaccctgctgctccagctccggctgcggaagttcctgttgccagtcgtcatgttgcaatccttgctgctcccagagttcctgctgtgtgcccgtgtgttgccagtgtaagatctag

SEQ ID NO: 30763 - DNA, 351 bp, Artificial Sequence
  Description of Artificial Sequence: Synthetic coding sequence
tgttgccaccctacgtgctgccagaatacctgttgccggacgacatgttgtcagcctacgtgtgtggcgagctgttgccagccttcctgctgctcaacaccctgttgtcaaccgacatgttgcgggtcttcctgctgcggaaccacttgttgccagccaacctgctgtcagcccacctgctgtagaaacacatcctgccagcctacatgctgcggaagttcttgctgtcagcctccctgttgtcgccctacttgttgccagactacctgttaccgaaccacttgttgcaggccttcttgctgttgttcaccctgctgtgtgagctcctgttgtcagccttcctgttgttag

SEQ ID NO: 30764 - DNA, 306 bp, Artificial Sequence
  Description of Artificial Sequence: Synthetic coding sequence
aggcccttctgttgccacacgccatgctgccagcccagctgctgcgtgccttcctgctgccaaccttgttgtcatccaacctgttgtcaaaacacatgctgtcggacgacctgctgccagccgacctgcgttgctagctgctgccagcctagctgctgttccacaccgtgttgccagcccacatgttgcgggcagacctgtaacgagagtagctactgcctcccctgttgccgacccacttgctgtcagactacttgctaccggacgacatgttgtaggcccagctgttgctgcagcccctgctag

SEQ ID NO: 30765 - DNA, 753 bp, Artificial Sequence
  Description of Artificial Sequence: Synthetic coding sequence
atgacgcattgttgctccccttgttgccagcccacctgctgccgcactacctgctgcaggacaacctgctggaagccgaccactgtgaccacatgcagcagcaccccctgctgtcagccctcctgctgcgtgccttcctgttgccagccttgctgtcaccctacatgttgccaaaatacttgttgcaggaccacatgttgtcagcctacatgtgtggccagttgctgccagccttcatgttgctccacaccctgttgtcagcccacctgctgcggtagtagctgttgtggccagacttcctgtggatccagctgttgtcaacctatctgcggtagctcttgctgtcagccttgctgtcaccccacctgctatcagactatctgttttcgcacaacttgctgtcagccgacctgttgccagcccacctgttgccggaatactagctgccagccaacgtgttgcgggtcctcatgctgtcagccctgttgccatcccacatgttgccagaccatttgtaggagtacttgttgtcaaccctcatgtgttacaaggtgctgctcaaccccctgttgccaaccaacctgcggggggtctagttgctgcagtcagacatgtaacgaaagctcgtattgtctgccctgctgccgaccaacctgctgccagactacctgctaccgaacaacttgctgtaggccctcttgttgctgcagcccatgctgtgtgtcttcttgttgccagccgtcctgttgctag

SEQ ID NO: 30766 - DNA, 483 bp, Artificial Sequence
  Description of Artificial Sequence: Synthetic coding sequence
atgacccattgttgcagcccggggtgtcagcctacctgttgtaggacaacatgctgcagaaccacttgttggcagcctactattgtgacaacatgctcctcaacaccttgctgccaaccctcttgttgtgtatccagctgctgccaaccctactgccatcctacctgttgtcagaatacctgttgcaggaccacctgctgccagccaacttgcgtgacctcttgctgccagccttcctgctgttccactccctgctaccagcccatttgctgcgggtcgtcatgttgtggccaaacgagttgcggatcctcctgtgggcaatctagttcttgcgcaccggtgtattgtcgtcggacatgttaccaccctacaaccgtctgtctcccaggctgccttaaccagtcctgcggaagctcctgttgccaaccctgttattgccctgcctgctgcgtgtccagctgctgccagcacagctgctgttag

SEQ ID NO: 30767 - DNA, 510 bp, Artificial Sequence
  Description of Artificial Sequence: Synthetic coding sequence
atgacccattgctgtagcccctgctgccaaccaacgtgttgtagaaccacttgctggaaacccactacagtcacaacctgcagtagtacaccctgttgtcagccaagttgttgtgtttcgtcctgttgccagccatgttgccatccaacttgttgtcagaatacatgttgtaggactacatgttgccagcccacctgcgtgacatcatgttgccagcccagttgttgctctactccctgctgccagcctatttgttgtggatcatcttgctgtggacagacttcctgtggcagctcttgctgccagcccagcagttgcgctccaatttattgcagaaggacatgctaccaccccacctccgtatacctccctggttgtctgaatcaaagctgtggcagttcttgctgtcagccttgctgtcggccagcctgttgtgagacaacttgctgtcgaacaacgtgttttcagcctacctgcgtgaccagctgttgtcagcctgcctgttgttag

SEQ ID NO: 30768 - DNA, 510 bp, Artificial Sequence
  Description of Artificial Sequence: Synthetic coding sequence
atgacacattgttgtagcccttgctgccagcctacatgctgccgcacaacctgctggaagccaaccaccgtgactacgtgtagctccacgccttgctgtcagcccagctgttgcgtttcctcctgctgccagccctgctgcaggccagcatgctgccaaaatacctgctgcagaaccacatgttgccaacctacctgtttgacatcatgctgtcagcccagctgctgctccacgacgtgctgtcagccaatctgctgcggctcttcttgttgcggccagactagttgcgggagttcatgtggacagagctcatcatgtgcacctgtatactgtcggcgcacatgctactacccgaccaccgtttgcctgccagggtgtctcaaccagtcctgcggatcctcttgttgccagccatgctgtcggcccgcctgctgcgagactacttgctgccgcactacatgcttccaacccacatgcgtctcttcttgctgccagccatcttgttgctag

SEQ ID NO: 30769 - DNA, 528 bp, Artificial Sequence
  Description of Artificial Sequence: Synthetic coding sequence
atgacacattgttgcagcccatgttgccagcctacctgttgccgtactacctgctgcagaacgacctgttggaagccgacaacagttaccacatgcagttcaactccctgttgtcagccatcatgctgtgtttcaagttgttgtcagccgccttgctgcaggcccgcatgctgtcagaacacctgttgtcgcactacctgctgtcaaccaacgtgtctcaccagctgctgccagcctagctgctgcagcaccacatgttgccagcccatatgttgcggctcttcatgctgcggccagaccagttgcgggtcctcctgcgggcagtctagctcctgtgctccagtgtactgtcgccgaacatgttactaccctactacagtgtgtctgcccggatgcctaaatcagagctgtggaagtagctgctgtcaaccttgttgccggccagcatgctgcgagactacatgttgccgcaccacctgctttcagcccacttgcgtcagcagctgttgtcaaccatcttgttgttag

SEQ ID NO: 30770 - DNA, 2037 bp, Artificial Sequence
  Description of Artificial Sequence: Synthetic coding sequence
atgcctacatggggtgcccgcccagccagccctgaccggttcgctgtttctgcagaagctgagaacaaggtgagagagcagcagccccatgttgagcgtatcttcagcgtcggggtcagtgtgctgcccaaagattgtcctgacaaccctcacatatggttgcaattggagggaccaaaggagaacgcgtcacgtgcaaaggaatatttgaaaggactttgctccccagagcttcaggacgagatccattatccgccgaagctccactgtatattccttggtgctcaggggttttttttggattgtctggcttggagtacttctgctcatctcgtgcctagagcgcctggatctctcatgatttcgggactgacggaggctttcgtgatggctcagagcagagtggaggagctggccgaaaggctctcgtgggattttacacccggtccgagtagcggcgcttcgcaatgtacaggggtacttagagacttttccgctcttcttcagtcacccggggacgcacaccgagaagctctcttgcagctacctcttgctgttcaggaggagctactgtctctcgtgcaggaagcatcatctggccagggcccaggcgctctggcatcctgggaaggccggagttccgctctgctgggcgcacaatgtcagggggttcgtgctccaccatctgacggtcgcgagtctcttgacacaggatctatgggcccaggtgattgtcgcggcgccagaggcgacacatacgcagtcgaaaaagaaggggggaagcaaggtggcccacgcgaaatggattgggggtggaaagagttgccaggcgaagaggcttgggaacgggaggtggctctcaggcctcagtcggtgggaggcggcgcccgcgaatcagctccactgaagggaaaagcgttaggcaaagaagagatcgccctgggcggggggggtttctgcgtgcatcgcgaaccacccggtgcacatggttcatgccaccgtgccgctcagtctagaggtgcctctctcctgcagaggttacataatggcaacgcgtcacccccacgcgttcccagcccccctccagccccagaaccaccctggcattgtggggacaggggggattgtggcgatcgcggagatgttggtgatcgtggggacaagcagcagggaatggcgagggggaggggcccccagtggaaacgaggcgcccgcggcggaaatctggtgactggtacccagaggttcaaggaggcgctccaagatcctttcactctgtgcctcgctaacgtccccggtcagccagatctgaggcatattgtgattgatggttccaacgtcgccatggtgcacggactccagcattatttctccagtagagggatcgccattgcagtgcagtatttttgggacagggggcatcgggacatcacagtgtttgtgccccaatggcggttctccaaggatgcgaaagttcgagagagccacttcttacaaaaactgtactcactgagcctcctcagtctaacaccgagtagggtgatggacggaaaacgcatttcatcatacgacgatcgtttcatggtcaaactggctgaggagacagacgggattatcgtgtccaatgaccagtttagagacctcgccgaagagagcgaaaagtggatggccatcatcagagagcggttactgcccttcactttcgtgggaaatctgttcatggtgcctgacgatcccctggggcgaaacggtccaaccctggatgaattcctcaagaaacctgctagaactcagggaagttccaaagcgcaacatcctagtcggggattcgctgagcacgggaaacagcagcagggacgggaggaggaaaaaggctccggggggatccggaagacccgagagactgaacgcttgcggcggcagctactggaagtgttttggggccaagaccacaaagtcgattttattctgcaacgcgagccttattgccgtgacatcaatcaactgtcggaggctctgttgtctcttaacttctag

SEQ ID NO: 30771 - DNA, 2037 bp, Artificial Sequence
  Description of Artificial Sequence: Synthetic coding sequence
atgccgacatggggggcgcgcccggcaagtccagataggtttgccgtaagtgctgaagccgagaacaaagttagagagcaacagccacacgtggagagaatcttttccgttggtgtatccgttctgcctaaggactgtccagacaatcctcacatctggctgcagctggaaggccctaaagaaaatgcctcacgtgccaaagaataccttaagggactctgttcccccgagctgcaagatgaaatacattaccccccaaagcttcattgtattttcttgggcgcacagggtttctttctggattgcctggcatggagcaccagcgcccacctcgtaccacgggctccgggatcgcttatgataagcggcctgactgaagccttcgttatggctcaaagtcgggtggaggagctagcggagcgcctgtcttgggacttcacacccggaccgagtagtggagctagccagtgcactggggtcttaagagattttagcgcccttcttcagagtccaggcgatgcccatcgtgaggcacttctgcaactgcccctcgctgtccaggaggagctgttgtccttagtgcaggaggcctcctccgggcagggacctggagcactggctagctgggaaggaagatctagcgccctgctcggcgctcagtgtcaaggggtgcgggcacctccgtccgacgggagagagtcgttggatacaggctccatgggacccggcgactgcaggggggcaaggggagatacatatgccgtcgagaaagaaggcggcaagcagggagggcctcgggaaatggactggggttggaaggagttaccaggtgaagaggcctgggaacgggaggtcgccttgcggccgcaatctgtgggtggcggtgctcgggaatcggcccctctgaagggaaaagcccttgggaaagaggaaattgcccttggagggggaggcttctgcgtgcaccgggaaccaccaggagcacacgggtcttgtcatcgagctgcccagagtcggggggcgagcctacttcagcgtttgcacaacggaaatgcatctccaccccgagttccaagcccccctccggcaccggagccgccatggcattgtggcgaccgcggtgattgcggagacaggggagacgtgggagatcggggtgataagcagcagggaatggcccgcggcagggggcctcagtggaaacggggcgcaaggggtggaaacttggtgactggaactcagcgcttcaaagaggctttacaagacccgtttactctctgcctggctaatgtacctggacagccagatctcagacatatcgttatcgatggatcaaatgtggccatggtgcatggtcttcagcattatttctcatctaggggaattgctatcgctgtccagtacttttgggatagggggcatcgcgacatcacagtgttcgtcccccagtggcgttttagcaaagacgctaaggtcagggaaagccatttcctccagaaactgtattctctcagcctgctaagtctcaccccatcacgcgtgatggatgggaaacgcattagcagctatgacgacagatttatggtaaagctagctgaagagacggatggcatcatcgtgtccaatgatcagttcagagacttggcagaagagagcgagaaatggatggccattattcgggagaggctgcttccctttactttcgtgggcaacctgtttatggtgcccgacgaccctctgggtcggaacggccccacccttgacgaattccttaagaagccggcaagaacccaggggtcatcaaaggctcagcatccgtcgcgcggtttcgctgagcacgggaaacagcagcagggcagagaagaggaaaaaggtagtggaggtattagaaagacacgagagactgagagactgagaaggcagctgctcgaagtgttctgggggcaagaccataaggtggactttatactgcaaagagaaccttactgccgcgacatcaaccagctcagcgaagccctgctgtccctcaatttctag

SEQ ID NO: 30772 - DNA, 408 bp, Artificial Sequence
  Description of Artificial Sequence: Synthetic coding sequence
atgcccacgtggggggcaagaccagcaagcccagatcgcttcgcagtttccgccgaggccgaaaacaaggtgcgagaacagcagccccatgttgaacgtatcttctcagtaggggtctccgtgctccccaaggattgccctgacaatcctcacatctggctccagttagagggccctaaggaaaatgcttcacgcgcaaaagagtacttgaaaggtctgtgtagtccagaactgcaggatgagatacactaccccccaaaactgcattgcatcttccttggtgcccaggggttctttctcgactgcctagcctggagcaccagcgcccatttagtgccacgagcccctggaagtctcatgatctccgggctgactgaggctttcgtgatggctcagtcacgcgtgtag

SEQ ID NO: 30773 - DNA, 2037 bp, Artificial Sequence
  Description of Artificial Sequence: Synthetic coding sequence
atgcctacatggggcgcccggccagcgtcacccgatagattcgcggtgtctgccgaagctgagaacaaagtacgggaacagcagccgcatgtagagcgaatttttagtgttggtgtttctgtactacctaaagactgtcctgacaacccccatatatggctccagctggagggcccaaaggaaaatgcctcccgagccaaggaatacctgaagggcttgtgcagccctgaattgcaagacgagatccactacccaccaaagctccactgcatcttcctcggtgcccagggcttctttctcgattgcttggcttggtcgacttccgcccaccttgttcctagggcccccggctctctgatgattagtggcctgaccgaagcctttgttatggcccaatcaagagtcgaagaactggccgaacggctctcttgggatttcacacccggccccagcagtggtgcctcacaatgtactggcgtgctgcgggacttctcagcactacttcaaagccccggcgatgcacacagggaagcccttctgcagctgccactcgcagttcaagaagagctgcttagtctggttcaagaagcctcctctggccaggggcccggggccctcgcaagctgggaaggcagatcctctgccttactcggtgcacagtgccaaggagtcagggcacccccttccgacggacgcgaatcattagacacgggctccatgggccccggagactgcaggggggcacgcggggacacctacgccgtcgagaaggaaggcggcaagcaaggcgggccccgggagatggattgggggtggaaggaactgccaggtgaagaggcatgggagcgcgaggtggccctgaggcctcagagcgtggggggcggagcgagggaatcagcaccgttgaagggtaaagctctcggcaaggaggagattgcattaggcggcggagggttctgcgttcaccgtgagcctccaggcgcccatgggagctgccatcgtgccgcccagagccgaggggcaagcctcctgcagaggctgcacaacggcaacgcgtccccacccagagtgccctcaccacccccagctcctgaaccaccatggcattgtggcgacagaggggattgtggagatcgcggcgatgtcggtgatcgaggtgacaaacagcagggcatggctagggggaggggtccacagtggaaacgcggagcccgaggaggcaacctggtaactggaactcagcggtttaaggaagcgctgcaggaccccttcacactgtgtctagccaatgtgcctggtcaaccagacctgcgccacatagtgatcgacgggagcaacgtggctatggttcacggtctgcagcactatttttccagtcgcgggattgcgatcgccgtacagtatttttgggaccgaggccatcgcgatatcaccgtctttgtgccacagtggcggttcagcaaagatgcaaaggttagagagagccattttcttcagaagctctatagtcttagtctattatcattgaccccttctcgcgtcatggacggtaagaggatctcatcatatgatgaccggtttatggtgaaactggctgaggaaacggatggcatcatagtcagcaacgaccagttccgcgacctggcggaggaatctgaaaagtggatggccataataagagaacgccttctccccttcacttttgtcggtaacctgttcatggttcccgacgaccccctgggaaggaacggacccacccttgacgaattcctgaaaaaaccagcgagaacgcaagggtcctctaaggctcaacatccctcgcgcggattcgcagagcacggtaaacagcagcagggcagggaggaggagaaaggatctggtggcatacgcaagactcgcgagaccgagagactcagaagacagctgctggaagttttttgggggcaagatcataaggtggactttatcctccagcgggagccctactgccgggatataaatcagctctcggaggccctgctctccctgaatttttag

SEQ ID NO: 30774 - DNA, 387 bp, Artificial Sequence
  Description of Artificial Sequence: Synthetic coding sequence
atggccgtgggcactagcgccctgtccaaggagccttggtggaccctgccagagaactttcactcacctatggtgttccacatggaagaggatcaagaagaactcatcttcggccttgatgacacctaccttcgttgtatcgagctccacagccatacacttatccagcttgagcgatgcttcactgccaccggccagactagagtgaccgttgttgggcctcctatggccaaacaatggttactgctgatgttccactgtgtgggatcccaggatagcaagtgtcatgccaggggcctcaaaatgttggagcgggtgagaagtcagcccctcactaatgatgacctcgtgacatccgtcagtctgcccccctataccggggattag

SEQ ID NO: 30775 - DNA, 1251 bp, Artificial Sequence
  Description of Artificial Sequence: Synthetic coding sequence
atgtcgccctcccatgtcgttgtgaatgtgtccactgcccgctccgggcctctcaccacatccagcgctcccgtgtctcgagcagagtccttgaggccaggctctcgcagctgtacaatgtccatgagccctaccgtcatcatactcgcatgcctgggatttttcctggaccaaagtgtgtgggctcatgtcggcggccaggacaaacctttttgctctgcgtggccctcagccgtggtacctcaggggggacacgtgacactgcgctgccactgcagaagaggcttcaatatctttaccctgtacaagaaggatggagtacctgttccagaactgtacaatcgaatcttttggaatagctttctcatttcccccgttacccctgcccatgccgggacttatcggtgccgtgggtttcaccctcactctcctacagaatggtccgccccaagtaatccgctggttattatggtgacaggcctgtacgagaagccttccctgaccgcaagaccaggacctacggtgagagcgggcgagaacgtaacattgtcctgttcctctcaatctagctttgatatctatcacctgagtagagagggggaggcccatgaattgcgattgcccgccgtgccctctattaacggcacattccaggcggatttcccattgggccccgctacacacggggagacatataggtgcttcggtagttttcacgggagcccgtacgagtggagcgaccccagcgaccctctgcccgtcagcgtgacaggtaatccgtcctctagctggccctctccgacagaaccgtctttcaagaccggtatcgctcgtcatctgcacgccgtgattagatattccgtggccattatcttattcacaatccttccattcttccttctccacagatggtgctccaagaaaaagaacgccgccgtaatgaatcaggaaccagccggccacagaaccgtgaatagggaagactcagatgaacaggatcctcaagaagtgacatacgcccagctggatcactgcatttttactcagagaaagataaccggccccagtcagcgcagtaagcggccctctaccgatacatctgtgtgtattgagctgccgaacgctgagccacgcgctctcagccccgctcatgagcaccacagccaagccctcatggggagcagtcgcgaaacaactgcgctttcacagacacagctggctagttccaacgtccccgctgctgggatctag

SEQ ID NO: 30776 - DNA, 915 bp, Artificial Sequence
  Description of Artificial Sequence: Synthetic coding sequence
atgtctttaatggtcgtgagcatggcgtgcgtgggcttcttcctgctgcagggcgcatggccccacgagggcgtgcacagaaagcctagtctgctcgcccaccctggaccactggttaagtccgaggaaactgtcatactccaatgctggtcagatgttcgttttgagcactttcttctccaccgcgaaggcaagtacaaagatactctccatctgatcggagaacaccacgatggcgtatccaaagctaacttctctataggacctatgatgcaggacctcgccgggacctaccgctgttatggcagcgtgactcacagtccttaccagctcagtgctccctctgatccgctggatattgtgatcacaggactctacgaaaaacccagcctgtccgctcagcccggacccaccgttcttgcaggggagagtgtgactctcagctgctccagccgctcttcgtacgatatgtaccacttaagccgagagggagaggctcatgagcggcgtttctctgcggggcctaaggtcaacgggacttttcaggcagattttcccttgggtccagctactcacggaggcacatatcggtgctttggctcttttcgtgactccccatatgagtggtccaactcgagcgacccgcttttggtcagcgttacaggcaaccctagcaatagctggccaagccccactgaaccgtcctcaaaaaccggtaatcccagacacttacacgtgctgatcgggacatccgtggtaaagattccttttacaattctcctattctttcttttgcataggtggtgtagcaacaagaagaacgccgccgtgatggatcaggagcccgcaggaaatagaacagtaaactcggaggactcggacgaacaggatcaccaggaagtgagctacgcttag

SEQ ID NO: 30777 - DNA, 915 bp, Artificial Sequence
  Description of Artificial Sequence: Synthetic coding sequence
atgtcactgatggttgtatccatggcctgtgtgggctttttcctgttacagggtgcgtggccccatgagggcgtgcaccgtaaacccagtctgctggcgcatccgggccccctggtgaagtctgaagagacagtgatcctgcagtgctggtctgatgtgaggtttgagcattttctgctgcaccgtgaggggaagtataaggataccctgcacctgataggggaacatcatgacggagtatccaaggctaactttagcattggtcctatgatgcaagacctggccgggacctacaggtgttacggctccgtgacccattccccctaccagctaagtgctccaagcgatccacttgacattgtgatcacaggattgtacgagaaaccctcgctcagcgcccagcccggccccaccgtgctcgccggagagtcagtgacactaagctgctcatctcgcagcagttacgacatgtaccacctctctagagagggagaagcgcatgagcggaggttcagcgcaggccctaaggtgaatgggacgttccaggccgacttccccctcggtcctgctacccacgggggcacatatcgctgcttcggctcattcagggacagcccttatgagtggtccaatagcagtgacccgctcctggtgagcgttaccgggaatccatcaaactcctggccatctcctacggaacccagctcaaagacaggcaatccacggcacctgcacgtgttgataggcacctcagtagtgaaaatccctttcaccatcctgctgttttttctactgcacagatggtgctccaataagaaaaatgccgcggtcatggaccaggaacctgccggaaataggacagttaacagcgaagattctgacgagcaggaccaccaagaggtgtcgtatgcttag

SEQ ID NO: 30778 - DNA, 867 bp, Artificial Sequence
  Description of Artificial Sequence: Synthetic coding sequence
atggcttgcgtagcgttctttctcctacagggagcctggccccacgaaggctttcgcagaaagcctagtcttctggcgcaccctgggccactcgttaagtcagaggaaacagtaattcttcaatgctggtccgacgtaatgtttgaacacttcctgctgcaccgggaaggtaccttcaaccacaccctgcgactgattggggaacacattgacggggtgtccaagggcaattttagcattggaaggatgacacaggacctggccgggacctataggtgctacggctccgtgacacactcaccttatcagctctctgcccctagcgaccctttggatatcgttataacaggactttatgagaagccttcactgtctgcccagcctgggccaacagtactggccggcgagtctgtgaccctcagttgctcgagtcgcagcagctacgacatgtaccatctgtcccgggaaggtgaagctcatgagagacggttaccagcgggacccaaggtcaaccggactttccaagcagattttcccctggatcctgctacacacggggggacataccgctgcttcggctccttcagagattctccttatgaatggtctaaatcttcggaccctctgctggtttccgttactgggaactccagcaattcgtggccttccccgactgagccctctagcgagacaggcaatccacggcatctccatgtattaatcgggacaagcgtcgtgaagctccccttcacaatccttctgttctttctgttgcatcggtggtgtagtaataagaaaaatgccagtgtgatggatcagggtcctgctggtaaccgtacggtgaaccgggaggattcagacgaatag

SEQ ID NO: 30779 - DNA, 666 bp, Artificial Sequence
  Description of Artificial Sequence: Synthetic coding sequence
atgagcctcacggtggtgtccatggcttgtgtggggtttttcttgctccagggggcatggccactgatgggcaatcatagaaaaccttccctactggcgcaccccggccccctgctgaaatctggggaaaccgtgatcctgcagtgctggagcgatgtgatgttcgaacacttcttcctgcaccgtgaggggatctctgaagacccatcacggttagttggccagatccatgacggcgtctccaaggcgaatttttctattggacccctaatgcccgttctcgcaggaacgtaccgctgttacggctccgtgccacatagtccgtaccagctctccgccccaagcgacccactcgacatagtgataactggtctgtacgaaaagcctagcctgtccgcacagcctggacccactgtgcaagcaggtgagaacgtaacgctgtcctgctcatcctggtccagctacgacatataccacctgtcccgtgagggagaagcccacgaaaggagactccgggcggttcccaaggtcaaccgaacattccaagctgactttccattagggccagccacacatgggggaacctatcggtgtttcggttccttccgcgcgctcccttgcgtgtggtctaacagctccgacccactgttggtctctgtaacctag

SEQ ID NO: 30780 - DNA, 1002 bp, Artificial Sequence
  Description of Artificial Sequence: Synthetic coding sequence
atgtctctgaccgtagtctcaatggcttgtgtggggttctttcttcttcagggagcctggccacttatgggcgggcaggataaaccatttctgtctgctaggccttcaactgtggtccctaggggcggtcacgttgccctgcaatgccattaccggagagggtttaataatttcatgctttacaaagaagaccgaagccacgtgcctatctttcacggaagaatcttccaggagtcattcattatgggtccagtgacacctgcccacgcggggacttatcgttgccggggctccagaccgcatagcttaaccgggtggtcaacgccctcgaatcctctggtgataatggtcacagggaatcatcgtaagcccagcctgctggcccacccaggtcctctgctcaagtccggcgaaacagttattctgcagtgctggtctgatgttatgttcgagcacttctttctgcacagggagggcatcagcgaggacccttccagactcgtggggcagatccatgacggagtctcaaaagcaaatttctccatcggccccctcatgccagtgttagcagggacatatcgatgttatgggagcgtgccccattctccctatcaacttagcgcaccctcagaccctttagatattgtgatcaccggactgtacgagaaaccatccctctcggcccaaccagggcccaccgtccaagcgggggagaatgtgacattaagctgttcttcttggagttcatacgacatttatcatttatctagggagggggaggctcatgaaagaagacttcgtgccgtgcccaaagttaaccggactttccaggctgattttcctctgggccccgcaacccatggcggtacttacaggtgtttcggcagtttcagggcgttgccttgcgtgtggagtaacagctccgacccactcttggtcagcgtgacgggcaacccctccagtagctggccttctcctactgaaccctctagtaagtcctag

SEQ ID NO: 30781 - DNA, 5250 bp, Artificial Sequence
  Description of Artificial Sequence: Synthetic coding sequence
atgcaggccatggatcccgccgccgccgatttgtacgaggaggacggcaaagatctcgacttctatgacttcgagcccctgccgactctccccgaggacgaggagaacgtgagcctggctgatatcttgagcctccgggaccgtgggttgagtgaacaagaagcgtgggccgtctgtctggaatgttcactctcaatgcggtccgtcgcgcacgccgcaatttttcagagcctgtgcataacccccgataccctggcattcaacacttccggtaatgtctgctttatggaacagctgtccgatgaccccgaaggggcatttgtgcccccagagtttgatgtaactgggaatacctttgaggcccatatatactcgttgggggccaccctcaaggcagccctggagtacgtcgcagaacctaccctggagccgaggcttagccaggacctcgaggccctgctgtctcgaatgcaggctgaggatcccggagacagaccagacctggagtccataatagccctgtgcgaagagaaattacaactaaccagctcctgtcgcgtttgtcgctccctatctgccgttggcagacgtgtactgtctattgagtcatttggagcacttcaggacgtgtccgagtcatcctggagggagcgtcccgcgcccgggaacgccggcccacgtaggcctccaggagatccaagcactgatcccgaagtgctgccgacacccgagggacctgaatccgaaaccagtagagggccgagagctagccccactaaggctcttctgtctacccccgtgcggaacggggaaagccacagtagggaaggtcttgccggactggtgctcgacgccgaacgaacactcggcgagctcgatcgggacgccctgagacggagtaggctgcgcaaagtccagacgtttcctagactgctgtcagattccccggaagccaccctttgcctaccactgacccgagggaaaagccagctgcccatctcagaactttttagtccagaccccaggaaggcgttcctggatcgcaaaaatggtctatccagtttccaggcccagcccaaatgccggctttggccagaacaggagccagagcaccagctggggagagtgccttgtgcaggacgctcaaccgaccggggaccaggggttccgggatcccctggacaaccagagaccagccatccatcccaggggccagccgaggcccccgctgaccctagggacgcctctggtgaggcccagactccccgggacgatgagcggatccctgaaggagcccggcagctcgaatcagcagccgccgaacagtgggtgtccctgcaggatctcctgagtcaacttggtcggccgttccgggagtacgagctttgggccctctgtctggcctgtctaagggccctgcagacaaggccggaacaccccgcatacctgtgtctcgattctgtcttggttgcagaagatggtgccgttctcttccagccaccccctgcaaatggtagctacgactcttttttcctggcacccgaacttgctgaggagcgtctcgtgaccgaaaaggcaagcgtctactgtgtggccgccgttctctggaccgccgctaaattttccgtgcccagaaaccacaagctggcattgcctcgtaggctgaaaaccttgttgctggacatggcgcgacggagtgctcctgaaagaccctcagccgctgaggcaatcaaggtgtgcggaagttaccttctacagcgcggcatggattcccgcaaaatcctagcgcacctgcgggctagcatatgccaggtctaccaggaagaagagacgatcagcctgcaaaacgccttctccgtcgtggaactgaaaccttccgtcgcaccggcacccgaaccatcacccggcttcctgcccgtgaacagcgatactggattagtggctgtccccggacctgttcctgggcagcatccttgcggagaagaggctacacagctcccagctgctttcacatccgaagccactcattttaagcctatcgtactggcccagaatgcttctgtcgcccgggatcagcccgccttggcccaggaagagagcgaggagagaggcggacagcgggagggagagggggaggaaaagttatctctggaagctcatgcgggaagcccttcactaaagaccccagacgggccagtcccaggcccgggaccgcagggggctgctcctgagccactgggagccagcgtgcagcgagatagcgcccagggaagaccctgtcccccacctcaggcacctgccaaccagccggagggtgccagttctgctgctcctggcagtcccgtgccagctccaccaaccaaggcaagcgccctgccggtggagcagggacctgcagaacccatccctccaggcgttgcctctgggggcctccggcctgatgccttaggccccacaactgctcatcacggtcctagacatccgccaaagccccctagatctaaagcaacagaacgccctggccaggagccagaggggcccggagcaactcccgccggggaacgcgatgatcagagccccgattcagttccagagcggcctagaccagccgatcgcaggctgtgtctgccttgcgtggatgccagcccccttcccggtcgcacagcctgccccagcctgcaagaagcaacccggctgatacaggaagagtttgcgttcgatggctatctggataacggcctggaggccttgattatgggtgagtacatcttcgccttaaaagacctaacattcgcaactttctgcggcgcgattagtgagaaattctgtgatctctattgggatgagaagctacttcagaacctctttaaggtagtgaatggccaggcgtctccgtcaccttctactgccgaggaggcaggttcccaactggaaggaagccagtcccctagatccccctcatctaaaagaccgtcactgcatcggcttggcaaggagaaacctgccatggcccgcacatcctccagggcaccatgctcccccacctcagtcagtgacgttgactccgatgcgttatcaagaggtaacttcgaggtagggtttagacctcaacgcagtgtgaaagctgagagagctcaacagcccgaagcaggagaagacaggcgacccgctggaggagctagcgacgtggaagcagtgactcgtctggccaggagcaagggtgttggccctgcactgagtccggggcctgcaggattccagtcatgcagcccaggttggtgctccgccttttacgaggcagattgtttcggcgcagacgtccacaattacgtcaaggacctcggtagacagcaggccgatggtgctctgccagatgcgcagagccccgagctagagcaacagctaatgatggagaagagaaactatcggaagactctcaaattttatcagaagctgctgcagaaagaaaaaagaaataaaggatctgacgtcaagacgatgctctccaagctcaagggacagctggaagaaatgaagtcacgagtgcagttcctttctctcgtgaagaagtatcttcaagtcatgtacgctgaacgatggggcctggagccgtgcacactgcccgtgatagttaatatcgcagccgcaccatgcgataccctagatttttcaccattggatgagtctagttctctgattttttacaatgttaacaaacaccctggcggtcgacagaaggcacgaatccttcaggcaggtaccccattaggcctgatggcatacctgtatagctcggacgcatttctcgagggatatgttcagcaatttctttatacatttcgatacttctgcactcctcatgattttcttcactttctgctcgatcgaattaattcgaccctgaccagggcacaccaggaccccaccagcactttcacgaaaatataccgccgatccttatgtgtgttgcaggcctgggtggaggactgttacgccgttgatttcccccgaaactccggattgcttggcaaattagaggacttcatctcatcaaagatcctgcccctcgatggcagtgctaaacatctcctggggctgctcgaagtcggaatggataggcgagccgaggggaacccaagaggcacggacctcgagaaccctagagaagccgaggaagatgcaaggcctttcaatgctttgtgtaagcggctttctgaagacggcatcagtcgcaagagttttccctggcggcttcctagagggaacggccttgttttgcctccacataaagaaagaccctataccatcgccgccgctttacccaaaccttgctttctggaggacttttatggaccctgcgcaaagaccagtgaaaaggggccctactttctcaccgagtactcgacccaccaactgttctctcagcttacactcctgcagcaggaactctttcagaaatgccacccagttcacttcctgaacagtcgtgctctaggtgtgatggataagtctacggccatcccaaaagctagttcatccgagtccctcagtgccaaaacctgcagcctcttccttcctaactatgtgcaggataagtatcttctgcagctccttcgtaatgctgacgatgttagtacatgggtggccgctgagatcgtgaccagccatacctcaaagctgcaggttaatctgctgtctaagttccttctaatagccaagtcctgttacgaacagcgaaacttcgccactgctatgcaaatcctgtccggccttgagcacctggcggtcaggcagtcccctgcatggcgcatcctccctgcaaagattgctgaggtgatggaggaactgaaggcagtggaagtgttcttaaagtccgactcactgtgtctcatggagggtcggcgctttagggctcagcctacgctgccctccgcccatttgctggcaatgcacatacagcagctcgaaacaggagggtttacaatgactaatggtgctcatcggtggtccaaactgcggaatatcgcaaaagtcgtctcccaggtccatgcctttcaagagaatccgtacacatttagccccgaccctaaactccaatcatatttgaagcaacgcatcgcaaggtttagcggagccgatataagcacactggccgctgattctcgcgcgaacttccaccaggttagctccgaaaaacacagccgaaaaattcaggacaagttgcgaagaatgaaggcgacttttcagtag

SEQ ID NO: 30782 - DNA, 5256 bp, Artificial Sequence
  Description of Artificial Sequence: Synthetic coding sequence
atgcaagctatggatccagcagcagctgacctctacgaagaggatgggaaagaccttgacttttacgatttcgagcctttacccacgcttccggaagatgaagaaaatgtctccttggctgatattttaagcctaagggacaggggcctttcagaacaggaagcttgggccgtatgcctggagtgtagcctgtccatgcggtccgtcgcccatgccgctatctttcaatcactgtgtattactcccgacaccttggctttcaataccagcggtaatgtttgcttcatggaacagcttagcgatgaccccgaaggcgctttcgttcccccagagttcgatgtgacggggaacacattcgaggcccacatctactcccttggggctaccctgaaggccgctttggagtatgtggcagagccgaccctagagcctcgactgagccaggacctggaggccttgctctctagaatgcaggctgaagatccgggcgaccggcccgatctggagagcattatcgctctgtgtgaggaaaaactgcagctgactagcagttgccgcgtgtgcagatcgttgagcgccgtgggtcggcgagtgctctcaattgagagcttcggcgcgctgcaagacgtgtcagagtctagctggcgcgaaagaccggctcccggaaacgctggccccagaagacctcctggggaccccagcaccgacccagaggtccttcctacccctgagggaccagaatctgagacctcacgtggacccagagcgtctcccactaaggcgcttctttctacgcctgtcagaaacggcgaaagccactcccgagagggactggcggggctcgtgctcgatgctgaaagaactttaggggagctggatcgcgatgcactccggagatctaggctgcgaaaggtccagaccttccctcggcttctctccgattcacccgaagcgaccctttgcctccccttaactagaggtaagtctcagctccctatctctgagctgttttctcctgaccctaggaaggcgtttctggatcggaagaacggtctgtcaagtttccaggcacaacccaaatgtcggctgtggccagaacaggagccagaacatcagcttggccgcgtgccctgcgctggacggtctaccgatagaggccccggtgtccctggatctcctggacagccagagaccagccatcctagccaggggccggccgaggctcccgcagaccccagggatgcctccggggaggctcagacgccccgtgatgatgagcgcatcccagagggggcccggcagctcgagagtgccgcggccgagcagtgggtgtccctgcaggatttactttcccagctcggtcgtccttttcgcgaatatgaactgtgggctctctgcttagcttgcctccgcgccctccagacacgaccagagcacccggcttatctgtgtctggactcagtactcgtggcagaggacggagccgtactcttccagcctcctccagctaacggctcgtacgacagtttttttcttgccccagaactagcagaagagcgcttagtcactgagaaggctagcgtttactgtgtggctgcggtactttggaccgcagcaaagttcagcgtgccccggaatcacaaactggcactcccacggcggctgaagaccctgctactggacatggcaagaagaagtgcgcctgaaaggccgtctgcagccgaggccattaaagtgtgcggaagctacctgctgcagcgtggaatggacagtcgcaagattctggcacatctacgcgctagcatatgccaggtttatcaggaagaggaaacaatttctctccagaacgcctttagcgtagtagagctcaaaccaagcgttgctcctgcccctgagccttcaccaggttttttaccagtgaacagtgatacaggactggttgccgtgccaggtcccgttcccggacagcacccctgcggcgaggaggccacacagctacccgctgcctttacgagcgaggccacccatttcaagccaatcgtgcttgcccaaaacgccagcgtcgcgagggatcagcctgcacttgcccaagaggagagtgaggagcgaggcgggcagcgcgaaggtgagggagaagaaaagctatccctagaggcccatgcgggttcaccatccctgaaaacccccgacggacctgtgccaggccctggccctcaaggagccgctcccgagcccttgggggcctcagtccaaagggacagtgctcagggacgcccatgtccgccccctcaagctcctgccaaccagcccgaaggggcctcctctgccgcacctggtagcccagttcccgccccacccaccaaagccagcgctttacctgtggagcaggggcccgccgaacccatacccccaggcgtggcctcaggagggttacggcccgacgcactggggccaaccactgctcatcacggcccacgtcaccctccaaagcccccgcggtcaaaggctactgagaggcctggacaggagccagaaggccctggcgcaactccagctggagagcgcgacgatcagagccccgattctgtccccgagcgcccacggcccgcggacagacgactttgcttgccctgtgtagacgccagcccactgcccggcagaaccgcttgtccctcactacaagaggctactcgactcatccaggaagagttcgcctttgatggctacctggataacggtttggaagctttgatcatggagccgggcgagtacatcttcgctttaaaagacctgaccttcgccaccttttgtggcgccatttctgaaaagttttgcgatctttactgggacgaaaagttgcttcagaatcttttcaaggtggtgaacggtcaggccagtccatcccccagcacagcagaagaggctgggagccaactcgaaggaagccagtccccccgtagcccttcctcaaaaagaccatccctccatagattagggaaagaaaagccagctatggcccggacaagcagcagggctccatgtagcccaacaagtgtcagtgatgttgacagcgatgcactgagcaggggcaacttcgaagtagggttccgtccgcaaagatccgtcaaagcagagagggcccagcaaccggaggcaggggaggacagaagacctgcgggcggcgccagtgatgtggaggccgtgacacgcttagccagatctaaaggggtaggtcctgccctgtcccctgggcccgctggctttcagtcctgttctcctgggtggtgttcggcattttacgaagccgattgctttggcgccgatgtgcacaactacgttaaggatctaggacggcagcaggcggacggtgctctgccagacgctcagtcacctgaactggaacaacagctcatgatggagaagcggaattatcggaagacactgaaattttaccagaaactcctccagaaggaaaagaggaataaggggagcgatgttaagactatgctgagtaaactcaaggggcagctggaagagatgaaatctcgcgttcagtttctttctctagtgaaaaaatacctgcaggtgatgtacgcagaaagatggggactggagccttgtacgttgccggtgatcgttaacattgcggcagctccatgcgataccctcgacttcagccctctggacgaaagcagttccctcatcttttacaatgtcaacaaacatcccggaggtaggcagaaagcaagaattctccaggccggcactcctctgggactcatggcctatctgtattcatccgatgcatttctcgaggggtatgtgcagcagtttctgtatacctttagatatttctgcactccccacgattttcttcactttctgttggatcgcatcaactctacacttacccgtgcccaccaggatccaacctctacctttaccaagatctatcgtcggtctttgtgtgtactccaggcatgggtggaagattgctacgcagtggattttcccagaaactccggtctcctgggcaagcttgaagatttcataagctcaaaaatcctgccattggacggcagcgccaagcatctgctcggcctgttggaggtgggaatggatagacgggccgaggggaatcccagagggaccgatttggagaaccccagggaggcggaagaagatgccaggcccttcaacgccctgtgtaaacgactgtccgaagatgggatttccagaaagagctttccctggagactaccacgggggaatggactcgtcctccctccccataaggagcgcccttatactatcgccgccgccctgcccaaaccatgtttcctagaggatttctatggaccatgtgctaaaactagcgagaagggcccatattttctgactgaatatagcacacatcagctgttcagccaattgaccctcctccagcaagagctgtttcagaaatgtcatcccgtccattttttgaactcaagagccctgggagtcatggacaagtccacggcaatcccaaaggccagttccagtgagagcctctctgcgaagacctgcagtctttttttgcctaactatgtccaggacaagtatctgttacagctcttgcgtaatgccgacgacgtgtctacctgggtggctgccgaaatcgtcacgagccatacttcaaagctgcaggtgaacctgctgagcaagtttctattgattgccaaaagttgctacgagcagcgcaatttcgctaccgccatgcagatcctgtctggacttgaacacctggccgtgaggcagtccccagcctggagaattctgccagcgaagatcgccgaggtgatggaggagctgaaagccgtggaagtgttcctgaaatcggatagtctatgtttgatggagggtagacggttccgcgcacagccaaccctaccatcagcccaccttctggctatgcacattcaacagttagagaccgggggatttaccatgaccaacggagctcatcgctggagtaagctgaggaacatcgctaaagtggtgtctcaagtgcacgccttccaggaaaacccctacactttctcccctgaccccaagttacaaagttatctgaaacagaggatcgctcgtttctcaggggctgacattagtactctggccgcggacagtcgagctaattttcaccaggttagctctgagaagcactcccgcaagatccaggataagttacggaggatgaaagccaccttccagtag

SEQ ID NO: 30783 - DNA, 561 bp, Artificial Sequence
  Description of Artificial Sequence: Synthetic coding sequence
taagacctgtcgaagtcaagagagaacctgagtgccgtgatgttgtataacccaggactgtttcccatcaaaggcccaatatgcctccggctggaattcgaacgccagcagagggaggagctcgagaagctcgagtcaaagagaaagctgattgaagagatggaggaaaaacagaaatcggacaaggcagagctggagcggatgcagcaggaggtggagacccagcggaaggagactgagattgtccaattgcagatcaggaagcaggaagagtctttgaagagaaggtcctttcacatcgagaataaactcaaggatcttcttgccgaaaaggaaaaatttgaggaagagagactgcgggaacagcaggagattgagctgcagaaaaagaggcaggaagaagagaccttcctacgtgttcaggaggagctgcagagacttaaagagctcaacaacaatgaaaaagcagagaaatttcagattttccaggagctggaccagctgcagaaggagaaagacgaacagtacgcaaaacttgaactggagaagaaaagattgtag

SEQ ID NO: 30784 - DNA, 2874 bp, Artificial Sequence
  Description of Artificial Sequence: Synthetic coding sequence
atggccgatcccgctgaatgttctatcaaggtgatgtgtaggtttagacccctgaacgaggcagagattttgcgcggtgataaattcataccgaagtttaagggggacgaaacagttgtgattgggcagggcaaaccatacgttttcgaccgcgtgttgcccccaaatacaactcaggaacaggtttataatgcctgcgccaaacagattgtcaaagatgtgctggaagggtacaatggcaccatatttgcctacggccaaacctcctccggaaaaacccacacaatggagggcaaactccatgatccacagctgatgggcatcattccccgaatcgcccatgatattttcgaccacatttacagtatggatgagaacttggagttccatatcaaagtaagttatttcgaaatttatctggacaagatacgggacctgctcgatgtctctaagactaatctcgccgtccatgaggacaagaacagggtgccctatgtgaagggctgcactgagcgtttcgtcagtagcccagaagaggtgatggatgtgatcgacgaggggaaagccaataggcatgtcgcagtcacaaacatgaacgagcattcctcccgtagccactctatctttcttataaacatcaaacaagagaacgttgaaactgagaagaaattgtcgggaaagttatacttagttgacttggccggaagcgaaaaagtgtctaaaaccggggcagagggagctgtgctggacgaagcgaagaatattaataagtccctgtctgcactggggaacgtcatcagtgcacttgccgagggtactaaaacgcacgtcccttatagagattcaaaaatgacccgaattctgcaggacagcctcggtggaaactgccgcaccacaatcgtgatttgctgtagcccttcggtgtttaatgaggccgaaactaagtccacactgatgtttggccaaagggctaaaactattaaaaacactgtatctgtgaatctggaactcacagccgaagagtggaaaaagaagtacgagaaagagaaagaaaaaaataagaccctgaagaatgtgattcagcacttagagatggagcttaaccgctggcgaaatggagaggctgtgcctgaagacgagcagatcagcgccaaagaccagaaaaacctggagccctgcgataacacacccatcattgataatattgcccctgtagttgcaggcatctccacagaggaaaaggagaagtatgacgaagagatatcaagtctgtaccggcagcttgatgataaggacgacgagattaaccagcagtcacagctcgctgaaaagctcaaacaacaaatgctcgaccaagacgagcttctcgcctctacccgccgcgactatgaaaaaattcaggaggagttgacacgtctgcagattgagaatgaagccgccaaggatgaagtcaaagaggtgctgcaagccctcgaggaactggcggtaaactatgaccagaagtcacaagaggtggaagacaagacacgagcaaatgagcagctgacagacgagttagcgcagaagacaactaccctgacaactacccagagagagttgtctcagctgcaagagctgtcaaaccatcaaaaaaagcgggcgaccgaaattctgaacctcctgctcaaggacttgggcgagatcggcggaatcatcggtactaatgacgtaaagacactcgcagacgttaacggcgtgattgaagaagagtttaccatggctcgcttatacatttccaagatgaagtcggaggtcaaatcactggtgaacaggtcaaaacagctggagtctgcacaaatggactcaaatcgcaaaatgaatgctagcgaacgcgaactcgcggcatgccagcttctcatttcccagcatgaggcgaagatcaagtccttgaccgactatatgcagaatatggagcagaaacggcgacagttagaggagtctcaggattcattatctgaagaactggccaaacttcgggcccaggagaagatgcacgaagtgagctttcaggataaggagaaagagcacctgacaaggctgcaggacgccgaagagatgaagaaagctctagagcaacagatggagagtcaccgcgaggcccatcaaaagcagctttccagactgagggacgaaattgaggaaaaacagaagatcattgacgagatccgggatctaaatcagaaactgcagctcgagcaggagaaactgtccagcgattataacaaactgaaaatcgaagaccaggagagagaaatgaagcttgagaaactgcttctgctgaatgacaagcgggaacaggccagagaagacctcaagggattagaagaaacggtttcaagagagctgcagactctccataatttacgaaagctttttgttcaggatctgaccacccgcgtgaagaagagtgtggagttggacaatgatgacggaggtggctccgccgcccagaagcagaaaatcagcttccttgagaataaccttgaacagctgaccaaggtccataaacagctcgtaagggacaacgccgacttgcgctgtgagctgcccaaactggaaaagaggctgcgagcaactgccgaacgggtgaaagcactcgagagtgcgttgaaggaagctaaggagaatgccatgagagatagaaaacgctaccagcaggaggtggaccgcattaaggaggctgttagagctaagaacatggctcgtagggcacattctgcccaaatcgccaagcccatccgcccaggtcattaccctgcctcttctccgactgctgttcacgccatccgtggcggcggcgggtccagcagcaactcgacccattaccagaaatag

SEQ ID NO: 30785 - DNA, 2064 bp, Artificial Sequence
  Description of Artificial Sequence: Synthetic coding sequence
atggtggagaacgaacgtctcaggcaagaaatgcgcaggtgtgaagcggaactgcaggagctcagaactaagcccgccggtccttgtcctggatgtgagcactcccaagagtccgctcagctgcgcgacaaactatcacagctgcagctggagatggctgagtccaaaggaatgctgagtgagctgaacctggaggtccaacagaagactgatcggctcgcggaagtggaactgcggctcaaggactgtctggctgagaaagctcaggaggaagagagactatcaagaagactaagggattcccacgaaaccatagcaagcctgcgggcccagtctcctccagtaaagtacgtgatcaaaacagtggaggtcgagtcttcgaaaacaaagcaggccctgtctgagagccaggcacggaatcagcacttacaggagcaggtggcaatgcaaaggcaggtgctgaaagagatggaacagcagctccaaagctctcaccaactgactgcccgtctgcgggcccagattgcaatgtacgaaagtgagctcgagcgagctcacgggcagatgttggaggagatgcagtcgctcgaagaagataagaatcgtgccattgaagaggcattcgcaagggctcaggtggagatgaaggcggttcatgaaaatctagccggcgtgcggactaaccttctgactctccagccagcccttcgcacactgaccaacgattataatggactaaagaggcaggttcggggattccctctattgttgcaggaggcactgcgctctgtgaaggcggagataggccaggctatcgaggaagtcaattccaataaccaagaactgctccgcaaataccggcgggaacttcagctgcgaaaaaagtgtcacaatgagttagtcagactgaaaggcaatattcgagtaatcgctcgggtgcgacctgtcactaaggaggacggggagggccctgaggcaacaaacgcagtgactttcgacgccgatgatgatagcatcattcacctgttacacaaagggaaacccgtgtcctttgaactagataaagtgtttagtccgcaggcctcacagcaagacgtattccaggaggtgcaggctctggtcacgagctgtattgatgggttcaatgtgtgcattttcgcttatggtcagaccggtgctggcaaaacatataccatggaagggacagcagaaaatccggggattaaccagcgcgccttgcagctgttattctctgaagttcaagaaaaagcatccgactgggaatacacgattactgtgtcagctgccgagatctacaatgaagtcctcagggatctcctgggtaaggagcctcaagagaaacttgagatcagactttgtccagacggatccggccagttatacgtccctggccttaccgaatttcaggtgcagagtgtggacgatatcaacaaggtcttcgaatttgggcataccaatcggacaacagagttcacaaatctgaacgagcattctagcaggagccatgccttactaattgtgacagtgcgcggggtagactgcagtaccggcctacgaaccactggaaagctcaatttggtggatctagcgggtagcgagcgcgtcggcaagtcgggagccgaagggtcccgcttgcgggaagctcagcacattaataagagtttgtcagctctgggtgatgtgattgcagctctgcgctccaggcaaggccatgtcccttttcgaaactcgaagcttacgtatttattgcaggacagcctaagtggcgattctaaaaccctgatggtagttcaggtgtcaccagtggaaaagaacacatccgaaaccctatattccttgaaatttgcagaacgcgtccggtctgtggagctgggcccaggcctcagaagagctgagctgggaagctggtcttcacaggagcatttagagtgggagccagcttgccagactccgcagccaagcgctagagcccactctgctccctctagcggaaccagttctcggcctggatctattagacggaagctgcagccctctgcttag

SEQ ID NO: 30786 - DNA, 2556 bp, Artificial Sequence
  Description of Artificial Sequence: Synthetic coding sequence
atggctcaggtcctccacgtccccgcaccctttccaggtaccccagggcccgccagcccaccagcgtttccagcgaaggaccctgatcccccctactccgtagaaacgccttatggctaccgcctagatcttgattttttgaagtatgtggacgacattgaaaaagggcatacgctgcgacgcgttgccgtgcagcggaggcccaggctgtcctccctgcccagaggcccagggtcttggtggacaagcacagagtcattatgttccaatgcctcaggggattcccggcattcagcctattcctattgtggacggggcttttacccgcagtacggcgcgttggaaactagaggtggctttaatccgcgcgtggagcggacattgctggacgcacggaggcgcctggaggatcaggctgccacgccaaccggcttgggctcgttaaccccctcggccgcagggtccaccgccagtcttgtaggggtgggactgccacccccaacacctcgctcctccggactcagcacccctgttccgccatccgccggtcacttggcccacgtgagagagcagatggcgggggcactaagaaagcttagacagctggaggaacaggttaaactcatccccgtgctgcaggtcaaactcagcgtcctgcaggaggagaagcgtcagctgaccgtccaattaaagtcccagaaatttcttgggcaccccacagccggccgaggcaggtcagaactttgtctcgacctgcccgacccaccagaggacccagtagctttggagaccaggtctgtgggcacgtgggtgagggagcgggatctcggcatgccagacggtgaagctgccttggccgccaaggtggccgttttagaaacacagcttaaaaaggcattgcaggagctgcaggccgcacaggcacgtcaggcagatccacagccccaggcctggccaccaccagatagtcctgttcgagtggatactgtgagggtggtcgagggaccccgtgaggtcgaagtggtagcgagcacagccgctggagcgcccgcccagagggcacaaagcttagagccatatggtacaggactccgagcccttgccatgcctggcaggcctgagagcccgccagtgtttcgctctcaagaagtggtggagaccatgtgccctgttcctgcggccgccacaagcaacgtacacatggttaagaagatctccattaccgagcgaagttgcgatggtgcggccggcctccccgaagtgccagccgagtcgtcttcctcgccccccggctccgaagtggcctccctgactcaacccgaaaagtcaacaggacgtgtccctactcaggagccgacccaccgtgagccgacccgacaggccgctagccaggagtctgaggaagccggtgggactggaggccctccggctggcgtgaggtcaatcatgaaacgcaaagaggaggtcgccgatcctactgctcacagacggtccttacagttcgttggagtcaacggcgggtatgagtcctccagtgaagatagctcgactgcggaaaatatttccgacaacgattcaactgaaaacgaagcccctgaaccccgggagcgggttccatcggtggccgaagccccacagcttcgaccagcaggcaccgcagccgcaaagacaagtcggcaggaatgccaactgagcagagagtctcagcatattccaacagccgagggggcttctggctcaaacaccgaggaagaaatcaggatggagttgtcccccgatctcattagtgcatgtttggcactcgagaagtatctcgataatccgaatgccctaaccgaaagggagttgaaagttgcatatactactgtactgcaggaatggctcaggctggcttgtagaagcgacgcacatcccgaactcgtgaggcgccacctcgtcaccttccgcgcgatgtctgccaggctgcttgactacgtggtgaacattgccgattccaatggaaataccgcgcttcactatagcgtctcgcacgcaaacttccctgttgtgcagcaactcctcgacagcggcgtttgcaaagtcgataaacagaacagggccggatactcccctattatgctcactgccctagcgactctgaagacacaagacgacatagaaactgtactccaactcttcagattaggaaacattaacgccaaggcgtctcaggccggccagacagccttaatgttagccgtgtcccatggtcgggttgacgtggtcaaggctctgttagcatgtgaggcagatgtcaatgtccaggatgatgacgggtcaacggctctgatgtgcgcctgcgaacacggccataaggagatagccggactgctgttggcagtcccgagttgcgacatatccctcactgatagagacgggtcaactgcactgatggtagccctggatgccggccagagtgagatcgcttctatgctgtacagccggatgaacatcaaatgctcctttgctccgatgagtgatgacgaatcacccacctcgagcagcgccgaagaatag

SEQ ID NO: 30787 - DNA, 2580 bp, Artificial Sequence
  Description of Artificial Sequence: Synthetic coding sequence
atggctcaggtgttgcatgtgcccgctccctttccaggtacaccaggaccggcaagtccgcctgccttccccgctaaagacccagatccaccctatagcgtagaaaccccgtatggctatcgacttgatttggactttcttaagtacgtcgacgacattgaaaaggggcacacccttcggagagtggcagtgcagagaagacctcgcctctcctctttgcctcgcgggccgggatcttggtggacgtctacggagagcctttgcagtaatgcctcaggggactccaggcacagcgcctactcttactgcgggaggggattctacccccaatacggcgctctggaaacacgcggaggcttcaatccgcgagtggagagaacactgctcgatgccagacgccgcctcgaagaccaggcagctacaccaaccggattgggatctctgactccgtcagccgccggatctaccgcctctttggtgggagttggccttccgcctcctacacctcggagctcaggcctcagcacaccagttcctcccagtgctggtcacctggcacacgtccgggagcaaatggcaggagctctccgaaagctccgtcagctggaggaacaagttaagctgattcccgtgctacaagtgaaattgtctgttttacaggaagagaaacggcagttaacagtgcagcttaagtcccagaagttcctgggccaccccaccgccggaagaggacgatctgaactctgccttgacttgccagatcctccagaagacccagtggctctcgaaacccggagcgtgggaacctgggtccgggaaagagatctgggaatgccagatggagaggctgctctagccgccaaggtagccgtgcttgaaacacagctcaagaaggctctccaagaactgcaggccgcacaggcacgccaggcagatccacagccacaggcctggcccccgcccgattcacccgtcagggtggatacagttagggtcgtcgaaggaccaagagaggtagaagtggtcgcctccaccgctgcaggtgcaccagcccagcgggcccagtcactggagccttacggaacaggactgcgagctttagctatgcccggccgccctgagagcccccccgtcttccgtagtcaggaggtggtggaaacgatgtgccccgttcccgcggcagcaacttccaacgtccacatggtgaagaagatttcaatcacagagaggtcctgcgacggcgccgctgggttgcccgaggtgccagcagagtcctcaagctcccccccgggcagcgaagtggcctcgctgacacaacctgaaaaatccactggcagggttcctacacaggagcccacgcacagggagcccactcgacaggcagcctcccaggagtctgaggaggcaggcggaactgcacctcctctatctagcccacccgggggaccaccggctggggtgagaagcattatgaagcggaaagaggaagtcgcagacccaactgcccatagaaggtccctgcagttcgtgggggtgaacggcgggtatgagagctcctctgaagactcatccactgcagaaaacatctcagacaacgacagcaccgaaaatgaggcgccagagcctagggagagagtgcccagtgtggcagaggccccccaattgcggcccgccggaactgcagcagcaaaaaccagcaggcaggaatgccaattgagcagagagtcccaacatatccctaccgcagagggtgccagcggcagtaacacggaagaagagattcggatggagctgtcccctgacttgatttctgcctgtctggctctggaaaagtacctggacaatcctaatgccttaacagaacgggagttaaaggttgcttacacgaccgtgcttcaagagtggctccggctggcttgtcggagcgacgcacatccggaactcgtgcgccggcacttagtgaccttccgggcgatgtcggcacggttgctggattacgtcgtcaacatcgccgattctaacggcaatacggcgctgcactactccgtctctcatgccaatttccccgtggtgcaacaacttttagactccggtgtgtgcaaggtggacaagcagaaccgcgccggatactcaccaatcatgctcacagcactcgcaaccctgaagacgcaagatgacatcgagacagtgctccagctgttcagattgggcaatataaatgctaaggcctcacaggccggacaaaccgccttaatgctggctgtaagtcacgggcgagtcgatgtggtgaaggcactcctggcatgcgaggccgacgtcaacgtgcaggatgacgatgggtcaaccgcacttatgtgtgcctgcgaacacggacacaaggagatcgccggcctcctgttggccgtaccctcatgcgacataagcctgactgacagagacggttcaaccgccctcatggtggctctggatgctggtcaatcagagatagcatcaatgctctacagccgcatgaacattaagtgctcctttgctccaatgtctgacgatgaatccccaacttctagctctgctgaagagtag

SEQ ID NO: 30788 - DNA, 2556 bp, Artificial Sequence
  Description of Artificial Sequence: Synthetic coding sequence
atggcccaggtgctgcacgtaccagccccgttccctggaacacccgggcccgcctcccctccagccttccccgccaaagaccccgacccaccttattcggtcgagacgccttacggctacaggctggacctcgacttcctgaagtacgtggacgatattgagaaaggacacaccctgcgccgagtcgccgtgcagcggcgtccaagactaagctccctcccccgtgggccaggcagctggtggacatcgaccgaaagcttgtgtagtaacgcctcgggcgactctcgccacagcgcctattcttattgcggacggggattttatcctcaatatggagcattggaaacgcgcggcggctttaaccctcgggtggagcgcaccctgctagacgcgcggagacggctggaggatcaagctgcaacgcctacagggcttggaagcctgactcctagcgcagccggctcaactgctagtctggtaggcgtggggttaccccccccaaccccccgatcatccgggctgtcaacacccgttccaccctcagcagggcacctggctcatgtaagggagcaaatggcaggcgccctccgcaagctgagacaactggaggagcaggtgaaacttatacccgtgttgcaggttaagctctcagtgcttcaggaagaaaaaagacagctcactgttcagctcaaaagtcagaagttcctcggccatccgacagccggtcgcgggcgcagtgaattgtgtctggatctgcccgacccgcctgaggatccggtggccctggagactcgctcagtcggcacctgggttcgtgagcgcgacttaggcatgcccgacggggaggcggccctggccgccaaggtggcagtcttggaaacacagctaaaaaaggccttgcaagagcttcaggcggctcaggcgcggcaggccgacccccagccacaggcttggcccccacccgactctccggttcgcgtcgatacagtccgagtcgtggagggccctcgggaggttgaggtggtggctagtacagccgcaggcgccccggcgcagagggcccagtcgctggagccatacgggactggcctcagggcactggccatgcccggccggcccgaatcacctcctgtcttcaggtcccaagaggtggtagagacaatgtgtcccgtgcccgctgccgctacctctaatgtacatatggtgaaaaagatttcgatcacagagcgatcatgtgatggagccgcggggctgcctgaggttccagccgaatcttcttctagccctccgggcagcgaagtagcttcgttgactcagcccgagaaaagcaccggcagggtgccaacacaggaaccaacacaccgagagccaaccaggcaggctgcttctcaagaaagcgaagaggctgggggaacaggcggacccccagccggggttcggtctatcatgaagcgcaaagaggaggtggcagaccccactgctcacaggagaagtttgcagtttgtcggggtgaacggcgggtacgaatcatctagcgaggacagctctacagctgaaaacatctcagacaatgactccaccgagaacgaggcaccagagccacgggagcgggtgcctagtgtggccgaggccccacagttgcgacctgcagggacagctgccgcaaagacgtctcggcaagagtgccagctgagccgggaatctcagcacattcctactgccgaaggggcttctggaagcaacaccgaggaggagattcgcatggagctcagtcccgacttgatcagcgcatgcttagccctggagaagtatttggacaaccctaacgccttaacagagcgggagttgaaggtggcatacactacagtgttgcaggagtggttgcggctggcgtgcagatcagatgcccaccccgagctagtgcgccggcaccttgttactttccgagctatgtccgccaggctgcttgattacgtggtgaacattgcagactcaaatggcaatacagctctgcactactccgtgtcccacgccaacttcccagtcgtacaacagttactcgacagtggagtgtgtaaggtcgacaagcagaatcgggcaggctattccccaatcatgttgacagcactggctacgctgaagacacaagatgatatagagacagtgttgcagttgttccgcctgggcaatatcaatgcaaaagcctcccaggctggccagaccgctctcatgctcgccgtctctcacggtcgggtggacgttgtgaaagccctgctcgcctgtgaggccgatgtcaatgtacaggacgacgacggttcaactgcactgatgtgcgcatgtgagcacgggcataaagagatcgccggcctgttgctggccgtgcctagctgcgacatctcactcactgaccgggacggaagtactgccctgatggtagcactggatgcgggtcagagtgagatcgcatccatgctgtactctcgtatgaacatcaagtgttctttcgcgcccatgtcggacgatgaatcacccacctcttcatcggccgaggaatag

SEQ ID NO: 30789 - DNA, 2466 bp, Artificial Sequence
  Description of Artificial Sequence: Synthetic coding sequence
atggcaaaattcgccctgaaccagaatctacctgatcttggcggcccacggctgtgccctgtgccagccgccggcggtgctaggtccccatcttcaccttacagtgtcgaaaccccctacggcttccacttagacctggattttctgaaatacatcgaggaattggaacgagggcccgccgccaggcgagcaccaggccccccaactagccgacgtcctcgggccccgagacccgggcttgcaggggcccgatctccgggagcctggacctcatcagaaagcctggcctcagacgacgggggggcaccaggaattctttcgcagggcgccccctcgggattgctcatgcagcctttgtctccacgggctcctgtcaggaaccctcgcgtcgagcataccctccgtgagacctctcgaaggctggaacttgcgcagactcacgagagggcgcctagtccaggtcgcggggtacccagaagtccacgtggatccgggcggtcctccccggcccctaacctggccccggcctcccccggtcccgcacagttgcagctcgtccgcgaacagatggcagcagctctcagacgactgcgcgagctcgaagatcaggcgagaacactgcctgagcttcaggaacaggtacgcgccctcagggccgagaaagcaaggttgctggccgggcgagctcaacccgagcctgatggcgaagccgagacgcgccccgataaactagctcaactgagacgtctgacagaacgtctggccacaagcgagcgaggaggccgcgccagagcgagtcctagagccgacagccctgatggactggccgcaggaagatctgaaggagctctccaagtgctagatggtgaggtgggcagccttgatggaacaccccagacccgcgaagtagctgctgaagccgttcccgaaacaagagaggcgggagcacaggcagtcccagagaccagggaggcaggagtcgaagccgccccagagaccgtggaagcagacgcttgggtgacagaagccctcctggggttaccagctgccgctgaacgcgaactggagctactgcgggcttcacttgagcaccagcgcggggtttctgagctcctgaggggcagactgcgggagctggaagaagccagagaggctgcagaggaagctgcagccggagccagggctcagctaagagaggccacaacacagacaccttggagctgcgccgagaaggccgctcagaccgaatcgcccgccgaagccccctccttgacccaagagtcatcccccggtagcatggatggcgatagggctgtcgcccccgcaggtattctgaagtccattatgaagaagcgggatgggacccctggagcccagccatcttctggcccaaagtcacttcagttcgtgggcgtgttgaatggagaatacgagtcaagcagttccgaagatgcctccgacagtgatggcgacagcgagaacggcggtgcagagcctcctggtagttcttcaggctctggagacgattcaggaggtggcagcgatagcggcactccagggcccccgtccggcggtgatatccgtgatccagagcccgaggccgaggctgaaccccagcaggttgcccagggacgatgcgagcttagtccaagactgcgggaggcctgcgtcgcactccagcgacagttgtcccggcccaggggggtggccagcgacggtggggcagtacgtttagtcgcacaggagtggtttcgtgtcagctcacaacgacggagccaagcagagccggtggctcggatgctcgaaggcgttaggcggctgggaccagaactgcttgcgcatgttgttaatctagccgacggcaatgggaacaccgcactccattatagtgtttctcacggtaatctggccattgcttcgctgttgttagatacaggagcctgcgaggtcaataggcaaaatcgagcggggtacagtgccctgatgctcgctgcactgacctccgttaggcaagaagaagaggacatggccgtagtccagaggttattttgtatgggtgacgtaaatgccaaagcttcccagacaggccaaaccgcactgatgctggcgatttcccacggcaggcaagatatggtggccaccctgcttgcatgtggtgctgacgtaaatgcacaggacgccgacggagctacagccttgatgtgtgcaagcgaatatgggcgcctcgacactgtccgtttactgcttacacagccaggctgtgatcccgcgattttagacaacgaggggacctcagctctggctatcgcactcgaggcagagcaggacgaagtggccgctctgttacacgcccatctgtccagtggacagccagacacccagagtgagagcccccccgggtcccagaccgcaaccccaggagagggtgagtgcggggacaatggagaaaatcctcaggtgcagtag

SEQ ID NO: 30790 - DNA, 633 bp, Artificial Sequence
  Description of Artificial Sequence: Synthetic coding sequence
atggctaccgcacgcaccgtggccccttccccgagggtggcccctcgagctcccgggatgacggcagctggtgaccccacacgagcacctctggccttgcctgctgctggaacttcagggacactctctccacggagaagacagtccctgtccagatggcataggggcggagaaagaagaagcctggtggtgtggcgaggaggtggctgccccccgcctgggaggagatgtccgcggtccatccttagcctgtcatggccacccctacaggtccgagcggaaccggcgtcagaaggaggagtgcgctcagccgccgccgcagcagaacccgctcctcgatcctctgacggcggtgcagtgaggctggtggcccaggaatggtttagggtctcaagtcaaaggagaagtcaagcggagcctgtggcaaggatgctcgagggcgtgagaagacttgggccggaactgctggctcatgtggtgaatctggcggacggtaatggcaacactgctttacactatagtgtatcccacggcaacctggctatcgcttcacttctgcttgatacaggccaatcgcagggccgcgtcggccatcaggagatgggtgggggtagggggcaagggctaacatag

SEQ ID NO: 30791 - DNA, 402 bp, Artificial Sequence
  Description of Artificial Sequence: Synthetic coding sequence
atgattactccgctcgctagtgccgagacaaacgaagacatggccgttgtgtggaagctactcagggagggaaacgtcaatatccaggccacacaggggggccagacagcactgatgttaggagtgtctcacgacagggaggacatggttcaggctctgctgtcatgtcaggcagatgtgaacctccaggatcacgatgggtcctccgcgctgatggtggcatgccaccacggcaacgtggacttagtaagacttctgctggctcacccagcatgtgactcaagtctgacagacaaagccggccgaaccgcactgtccattgccctgaaatcccccactcacatggagatcgctggactgctccgggcccacgcagagcagggccgttctctcgggctgtag

SEQ ID NO: 30792 - DNA, 1104 bp, Artificial Sequence
  Description of Artificial Sequence: Synthetic coding sequence
atggaaaagacagacgaaatttcacctagtacgagtctgaagtctataatgaaaaagaaagactatggattccgcgccggtggaaatggcaccaagaaaaacctgcagttcgtcggagtgaacggaggctacgagacaacctcatctgaggagacgagcggagaggactctacacctgaagatttgtctgatagcgaggccgaaaaaaagtgtgacggacctgatcataagcacgtgaaagatgctcacctgacctgcgaggcaggacagggcattccagaggggacctgtcacgcagcccaggagtctgggcccggagaggaagttccacactcaaaggccgaacgctacaagcctagcgaggaatttctgaacgcctgcagggcactcagccaacacctccctgagaccggcactaccacagaccagctgttgaggcagagcctcaacaccatctctcaggagtggtttcgagtttcctcgcgaaagagtagttccccagccgtggtagcttcttacttacacgaagtccagccacactccccccacttcctgaagttgttggtgaacctggcggaccacaatggaaatacagcgctccactattcagtttcccacagcaacttttccattgtcaagttactgttggaaactggtgtatgtaacgttgaccatcagaataaggccgggtacacggccgtcatgatcacaccgcttgccagtgccgaaacaaacgaagatatggcggttgtgtggaaactgttacgcgaaggtaacgtgaatattcaggccactcagggaggacagaccgccttgatgttgggagtttctcacgaccgggaggacatggtccaggcattgctgtcctgtcaggccgatgtgaacctccaggaccacgatgggtccagcgctcttatggtagcatgtcatcatggtaatgtagacctggtgcggctgctcctcgctcaccccgcatgtgattcctccttaaccgataaggcaggccggactgcattaagcattgccttgaaaagccccacccatatggagatagctggcctgctgagggctcacgcagaacagggacgatcccttgggctgtag

SEQ ID NO: 30793 - DNA, 1056 bp, Artificial Sequence
  Description of Artificial Sequence: Synthetic coding sequence
atgaaaaagaaggactatggattcagggctgggggcaacggtactaagaagaatctgcagttcgtcggagttaacggtggatacgaaactacaagcagcgaggagacttccggagaggactcaacacctgaagatctgagcgactcggaggccgagaagaagtgtgatgggcctgaccacaaacatgtgaaggacgcacatttaacttgcgaagccgggcaaggtatccctgaggggacatgccacgccgcacaggaatctggtcctggggaggaggtgccgcacagcaaggccgaacgttataaaccatcggaggagtttctgaatgcgtgtagggccctgagccagcatctacccgaaactggcacaactactgatcagcttcttaggcagagtttaaacaccatttcacaggagtggttcagagtcagcagtcggaaatcgagctcgccggccgtggtcgcctcttatttacacgaggttcagccccattcaccacacttccttaagctgcttgtgaatctcgccgatcacaatggaaatactgccctgcattattctgtctcacattccaattttagcatcgtcaagctgttactggaaacaggtgtttgtaacgtagaccatcaaaataaggcaggatatacagccgtgatgataacacctctcgccagcgcagagaccaatgaggatatggctgtagtttggaaactgttgagagagggaaacgtgaatatccaggctactcaaggcggacaaactgccctaatgctaggggtctctcatgacagggaagacatggtgcaggctctcctctcatgtcaggccgatgtgaacctacaggaccatgatgggagctctgctcttatggtcgcctgtcaccacggtaacgttgacctcgtgagattgctacttgctcatcctgcttgtgattcctctctgactgacaaagccggacgtaccgctctgtccatagcactcaagagtcctacgcacatggagattgcggggctcctgagagcccacgcggaacagggcaggagtcttgggctgtag

SEQ ID NO: 30794 - DNA, 2988 bp, Artificial Sequence
  Description of Artificial Sequence: Synthetic coding sequence
atggaaaaaaccgacgctaaagatcagagctcacagggcgacgaagaaaaggacccaccaaagagccatccctatagtgtggagacaccatacgggtttcacctggatctggacttcttaaagtacgtcgacgacattgagaaaggcaataccatcaaaagaatacccattcacaggagagctaaacaagccaaattttcaacattaccccggaatttttccctcccagacagcggcgcgagaccccctgcagctcctccactgcagaattggagtccggtcgtgcctagagaggcttcactcggcacccaggagcagaatcagagtcctccactgggcaatgccccgcaggcttccacctcaaggtcagaggtgagttatcaccgaaaagcactcctcgcagaggcaacccggcagcttgaggcggcggagccagaggacgcggaactgacattcgggtcaggcagaccacagctgcttcgcgcctcctccatgcccgccactctattacatagcagagcctccgaggagcccggtttgtctctgggcccaccagccccccccgctctgcccccactccagggcgagggttccgtgtgcgatgggacattcgaacccgctgagggactggcagggttccattcctcaagtccccgtgcctccacccgaataccagaactggtgcaagagggcgccgaaccccccgaaggagtggttaaggtgccaaatcacctgccgcttcccgggccacccttttcgtttcaaaacgtcctggtcgtgcttgaggataaagaggacgagcataacgctcgggaagccgaggtgctatttacgcctgggtctcccaccccctctccaccgccactcccatccccaattcctgagaatgagttgttactcgaggaaatagaactcaatatctctgaaatacctcctccccctccagtggaggtcgatatgcggagcattggcatccgcgtcaccgaggaaagtctgggattggcccgtgttgatccagggagcatttctagcctcaaacaacaagtgtcagcacttgagggggaattgagcggccgtacagaggaattggcccaagtgagaacagcccttcagcagcaagaagaagagatcaaggctcgcgagcagcgcatccgcgagttggagttcacagtggcccagttagaagggcagtttcaccaagaaaacgccaaagatactcaaggccaaaccgacgttatggtgaatacggaccctgtgcatggacttttgactagagagtcctgtgataagggcattgaagtgaatctactgggcagcatggagtctgaatcctggggccataggggggaggagaatggccttctgtggggacccgacggccataagcagggcaaccagagcccagcagaaagggtgttgttacctcaactcagtctcccccagggccctgagcaggtgctcacatctagcgtgcacagtttcctgagtactgaactgagaattgaggaggccggaacagagcaggaaggcgggcctcagggcggtacccgtggcgctggtggattcttgtggggctccgatcgcaaaactcctcccgctggtcgcgaagagacctcttccaacctgccaggcaaggagcatcccggtaggccaccttccagccccacggacgccactattggccagtatgtgaagaagattcaagagcttttgcaggaacagtggaactgccttgagcatggatatccagagctggcgtccgccattaagcagccagcctccaagttatcttccatccaatcccagctgcttagtagcctgaatctgctgcttagcgcctactctgcgcaggcacatccccccaaggagccaccagcatccagcagctctccgcccgtggagatatcgccttccacctctctaaaaagtattatgaaaaaaaaggactacggatttagagcaggcggaaatgggaccaaaaagaatttacagtttgtgggtgtcaacggtggctacgaaaccacctcttctgaggagaccagcggggaagattcgacaccagaggatctgtccgattccgaagccgagaaaaaatgcgacggaccagaccataaacacgtaaaagacgcacatctgacttgcgaagctggccagggtatacccgagggaacttgtcatgccgcccaggaaagcggccctggcgaagaagtcccccactcaaaggccgaacggtacaaaccttctgaggaatttttgaatgcctgtcgggcgcttagccagcatctacccgagacaggcacaacaactgatcagctacttcgacagtctttaaacaccattagccaagaatggtttcgggtgtcatcaaggaagagctcttccccagctgtcgttgcctcttatctgcacgaggtgcaaccacattctcctcattttttgaagctccttgtaaatttggcggaccataatgggaataccgctcttcactacagcgtgagtcactctaatttctccatagtgaaactgcttctggaaactggggtatgcaacgttgaccatcaaaacaaagctggttataccgccgtgatgatcactcctttggctagcgccgagactaatgaggacatggctgtcgtttggaaattactgagagaaggtaacgtcaacatccaggctacacagggtggtcagacagcccttatgctcggcgtgagccatgaccgtgaagacatggtccaggctttgctcagttgccaggccgatgttaacctgcaagaccatgacggtagtagtgccctaatggtggcatgccatcacggaaacgttgatctggtgcgattgcttctggcgcatcctgcctgcgactccagcttgaccgataaagctggccgtacagcactgtctattgccctgaaaagcccgacacatatggagatagccggcctgctcagagctcacgccgaacaggggcgctcactcgggctgtag

SEQ ID NO: 30795 - DNA, 387 bp, Artificial Sequence
  Description of Artificial Sequence: Synthetic coding sequence
atgatgactgccgtctcattgaccacgaggcctcaggagtccgtcgctttcgaggatgtggcagtgtacttcaccacaaaagagtgggcaatcatggttcccgcagagagggctctgtatagggatgtcatgctggaaaactacgaggcagtcgctttcgttgtccctcctacttccaaaccagcactcgtgtctcatttggaacagggtaaggaatcttgttttacccagcctcagggtgtcttatcacggaacgactggcgggcgggctggatcgggtacctcgaactccggcggtatacgtatcttgctaaggctgttctgcggcggatcgtgtccaaaatctttcgaaaccgccagtgttgggaagatcggcgcaaagcctag

SEQ ID NO: 30796 - DNA, 387 bp, Artificial Sequence
  Description of Artificial Sequence: Synthetic coding sequence
atgatgaccgcagttagcctgacgactaggcctcaagaaagcgtagcgtttgaggatgttgctgtctactttacaacaaaggagtgggccataatggtcccggctgaaagagctctgtatcgcgatgtcatgctcgagaactacgaggctgtagccttcgtggtgcctcccacctcgaagccagcacttgtgtcgcacctggaacagggcaaggaatcttgcttcacccaaccccagggcgtcctgagtagaaacgactggagagcagggtggatcggctacttggagttgcgccgctatacctatctggccaaagctgtcttgcggcggatcgtgtctaagatttttcgcaacagacagtgctgggaagacaggcggaaagcttag

SEQ ID NO: 30797 - DNA, 387 bp, Artificial Sequence
  Description of Artificial Sequence: Synthetic coding sequence
atgatgactgctgtctccttgactaccaggccgcaggaaagcgtcgcattcgaggatgtagcagtctacttcacaaccaaagaatgggctatcatggttcctgcagaacgtgctttgtatcgagatgtcatgcttgagaattacgaagccgtcgctttcgtggtgcctcccacctcaaagcccgccctggtgtctcatctggaacagggcaaagagtcatgttttacacagccccagggcgtgctctctcggaacgactggcgagctggttggatcggctacctggagctccggcgctatacttacctcgcaaaggccgtactccgcaggatcgtctccaagatattcagaaaccggcagtgctgggaagatcgccgaaaggcttag

SEQ ID NO: 30798 - DNA, 3090 bp, Artificial Sequence
  Description of Artificial Sequence: Synthetic coding sequence
atgagggaaaactacgaaactctagtgtctgtcgggaccgctgagctactgccactgtctgccttcctgagcccctctgagcctggaagagccgttggtggtggtagccacgccgacgagggtcaggagcccgcaggctgcggagaccctcaggggggtcaaccacgacattccctgcatctcacagctctggtccagttggttaaggagatacccgaatttctgttcggcgaggtcaagggcgcgatggactcccccgagagcgagtcacgaggtgcttcactggatggggaacgggcatcccccgaagccgctgcagctcgggaaccctgccctcttaggggactgctcagttgtctgccagacgggccaacttcccagccccatttagctacgactcccactgactccagttgctccagtgggcccaccggcgacggagtgcaagggtctccactacccataaagaccgcagataagccttggcctacccgaaaggagggacctggcgcccttgggggcgagccctcccctcccacccatagcccctcgaggcgcaagtcacaccggggccaggaacgcggcacttccgaagccggcatcagccctggcaacagcccactccaggggctgatcaattgccttaaagaaatcttagtgccgggcccacgtcatcccgaaacttcgccaagtttcctgcccccactgccttctctcgggaccagcagattaacccgcgcggacctcggacccgggtcccccccctgggcggtgaagactgaggccgtttccggcgactgccccctgcagggacttctgcactgtctgaaggaacttcccgaggctcaggatcgccacccttccccgagcggcgtgggtaatcggcggctgcaagaaaatcccggggcctggaagcgtggctctgggggtccgggttatctactgacccctccgcctcatcccgacctcggagccgggggtttactgtcagtgaagatggagaacagttgggtgcagtccccaccaggcccagctagttgtcagcccgggcggcagccactgtcaccttccgctaccggcgacacccgcggtgttccccagccttcctggggacctgaggcccaggctgccagcgcctcctcttcgcctctggaagcgctggaagcttgcctgaaggggatccctcctaatggatccagcccatcccagctgccaccgacctcttgctctcagaatccacagcctggtgactcaagaagtcagaagcccgaacttcagcctcacagatcccactccgaggaagccaccagggaacccgtgcttccattgggcctccaatcatgtgtgagagatgggccgtcaagaccattggcccctaggggcactcccacatctttcagttcttcatctagcacagattgggacctcgattttggcagtccagtgggtaatcaaggccagcatcctggtaagggctcccccccaggctccagccccttgcagggtctggaaaattgtctgaaagaaattcctgtgccagtgctgcgccccgcctggccttgctctagcgccgctgatagaggacccaggagggccgagcctcgaaactggacagcggataaggaaggtctgcgcgccgaagcctgcgaatcacgcctcggccaagggagaggtgaggcaccgacaaggtcccttcatctggtgtccccacaggtctttacatcctcctgcgttcctgcatgccaccaacgcggttttaaagacccaggcgccacaagacctggggtgtggcgatggctgcctgaaggatctgcccccaagccatctcctctgcactgccttgagagtgcattgcggggcattttgccagtgcggcctcttaggtttgcctgtgttggaggcccatctccatcaccgtcgccaggcagctccagttctttttctggctcggagggagaggaccctcgtcctgagcctgacctctggaagccgctaccgcaggagcgggaccggctcccctcgtgtaagccccctgttcctctgtctccatgcccaggtggaacacccgcaggctctagtgggggcagccctggcgaggacccccgccggaccgagccgcgatattgttcaggactcggagctgggacagcccaggatccatgtccagtgtcgcagctggagaaaagaccacgggtgtctgaggcttcccggggtctcgagttgggccatggtcgcccccgggttgcggctaaaacccacgagaggctcctcccccaaggtcctcccgaactgccttcagaatctcctccgccagagttgccgccccccgaagccgccccccctgtactgccagccagctcgcttcagcccccctgtcattgtggcaaaccgctgcaacaggagcttcactcgctcggcgctgctcttgccgagaaacttgacaggctggcaacagctctggccggactcgctcaggaagtagctaccatgcggacccaagtgaatcgcttaggacgtcgtccccagggcccaggccctatgggtcaagcttcatggatgtggacactgccacgaggccctcgttgggcacacgggcctgggcatcggcaccttccgtattggcggcaaaagggccctaccaggcccaagcctaagatcctccgggggcagggtgagagctgccgcgcaggggacctccagggcttgagtcggggcaccgccaggcgcgcaagaccactacccccggacgcacctcctgcggagcctcctggcctgcattgcagctcaagccagcagctgctcagttccaccccctcctgccacgccgcaccccctgcgcaccccctactggctcatacaggggggcatcagtcacctctcccgccgttggtgccagccgccctgcccctgcagggtgcttctccacccgccgcctctgccgatgcggatgtcccaacttctggcgtggcgccagacggcattccggagcggcctaaagaaccttcttcgctgcttggcggagtgcagagagctttgcaggaagaactttgggggggagagcaccgggatcctcgttggggagcccactag

SEQ ID NO: 30799 - DNA, 2910 bp, Artificial Sequence
  Description of Artificial Sequence: Synthetic coding sequence
atgcgtgagaactacgagacactggttagcgtgggaacagcggagttgttgcctttgagtgcctttctttcaccatctgaaccaggacgggccgtgggcggtggctctcatgcagacgaaggacaggaacccgccggatgtggtgatccccagggcgggcaaccacgacatagcctgcaccttactgctctcgtccaactggtgaaagagatccctgagtttctgtttggggaagtcaaaggcgccatggactctcccgagagtgagtctcgaggggcttcacttgatggggagcgagcatcccctgaagccgcagcagcccgtgaaccatgtcctctgcgaggactgctctcctgtttaccagacgggccaacttctcagccgcacttggcaaccacgcccaccgattcctcatgttcttctggccctacaggggatggcgtgcagggatccccactgcctattaagacagccgataagccttggcctaccagaaaagaaggccccggcgctttaggcggcgagccctccccacctacccattctccatcaagaaggaagtctcacagagggcaggaacgtggaacttcagaggctggtatctcaccaggtaatagtcccctgcaggggcttataaactgccttaaagaaatcctcgtgcctggaccacgacaccctgaaacctcgcctagttttcttcctcccttacccagtctgggcacatctcgtttgactagggctgatctgggccctggctctcctccttgggccgttaaaactgaagctgtgagcggggattgtccgctgcagggacttcttcattgcctgaaagagctccctgaggctcaggatcggcacccttcaccatccggagtgggcaataggagattgcaggaaaaccctggagcctggaaaaggggctcgggcggccctggctatcttctgactcctccaccacatcccgacctgggtgccgggggcctcctgtcagttaagatggaaaatagctgggtacagagccctcccggtcctgcatcgtgccagccaggccgacagccactctccccttccgcaaccggagataccaggggcgtgccacagcccagttggggacccgaggcacaggcagcaagtgcgagctccagcccattagaggccctcgaggcatgcctcaaaggtatcccacctaacggctcatcccccagtcagcttccaccgacgagctgttcacaaaacccacaaccgggtgattctagatcccagaagccggaacttcagccccaccgaagtcatagtgaagaggctactcgcgaaccagtcctaccactagggttgcagtcatgcgtccgcgacggccctagccgaccattagcgccccggggaactcctacaagtttttcgtcctcttcaagcactgactgggacttagacttcggatctcctgttggaaatcagggacaacatcccggcaaaggttctccacctggaagctctcccttgcagggattggagaactgtttgaaagaaatacccgtgccggtcttgcgaccagcatggccttgttcttctgctgctgatcgtggacccagaagggcggaacctcgcaattggacagccgataaagaaggctcagcccctaagccctctcctttgcactgccttgaatccgccttgcgcggtatactgccggttcggcctttgcggtttgcgtgcgttgggggccctagtccaagcccgagccctggctcctcttcctctttttcgggctcagaaggggaagacccgcgccctgagcctgatttgtggaaaccactgccccaagaaagagatcgactcccgtcctgtaagccacccgtccctctaagtccttgtcccggcggcaccccagccggaagtagtgggggctctcctggtgaggaccccaggagaaccgagcctcggtactgttccggcttgggggcaggcactgcccaagacccatgccctgtaagtcaacttgagaagcggcctagggtgtccgaagcatcccggggtttagagctcggacacggccgcccccgcgtagctgccaaaacccatgagcgactcctgccacagggacccccagaactaccttctgaaagtccacctccagagctgccgcctcccgaggcagccccccccgtccttcccgcttctagtctgcagcccccctgccattgtgggaagcccctacagcaggagttgcattctttaggggctgccttggctgagaaacttgaccggctggcgactgcactggccgggttggcccaagaggtagcaactatgcgaactcaggtgaatcgtttagggcggaggcctcagggcccgggccccatgggacaagctagttggatgtggaccttgcctagagggccgcggtgggctcacggaccaggacaccggcatttaccctactggcgtcagaagggacccactcgacccaagcccaaaatcctgagaggacaaggagagtcctgccgtgccggagacttgcagggtctcagccgtggcaccgcgaggcgtgcccggccgttgccccctgacgccccaccggcggagccacccgggctgcattgtagctccagtcaacaattgctctcctctacgccaagttgccacgccgcgcccccagcacaccccctcctggcacatacaggtggacaccagtcccccctccctccattggtcccagctgcactgccattgcagggcgcttctccccctgcagctagcgctgacgccgacgtgcccaccagcggggtggctcctgacggcattccagaacgccctaaggaaccttcatccctcctcggcggtgtgcagagggcgctgcaggaggagttatggggcggggaacaccgggacccccggtggggggcacattag

SEQ ID NO: 30800 - DNA, 312 bp, Artificial Sequence
  Description of Artificial Sequence: Synthetic coding sequence
atgcgcgagaactatgaaacattggtttccgtggggacagccgagctactgccactgtccgcattcctctctcctagtgaacccggtcgcgctgtgggcggaggtagtcacgcagacgagggacaggagccagcgggttgtggggaccctcaggggggtcaacccaggcattcactccatctgacggccctggtgcaattggtaaaggagataccagaatttctattcggcgaagtcaaaggagcaatggattcacccgaatcagaaagccgaggcgcgtctctcgatggtgagagggcaagccctgagtag

SEQ ID NO: 30801 - DNA, 1479 bp, Artificial Sequence
  Description of Artificial Sequence: Synthetic coding sequence
atgccgtccttcctcgttccctcattagtttcttcgccagtgctgctgaaattgctgtttagccccggacctaagactatttggagtctctggcagcaaccaatgctgtttcaggaagccaccgcttttgagaatatgacgaaagattggaattatttggaaggttcacaaaaggattgctacagagacacgatgttggactcctacgagaacacagtgccccagggctcttttctgcagctgagtatgatgccccaacgcgctggcaacgatccccctggagtgagcaacgcttctgaaatggaaatggaaatctccaatatgagggagaaattcctaatgagtgtcacgaaactggtggagtcaaagtcttataattcaaaagtattcagcaaggagaagtatttccagaccattaaagaggtaaaagaagcaaaagaaaaaggaaagaaatcctcccgcgactaccgccgtgcagccaaatacgatgtgatatctgttcaaggaactgagaagttgatcgaagccacgcacggggaacgcgacaggattcgttattacgtccataaagaagagctctttgatattctccatgacacccatcttagtatcggacacggtggacgaacccggatgttgaaagaactacaaggaaagtacggtaatgttactaaagaagtgatagttttgtatctaacgctttgcaagcagtgccaccagaagaaccccgtacctaagcgaggcctggccccgaagcctatgacgttcaaagatattgattcgacctgtcaggtcgagatcctggatatgcaaagctccgccgatggtgaatttaaatttattttatactaccaggaccatagcactaagtttatcatcctgagacccctcaggactaaacaggcccacgaagtggtttcagttctgttggacatcttcaccattctagggacccctagcgttttggacagtgactcaggcgtggagtttacaaatcaagtcgtacacgagctcaatgaattgtggcccgacctgaagatcgtgtctggcaaataccaccccggccagagtcaggggtccctggaaggcgcaagccgggacgttaagaatatgatatcaacttggatgcagtcaaaccactcgtgccattgggccaagggcctgcggttcatgcagatggtgaggaaccaggcttttgatgtcagcctccagcagagcccttttgaggcgatgtttggctacaaggcgaagtttggactgtactcttctaatctacctcgcgaaactgtcgctactcttcagacggaagaggaattggagatcgctgaggagcagttagaaaacagcctgtggatccgacaggaggaacgcgccgaaattggagccgacagatccgacatggacgacgacatggaccccacacccgaggcaagtgagccctccacttcgcaggggacctccggcctgctgtgctggtag

SEQ ID NO: 30802 - DNA, 1233 bp, Artificial Sequence
  Description of Artificial Sequence: Synthetic coding sequence
atgatgccccagcgtgccggcaatgaccccccaggggtgtccaacgctagcgagatggagatggaaatttcgaacatgcgtgagaagttcctgatgagtgttaccaaacttgtcgagtctaagtcttacaattctaaggtcttcagtaaagagaaatacttccagacaatcaaagaggtgaaagaggctaaggagaaggggaagaagagctccagggattaccgcagggccgccaagtacgacgtcatcagcgtgcaagggaccgaaaagctaatcgaagctactcacggggagcgagacaggattcggtattacgtccacaaagaggagcttttcgatatactgcatgatacccatctttccataggccacgggggaagaacccggatgcttaaggaattacaagggaaatatggcaatgtgacaaaggaggtgattgtactgtatcttaccctgtgtaaacaatgtcaccagaaaaaccctgtccccaagaggggactcgctccaaagccaatgacttttaaagacatcgactccacatgccaggtggaaatactggacatgcaatccagcgcagacggagaatttaagtttatcctttactatcaggaccatagtaccaagttcatcatccttcggcccttacgaaccaaacaggctcacgaggttgtgagtgttctgttggatatctttacgatattgggtaccccgtctgtcttagactccgactctggggtggaattcaccaatcaggtggtgcatgaactcaatgaactgtggccggacttgaagattgttagcggtaaataccacccaggtcagtcacagggtagcctcgaaggagccagcagggacgttaaaaatatgatcagtacttggatgcaatccaaccactcatgccactgggccaaagggttgaggtttatgcagatggtaaggaatcaggctttcgacgtgagcctgcagcagagcccgttcgaggcgatgtttgggtataaagccaaatttggcctgtattcttcaaacctgcctagggaaacagtggccacgctacagacagaagaagagttagagattgccgaagagcagttggagaattctctgtggattaggcaggaggagcgcgcagagatcggtgcggatagaagcgatatggacgatgacatggatcctacgccggaagcctccgagccgtccacttcacagggaacatccggactgctgtgctggtag

SEQ ID NO: 30803 - DNA, 2130 bp, Artificial Sequence
  Description of Artificial Sequence: Synthetic coding sequence
atgggacacaggacggccatgcccgagcctcgcgggagtagccagctgcgggtgaatgccgctttcgccgctcgctacaacagataccgggagagagaggagctccagcgcctgaaagaccgctatggggatagagatagttccagcgattcctcttctgagagtgattcaagtgacgagagagtggaatttgaccctcaacaggagagggatttttataaaaccctctcgcttctcaagaagaaagacccaagaatctatcagaaagatgcgactttttacaacaggactgcctcttccagtgactctgaggaggaccctgaggcactagagaagcagaaaaaggtaaggcccatgtacctaaaagattatgaaagaaaggttatcctggaaaaggctggtaagtatgtggacgaggagaattccgacggggaaacttcgaaccatagactgcaggagacttcctctcagagttacgtggaggaacaaaagcagttgaaggagagttttcgcgctttcgttgaagactctgaagatgaagatggcgctggcgaaggagggtccagcctgctacagaaacgcgccaagacccgccaggagaaagctcaagaagaggctgactatatcgagtggcttaaaggacagaaagaaatccgaaatcccgactctctgaaagagttgacacacctgaaggagtactggaacgaccctgagctcgacgagggggaaagattcctgagagactacattttgaataagaggtatgaggaagaggaagaggaggaagaagacgaagaggagatggaggaagaggagggtgtgcacggaccccccgtgcaattggccgtcgatgacagttctgacgagggggagttgttcctgaaaaaacaggaagattttgagcaaaaatataattttagattcgaagaacctgatagcgcctcagtcaaaacgtatcctcgatcaatcgcctcatccgttaggcgaaaggacgaaagacgaaaagagaagagggaggagactcgggagcgcaagaagagggagaaggctaaaaagcaagaggaactgaagcagctcaagaatttgaagcgaaaggaaatcctcgctaaacttgagaagctccgtaaagtgacgggtaatgaaatgttgggactggaggaaggcgacctggaagatgattttgaccctgcccagcacgatcagttgatgcagaaatgctttggggacgaatactatggggccgtggaagaagaaaaaccccaattcgaggaggaggaagggctggaggatgactggaattgggacacatgggacgggccagaacaggagggggactggagtcagcaagagttgcactgtgaagacccaaattttaacatggatgctgactatgatccgtcccaacctcgtaagaaaaagcgcgaagcacctctgacaggaaagaaaaagcgtaaatcaccattcgcagccgctgtagggcaggagaagcctgtcttcgagcccggagacaaaaccttcgaggagtaccttgacgagtattaccgcttagactacgaagacatcatagacgacttaccctgcaggtttaagtatcgcaccgtggtgccttgcgatttcgggcttagcaccgaggaaattctggcagcagacgataaggaactgaaccgttggtgctccctcaagaagacctgtatgtatcgatccgagcaagaggagctgagagacaagagggcctatagccagaaagcccagaatagctggaagaagcggcaggttttcaaatccttgtgtagggaagaggccgagacgcctgcagaggcaaccggcaagccgcaaagggatgaggccggcccgcagcgccagttgccagccttggatggctctcttatggggccagaatcgccccctgcccaagaagaggaagcgccggtcagccctcataagaagccggcgccgcagaaacgccgccgcgccaaaaaggccagattgctggggcccacagttatgcttggaggatgtgagttttcccgccagcggctgcaagcctttgggctgaatccaaaaaggctgcacttccgacaacttggccggcagagaagaaaacagcaaggccccaaaaatagctcatag

SEQ ID NO: 30804 - DNA, 1749 bp, Artificial Sequence
  Description of Artificial Sequence: Synthetic coding sequence
atggggcacagaactgccatgcccgagccccggggctctagtcaactaagagtcaatgctgccttcgctgcccggtacaacagatatcgtgagcgcgaggagctgcagcgtttgaaggacagatatggtgaccgcgattcgtcaagtgacagttcatcagagtcagacagctcagatgaacgtgtggaattcgacccacagcaggagcgtgatttctacaagacgctctctctgctgaaaaaaaaggatcccaggatataccagaaggatgcaaccttctacaatcgaactgcaagcagcagcgattctgaggaggatcccgaggctctggaaaaacagaaaaaagttaggcctatgtatttgaaggattatgaacgcaaagtgatcctagagaaggccggcaagtatgtcgatgaggaaaactctgatggcgaaacttctaaccacaggctccaagaaacatcgagtcagtcatatgtggaagagcagaagcagttaaaggagtcatttagggctttcgtcgaggattcagaagatgaagacggcgccggggaaggcggatccagtctgctccagaagcgagcaaagacacgtcaggagaaggcgcaagaggaggctgattacatcgagtggctgaagggccagaaggaaatccgtaatcccgattcactcaaggagttgacacacctcaaagagtattggaacgatcctgagctggacgaaggggagcgattcctgagagattatattctgaataagcggtatgaagaggaagaggaggaggaggaagacgaagaggaaatggaggaagaggaaggagtacacggtccaccagtccagctagccgtagacgactctagcgatgaaggagagctgtttctgaagaagcaagaagatttcgagcagaagtacaattttaggttcgaagagcctgattcagccagtgtgaagacttatccaagatccattgcctctagcgttcgcagaaaagacgaaagaagaaaggagaagagagaagaaacacgggaaagaaagaagcgcgaaaaggccaagaaacaggaagaacttaagcagctcaagaatctgaagcggaaagagatccttgcaaaattggaaaagttgcgcaaggttacaggtaatgagatgctcgggctggaggaaggagacctcgaagacgacttcgatcctgcccagcacgatcaactcatgcagaagtgcttcggagatgagtactatggcgctgttgaagaggaaaagccccagtttgaagaagaagaaggcttggaggacgactggaactgggatacttgggacggcccagagcaggagggcgattggtcccagcaagaattgcattgtgaggacccaaattttaatatggacgccgattacgaccctagtcagccacgcaaaaagaaaagggaggctcctctaacaggcaaaaagaagagaaagtcacccttcgccgccgcagtaggacaggagaagccagtcttcgagcctggagaggcccaggtgggacggccgtgggtcggtcgcggccacagaggagcatggcactcccccgccgcctggctgtgcctcgagcagggcactagaaggagcaggtcaacttggatgagtatcacgggttggacgaccaggacttcctcaaccacttgtccagtggcgagcagcactgctcagtggtgcccagtgaccttagcctccgctctgaggaggagttccctcctcacaattcgttcttag

SEQ ID NO: 30805 - DNA, 1065 bp, Artificial Sequence
  Description of Artificial Sequence: Synthetic coding sequence
atgccactggttgtgttctgcggactgccttattccgggaagagccgtagggccgaagagttgcgagtggcactggccgctgaaggacgggcagtgtacgtggtggacgacgctgcagtgctaggcgccgaggacccagccgtttatggcgatagcgcaagggagaaagccctcaggggagcccttcgggcttctgtggaaaggagattgtccaggcacgatgtggtcattctggattcacttaactatattaagggtttcaggtatgaactctactgtctggcgcgagctgcccggacccccctgtgtttggtgtactgcgtgcggcctggcgggcctatagctgggccccaggtggcaggagcaaacgagaatcccggacggaacgtgtcggtttcatggagaccacgcgccgaggaagatggaagggctcaggcagcgggaagctccgttttgagagagctccatactgcagattcagtagtgaacgggagtgcccaggctgatgtacctaaggaactcgaaagggaggagagtggtgcagcagaaagccccgctctggtaacacccgacagcgagaaatccgccaagcacggatctggggccttctacagtcctgagcttcttgaagctctgacactacgcttcgaagccccagactcccgcaatcggtgggaccgtccactatttaccttggtgggactagaggagcctcttccgttagcaggcatcagatccgctcttttcgaaaaccgggccccccctccccaccagagcacacagtctcagcccctcgccagcggatcattcttgcatcaattagaccaggtgacctcccaggtgctggccggcttgatggaggcacagaagtcggccgtgcccggcgacctgcttaccctcccaggcacaacagagcacctgcggtttactaggccattaacaatggcggaacttagtaggctccggcggcagtttattagctatacaaagatgcatccgaacaacgagaacctaccacaactcgccaacatgttccttcagtacttaagccagtctctacattag

SEQ ID NO: 30806 - DNA, 162 bp, Artificial Sequence
  Description of Artificial Sequence: Synthetic coding sequence
atggaggccgccggagggttccaagtccactttcatccctctaacggggatggcagatttattgagacgagcagcgcagctgacctggaggtgataagttacagctcaaaggtgagcgtcacggagcgttgttttattaaagtctgtaccgtcctcttctag

SEQ ID NO: 30807 - DNA, 162 bp, Artificial Sequence
  Description of Artificial Sequence: Synthetic coding sequence
atggaagccgcaggtggatttcaggtccattttcatccctccaatggcgacggacgtttcatcgagacatcatccgcagccgacctggaggtgatcagttactcttcaaaggtctccgtgactgaacgttgcttcattaaggtttgtacggtcctgttttag

SEQ ID NO: 30808 - DNA, 1041 bp, Artificial Sequence
  Description of Artificial Sequence: Synthetic coding sequence
atggatatgctcgaccccggcctcgacccagccgctagcgcaactgcagccgcagccgcaagccatgataaaggacccgaagccgaggagggggtggagcttcaagagggaggagacggtcccggggctgaagagcaaaccgccgtggcgattaccagcgtgcagcaggccgccttcggcgatcacaatattcagtatcaattccggacagagactaacggggggcaggtgacataccgggttgtgcaggtgaccgacggacagctggatggccagggagataccgccggcgccgtgtcagtggtctccaccgccgcgtttgccggagggcagcaggccgtaacgcaagtcggagtggatggcgccgctcagcgcccaggccctgccgctgcctccgtcccaccgggacccgccgctccgtttccactcgccgtcattcagaatccattcagtaacgggggcagccctgctgctgaggccgtgagtggggaagcccgattcgcctactttcccgcgtccagtgtcggggacacaaccgctgtaagcgtacagaccaccgaccagtcactccaggctggaggacaattctatgtaatgatgactccccaggatgtgttgcagactgggactcagcggacaattgccccccgcacgcatccttattcccctaagatcgacggcactcgtacccctcgagatgagcgcaggagagcacagcacaatgaggttgaaagacggcgccgtgataagatcaacaactggatcgtccaactatctaagatcatccccgactgcaacgctgacaatagcaaaacaggtgcctccaagggcgggattctcagcaaagcctgtgactacatcagggagctacgccagacgaatcagcgcatgcaggagactttcaaggaggccgaacgactgcagatggataacgaattactccgacagcagatagaagagcttaagaatgaaaatgctctgctgcgcgctcagttgcaacagcataacctggagatggtaggcgagggcacccgacagtag

SEQ ID NO: 30809 - DNA, 531 bp, Artificial Sequence
  Description of Artificial Sequence: Synthetic coding sequence
atggatctgcccgatagtgcgtctcgagtcttttgcggacggatcctttcgatggtgaacaccgatgatgttaacgcaatcatcctggcccaaaagaacatgctcgatcggttcgagaagacaaacgaaatgttgctgaatttcaacaatttgtctagcgcaaggctccagcagatgtccgagcggttcctgcatcacacaaggaccctggtggagatgaagcgtgacttggattccattttccgcaggatcagaacattgaagggcaagctagcacgccagcacccagaggcattttcacatattcccgaagccagctttctcgaggaagaggacgaggaccctataccacctagcaccactacgacaatagcgacgagtgaacagagcacaggctcttgcgataccagcccggatacggtttcaccatctctctcacccggattcgaggatctgagtcatgtccagccagggagccctgctattaatgggcggagccagactgatgatgaggagatgaccggcgagtag

SEQ ID NO: 30810 - DNA, 531 bp, Artificial Sequence
  Description of Artificial Sequence: Synthetic coding sequence
atggacctcccagactcagcgtccagggtcttctgcgggaggattttaagcatggtgaataccgacgacgtcaatgctattattctcgcccagaagaacatgctcgaccgatttgaaaagaccaacgaaatgttgctcaattttaacaatctctccagtgctaggcttcagcaaatgagcgagagattcttgcatcatactagaacattagtggagatgaaaagagatctggattccatcttccgaaggatacgcaccttaaagggaaagcttgcccggcaacatcctgaggcattcagccacatccctgaggcatcttttctcgaggaagaggatgaggatcccatcccgccatctactacaacgaccatcgcgacctccgagcagtccaccggctcatgtgatactagccctgacacagtgtctcccagcctgagtcctggctttgaggatcttagccacgtgcagcccgggtcacctgcgatcaatgggcgcagccaaaccgatgatgaggagatgactggcgaatag

SEQ ID NO: 30811 - DNA, 432 bp, Artificial Sequence
  Description of Artificial Sequence: Synthetic coding sequence
atgcgggatgccgatgctgacgctggtgggggcgctgatggcggggatgggaggggcggacactcttgccgggggggggtggatacagcagcggcacccgcaggcggcgcacctccagcacatgcaccgggacctggcagagacgccgcgtccgcagctcgtggatcaagaatgcgcccgcatatctttactctttccgtgccattccctacaccacttgaggcagagattgcacacggcagcctcgcgccagatgcagagccgcatcagagggtcgtgggtaaggatttgacggtgtccgggagaatactggtcgtccgatggaaagctgaagactgcaggctacttcgtataagtgtaattaatttcctagaccagctttcactggttgtccggaccatgcagaggtttgggcctcccgtgtcaaggtag

SEQ ID NO: 30812 - DNA, 3747 bp, Artificial Sequence
  Description of Artificial Sequence: Synthetic coding sequence
atggtggtggcactgcgctacgtgtggccgctcctcctgtgttcgccttgcctgctcattcaaattcctgaggagttgatggagcctccagtgataacagagcagtccccccgtcgccttgtggttttccccactgacgatatctcattgaagtgtgaggcctccggaaagccagaagtgcagttcaggtggacacgcgatggcgtgcatttcaaacccaaggaggagttgggggttacagtctaccagagtccccatagcggctcattcactatcactggtaacaactctaacttcgcgcagcggtttcagggaatatatcggtgcttcgccagcaacaagttgggaactgcaatgtctcacgagattcggcttatggcagaaggcgccccaaagtggcctaaagaaacggtgaagcccgtggaagtggaggagggagagagcgtggtgctgccttgtaacccaccccctagcgcggaacccttgcgcatctactggatgaacagcaagatcctgcatataaaacaggatgagcgagttacaatgggtcaaaacgggaatctctattttgctaatgtgctgacttctgataatcattctgactatatctgtcacgctcactttcctggtaccaggacgatcatccagaaagagcctatcgacctgcgggtgaaggcgacgaatagcatgattgacaggaagcccaggttgctgtttcccaccaactcatcttcccacctcgtggcactgcagggtcagcccctggttctggaatgtattgccgagggctttcccacacctacaattaagtggctgcggcccagcggccctatgcccgcagaccgggtaacttaccagaatcacaacaagaccctgcaactcttaaaggttggcgaagaggacgacggcgagtaccggtgtctcgctgaaaactctctcggttctgctagacatgcctactacgtcaccgtggaggcagctccttactggcttcataagccacagtctcatctgtacggtccaggagagactgcccgtctggactgccaggttcagggtagaccccaacctgaggttacctggcggattaatggcatccccgtggaagagcttgccaaggaccagaagtatagaatccagcggggcgcactcattctgagcaacgtccagccaagcgacacaatggtgacgcagtgtgaggctcggaacagacatggcctgctgctggcgaatgcctacatatacgtggtacagttgcctgcaaaaatcctcaccgcagataatcagacctatatggccgttcagggttccaccgcgtacctcctttgcaaggcttttggtgcgccggtgccgtctgtacagtggctggacgaggatggaaccaccgtactgcaagacgagcggttctttccgtacgcgaacggaacattggggattcgcgacttacaggccaacgacactgggcggtacttctgcctggccgccaacgatcagaacaacgtgacaattatggccaatcttaaggttaaagatgctacacagattacgcagggaccacggtctaccattgaaaaaaaaggaagccgggtcactttcacctgccaggcaagctttgatccttcgttacagcctagcatcacatggcggggcgatggtcgggatttacaggaactgggagatagcgacaaatattttattgaggatggacggctggtcattcattcgctggactattcggaccagggcaactacagctgtgttgccagcactgagctggatgtagtagagtcaagagcccagctcctggtagtcggcagccctggtcctgtgcctcggctcgtgctgagtgacctccatcttctgacccagtctcaggtgcgtgtgtcgtggtctcccgccgaagaccataacgctccaatcgagaaatatgatatcgaatttgaggacaaggagatggctcctgagaagtggtacagtctgggaaaggttcccggcaatcagacgagcacgactcttaagctcagtccttacgtccattatactttccgggtgaccgctatcaataaatacggaccgggggagcctagcccagtttctgagactgtggtaaccccagaagctgcccccgaaaagaatcctgttgacgtaaagggggaagggaatgagactactaatatggtgattacctggaaaccacttagatggatggattggaatgcaccccaggtccagtaccgggtacagtggcgcccccagggaactcgggggccctggcaggaacagatcgtgtccgatccatttcttgtggtttctaatacatcaacttttgttccctacgagattaaggtccaggctgttaacagccaggggaaaggacccgaaccacaggtgacaatcggctactctggggaagactatccacaagcgatacccgaactggagggtatcgagatccttaattctagtgctgtcctggtaaagtggcgtccagtggaccttgctcaggtgaaaggccatttgcgcgggtataacgtcacttattggcgagaaggttcccagagaaagcacagcaagcgacacattcacaaggaccacgttgtcgttccggctaacaccacctctgtcattctctctgggctccgcccctactcatcttaccacctagaggtgcaggcctttaacgggcgcggtagcggaccagcctccgaatttacattctcaacaccagaaggagtacccggtcacccagaagctcttcacctagagtgtcaaagtaatactagtctgctgctgcggtggcaaccccctctaagtcacaatggtgtgctcactgggtatgtgctgagctaccacccattggatgagggtgggaaggggcagctgtcttttaacttgagagaccccgaactaaggacacacaatctgaccgatttgagccctcacctgcgataccggttccagttgcaggctacaacgaaagaagggcccggggaggccatcgtgcgcgaggggggaaccatggctctttccggcatttcagacttcgggaacatttctgcaaccgcaggggaaaattactcagtggtcagctgggtgcctaaggagggtcagtgcaacttccgattccatatcctttttaaggctttgggcgaggaaaaaggtggagcaagccttagcccccagtacgtgagttataaccaaagttcatacacccagtgggacctccagcctgatacggattacgaaattcacctgttcaaagaacggatgttccgccatcagatggcagttaaaactaatggaacaggtcgcgtgcgtctgcccccggctggcttcgcgactgaggggtggttcattggcttcgtttctgccatcatcctcttgttattggtgctactcattctgtgcttcatcaaacggtcaaaaggaggaaagtacagtgtgaaagacaaagaggacacccaggtggactccgaggctcggccaatgaaagatgaaacattcggggaatatagcgacaacgaggagaaggcgttcggatcatcccagccatcgctcaacggagacatcaaaccgctcgggtctgacgacagtctcgcggactacgggggctctgtcgacgttcagttcaacgaagacggttcattcattggccagtattccgggaaaaaagaaaaggaagccgccgggggaaacgattcctcgggcgcaacctcaccaatcaatcccgccgtcgcactcgagtag

SEQ ID NO: 30813 - DNA, 3774 bp, Artificial Sequence
  Description of Artificial Sequence: Synthetic coding sequence
atggtggtcgccctccgatacgtgtggccactcctgctgtgctcaccttgcttgctgattcagatcccagaggagtacgagggacaccacgtaatggagccacccgtcatcacagagcaaagccctagaagactagtggttttccccacagacgacatctcactgaagtgtgaagctagcgggaagccagaggtccagttccgctggactcgcgatggtgtgcacttcaagcccaaggaggaactgggcgttactgtgtaccagtctccccattccggtagcttcacaattaccggcaataattccaactttgcacagcgttttcagggcatttatagatgtttcgcctctaacaagttgggtacagcgatgtctcacgaaatccgactgatggctgagggggcccctaagtggcccaaggaaacggtcaagcccgtggaggtggaggaaggcgagagtgtcgttctgccttgcaatcccccgccctccgcagagccactacgcatttactggatgaacagcaagattttacacatcaagcaggatgagagagtgacaatgggccaaaatggaaatctgtatttcgccaacgtgctaaccagtgataaccattctgattacatttgtcacgcacattttccggggacaaggaccataattcaaaaggagccaatcgacctgcgcgtgaaagcaacaaacagcatgatcgaccggaagcccagactcttatttcctactaattcatcctcacacctggtggccttacagggtcagcctttggtcctggagtgtattgcagagggcttcccaactcccacgatcaaatggctccgtcccagtggccctatgcccgcagacagagtaacgtaccagaaccacaataagacgctgcaactgttgaaagtcggtgaagaggatgatggagagtaccggtgcctggccgaaaatagtttgggctcggcccgccatgcatattacgtgactgtagaagctgccccttactggcttcataagcctcaaagccacctgtacgggcccggtgagacagctaggcttgactgtcaggtgcaggggcggccacagccagaggtgacctggagaatcaacggcatcccggtggaagaactggcaaaggaccagaaatacaggatacagaggggcgcacttatcctgtctaacgtacagcccagcgatactatggtgacgcagtgcgaagctcgaaaccggcatggactgctcttagcaaatgcctatatttacgtcgttcagctccccgctaagatcctgaccgccgataaccaaacatacatggcagtgcaggggtcaaccgcttacctgctgtgcaaagccttcggcgccccggtcccctccgtgcaatggctggacgaagatggcacaaccgtgctccaggacgagagatttttcccgtacgcgaacggcacactggggatccgagacctgcaagccaacgatactggcagatatttttgccttgcggcaaatgaccagaataatgtgacaatcatggccaatctgaaggttaaggacgccacccagatcacccagggaccgcggtctaccattgagaagaaaggatcgagggtgactttcacctgccaggccagttttgacccctctcttcagccaagtataacctggagaggagacggccgggaccttcaggagctgggtgatagcgataagtattttattgaggacggccgcctggtgattcactctctagactattccgatcaaggcaactactcctgcgtggcctctacagagcttgacgtcgtggaatcccgagctcagctcctggtagtggggagcccaggccccgtgccacgcctggtgttaagcgatctacatctactaactcagtcacaggttagggtgtcctggtcccctgctgaggaccacaacgcaccaatcgaaaaatacgatattgaattcgaagacaaagagatggctcccgaaaagtggtattcactcggaaaagtacccggcaaccagacttcaacgacactaaagctcagcccctatgtacactataccttcagggtgacggcgatcaataagtatggaccaggagagccctcgcctgtgtccgagaccgtggttacaccggaggcagctccagaaaagaatcccgtggatgtcaaaggggaggggaacgagacgaccaatatggttatcacctggaaacccctgcgttggatggattggaacgccccccaagttcagtacagagtccagtggagaccccagggcactcggggaccctggcaggagcagatcgtgagtgacccattccttgtggtaagtaacactagtacctttgttccctatgagattaaggtgcaagctgtgaactcccaaggtaagggccccgagccccaggtcactatagggtattccggcgaggattacccccaggcgattcccgagttggaggggatagaaattctaaactctagcgctgtcctggtgaagtggaggcccgtagacctcgcccaagttaagggccacctccgtgggtataatgtgacctactggcgggagggaagtcaacgtaaacactcgaagagacacattcataaggatcacgtggttgtgcctgccaacaccactagtgtgatcctatcaggccttcgtccctactcatcgtatcatctggaggtgcaggctttcaacgggcgcggaagtgggcctgcctcagagtttacgttcagcaccccagaaggggtacccgggcaccctgaagcactgcacctggaatgtcagtcgaatacgtctctgttgttgcgctggcagcctcctttatcccataacggagtactgaccggttacgtgctgtcttaccatcctctagatgaagggggaaagggacagttgtcgtttaacctcagggaccctgaactgcgaacgcacaacctgaccgatctatccccacacttgagatatagatttcagctgcaggcaactacaaaagaaggtcctggagaggctattgtcagagaaggcggcacgatggcactgtccgggatttctgattttggaaacatcagcgccacagcaggtgagaactattctgtcgtgtcttgggtgccgaaggaggggcagtgcaactttagatttcacattttattcaaagccctcggggaagagaagggaggggcgagcctaagcccccagtacgtcagctacaatcagtcaagttacacacaatgggatctgcagccagacaccgactacgagatccacctattcaaggaacgtatgtttcgacatcagatggccgtgaagacaaatggtactgggagagtacgtctccctcctgcaggatttgccacagaaggatggttcataggttttgtcagcgcaattattctgttgctgctggtgttactgattctttgtttcattaaacggtctaagggtggtaagtattcagtgaaagacaaggaggacacacaggtcgactccgaggcaagacccatgaaagacgaaacatttggtgagtaccggtccctggaaagtgataacgaggaaaaagcatttgggtcatcccagcccagcttgaatggggacatcaaacctttgggatcagatgattcccttgccgattacgggggttcagtggatgtccagttcaatgaggatgggagttttataggacagtacagtgggaaaaaggagaaggaagcagctggtggcaatgattcctccggtgctacttctcctattaatcctgccgttgcacttgagtag

SEQ ID NO: 30814 - DNA, 1338 bp, Artificial Sequence
  Description of Artificial Sequence: Synthetic coding sequence
atgttgctattcgtcgagcaagtagcgagcaagggtaccggacttaatcccaatgccaaggtgtggcaagagattgcgcccggcaacaccgatgccactccagtcacccacggtaccgagtcttcctggcatgaaatagcggcaacctctggcgcacacccagaaggcaatgccgagctatcggaggacatctgcaaggaatatgaggtgatgtattctagttcgtgtgaaaccactagaaataccaccgggatagaagagtccactgatgggatgattcttggaccggaggatttgagttaccaaatctatgatgtgagcggcgagtctaactccgccgtctctaccgaggatctgaaagaatgtctgaagaagcagttagaattctgcttcagtagagaaaatctctccaaggatctgtacctcattagccaaatggactctgatcagtttatccccatttggaccgtggctaatatggaggaaatcaaaaagctgaccacagacccagatctgatcctagaggtactgaggtcctcccctatggtacaggtggatgaaaagggcgaaaaggttcgcccaagccataaacgctgcattgttattctgcgggagattccagagaccactcccattgaagaagtgaagggcctatttaaatctgaaaactgtccaaaagtcatttcctgtgagttcgcccataacagcaactggtatattacatttcaatctgacacagatgcccagcaggcgtttaagtacttgagagaagaggtgaagacctttcaggggaaacccataatggcgagaatcaaggctataaatacgttttttgcaaagaatggctacaggctgatggattcctcgatctattcacatcccatacaaacacaagcccaatacgcgtctcctgtgttcatgcagcccgtgtataaccctcatcagcagtactcagtctactccatcgtgcctcagagttggtccccgaaccccaccccttatttcgagactccacttgcaccctttcctaacggctcgttcgtaaacggttttaactctcctggctcctataaaactaatgccgccgcaatgaacatgggtaggccgtttcaaaagaacagggtgaaacctcagtttcgatcatctggcgggagcgaacacagcactgaggggtcagtaagccttggtgatggtcaattgaatcgatatagctcgaggaacttccctgctgaaagacacaaccccacagtgaccggtcatcaggaacagacctacctccagaaagaaacatcgaccctgcaggtggaacagaacggggactatggccgtggcagatag

SEQ ID NO: 30815 - DNA, 2568 bp, Artificial Sequence
  Description of Artificial Sequence: Synthetic coding sequence
atggagaactggccgacaccttctgagttggttaataccggtttccagtccgtattgagtcaggggaataagaagccacagaacagaaaggagaaagaggagaaggtcgaaaagaggtcaaacagtgattccaaagaaaatagagaaactaaactaaacggtcctggagagaatgttagcgaagatgaggcacagtctagtaatcagcggaagcgagggtggaagagagatcgagagaagcgcgacgaccaagacgatgtgtcgtcagtgcgctccgagggaggtaacataagaggctcctttagggggaggggaaggggacgaggaagggggcggggaaggggcagaggtaatcctagactgaactttgactattcatacggttatcaggagcacggggagagaaccgaccaaccctttcagacagaactaaatacctcaatgatgtactactacgatgacgggaccggggtgcaagtttatcctgtagaagaggctctgttgaaggagtatatcaagcggcaaatcgagtactatttctctgtcgagaatctggagagagacttctttctgcgcgggaagatggacgagcagggtttcctgcccatcagtcttatagctgggtttcagcgcgtgcaggctctgaccactaaccttaacctgattctggaggctctgaaggattcaaccgaggtagaaatcgttgacgagaagatgcggaagaagatcgaaccagaaaaatggcccataccaggacccccacctaggtcagtgccaccaacagatttctcccagctgatcgactgccctgagttcgtccctggccaggccttttgctctcacactgagtccgcgcccaactccccgcggatcggttctcctctttctcccaaaaagaacagcgaaacctccatcctccaggcgatgagtcgaggactgagtacctctcttccagatctcgatagtgagccatggatcgaagttaagaaacgacaccagcctgcccccgtgaaacttcgggagtccgtcagcgtgcccgagggtagcctaaatcagctgtgttctagcgaggagccggagcaggaggagctggatttcctctttgacgaggaaatcgaacagatcggcaggaagaatacctttacggattggtcagacaatgattccgactacgagatcgatgatcaagatctgaataagattcttatcgtcacacagactcccccatatgtcaagaaacatcccggcggagacagaaccggtacccatatgtccagagctaagatcaccagcgagttagctaaggtgattaacgatggcctttattactatgaacaggacttatggatggaagaggatgagaataaacacacggctataaagcaggaggtggagaatttcaaaaagttgaatctcatctcaaaagaacagtttgagaacctgacacccgaactcccgttcgagcccaatcaagaggtccccgtggctccctcccaatcaaggcaggatctgaccgatgagctcgcacagaaactgttcgatgtgtcagagatcacttccgcggctatggtgcactccctccccacagcagtacctgaatccccgagaattcatcccactcgtactccgaagacgcccagaacaccgcgactgcaagatcccaacaagacgccacgtttctaccctgtggtaaaggagccgaaggctattgatgtaaaaagccccagaaaaagaaaaacaagacacagtactaatccccctctggagtgtcatgtgggctgggtgatggactcccgtgatcgaggtcccggcacgtcttccgtgagtacgagtaacgcgtcgccaagtgaaggggccccactcgcggggagctacgggtgcacaccccactcttttcctaagtttcaacatccttcccacgagctcctgaaggagaacggctttacccagcaggtttatcacaaatatcggcggcgatgcctgagcgagcgcaaacggctcggcattggccaatctcaagaaatgaataccctgtttaggttctggtctttctttctacgcgaccatttcaacaagaagatgtacgaggagtttcgccagctggcttgggaggacgctaaagaaaactatcgttatggtctggagtgcctctttcggttctattcttatggtttggaaaaaaagtttcgtagagagattttccaggactttcaggaggagaccaaaaaggattacgagtcggggcagctctatgggctcgaaaagttttgggcctatctcaagtactcgcagtccaagacacagtccatcgatcccaagctccaggagtatctctgctctttcaagagactcgaggacttccgtgtcgatccgcccatttccgatgaattcggccgaaagcggcactcctccacgtcaggggaggaatccaatagacataggttaccaccaaattcgtccaccaaacctccgaatgccgccaaaccgactagcacttcagagctacaggttcctattaactcgccccgccggaatatttccccagagtcatctgacaatagccattag

SEQ ID NO: 30816 - DNA, 2745 bp, Artificial Sequence
  Description of Artificial Sequence: Synthetic coding sequence
atggaaaactggcctactccatccgaattagtcaatacaggttttcagtctgtcctcagccaaggcaataaaaagccacaaaatcggaaggaaaaagaggaaaaggtcgagaagcggtccaactcggatagtaaggagaaccgtgagacaaagctaaatggaccaggagagaatgtctccgaggatgaggcccagagctccaatcagagaaaaagggccaacaagcataagtgggtacctcttcatttggatgtggtgaggtcagaaagccaggaacgccccggcagcagaaactccagtcggtgtcagccagaggcaaataagcctacgcacaacaataggcggaatgacaccagatcctggaagcgcgaccgcgaaaagagagatgatcaggatgatgtgtctagtgtcagaagtgaaggtggcaacatccgcgggtccttcaggggccgcggacgtggacgagggagggggcgcgggcgaggaagaggcaacccacgtctgaacttcgactattcgtacggctaccaggagcacggcgaaaggacggaccagccctttcagactgagttaaacaccagcatgatgtactactacgatgatggtaccggtgtgcaggtgtatccggtggaggaggccttattaaaagaatatattaaacgacagatagagtactatttttcagtagagaatctggagcgggacttttttttacggggaaaaatggacgaacagggctttctacctattagcttgatcgctggctttcagcgggtgcaggctctcactacaaatcttaatctcatcctggaagccttaaaggactcaacagaagtcgagatcgttgatgaaaagatgcgaaagaaaatcgaacccgaaaagtggccaatcccgggtccccctcccaggtccgtgccaccaacagattttagccagctcattgactgccccgagttcgtccccgggcaagcattttgcagccacaccgaaagcgccccgaacagcccgagaatcggctcgcctttgtcacccaaaaagaactcagaaaccagtatcctccaggctatgagccggggcctgtctaccagccttccagacctggattctgaaccctggattgaagttaagaagcggcaccagcccgcaccggtaaagctcagagagtcagtgagcgtgccagaaggatcgctgaaccagctctgtagcagcgaggagcccgaacaagaggaactggacttcttgttcgacgaagagatcgagcaaattggaagaaaaaacacttttaccgactggtccgacaatgactcagactacgagatcgatgatcaggacctgaataaaattctgatcgtgacacaaactcctccatatgtgaagaaacatccaggtggagaccgaactggcacacatatgagccgagcaaagattacaagcgagcttgctaaggtgatcaatgacggactgtactactacgagcaggacctgtggatggaggaagatgaaaataaacataccgcaatcaagcaggaggtggaaaacttcaagaaactgaacctaatcagtaaagaacagttcgaaaatctaacacctgaactccccttcgaaccgaaccaagaagtgccagttgctcctagccagagtcgacagggtggcgtgcaaggcgtgctgcacatccctaaaaaagacctaaccgacgagctcgcacagaaactgttcgatgtctctgagattacttccgcagctatggtgcacagcttacccaccgccgttccggaatctcctcgaattcatcctactaggacgcccaaaactcctcgcacaccaagactgcaggaccccaataagacgccccggttctaccctgtggttaaagaaccaaaggctatagatgttaagtcgcctagaaaacggaagacccggcactccaccaatccccccctggagtgccacgttggttgggtgatggattcgcgcgacagaggcccaggaacttccagcgtgtcaacctccaatgcctccccatcggaaggagctcctctcgcaggtagttatggctgtactccgcattcctttccaaaatttcagcatccctctcatgaactgcttaaagagaacggcttcactcaacaagtgtaccataagtatagacggaggtgtctgtccgaaaggaaaaggctgggaattggacaatcacaagagatgaacacactctttcggttttggtcattttttctgagagaccactttaacaaaaagatgtatgaagaattccggcagctggcctgggaggatgcaaaagaaaactaccgttatggactagagtgcttgttccggttctatagctatggactagagaaaaaattccgaagggaaatttttcaggacttccaggaggaaaccaaaaaagactacgagtctggccaactgtacggactggagaagttctgggcctacctcaagtactctcagagcaaaactcagagcatagaccccaagctgcaagaatatctgtgtagcttcaagcgcttggaggatttccgggtggatcctcccatctccgacgagtttggaagaaaaagacatagcagcacctcaggagaagagtccaaccggcatcggctaccaccgaacagctccaccaaacctcctaacgccgccaaacctacaagcacttctgagctccaggtccctatcaactccccaaggagaaacataagcccagagtcctcagacaattcacactag

SEQ ID NO: 30817 - DNA, 846 bp, Artificial Sequence
  Description of Artificial Sequence: Synthetic coding sequence
atggtccattctctgcccaccgccgtgccagaatcaccacgaatccatcctaccagaactcctaagaccccacgcacaccccgccttcaagacccaaacaagacaccacgattttacccagtagttaaggaacccaaggccattgatgtgaagagccctcgcaagaggaagactaggcactcaaccaatcccccgctcgaatgtcatgtgggctgggttatggacagtcgggatcgcggacccggcacgtcgtccgtgtcaacatccaatgcctctccgtctgaaggggctcctttggccggctcttatgggtgcacaccacattctttccccaagtttcagcatccttctcacgagttactcaaggagaatggctttactcaacaggtgtatcacaaataccggcgaagatgcctctccgaaaggaaaaggctaggcataggacagtctcaggagatgaacacactttttagattctggtccttctttttgcgggatcactttaataaaaagatgtacgaggagtttcggcagctcgcatgggaggacgctaaggagaattaccgctacgggcttgagtgcctttttagattctattcctacgggcttgagaaaaaatttaggagggaaattttccaagactttcaagaggagaccaagaaagattacgaatctgggcagctatatgggttggaaaaattctgggcgtacctcaaatattcacagtccaagacccaatccatagacccaaaattgcaagagtatctgtgttctttcaaaagactcgaggacttcagggtagataaccaccatgacaggctgctcctgctaatcataaatatctag

SEQ ID NO: 30818 - DNA, 1008 bp, Artificial Sequence
  Description of Artificial Sequence: Synthetic coding sequence
atggagaactggcccacaccatccgagctagttaacacaggcttccaaagcgtcctgtcacagggcaataagaaacctcaaaacaggaaagagaaggaggaaaaggtcgaaaagcgatcgaactctgatagcaaagagaatcgagagacaaagctcaacggtcccggggaaaacgtctcggaggacgaggcccagtcctccaatcaacggaagagagcgaacaagcacaaatgggtgccgcttcatctggatgtagttcggtctgagtcacaggagcggccaggtagcaggaactccagccgctgccagcctgaagctaataaaccaacccataacaataggcggaacgatacccgctcatggaaaagagaccgggaaaagcgtgatgaccaggacgacgtgtcaagcgtgagatccgaaggcggcaatatcagagggagctttcggggacgcgggagaggaagagggcgaggtagaggaagaggccggggcaatccccgattgaactttgactattcttacggataccaggagcacggagagcgcacagatcagccatttcagactgaactgaatactagcatgatgtactactatgacgacggtaccggcgtccaggtgtatcccgtggaggaggcactgctgaaagagtacatcaagaggcagattgagtattatttttccgtggagaacctagagcgcgattttttcctccgtgggaagatggacgagcagggttttctacctattagcctcatcgcaggattccaacgggtccaagcccttaccactaacctgaacctgattctagaggccctgaaagattcaacagaagtggagatagtcgacgaaaagatgaggaagaaaatcgagccagagaagtggcccatccctggcccccctccccgctctgttcctcctaccgatttctcccaactgatagattgcccagaatttgtgcctggacaagccttttgttcccacactgttcgcgtgatgatcttttag

SEQ ID NO: 30819 - DNA, 1569 bp, Artificial Sequence
  Description of Artificial Sequence: Synthetic coding sequence
atggaaaactggcccaccccatcagaacttgtgaatacaggctttcaatcagtcctctctcagggaaacaagaaacctcaaaaccgaaaagagaaggaagaaaaggtggagaagcggtccaactcggatagtaaggagaatcgggagacgaaactgaacgggcccggagaaaacgtaagcgaggatgaggctcagtcctcaaaccaacgaaagcgggctaacaagcacaaatgggtcccattgcacctggacgttgtgagaagcgaatcacaggagcggccgggaagtcgcaattcttctcgttgccaacccgaggccaacaagccaactcacaacaaccggaggaatgatacacgtagctggaagagagaccgggagaaacgggatgaccaggacgatgtttcctccgttcggtctgagggagggaacattcgcggtagttttcgggggcgcgggcgagggcgcgggaggggacggggcagaggacggggtaacccaaggctgaacttcgattactcttacgggtaccaggagcatggcgaaagaacggatcagccttttcaaacagagctgaatacatcaatgatgtactactatgatgacgggaccggggtgcaggtgtaccctgtggaggaagcgcttttaaaagaatacattaaaaggcagatagagtactacttctcggtggaaaatctcgagagagacttctttctccggggcaagatggatgagcagggctttctgcctatttccctgatcgccggcttccaacgggtacaggccctaaccacaaatctgaatctaattttggaagcactgaaagacagcaccgaagtcgagattgtggacgagaagatgcgcaagaagatcgaaccagaaaagtggccaatcccagggcctccacctcgctcagtccctcctaccgacttctcacagcttattgactgtcctgagttcgtgcccggacaggccttctgtagtcataccgagtccgctcctaactctccaaggatcggcagtccgctctctcctaaaaagaattcagaaacttcaatcttacaggcgatgtcccgaggactatcaacatcccttccagatctggacagtgaaccttggattgaggtcaaaaagcggcatcagccagcccccgtaaagctccgcgaatctgtgtcggtgccagagggatccctcaaccaactgtgctcgagcgaggagccagagcaagaggagcttgatttcctcttcgatgaggagattgaacagatcggtagaaaaaatacctttacagattggtccgacaatgattcggattacgaaatcgacgaccaggatcttaacaagattctgattgtaacgcagacacccccctacgtcaagaaacaccctggcggggataggactggtacacacatgtcaagagccaagattacaagtgaattggctaaggtgatcaacgacggtttgtactattacgaacaggacctttggatggaagaagacgaaaacaaacacacagcgattaaggtcatcgtgtccgggcaacatctcagcacggacgccttgttctag

SEQ ID NO: 30820 - DNA, 1077 bp, Artificial Sequence
  Description of Artificial Sequence: Synthetic coding sequence
atggagaattggcccaccccatccgagttagtaaacacggggtttcagtccgtccttagtcagggaaataagaaaccacagaaccggaaggaaaaagaagagaaggttgagaagaggagcaacagtgatagtaaggaaaatcgcgagacaaaactcaatgggcccggcgaaaacgtgagtgaggacgaggcgcaatcctctaaccagaggaaaagggccaacaaacataaatgggtgccactgcacttagacgttgttagatcagagtctcaagaacggcccggctctcggaatagctccagatgccaacccgaggccaacaagcccacccataacaatagacgaaatgatacacgatcctggaaacgcgatagggaaaaaagagatgaccaggacgatgtgtcttctgtgcggagtgagggaggcaacattagaggatccttcagaggccggggccgcggaagagggcgtggccgcggtcgcggccgaggcaatccaagactcaatttcgactattcctacggctatcaggaacacggagagaggacagatcagccattccagacagagctgaataccagcatgatgtattattacgacgacggtaccggggtccaggtttaccctgtggaggaggccttactgaaggaatatattaaaaggcagattgaatactacttttctgtagagaacctcgagcgcgatttttttttgcgggggaaaatggatgaacaagggttcttaccgatttccttaattgctgggttccagcgtgtccaggcccttaccactaatctcaatttgattttggaagcgttaaaagattccaccgaggtggaaattgttgacgagaagatgagaaagaagattgaacccgagaaatggcccattcctgggcccccacccagatccgtgcctccaacggacttctcacagctaattgattgccccgaattcgtgccaggtcaagcattttgtagccataccggaaatattttcagctcacgagcaaacgacgtgactgtgggttatctcgtccaattcacctatttgtttatctacttccagtttatctag

SEQ ID NO: 30821 - DNA, 2364 bp, Artificial Sequence
  Description of Artificial Sequence: Synthetic coding sequence
atggagaattggcccaccccaagcgaacttgtgaacacaggttttcagtcggtgttgtctcaaggcaacaaaaagccccagaatcgcaaagaaaaggaggagaaagtcgagaagcgctccaattctgatagcaaagagaatcgcgaaaccaaactgaacggccctggcgagaacgtatcggaggacgaggcacagtcctcaaatcagcggaaacgggcaaataagcataaatgggtccctctgcacctggacgttgtgcgctctgaaagtcaggaaaggcccggatctagaaactcctccagatgtcagccggaagctaacaagcccacacacaataatcgtcgcaatgacactcgatcctggaagagggatagagagaagcgggatgatcaggacgatgtcagttccgttagatctgagggcggtaatattcgggggtctttccgcggaagaggcaggggccggggacgcggaagaggaagaggaaggggaaatccacgtctgaattttgactacagctacgggtaccaggagcacggagagaggacagaccagccattccagaccgagctgaatacctcaatgatgtactactatgacgacggcaccggagttcaggtctaccctgtagaagaagccctccttaaagagtacatcaaacggcagatcgaatattacttttctgtagagaacctggaaagggatttcttcttgcgggggaagatggacgagcaggggtttctgcctatttccttaattgcaggctttcagcgcgtccaggcccttaccaccaatctgaatcttattcttgaggcgctcaaggatagcactgaggtggagatcgttgacgagaaaatgcgcaaaaagattgagcctgaaaaatggcctattcccggcccacctccaagatccgtgccgcccaccgacttcagccaacttattgactgccccgaatttgtgcctggccaagccttttgcagccatactgaaagtgcaccgaactctccaagaatcgggagtcctctgtcgcctaagaagaactcggagacttcaattctccaggctatgagccggggcctgagcacatctttgccagacctcgattctgaaccgtggatcgaagtgaagaaaaggcaccagccggccccagtcaagctgagggagagtgtatcagtgcctgaaggtagcctcaaccaactctgttccagcgaagaaccagaacaggaagagctggattttctgttcgacgaggagatagagcaaattggcagaaagaatacatttacggactggtccgataacgactctgactatgagatagacgaccaagatctaaacaagattctcattgtgacccagactcccccatacgtcaagaagcatcctggcggagataggactggcacacatatgtcaagagccaagatcactagcgaattggccaaggtgatcaatgatggtctctattattatgagcaggacctgtggatggaggaagatgagaataaacataccgccattaagcaggaggttgagaatttcaaaaaattgaacctgatctcaaaggaacaatttgagaacctgacccccgagttaccatttgagccaaaccaggaggttcctgtggctccctcgcagagtaggcagggcggcgtccagggggtcctgcatattccaaaaaaggatctgacagacgagctggcacagaagttgttcgacgtgagtgagataacatctgctgccatggtccacagcctgccaacagccgtgcctgagagtcctcgaattcacccgaccaggacacccaaaaccccccgtaccccacgactgcaagacccaaataagactccaaggttctatccggtggtgaaagaaccgaaggccattgatgtgaagtccccacgtaaaagaaaaactcgacactcaacaaacccgcccttagaatgccacgttggatgggtgatggattcccgagacaggggccccggcacatcctccgtgagcaccagcaatgcctcccccagcgagggcgcacctctggctggaagctatgggtgtactccccacagtttccccaaatttcagcatccatctcacgagctattaaaggagaatggattcacccagcaggtttaccacaaatacagaaggcggtgtctatcagagaggaagcgtctggggatcggccagagtcaggagatgaataccttgttccgcttttggtccttcttcctgagggaccattttaataagaagatgtacgaggaatttcgccagctggcctgggaagatgcaaaagaaaactataggtccgccgtttggactcgtaaggtgctgggcctgttcgaaatatttagcatttag

SEQ ID NO: 30822 - DNA, 1476 bp, Artificial Sequence
  Description of Artificial Sequence: Synthetic coding sequence
tgagaggagaaggtggaaaaaaggagtaatagtgattcaaaggaaaacagagaaacaaagctcaacggtcccggggaaaacgtgagtgaagacgaggctcagagtagcaaccagcggaaacgggcaaacaagcacaagtgggtaccccttcatctcgatgtggtaaggtctgaaagccaggaacgtccagggagccgcaacagtagccggtgccagccggaagctaataagcccactcacaataataggaggaatgacacacgcagctggaagcgggatcgggagaaacgagacgatcaggacgatgtgagttccgtgcgtagtgaggggggaaatatccgaggcagttttagaggcagaggacgcggccgtggccgcggaagaggacgaggtcggggaaatccacgcctgaactttgactattcatacggataccaggaacatggggaacgaactgatcagccatttcagacggaactcaacacttctatgatgtactactatgatgatggcactggcgtccaggtttatccagtagaggaggcactgcttaaagagtacatcaagcgccaaatcgaatattatttttccgtcgagaatcttgaaagagactttttcctgcgaggcaaaatggatgaacagggtttccttcccatcagtctgatcgccggattccagcgggtgcaagccctcaccacaaatctcaatctgattctcgaggccctgaaggactcaacagaggtcgagatcgtggacgagaagatgcggaaaaagatcgagccagagaaatggcccatccccgggccgcctccccgttctgttcccccgactgattttagccagttgatagactgtcccgaatttgttccaggacaagccttctgtagccataccgagtccgcccccaacagccctcgcattggtagccccctcagccccaagaaaaattcagaaacctcgattctccaggctatgagccgcggcctgtctacaagtctgcctgaccttgattccgagccttggattgaagtgaagaaacgtcaccaacccgcccctgtgaaacttcgggaatccgttagtgtgccggaaggtagcctaaaccagctctgttcctcagaggaacccgagcaagaggagctggactttctcttcgatgaggagattgaacaaattggtagaaagaacacgttcaccgattggagtgataatgattccgactatgagattgacgatcaggatctcaacaagatcctgattgtcacacagactccgccttatgtcaaaaagcaccccggtggagaccgcactggcacccacatgagtcgtgccaagatcactagcgaactagccaaagttatcaatgacggcctatactattacgagcaggacctgtggatggaagaggatgagaataagcacaccgcaattaaagttatcgtatccgggcagcacctatctaccgatgctctcttttag

SEQ ID NO: 30823 - DNA, 1962 bp, Artificial Sequence
  Description of Artificial Sequence: Synthetic coding sequence
atgctgcttttcgtcgaacaagttgctagtaaaggcacagggctgaaccctaatgcaaaagtttggcaggaaattgctcccggtaatacggacgcaaccccagttacacatggcaccgagtcctcctggcatgagatcgccgccacaagtggagcccaccccgaggggaacgccgaactgagtgaagacatctgtaaagagtatgaagtgatgtattcgtcgagttgtgaaacaacacgtaataccacggggattgaggaatctactgatggaatgatccttggcccagaggatctgagttaccagatttacgatgtatctggagaaagcaactccgccgtatccaccgaagacctaaaggagtgtctgaaaaagcagctggaattttgcttctctagggagaatctgagcaaggacctctatctgattagccagatggactctgatcaatttattcccatttggaccgtcgccaacatggaggagataaaaaagctgacaacggatccggatttgatcctcgaggttcttcgctctagccccatggtgcaggttgatgaaaagggtgagaaagtacgaccgtctcacaagcgttgtattgttattctgagggagatacctgaaacaaccccaatcgaggaagttaaaggcctgttcaagagcgagaactgtccaaaagtaatctcttgtgagttcgcacataactcgaattggtatatcacattccaaagtgacaccgacgcacagcaggctttcaaatacctccgagaagaagtgaagaccttccagggaaaacccatcatggctcggatcaaagctattaacaccttctttgccaagaatggctatcggcttatggacagctcaatctattctcaccccatccagactcaggcccagtatgcttcacccgtcttcatgcaacctgtgtacaatccccaccagcagtattcagtctactccattgtgccgcagagctggtctcccaatcccactccttattttgaaactccccttgcacctttccccaacgggagcttcgtgaatggctttaattctcctggatcttacaagaccaacgccgctgcaatgaacatgggcaggccatttcagaagaatcgccgcacattatttcgcggacgccgtagacgcgaggacgaccgtatcagccgcccacacccgagcacggccgagagtaaggcccccactccgaagttcgaccttctggcgtcgaactttcctcctctgcctggcagtagcagtcgaatgcctggagaattagtacttgaaaacaggatgtcggacgtggtaaaaggagtatacaaggaaaaagataatgaagaattgactatttcttgtcccgtccctgcagatgagcagacagagtgcactagtgcccaacagctgaatatgagcacttcttcaccgtgcgccgctgagctgaccgccctcagcaccacgcagcaagagaaggaccttatagaagatagctcagttcagaaggacgggctgaatcagacaactattcctgtaagtcccccatcaaccacaaagccgagtcgcgccagtaccgcctctccctgcaataataatattaatgcagccaccgcagtcgccctgcaggagccgcgcaagttgtcctatgcagaggtttgtcagaaaccgccaaaggaaccaagttcggttttggtccagcccctccgagagcttcggtctaacgtcgtttccccgacaaagaatgaggacaatggcgctccggagaacagcgtagagaaaccgcacgagaagccagaggcgcgagctagtaaagactattccgggtttcggggaaatattattccaagaggcgccgctggcaagatcagggagcagaggagacagttcagccacagggccatcccccagggagtgacccggcgcaacggcaaggagcagtacgtcccaccgcgcagccccaaatag

SEQ ID NO: 30824 - DNA, 1962 bp, Artificial Sequence
  Description of Artificial Sequence: Synthetic coding sequence
atgctactcttcgttgagcaagttgcctccaaggggacaggcttaaaccctaatgctaaggtttggcaggagattgccccaggcaatacagacgccactcccgttacacatggcaccgaaagctcctggcatgaaatcgccgcaacttccggtgcccaccctgaggggaatgccgagttgtcagaggatatttgtaaagaatatgaagtcatgtatagctcctcttgcgagacaactagaaacacgacgggtatagaggaaagcacagatggcatgattttaggacccgaggacctctcataccaaatttacgacgtgtcaggagaatctaattcagcagtctccaccgaggacctaaaggaatgtttgaagaagcagctcgagttttgtttcagccgagaaaacttgagcaaggacctgtatttgatcagtcagatggactccgatcaattcattcccatctggactgttgccaacatggaggagatcaaaaagttgacaactgacccggacttgattttagaggtcttgcggagctcccccatggttcaggtggatgaaaagggggaaaaggtgcggcccagccacaaacgatgtatcgtcattcttcgggagatacccgagaccacccctatagaggaagtgaagggattattcaaatcagagaactgcccaaaggtcatctcgtgtgaattcgcccataacagcaactggtatataacattccagtcagacaccgatgcccagcaagcttttaaatatttgcgggaagaggtgaaaacatttcagggaaaaccaatcatggctcctttcccgaacggctctttcgtaaacggatttaactccccgggttcatacaaaactaatgcagcagcgatgaatatgggtcggccgtttcagaaaaatcgtgtgaaaccccagtttagaagttcaggagggagcgagcatagcactgaaggatcagtgtccctcggggacggccaactcaaccggtatagctcgagaaactttcccgccgagagacacaatcccacagttactggtcatcaagagcagacatatctgcagaaggagacaagtacgctccaagttgagcaaaacggggattacggacggggacgtagaactctatttagagggcggagaagacgggaggatgatcgtattagccgccctcacccctcaaccgctgagagcaaggcccctacgcccaagttcgatcttctcgcgtcaaatttccctcctttaccgggcagttcttccagaatgcctggcgaactggtgctggagaaccgcatgtccgacgtagtcaagggcgtttataaagagaaggataacgaggagctcaccattagctgtcccgtgcctgcagacgagcaaacggagtgtacctccgctcaacaattgaatatgtcaacatcttccccttgcgctgccgagctcactgcactttccacaacccagcaggagaaggacctgattgaagattcgagcgtccagaaagacggccttaaccagaccaccatcccagttagcccacctagtactaccaagccatcccgggcctctacggcctccccgtgcaacaacaatattaatgccgcaaccgccgtggcactccaggaacctagaaaactgtcctacgcagaggtctgccagaaaccgccaaaggagccaagtagcgttctggtacaaccattgagggagctgcgaagcaatgtggttagccccacgaagaatgaagacaatggcgcccccgaaaattcggttgagaagccccatgagaaaccagaggcccgtgcaagcaaggactattccgggttcaggggaaacatcatccctcggggagcggcgggcaaaattcgggagcagagaaggcagttctctcaccgcgccattcctcagggcgtgacccgcaggaacggcaaggaacagtatgtccccccaagatccccaaaatag

SEQ ID NO: 30825 - DNA, 1125 bp, Artificial Sequence
  Description of Artificial Sequence: Synthetic coding sequence
atgctcctgttcgtggaacaggtggcatcgaaagggacggggctgaaccctaacgcgaaagtatggcaggagatagctccaggtaacactgacgccactccagtgacccacggaactgaaagctcatggcacgagatcgctgctacttctggcgctcaccctgaggggaatgctgaactgtctgaggacatatgcaaggaatatgaggtgatgtacagctcaagctgtgagactacaagaaacaccacgggaatcgaagagtcgactgatggaatgatcctggggccggaggacttaagttaccagatttacgatgtgagtggcgaatccaattccgctgtttccaccgaggaccttaaggagtgcctcaaaaagcagctcgaattttgtttctctcgggaaaatctgagcaaggatctgtatctcatctctcagatggattccgatcagtttattcctatctggacagtggctaatatggaagagattaagaaactgaccacagatccggacctgatactggaggttttgcgctccagccccatggttcaggtggatgagaaaggcgagaaagtacggcctagccacaaaagatgcattgtgatccttcgagagattccagagaccactcctattgaggaggtgaaggggctattcaaatcagagaattgcccgaaggtgatttcttgtgagtttgctcacaactccaactggtacattaccttccagtccgacacagacgctcagcaagcctttaagtatctcagagaggaggtgaaaacctttcaggggaagcccatcatggcccggatcaaagctatcaacaccttctttgctaaaaacggatatcggctaatggattccagcatttatagtcatccaattcagacacaggcacaatatgcgtctcctgtgtttatgcaacccgtgtataaccctcaccagcagtactcagtgtattccatcgtgccccagtcctggtcccccaacccaacaccatatttcgagacaccactagcaccattcccaaatgggtccttcgtgaatggttttaactccccaggcagctataaaaccaacgctgctgcgatgaacatgggtagacctttccagaaaatcgtgtag

SEQ ID NO: 30826 - DNA, 2175 bp, Artificial Sequence
  Description of Artificial Sequence: Synthetic coding sequence
atgcttctgtttgttgagcaagtggctagcaaaggcactgggctgaatcctaatgcaaaagtatggcaggaaatagcacccggaaacaccgatgccactccagtgacacacggaactgagagttcctggcatgaaattgccgctacttctggggcccaccccgagggcaacgccgaattgagtgaggacatatgtaaagagtatgaagtgatgtactcatcctcatgcgagacgacaagaaacactactggcatcgaggagagtacagacggaatgatcttggggcctgaggacctcagttatcagatatatgatgtatccggagagagcaattccgccgttagcactgaggatttaaaggaatgcctgaagaaacaactggagttttgctttagccgcgagaacctaagcaaggatctgtacctgatcagccagatggactccgatcagttcatcccaatctggactgtggcgaacatggaagaaatcaaaaagttgacaactgatccagacctcatactcgaggttctgcgatcctcccccatggtgcaagtggacgaaaagggcgaaaaagtccggccttctcacaagcggtgtatagtgattctgcgcgagatcccagagaccacacccatcgaggaggtaaagggtctcttcaagagcgagaattgcccaaaggttatttcctgtgagttcgcacacaacagcaattggtatatcacctttcagtccgacaccgatgcacaacaggcttttaagtacctccgagaggaggtcaaaacatttcagggtaagcctattatggccaggattaaggcaattaacacattctttgctaaaaatgggtacagacttatggactcttccatttacagccatccgatccagacacaggcccagtatgcttcccccgtttttatgcaacccgtctacaacccccaccagcagtactccgtgtattcgattgtgcctcagagttggagccccaaccccactccatactttgagacacctctggctccctttccaaacggttcttttgtgaatgggttcaactccccaggctcatacaagaccaatgcggcggctatgaacatgggccggccattccagaagaaccgggtcaagcctcagtttcggtcatccggcgggtccgaacacagcaccgagggttctgtaagcctgggggacggccagcttaataggtactcctcaagaaactttcctgccgagcggcacaacccgaccgtgactggacatcaggagcagacatacctccagaaggagacgtctacgttgcaggtggaacagaacggggactacggcagaggaagacggaccctgttccgcggccgccggaggagagaagacgatcggatcagccgaccccacccgtccaccgctgaatccaaagcacctacaccaaagttcgacctgctggcatcaaatttcccacccctgcctggcagttcctcgcggatgcccggagagcttgttctcgagaatcggatgagtgatgttgttaagggagtttataaagaaaaagacaacgaagagctgaccatctcttgccccgtgcctgcagatgaacagaccgagtgcacgagcgctcagcaacttaacatgtctacttccagcccttgtgctgctgaactgactgcattgtccacgactcagcaggagaaagacctaattgaggattcctccgtgcagaaggatggcctgaaccagactactatccctgtgtcacccccctccaccactaaaccttcacgcgcctctactgcctctccttgcaataacaatattaacgcggccacagctgtcgccctacaggagcctcgcaaactttcttacgctgaagtttgccagaaacctcctaaggagcctagctccgtgctggtgcagccgctgagggaattacgcagcaatgtggtgtcccccacaaaaaatgaggacaacggcgcaccagagaattcggtggagaagccacacgagaaacccgaggcaagggccagcaaagactactcaggctttagaggtaacatcattccacggggggcagccggtaaaattagggagcagaggcggcagttctcccaccgagccatccctcaaggcgtgacccggaggaacggcaaggaacagtatgtgcccccacgttcgcccaagtag

SEQ ID NO: 30827 - DNA, 2193 bp, Artificial Sequence
  Description of Artificial Sequence: Synthetic coding sequence
atgctgctgtttgtggaacaggttgctagcaagggcacaggcctcaaccctaatgcaaaggtgtggcaagagatagcgcccggaaatactgatgctactccagtgacacacggcacggagtccagctggcacgaaattgccgccaccagcggggcacacccagaggtgtcggtgtttaacacaggaaacgcggagctctctgaagatatctgtaaggagtacgaagttatgtatagctcttcctgcgaaaccacaagaaacacaaccggaatagaagaatctacggacggcatgatactcggcccagaggacttgtcctatcagatttacgacgtcagcggagaatccaacagcgccgtttctactgaggacctgaaggagtgcctcaagaagcaattggagttttgcttctcacgggaaaacctgtccaaagatctttacctgatctcacagatggactcggatcaattcattcctatatggacagtggctaacatggaagaaatcaaaaagcttactacagatcctgacctcatcttagaggtgctgcggtcaagtccaatggtgcaggtagacgagaagggcgagaaagtgaggccatcgcacaagcggtgtatcgtcatcttacgcgaaatccccgaaactactcccattgaagaagttaaggggttgttcaagagcgagaactgccctaaggtgattagctgcgagtttgcccataatagcaactggtacattacctttcagagtgacaccgatgctcagcaggcttttaaatacctgagagaagaagttaagacctttcaaggtaaacccataatggctcggattaaggctatcaatacattcttcgccaaaaacgggtaccgtctcatggactcttccatctatagtcatcccatacagactcaggcacagtacgccagtcctgtgttcatgcagccagtctataaccctcatcagcagtactcagtgtattccatcgttccccaatcatggagtcctaatcctacaccctattttgaaaccccacttgcaccattcccaaacggatcgttcgttaatgggttcaactctcccggctcctataagacaaacgctgcagctatgaatatggggaggccatttcagaagaacagagtgaaaccccagttccgttcttcaggcggaagcgaacactcaacagagggaagtgtgtccctgggggacggacagctcaaccggtactcaagtcggaatttccccgctgagcgacacaatccgaccgtgacagggcaccaagagcaaacatatttgcagaaggaaacaagcactctccaggtggagcagaacggcgactacgggcggggtcggcgcaccctatttcgaggtcgtcgccggagggaagacgaccgcattagcaggcctcatccctccaccgctgaatctaaggcccccacgcccaaattcgatttgttggcatctaacttccccccgctccccggatcctccagccggatgcccggtgagcttgtcctcgagaaccgaatgtctgacgtcgtcaagggggtatacaaagagaaggataacgaggaacttacaatttcttgtcctgtacccgcagacgaacagacggagtgtacgagcgctcagcagctcaatatgtccacctccagtccttgtgctgccgaactgaccgccctcagcaccacccaacaagaaaaggatctgattgaggactcctcagttcaaaaggatggcctcaaccagacaacgatcccggtttccccaccatcaaccaccaaaccttctcgggcatcaacggcatctccgtgcaataacaacattaatgcagcaactgctgtggccttacaagagccaaggaagctgtcctacgccgaagtgtgccagaaaccccctaaggagccgtcaagcgtcctggttcagccattacgggagctgcgcagtaacgtcgtgtcacctactaagaacgaggataacggggctcctgaaaattcagtcgagaagccacacgagaaaccggaggctagagcctccaaggactactccggttttcgcggcaacattatccctaggggggcagccggcaagataagagaacaacgacggcagttttctcaccgtgccatcccacagggagtgacacggaggaatggaaaagagcaatatgtgcccccgcggtcaccgaagtag

SEQ ID NO: 30828 - DNA, 567 bp, Artificial Sequence
  Description of Artificial Sequence: Synthetic coding sequence
atgtattcatctagttgtgagaccacacgaaacacgacaggcattgaagaaagcacagacggcatgatactggggccggaagacctgagttatcaaatttacgatgtgtccggagagtccaatagcgcagtgagtactgaagacctgaaagagtgtttgaaaaagcaattagagttctgcttctctagggaaaatctttcaaaagacctgtacttaatttctcagatggacagcgaccagtttatccccatttggactgtcgcaaacatggaggaaattaagaaacttaccaccgatcccgacctgattctggaggtcttgcgatcatcccccatggttcaggtcgatgaaaaaggcgagaaagtgcggccttcccacaaacgatgtatcgttatcctgagggaaatccctgaaactacccccattgaagaggtcaaaggactttttaaatccgagaattgcccaaaggtgatttcctgtgagttcgcccacaactctaactggtatatcactttccagagcgataccgatgcgcagcaggcattcattctcaagaggcggtcatag

SEQ ID NO: 30829 - DNA, 2172 bp, Artificial Sequence
  Description of Artificial Sequence: Synthetic coding sequence
atgttgctcttcgtggaagtcgctagcaaggggaccgggctgaaccccaacgcaaaggtatggcaggaaatcgcacctggaaacaccgatgctactcccgtgacacacggaaccgaaagttcttggcacgagatcgccgcgaccagtggagcacaccccgaggggaatgccgaactatctgaagatatctgtaaggagtacgaggtaatgtactctagcagttgtgagacaacccgcaatactaccggaatcgaggaaagtacggacgggatgattcttggacctgaggacttgagctaccagatttatgacgtgtctggggagagcaactccgctgtttctaccgaggacctgaaggagtgcctgaagaaacagttggagttctgcttcagccgggagaacctctcaaaggatctgtatttgatctcccagatggacagcgaccagtttatccctatctggacagtagctaatatggaggagattaaaaaattgactaccgaccctgatctgattctggaggttctacgctcgagtcctatggtgcaggtggacgagaaaggagaaaaggtcagaccctcgcacaagaggtgcatcgtgatactgcgcgaaattcctgagacaacccccattgaggaagttaaagggctctttaagtctgagaactgcccgaaggtgatttcatgtgagtttgctcataactctaactggtatattacctttcaaagtgatactgatgcccagcaggcgttcaaatacttgcgggaagaagtgaagacgtttcagggcaagccgatcatggctcggatcaaggcaattaatacgttttttgcaaaaaacggataccggctgatggactctagcatctattcccaccccattcagacccaggcccagtacgcgtccccagtgtttatgcagcccgtttataacccccatcagcagtattccgtatatagcatcgtcccccagagttggagccccaatccaaccccttacttcgagacccccttagcacccttccctaatggctctttcgtgaacgggtttaattcacccggatcatacaagactaacgccgcagccatgaacatgggcagaccattccagaagaaccgcgtgaaacctcagtttcgctcttctggcggcagcgagcattccactgaggggtccgtgtcattgggggatggacagctgaaccgctattcttctcgcaattttcccgctgagaggcataatccaacagtgacagggcatcaggagcagacatatctgcagaaggagacgtcaacgcttcaggtcgaacagaatggggattatggcagaggacgcagaaccctgttccggggccgcagaagaagagaggatgacaggatcagcaggccgcaccccagtactgccgagagcaaggctcccacaccaaagtttgatttgctggcatctaactttccacccctgcccggatccagctcccgtatgcccggcgaattggttttggaaaataggatgtctgacgtcgtgaagggggtgtataaagaaaaagacaacgaggaattaaccatttcatgtcctgtgcctgccgatgagcaaaccgaatgcactagcgcccagcagctgaatatgtccacttctagcccttgtgcagcagagctcacagccctgagcacgacccaacaggagaaggaccttatcgaagatagcagtgtgcagaaggatggccttaaccagactactattccagtgtcccctccgtcaactacaaagccttcccgtgctagtaccgcatctccatgcaacaacaacatcaacgccgccacagcagtggctctgcaagagcccagaaagctgagctacgcggaagtgtgtcagaagccgccaaaagaaccttcctccgtgctggttcagcctctaagggaactccgcagcaatgtggtatcgccgactaaaaacgaagataatggagctcccgagaacagcgtcgaaaagccccatgagaagcccgaagctcgcgccagcaaagattattccggcttccgagggaacatcatccccagaggggccgcgggaaaaatcagggaacagcgtcgacagttctcgcatcgggccataccccagggcgtcactagacgtaacggcaaagaacaatacgtgcccccaaggagcccaaaatag

SEQ ID NO: 30830 - DNA, 2217 bp, Artificial Sequence
  Description of Artificial Sequence: Synthetic coding sequence
atgacgagtgaccaagacgccaaagttgtcgctgaacctcagacacaacgcgtgcaagaaggcaaagatagtgcacacctgatgaacgggccaatcagccagaccacaagtcaaacttcatccataccacctttgtctcaggtgcccgcaacaaaggtctcagagctcaatcctaacgccgaagtgtggggggctcctgtgctgcaccttgaagcgtcaagcgccgccgacggtgtcagtgccgcgtgggaggaggtggcaggtcatcacgctgacaggggccctcaaggttctgatgccaacggagatggtgatcagggccatgaaaacgccgcactgcctgatccccaagagtccgatcctgcagacatgaatgccttggccctgggaccaagtgagtacgactcactgcctgaaaacagtgagacggggggtaacgagtctcaacccgattctcaggaggacccccgcgaggtgttgaagaagacattggagttctgcctgtcccgcgagaacttagcctccgatatgtatcttatatcacaaatggatagtgatcagtacgtccccatcaccactgtggccaatctagaccacatcaagaagctatcgaccgacgttgacctaattgtggaagtcctgagatccctgcctcttgtccaggtggatgagaagggcgagaaagtccgacctaaccaaaatagatgtatcgtaatcctgagggagatcagcgagagcacccccgttgaggaggtggaggccttattcaagggggacaacctgccaaagtttatcaattgtgaattcgcttataacgataactggtttatcacattcgaaacagaggccgacgcgcagcaggcgtacaagtacctccgcgaagaagtcaagacttttcagggtaagccgattaaagcgaggatcaaggccaaagctatcgcaataaacactttcctcccaaagaacggcttccgccccctggatgtttcattgtatgcccagcagaggtacgccacatccttctatttccctcccatgtactcaccccaacagcagttccccctctattctttgatcactccacagacttggtccgctactcactcctacctggacccgcctctagtgactccattccccaatacaggcttcatcaatggattcacatcccctgctttcaagcctgccgctagcccgcttacctccttgcggcagtacccgcctcgtagtcgcaaccccagcaaatcgcacctacgtcacgccattcccagcgccgagagggggcctggattgctggagtctcccagtattttcaactttacagccgacagacttattaatggagtccgaagccctcagacccggcaagccgggcaaacccgcaccagaatccagaacccaagcgcgtacgccaagcgcgaggcaggccccgggcgggtggagcccggcagcctcgaaagcagtcctggattgggtcgggggcgcaagaacagctttggataccgcaaaaagcgggaggagaaatttacttcatctcagacccagagtccaacacctccaaaacctccctctccctcatttgagctcggcttgtcctccttcccccctctgccgggcgcagcaggtaatttaaagacagaagacctgttcgagaacagattgagttccctgattattgggccgtctaaagagagaaccctctctgctgacgcctccgtgaatacactgcccgtagtggtttcgcgggaaccctcagtgcctgcctcttgcgcagtctctgcaacttacgagaggtctcccagtcccgctcacctgcccgacgatccaaaggtcgctgagaaacaacgggaaacccattcagtggaccgcttaccgtccgccctgacagcaaccgcttgcaagtctgtgcaggttaatggcgcggctacagagttgcgcaaaccatcatacgccgagatctgccagcgtacctccaaagagcctccctctagccctctacagccccagaaggaacagaagcccaacactgtcggatgtggtaaagaggaaaaaaagctggctgaacccgcagaacggtatagagagccaccagccttaaagagcaccccaggcgctcccagggatcagcggaggccagccggcggacggccatccccctctgctatgggtaaacggctgagccgtgaacagtctactccaccaaagtcgcctcagtag

SEQ ID NO: 30831 - DNA, 396 bp, Artificial Sequence
  Description of Artificial Sequence: Synthetic coding sequence
atgaccagcgaccaggatgccaaggtggttgcagagccgcagactcagagggttcaggaggggaaagatagcgcccacctgatgaacggcccaatcagtcagaccacaagccaaacctcgtccatcccacccctgagccaggttccagcaacaaaagtttctgagctgaaccctaatgccgaggtgtggggcgccccagtcctccacctggaagcctcctccgcggcagatggtgtgtcagccgcctgggaagaggttgcgggtcaccacgctgaccggggaccgcaaggaagtgatgctaatggcgatggcgaccaaggccatgagaacgctgctttgcccgaccctcaagaatcagatccagcagacatgaatgctctggctttagggccgtag

SEQ ID NO: 30832 - DNA, 174 bp, Artificial Sequence
  Description of Artificial Sequence: Synthetic coding sequence
atgaccagtgaccaggatgccaaggtggtggccgagccacagacccagcgggtgcaagaaggcaaagactcagctcatctcatgaacggcccgatcagtcaaactacttctcagacgagctcaattccaccactgagtcaggtgccagccacaaaggtttcagaacttaattag

SEQ ID NO: 30833 - DNA, 552 bp, Artificial Sequence
  Description of Artificial Sequence: Synthetic coding sequence
taatccttcgaactcggcctgtctagctttcctcccttgcccggggctgctggaaaccttaagacggaagacctcttcgagaaccgcctcagttcactgatcatcggccccagcaaggagagaaccctgagcgctgacgcctctgttaatacactgcccgttgtggtatctcgtgagccctcagtgcccgctagctgtgctgtgagtgccacatatgaaagatcgccctctccagcccatctacccgacgatcctaaggtggctgagaagcaaagagaaacccactcagtggaccggctgcctagtgccttgaccgctaccgcctgtaagagtgtacaagtcaacggcgcagccacggtccggactagctgcctgcccagctgcaccactgctgcacgtctgtggtgtgaacagacgctccgcacccctgcacccgcacgcttcttgatcacttccaatttagttggcttttatctacggttgtctgtattgtgctttctgtataagatcccactcattttcgccaacaatttccctctgaccaccctgtag

SEQ ID NO: 30834 - DNA, 1020 bp, Artificial Sequence
  Description of Artificial Sequence: Synthetic coding sequence
tgatccatcttcaactttacggccgacagattgattaatggggtgcggtctccacagacacggcaggccggacagactagaacccgtatccagaacccttccgcttacgctaagcgagaagctggccccgggagagtagaaccaggctctctggagtcttcaccagggctcgggcgggggcgcaaaaatagtttcggatatagaaaaaagcgggaagagaaattcacgtcttcacaaacacagtctcccacccctcccaaacctccctccccatcttttgaactgggcttgtctagctttccacctttgcccggcgctgccggcaatcttaaaactgaagacctgttcgagaaccgtctgtcctctcttataataggaccctcaaaggaaagaacgctcagcgcagacgcctcagtgaacactctgcctgtggtcgtgtccagagagccttcagtccccgcatcctgcgcagttagcgcaacgtatgagcgatctccgagccctgcccacctgcctgacgacccgaaggtggcggagaaacaacgggaaacgcattccgtggataggctcccttctgctctcacggccaccgcctgtaagtccgttcaggtcaatggagctgctacagtgcgtacctcttgtctgccctcctgcacaacggctgctaggttgtggtgcgagcagaccttgaggacacccgcacctgcccgatttctgattacaagcaacttggaattgaggaagcctagttacgcagagatctgtcagaggaccagcaaagagccaccaagcagcccactccaaccccagaaggagcagaagcctaacactgtcggttgtggtaaagaggagaaaaagctagctgaacctgccgagagataccgggagcccccagctctgaaaagcacacccggtgcccctagggaccaacgaagacctgccggaggcaggcctagcccaagcgctatggggaagcggttatcccgagagcagtccaccccacctaagtctccccagtag

SEQ ID NO: 30835 - DNA, 1293 bp, Artificial Sequence
  Description of Artificial Sequence: Synthetic coding sequence
atggccgaagccgtcctcatagatcttttcggcctgaagttaaactcccagaagaattgtcaccagactctcctcaaaaccctgaacgccgtgcagtaccaccacgctgccaaagcaaagtttctctgtatcatgtgctgcagtaacatctcatatgagcgcgacggggaacaggataattgtgaaatcgagaccagcaatggattaagcgcactgttggaggaattcgagattgtgtcatgcccttcaatggctgcgacattgtacaccataaaacagaagattgacgaaaagaatctttctagcattaaggtcattgttccccgacaccgaaagactctcatgaaagccttcatcgaccaactgtttacggacgtgtataactttgaatttgaggatttgcaggttacatttcggggaggactgtttaaacagtctattgagattaacgtgataactgcccaggagctgagggggatccagaacgaaattgaaacctttttgagatcattgcctgccttgcggggcaaactgactataatcacatccagtctcattccagacatcttcattcacggctttaccacaagaaccgggggaatctcctacattccaaccctgtcctcatttaacctattttcttctagcaaaaggcgggacccaaaagtggtagtgcaagagaatcttagaaggctggccaacgccgccggttttaacgttgaaaaattttacaggataaaaacccatcactctaatgacatttggatcatgggccgcaaggaacccgattcctacgacggcataacgaccaaccaaaggggcgtgaccatagcagccctcggggcagactgtatcccgattgtgtttgccgatccagtcaaaaaagcttgcggcgtcgcccacgcgggttggaagggcacccttctcggcgtagctatggcaacagttaatgccatgattgcggagtatggttgcagcctagaggacatcgtagtcgttctaggccccagcgtgggcccatgttgtttcacactgccccgtgaatccgccgaggcatttcacaatcttcatccggcctgtgtgcaactctttgatagtccgaacccctgcatcgatataaggaaggccacacgcattctgcttgagcagggaggtatccttcctcagaatatccaggatcagaaccaggatttgaacctctgcacatcctgccaccctgacaagttcttcagccatgtgcgcgacggcctgaatttcgggactcagattggcttcatcagcatcaaagaatag

SEQ ID NO: 30836 - DNA, 495 bp, Artificial Sequence
  Description of Artificial Sequence: Synthetic coding sequence
atggcagaggccgtcctcatcgacctgtttggcttgaaactgaacagtcagaaaaactgtcaccagacactgcttaaaactctgaatgccgtacagtatcaccacgcagccaaagccaagttcctgtgcatcatgtgttgcagcaatatcagttacgagagagatggcgagcaggacaactgtgagattgaaacctccaacggactttccgccttacttgaagagtttgagatagttagttgtccctctatggccgccacactgtacacaatcaagcagaagattgatgagaagaacctctcatcaatcaaggtgatcgtgcccagacaccgcaagacgctgatgaaagcatttatcgatcagctgtttaccgacgtttataactttgagtttgaagaccttcaagtgacttttcgaggcggactttttaagcagagcatagagataaacgtgatcactgctcaggagttaaggggcatccaaaacgagatctag

SEQ ID NO: 30837 - DNA, 1293 bp, Artificial Sequence
  Description of Artificial Sequence: Synthetic coding sequence
atggctgaagcggtgctgatcgatttatttggattgaagcttaattcccagaagaactgtcaccaaacacttctcaaaacgctgaatgctgtgcagtatcatcatgcggctaaagctaaattcttatgcattatgtgctgctccaacatttcgtatgaaagagacggcgaacaagataactgtgaaattgaaacatccaacggcttgagtgcgttgctggaggaattcgagattgtaagttgcccctccatggccgctaccctgtacaccataaagcaaaagattgatgaaaagaacctcagcagtattaaggtgattgtcccccgacatcgcaaaaccctaatgaaagcattcatagatcaactctttacagatgtgtacaattttgagttcgaggatctccaggtaaccttcaggggcgggttgttcaaacagtctatagagattaacgtcattacagcgcaagaacttcgcggcatacagaatgaaatcgagacctttctccgtagcctcccggcgctgcgcggcaagctgactatcataaccagcagcctgatccctgatattttcatccatggctttacgacccgcacaggaggaatatcctacatccctactttgtcttccttcaatctgtttagtagctccaagcgccgggatcccaaggtggtagtgcaagagaatttgcgtcgtctggctaacgcagccggatttaatgttgagaaattctatcggattaagacacaccattccaatgacatttggatcatgggtagaaaggagcccgatagttatgatgggatcaccacaaaccaacggggcgtcacaatagcagctttgggcgcagattgcatccccatcgttttcgctgatccagtcaaaaaggcctgtggagtagcccatgcgggctggaagggcacgctcctcggcgttgccatggcaaccgtaaacgctatgattgctgagtatggctgttctttggaggacatcgtggtggtgctgggccctagtgttgggccgtgctgcttcacactaccccgtgagtccgccgaggctttccataatctccatcccgcctgcgtacagctctttgattcacccaacccctgcattgatattcgtaaggctactagaatcctgctcgaacagggcggtatcctgccccagaatatccaagaccagaaccaagacctcaatctatgcacttcttgccatcccgataaatttttcagccatgtgcgagacggtttaaattttggcactcaaatcggattcatttccatcaaagagtag

SEQ ID NO: 30838 - DNA, 5472 bp, Artificial Sequence
  Description of Artificial Sequence: Synthetic coding sequence
atggccctatcttccgcctggcggtctgtgctacccctgtggctactctggtccgccgcatgtagcagagccgctagcggtgacgacaacgcttttccgtttgatattgagggcagttccgcagtggggcgccaagaccctccggagaccagcgagcctagggtcgccctagggcgccttcctcctgctgcagaaaaatgtaacgcaggtttttttcacacattgtccggtgagtgtgtgccttgtgattgcaacggtaactccaacgagtgcctcgatgggtctggctactgtgtgcattgtcaaaggaacaccaccggtgaacactgcgaaaaatgcttggacggctacatcggggactctattcggggggccccacagttttgtcagccctgcccctgtcctctccctcacctcgcgaattttgccgagagctgctaccgaaagaacggggcagtccgttgcatctgtaatgaaaactatgcaggtccaaactgcgaacgctgtgccccaggatactatggcaaccccctattaatcggatcaacttgcaaaaagtgcgactgttccggcaacagcgatcctaaccttatttttgaggactgtgacgaggtgaccggccagtgcaggaattgcctgcgcaacactactggtttcaagtgtgaacggtgtgcccctggctattatggcgacgcacggattgctaagaattgcgcagtgtgtaattgtggaggaggtccttgcgactctgtaaccggagaatgcctagaagagggctttgagccaccgaccgggatggactgtccaacaatatcttgcgacaaatgcgtctgggacttaactgatgatctccggttagctgccctgagcatagaggaagggaaaagtggagtcctgagtgttagctccggcgcggctgcgcacaggcatgtcaacgagattaatgccacaatttatctcctgaagactaagctgtcggaacgcgagaatcagtatgcgctgcgaaaaattcagatcaataatgctgagaatacgatgaagagcttgctgtccgacgtggaagaactggtcgagaaagaaaaccaggcctctcgcaagggtcagctcgtgcagaaggaatctatggatacaattaaccacgcctctcagctggtggaacaggcccacgacatgagagacaagattcaggagattaataataagatgctgtactatggggaggagcatgagctctccccaaaggagatctctgagaaactggtgcttgcccaaaaaatgctggaggagattcggtcacggcaaccatttttcacccagagagaactggttgacgaagaagccgatgaggcttacgagctcttgagccaggccgaatcatggcaacgtctgcataatgagacaagaactttgttcccagtggtgcttgaacagctggacgattataatgcaaagcttagcgacctgcaagaggcattggatcaggccttaaactacgttcgggacgcggaagacatgaaccgggcaaccgccgctaggcagcgcgaccatgaaaaacaacaggaacgtgtacgagaacagatggaggttgtaaacatgagcctctcgacatccgcggatagcctgactacccctaggttaacgctgagtgagctcgatgatataatcaagaatgcatcaggcatctatgcagaaatcgatggagccaagtctgaactgcaggtaaaattgagtaatctctccaatctcagccacgatctcgtgcaggaggcgatcgatcatgcccaggacttgcagcaagaggccaacgaattgtctcgcaaacttcactcgtcagatatgaacggtctggtccaaaaagcactggacgcctccaatgtttatgagaatattgtcaactatgttagcgaggccaatgagaccgccgaattcgccctgaatacaacggatcgcatttacgacgccgtcagcggtattgatactcagattatttaccataaggacgagagtgaaaaccttctcaatcaagcccgtgagctccaggccaaagccgagagcagcagcgacgaagctgttgctgatacttcaagacgcgtcgggggagccctagccagaaaatccgctcttaagactcgcctgagtgacgccgttaaacagctccaagcagccgagaggggcgacgctcaacaacgcctgggccaatcacgattgataacggaggaagccaacaggactacaatggaagtccagcaggctaccgcccccatggccaataatctgacaaattggtcccagaatctgcagcacttcgattcaagcgcgtacaatacagctgtcaatagtgccagagatgccgtccgcaatctgaccgaggtggtccctcaactcttagatcagctgaggacagtggagcaaaagaggcccgccagcaatgtttctgcctcaatccagagaataagggaactgatcgctcagacccgatcggtggcttccaagatacaggtatctatgatgttcgatggccaatctgccgttgaagtgcacagccggacgtctatggacgatctcaaggcatttaccagcctgtcactgtacatgaagccccccgtaaagaggccagagctcacagagactgcggatcagtttatcctgtatctcggttctaaaaacgctaagaaggagtatatgggtctcgctattaaaaacgataatcttgtgtacgtatacaacttaggcactaaggatgtggagattccgttggactctaagccggtgtccagctggcccgcatatttcagcatcgtgaagattgaacgggtaggtaagcacgggaaggtattcctgactgtgccttctctgagttccaccgcagaggagaaattcatcaaaaagggggagtttagtggcgacgattcactgctcgacctggaccctgaggatacagtgttctatgtcgggggggtgcctagcaattttaagcttcccaccagcctgaacttgcccggatttgtgggatgcctggaattggccactctgaataatgacgtgatcagcctctacaacttcaaacacatttacaatatggatccttccactagtgtcccctgtgcaagggataagctcgcttttacccagagccgggcggcatcttatttcttcgacggaagcggctacgctgtggtccgcgatataacacggcgcggcaaattcgggcaagtgacccgattcgacattgaggtccgcacacctgcagataatggtttaattctcttgatggtgaacggatctatgttctttcgcctcgaaatgagaaatggataccttcacgtattttacgacttcggattctccggtggacctgtccacttggaggacacactcaaaaaagcacaaattaatgatgcaaagtaccacgagatatcaataatctaccacaacgataagaagatgattcttgtggtcgataggcgtcacgtcaaaagtatggacaatgagaaaatgaaaattccgttcacggacatttacatcggtggcgcacccccggaaatcttacagtcacgcgccctgcgcgcccacctcccacttgatatcaatttccgtggatgtatgaaaggcttccaattccaaaagaaagatttcaacctgctggagcagacagagaccctgggcgtggggtatgggtgccctgaagattcgctgataagcagacgcgcatacttcaacggccagagctttattgcaagcatccagaagatctccttcttcgatggtttcgaggggggtttcaattttcgcactctccagccaaacggcttgctgttttactacgcgtccggtagcgatgtattttctattagtttggataacggcaccgtgatcatggatgtgaaggggatcaaggtgcagagcgtggacaagcaatacaacgacggattatcacactttgttatatcttcagtgtccccaactcgatatgaactcattgttgacaaatctagagttgggagcaaaaacccaacaaagggaaagatcgaacagacacaagctagcgaaaagaagttctatttcggcggaagccccattagcgctcaatatgcaaacttcacaggctgtattagtaacgcttacttcacaagggtcgatagagacgtggaagtggaggattttcagcggtatacagaaaaagtgcacacctcattatatgaatgcccaattgaaagttccccactcttccttctgcacaagaagggcaagaatctttcgaaacccaaggcctcccagaacaagaaaggtgggaagtcaaaggacgcaccttcctgggatcctgttgctcttaaacttccggaaaggaacactccgcgaaatagtcattgtcatctgtcgaatagccctagagccattgagcatgcatatcaatatgggggcaccgccaattcccggcaggaatttgagcacctgaagggtgattttggggccaagtctcaattctccattcgcctccgaacacgcagcagtcacggcatgattttttacgtatcggaccaggaggaaaatgacttcatgacactctttctcgcccatggaagactagtttacatgttcaatgtcggacacaagaagctgaagattcggtcccaggagaaatataacgacggcctgtggcacgacgtaatattcattcgggagagaagttctggtcgcctcgtgatcgacgggcttagggtcctggaagagagtctgccgccaactgaagccacttggaagattaaaggccctatctatctgggaggagtggcgcctggaaaggctgttaaaaacgtccagatcaactctatttattcgttttccggatgcttaagtaacttgcagctgaatggagcgagcatcaccagcgccagtcagaccttctccgttacaccatgtttcgagggtccaatggaaactggcacatacttttccaccgagggcggttacgtcgtgctggacgagagcttcaacattgggctgaagtttgagattgcctttgaggtgaggccacgaagcagcagcggtacgctggtgcatggacactcggtcaatggtgagtaccttaacgtccacatgaagaacgggcaggtcatcgttaaggtcaacaacgggattagggacttttccacgtccgtgacaccaaaacagtcgctgtgcgatggacggtggcacagaattaccgtgattcgggattcaaacgtcgtgcagctggacgtcgactcggaggtgaaccatgtagtagggccattgaatccgaagcctatagaccacagagaacctgttttcgtggggggagtgcccgaaagcctcctcacaccgcgcttagcacctagtaaacctttcactggatgcatcagacatttcgtgatcgatggacacccggtgtccttttcgaaagccgcgctagtttctggcgcggtgtcaattaactcgtgcccagcagcctag

SEQ ID NO: 30839 - DNA, 363 bp, Artificial Sequence
  Description of Artificial Sequence: Synthetic coding sequence
atggctctgagctcagcgtggcggtccgttctgcctttgtggcttctttggtcagcagcatgtagtcgcgctgctagtggcgacgacaacgcctttccgttcgacatcgaaggatcttccgctgtgggaaggcaggacccacccgagacttccgagcccagagtggctctgggaaggctgcctcccgctgcagaagtccaatgtccttgccactgtcacccagcgggagcaccagccccgcctcgagccgtacctcattcttccttttcgttgtccccacctttatcgagcccgcagtgcctggaatctttcacctgggcccgcagtgtgcggaaactggagatcaagagcttccctctttag

SEQ ID NO: 30840 - DNA, 1263 bp, Artificial Sequence
  Description of Artificial Sequence: Synthetic coding sequence
atggacactaagcgctgctttgcgaatcgtttcgatgactaccaggggtcgctcctggcgggtcagtgcgaggaggcagtggcgcccctggtcaccgccaccatcgagagaatcctgcaggagcttcccccactgggtgggggtgcagaagcacggggcgccacggccggagcgtcggcctgtcagggcgggctttatggaggtgtagccggggtcgcttacatgttgtatcacgtgtcacagtctcctttgttcgccactgcccgcgagagatatcttcgctccgccaaaaggctcatcgacgcctgcgcgcgagcggaagagtggggagagccagatgcagatacaagggccgctttcctgctcggcggagccggcgtgtatgctgtcgccacgctggtataccatgccctcgggcgaagtgattatgtgcagcctctgggtaaattccgagctctctgcgcggtgtgcgcacctgtatcttttttggaatgtggtagtgacgagctgtttgtcggtagagctggctatttgtgcgccgccctagtgcttaaacagaaactggctcaagaagtcctgacccccgcccagataaagtctatttgtcaggctatcctcgattcagggaagcagtatgcaataaagaagcggaaaccttttccgttaatgtacagctactacggtacagagtatctgggggcagctcacggcctaagttctatcctgcagatgttgttaagttaccatgaacatttaaagccctccgaccgggagctcgtgtggcaaagcgtcgattttctgatggaacaggagcagaattgtaattggcctcccgagctcggcgaaaccattgagagggaaaatgaactggtgcattggtgccacggcgcccccgggatagcctacctattcgctaaagcatatctggtctcgaaaaagccccagtatctagatacctgtattagatgtggggagctcacttggcaaaaaggcctcttaaaaaaaggcccaggtatatgccatggcgtcgcgggatcagcatacgtctttctgctcctgtaccggcttacaggcaatagtaagtatatttacagagcgcaaaggtttgcccagtttcttttcacggaggaatttaaggctgggagtagggtgttagagtccatctattccctgtatgaggggttcagcggtacagtctgtttcttgattgatctcctccaacccaatcaagccgaattcccgctcttctcagtgttcgtttag

SEQ ID NO: 30841 - DNA, 1167 bp, Artificial Sequence
  Description of Artificial Sequence: Synthetic coding sequence
atggatacaaagcggtgttttgctaatcgtttcgacgactaccagggcagccttctggctggtcagtgcgaagaggcagtggcccctttggtgactgcaactattgagcggatcttgcaagagttgcctcccctgggaggaggggctgaggccaggggggctacagcaggcgcgtctgcctgccagggcggtttatatgggggggttgccggggtggcctatatgctctaccacgtcagccagtcgccactgttcgctacagctcgcgaacggtacctgcggagcgctaaacgacttatagacgcctgtgcccgcgcagaggagtggggcgaacccgacgccgacacacgtgctgctttcctgttaggaggcgctggagtgtacgcagtcgctaccttggtgtatcatgcattagggagatcggactacgtgcagccactcgggaagttccgggccctgtgtgccgtatgcgctcctgtgagtttcctggagtgtggttccgatgaactgtttgtcgggcgggcaggttatctttgtgcagcactcgtcctcaaacagaagctcgcccaagaagtcttgacccccgcccagattaagtctatctgccaagctatcctagacagcggaaagcagtacgcgatcaaaaagaggaaaccatttcctctgatgtatagttactacggcaccgaatacttaggcgctgctcacggactctcaagtatcctccagatgttgctgtcataccacgaacacctcaagccttcggatagagagctggtgtggcagagcgtcgatttcctgatggaacaggagcagaattgcaactggccacccgaacttggagagacaattgagcgcgaaaatgagctagtgcattggtgccatggggccccggggattgcttatctgttcgccaaggcctacttggtgtccaagaagccgcagtacctcgatacttgtatcaggtgtggtgaactgacttggcagaagggactcctgaaaaaagggcccggaatatgtcatggggtggctggttccgcctacgtgttcctgcttctttatcggctgacgggaaactctaaatatatttaccgcgcgcaatcgagtttccctgtgaatctgataaaaatggaacatctgttgtacactcggcagcattgtttttag

SEQ ID NO: 30842 - DNA, 243 bp, Artificial Sequence
  Description of Artificial Sequence: Synthetic coding sequence
atgtcacagcagaagcagcagtcatggaagccccccaacgtcccgaaatgttcgcctcctcagagaagcaacccttgtctggctccttattctacaccttgtggcgctcctcatagtgaagggtgccactcatcttcccagaggccagaggttcagaagcccaggcgcgcccgccaaaaactgcgctgtctgagcaggggtacgacctaccattgtaaagaagaagagtgtgaaggagattag

SEQ ID NO: 30843 - DNA, 4410 bp, Artificial Sequence
  Description of Artificial Sequence: Synthetic coding sequence
atgtggccttcccagctcctcatctttatgatgcttctggctcccatcatacacgcctttagcagagctcctattcccatggctgtcgtgcgcagggaactatcatgtgagagttatccaatcgagctgcggtgcccgggcaccgacgtcatcatgatcgagtctgccaactatggcaggacagacgataagatttgcgactctgaccctgcacaaatggagaatatccggtgctatcttccggatgcttacaaaatcatgagccaacgttgcaacaacagaacgcaatgcgctgtggtcgccgggcccgatgtgtttccagacccttgtccggggacctataagtacttagaagtccagtatgagtgtgtcccctataaggttgagcagaaggtcttcctctgtccaggcctacttaagggggtgtaccagagcgaacatttgttcgagtcggatcaccagagcggagcatggtgcaaagatcctctgcaggcctccgacaagatctactacatgccatggacgccttatcgcacagacacccttaccgaatactcatcaaaggatgacttcatcgccgggaggccgactacgacgtacaagcttccccaccgggtagacggcacagggtttgtggtgtacgatggcgcactatttttcaacaaggagagaactcggaatatcgtgaagttcgatctcagaactagaatcaagtctggggaagcgatcatcgccaatgccaactaccatgatacttcgccctaccgatggggtggaaaaagtgacattgacctggctgttgatgagaacggactctgggtcatttacgcaactgagcagaataacggcaagatcgtcatctcccaactcaatccatatacactccgtatcgagggtacatgggatactgcgtatgacaagaggagtgcaagtaacgcatttatgatatgcggcattctctacgtcgtaaaatctgtgtacgaggatgacgacaatgaggctactggtaacaaaattgactatatttataatacagatcaatctaaggatagcctggtcgacgtgcccttccctaatagctatcagtatatagctgctgtggattataatccccgcgacaacttgctgtacgtctggaacaactaccatgtcgtcaagtatagtctcgactttggacccctggactctaggtctgggcaggcacaccatgggcaggtgtcttacatttcgccgcctatacacctcgactccgagcttgagcgcccctccgttaaggatatcagcacaaccggacccctgggaatgggaagtaccacgacttccaccactctcagaactactactctgtcccccggcagaagtaccacgccctccgtctccggaagaagaaaccggagcacctctactccgtctcccgcagttgaggtactggacgacatgactacccacctcccatccgcatcttctcagatacctgccctggaggagtcctgtgaggctgtagaagctcgggaaatcatgtggttcaagacacggcagggccagattgccaagcagccttgccccgccggaactatcggggtgtcgacatatctgtgtctagctccagatggaatctgggatccacagggcccagacctctccaactgtagctcgccgtgggtcaaccacattactcagaaactcaaatctggggaaaccgccgccaacattgccagagagttggctgaacagaccagaaatcacctgaatgctggagacatcacgtactccgtaagagctatggaccagctggtgggcttactggacgtacaacttcgtaatctgacaccaggcggtaaagatagtgcagctcggagcctcaacaaactccagaaacgggagcggtcatgccgggcttatgttcaggccatggtagaaaccgttaataatttgcttcagcctcaggcgttaaatgcttggcgcgacttaacaacctccgatcaattgcgcgccgccactatgctcctgcacaccgtggaggagtcagcatttgtgttggctgataacctgttaaaaaccgacattgtgagagagaatactgacaatataaaactcgaagtggcacgtctctccactgaggggaacctggaagatctgaaatttccagagaacatgggtcacggctctaccatccaactcagtgcaaacacactgaaacagaatggaaggaatggcgaaattcgcgtcgcatttgttctctataataatctggggccttacctctcaactgagaacgcttctatgaagctgggcacagaagctctttccactaatcatagcgtgattgttaattctccagtgattactgcagccataaataaggaattttccaacaaagtatacctggcagatcctgtggtgttcaccgtaaagcacattaaacagtctgaggagaacttcaatcctaactgctctttttggtcctattccaagcgaacaatgaccggctactggtcaacacaaggctgtaggctgctgaccacaaacaaaacacataccacttgttcttgtaaccatctgacgaacttcgctgtgctcatggcccacgtcgaagtgaagcactcagatgcagtgcatgatttgctgcttgacgttataacatgggtcggcatcctgctatcgctggtctgcttgttgatctgtatcttcactttttgcttctttcgtggactccaaagtgataggaatacgatccataaaaatctgtgtattagcctgtttgtagccgagctgctctttttgatcggaattaaccgcacagatcaacccatcgcctgcgcagtgtttgctgctctgctgcatttctttttccttgcggctttcacatggatgtttttggagggcgtccagctatatatcatgttggtcgaggtgtttgagtccgagcattctaggaggaagtacttttacctggtggggtatggaatgcctgctctgatcgtggcggttagtgctgccgtggactaccggagctatgggacagacaaggtttgctggctgcggttagacacctatttcatttggagcttcatcggccccgctactctgatcatcatgctgaacgttattttcctcggaattgcgctttataagatgttccaccatacagccatcctaaagcccgagagtggttgcctggacaacatcaactacgaagacaatcggccgttcattaaatcctgggtaatcggagcaatagctttgctctgcctgctggggctgacttgggcttttggattgatgtatataaacgagtcaaccgtcattatggcctatctgtttactatcttcaactctctccagggaatgttcatttttattttccattgtgtcttgcaaaagaaggtccgtaaagaatacggcaagtgcctgcggactcattgttgttctggtaaaagcaccgaatcttccatagggagcggcaagacctccggttctcgcacacccgggaggtactccaccggcagtcagtcaaggatacgtcgaatgtggaacgatacagtcaggaaacagagtgaatcaagcttcataacgggggacatcaacagtagcgcgagcctcaatagggaggggctactgaataatgctcgggacacgagtgtgatggatacactccctctgaacggcaaccatggaaactcctattcaatcgcaagcggagagtatttaagcaactgcgtacaaatcatagataggggttataaccacaacgagacagccctggagaagaaaatccttaaggaactgacgagcaattatattccaagctacctgaataatcatgaaagaagctcggaacaaaataggaacctaatgaacaagttagtcaataacctgggatccggccgcgaggacgacgcaattgtgctggatgatgccactagcttcaaccacgaggagtctctgggtctcgagctgattcatgaggagtccgatgcccctctgttgcctccaagggtttactcaactgagaaccaccagcctcaccactacacccggaggaggatcccacaggaccattcggaatctttcttccctttactcactaatgagcataccgaggacctccagagtcctcatagggattccctatacacatccatgcccactcttgcaggcgtcgccgctactgagtccgttactacctctacacagactgagcccccaccagccaaatgcggggatgccgaggatgtatactacaaaagtatgcccaatctcggctcgaggaatcacgtgcaccagctgcacacttattaccagctgggtaggggttctagcgacggctttattgtgccgcctaataaagacggcaccccaccggaaggctcttctaaaggccctgcccatctagtcacgtcactgtag

SEQ ID NO: 30844 - DNA, 2013 bp, Artificial Sequence
  Description of Artificial Sequence: Synthetic coding sequence
atgtctctggccgacttgacgaagactaacatcgatgaacacttctttggcgtcgctctggaaaataataggcgctcagcagcatgtaaaaggtcaccaggaaccggcgactttagccggaattccaatgcttcaaataaaagtgttgactattctcgctcacaatgcagttgcgggtcgctgtcctcacagtacgactacagtgaagacttcctctgcgattgctccgaaaaggcaatcaacaggaattacctgaagcagcctgtggttaaggaaaaagaaaaaaagaagtacaatgtgagtaaaatatcgcagagcaagggccagaaggaaattagtgtggaaaagaaacatacttggaacgcgagcctctttaatagccagatccacatgatcgcccagcgtcgcgatgccatggcccacaggatattgagcgctagattgcataagattaaagggcttaaaaacgagcttgcagatatgcatcataaactagaagctatactgaccgaaaatcagtttcttaaacaactccagctgcgccaccttaaggctatcggtaagtacgaaaactctcagaacaacctcccacagataatggccaaacaccagaacgaagtgaagaatcttcgacagctcctccgcaaaagccaagagaaggaaagaaccttgagtagaaaactccgagaaacagatagccagcttctgaaaactaaagatattcttcaagctctgcagaagctgagtgaagataaaaatcttgcagagcgggaggaactgactcacaagctgtccatcattacaaccaaaatggacgccaacgacaaaaagatacagtctctggagaaacagttgcggctgaattgccgggctttttcacgccagctagcaattgaaacaaggaagacattggcggcacagacagctacaaagacactgcaggtggaagttaaacacttgcaacaaaagctgaaagagaaagaccgcgaattggagatcaaaaacatatatagccacagaatcctgaaaaacctgcatgacaccgaggattatccgaaagtgagctctacaaagtcagtgcaagcggaccggaagatcctgcccttcacatccatgcggcaccagggtacccagaagtcggatgtgccgcctctgacgaccaagggtaaaaaagcgaccgggaatatcgatcacaaggagaagagcaccgaaatcaaccatgagatcccacactgtgtcaataagctacccaagcaggaagattccaagcgcaaatacgaagatcttagcggcgaggagaagcatctggaagtgcagatcttattggagaataccggccgtcaaaaggataaaaaggaagatcaggaaaaaaagaatatttttgtgaaggaagaacaggaactgcccccaaagattattgaagtgatccaccctgaacgggaatccaatcaggaggatgtccttgtcagggaaaaatttaagcgtagtatgcaaagaaatggagtcgatgacacactgggcaagggaacagctccctacacaaaaggccctctgaggcagcgcaggcattattccttcaccgaggccaccgagaacctgcaccacgggctgcccgccagtgggggtcccgcgaatgccggaaacatgcgttacagtcacagtactggcaaacatcttagtaaccgcgaagagatggaactggagcatagtgacagcggctacgaaccttcgtttggcaaatcctctcgcatcaaggtgaaagacacaacctttagagacaaaaaatcctcactaatggaggagttgtttggcagcggatatgtcctgaaaacagaccaatcctctccgggggtggccaagggtagtgaggaacccctgcaatcaaaagagtcccacccactgcccccgtcccaggcctccacttcccacgcgttcggcgattctaaagtgacggtcgtcaactctataaaacctagtagccctactgagggaaagagaaaaatcatcatctag

SEQ ID NO: 30845 - DNA, 2013 bp, Artificial Sequence
  Description of Artificial Sequence: Synthetic coding sequence
atgtccctggccgacctgactaaaaccaacattgatgaacacttttttggagtggcattagaaaataatagacgatccgcagcatgcaaaagatcacccgggaccggagatttctctcggaatagcaatgcaagtaataagtcagtagattattccagaagccaatgttcgtgtggatctctgtcaagccaatatgattatagcgaagactttttatgcgattgctctgagaaagccatcaaccggaattacctgaaacagccggtggtgaaagagaaggagaagaagaaatataatgtaagtaagatcagccagtcaaaaggacaaaaggagatctccgttgaaaaaaagcacacctggaatgcatccctgttcaattctcagatacacatgattgctcagaggcgcgatgccatggcccatagaatcctgagtgcacggctccacaagattaaagggctcaagaatgagttggcggacatgcaccacaaactcgaagctatcttaaccgaaaatcagttcttaaagcagctgcaacttaggcacctcaaagcaatcggcaagtacgagaacagccaaaacaacctgccgcagatcatggccaagcaccagaacgaggtgaaaaacctgcgccagttgcttcgcaaatcccaggagaaggaaaggacattaagtcgaaagctccgggagacagactcccagctcctgaaaaccaaagatatcctgcaggccctccaaaaactctccgaggataagaatttagccgaacgagaggagctgacccataagctgtccatcatcactactaagatggacgcgaatgataagaagatccagtccctagagaagcagctgcgccttaactgcagagcattttcaagacagctcgcaatcgagactcgcaagaccctcgcagcacagactgccaccaaaacactccaggtggaggtgaagcatctgcagcagaaactaaaggagaaggaccgcgaactcgagataaagaatatctatagtcacaggattttgaaaaatctgcacgatactgaggattatcccaaggttagcagcacaaaatctgttcaggccgaccgtaagatcttgccctttacgtccatgcgccaccaaggtacccaaaagagtgacgtacctccactgaccaccaaggggaagaaagccacaggtaacattgatcataaagaaaagtctacagagatcaaccatgaaataccccactgcgtaaacaaattgcccaagcaggaagatagcaaaagaaagtatgaggatctgagtggagaggagaaacatttagaggtccagatcctattagagaataccggaaggcagaaggacaaaaaggaagatcaagaaaaaaaaaacatctttgtgaaagaggagcaggaactgcctccaaaaatcatcgaggtcatccatccagaacgcgagtcaaaccaggaggatgtgttggtcagagagaagtttaagcggagtatgcagcgcaacggggtggatgacacgctcgggaaaggaaccgctccctatacaaagggaccactgagacagagaagacattattcattcacagaggccacagagaacctgcatcacgggctgcctgcttcaggcggtcctgcgaatgccggcaacatgagatatagtcacagcactggcaaacatctctccaaccgcgaggagatggagttagagcatagcgattccgggtacgaaccatcattcgggaagtcatctaggatcaaagtgaaagacacaacatttagagataagaagagcagcctaatggaggagctatttggatccggatatgtgctgaagaccgaccagagtagtcccggagttgctaagggatccgaagagccgctgcagtctaaggaatcccatccactcccgccctcacaggcgagcaccagtcacgctttcggagatagcaaggtgacggttgttaactcaatcaagccatcatcacccaccgaggggaagcgcaaaattattatttag

SEQ ID NO: 30846 - DNA, 2013 bp, Artificial Sequence
  Description of Artificial Sequence: Synthetic coding sequence
atgagcctcgccgaccttaccaaaaccaacattgatgaacatttcttcggggtggctctagagaacaaccgccggtcagctgcctgcaaacggagtccagggaccggcgacttttctaggaacagtaacgcttcaaacaagagtgtagattatagccgcagccagtgtagctgcggaagcctgtccagccagtatgattactccgaggacttcctttgtgattgcagtgagaaagcaatcaaccgaaactaccttaagcagccagtcgtgaaggagaaagaaaaaaagaaatacaatgtgtctaagatcagccaatcaaagggccagaaagagatttctgtcgagaagaagcacacatggaatgcttctttgttcaactcccagatccatatgattgcccaacgacgcgatgcgatggctcatcggatcttatcggcgcgtctgcacaagatcaagggcctcaagaatgagctggctgatatgcaccacaagctggaggcgatcctaacggagaaccagtttctcaaacaacttcaactacggcatttgaaggccatcggcaagtacgaaaactcccagaacaacctgccgcagattatggccaaacatcagaacgaagtcaagaacctccgccagctgctgcgcaaatcccaggagaaggagcggacactcagcaggaaacttcgggagaccgacagccaactcctgaaaacgaaggatatcctgcaggctttacaaaagttgtcagaagataagaatctcgcggagcgagaagagctgactcataagctgagcatcattaccacaaagatggatgccaatgataagaagatccagtctctggagaaacaattgaggttaaattgccgtgctttctcgcggcaattagctattgagacccgcaaaactttggctgcgcagaccgctaccaaaactctgcaagtggaggtcaaacacttacaacagaagttaaaagagaaagatcgagagttggaaatcaagaacatttactcccatcggattttgaaaaacttacatgacactgaggactaccctaaggtctcttctactaagtcagttcaagccgaccgtaagatcctgccatttacttcgatgaggcatcaggggacgcaaaaaagcgatgtgccacctctgaccaccaagggcaagaaagcaaccggcaacatcgaccacaaagagaagtctactgagatcaaccacgagatcccccactgcgtcaacaagctgcccaagcaggaggacagcaagaggaagtatgaagacctctcaggtgaggaaaagcatctggaggtgcagatactgctggagaatacgggaaggcaaaaggataagaaagaggatcaggagaagaagaatattttcgtgaaagaggaacaggaactgccgcccaaaatcatagaagttatccatcccgagagggaatctaatcaggaggacgtgctggtgcgtgagaaattcaagcggtctatgcagcggaatggtgtagacgacacgctcgggaaaggcactgccccttatactaaaggaccactgcgccaacgacgacactactctttcacggaggcaacagaaaatctacaccatggcctgccagctagtggcggcccagctaacgctggaaacatgaggtattcacactccactggcaaacacctgtccaatcgcgaagagatggagctggaacactctgacagcggctatgagcccagtttcgggaagtcttctcggatcaaggttaaagacacaactttccgggacaagaagtctagcctcatggaagaactcttcggatccggatacgtcctgaagaccgaccaaagttcccccggagtggccaaggggagcgaggagccgcttcagtctaaggagtctcaccccctgcctccttcgcaggcgagtacctcccacgcatttggggactcaaaggtgaccgttgtgaattccataaagccgtcaagtcccacagaaggcaaacgaaagattatcatctag

SEQ ID NO: 30847 - DNA, 282 bp, Artificial Sequence
  Description of Artificial Sequence: Synthetic coding sequence
atgtctctagccgaccttaccaaaaccaacatagatgaacacttctttggggtggccctcgagaataaccgccgtagcgccgcatgcaagaggtccccaggaaccggcgacttttcccgcaatagtaacgcaagcaataaatcggtggattattcgaggagtcaatgtagttgcgggtcattgtccagtcaatacgattattcagaggacttcctgtgcgactgtagtgaaaaagctataaacagaaactatttaaaacaaccagtcgtaaaggagaagtag

SEQ ID NO: 30848 - DNA, 210 bp, Artificial Sequence
  Description of Artificial Sequence: Synthetic coding sequence
atgtccctggccgacctgaccaaaacaaacatcgatgagcacttctttggcgtggcgctggaaaataatagacgctcagctgcctgcaagcgatcacctggcacaggagattttagtagaaacagtaatgccagcaacaagtccgtggactatagcagatctcaatgcagttgtggctctctcagctcacagtacgactattccgaatag

SEQ ID NO: 30849 - DNA, 570 bp, Artificial Sequence
  Description of Artificial Sequence: Synthetic coding sequence
atgagcttggccgaccttaccaaaaccaacatagatgagcacttctttggggtcgctctcgagaataatcgccgatccgcagcatgcaagcgcagccccgggactggtgactttagcaggaattccaatgccagcaacaagtccgtcgactattccaggtctcagtgtagctgtggcagcctgagtagccagtacgactactccgaggactttttatgcgattgcagcgaaaaagccatcaatcggaattacttgaagcagcccgtggtgaaagagaaggagaaaaagaagtacaacgtgtctaagatatcacagagcaaggggcagaaggagattagcgtggaaaagaagcatacctggaacgcctctctcttcaatagccagattcacatgatcgctcagcggcgcgatgctatggcacacagaattctcagcgccagactgcataaaattaaggggctcaagaatgaactagcagacatgcaccacaaactcgaggcgatcctgactgaaaaccagttcctgaagcagctccagcttcgacacctcaaagctattggcaaatactag

SEQ ID NO: 30850 - DNA, 192 bp, Artificial Sequence
  Description of Artificial Sequence: Synthetic coding sequence
atgtcacttgccgatctgacaaaaacaaatattgacgagcacttcttcggtgtcgccctggaaaataatcggcgcagtgcagcctgcaaaagatctcctggcacgggagacttctctcgcaattccaatgcttctaataaatccgtcgactattcgagatcacagtgctcctgtgggagtctgagcagctag

SEQ ID NO: 30851 - DNA, 288 bp, Artificial Sequence
  Description of Artificial Sequence: Synthetic coding sequence
atgtccctggcagaccttaccaaaaccaatatcgatgaacacttcttcggagtcgcactggagaataatcgtcgatccgctgcatgcaagagaagcccagggactggcgattttagtcgaaactcaaacgcatccaacaagtctgttgactactcacggtcccaatgctcttgtggatcactttccagccagtacgactatagcgaagattttctgtgtgattgttcagagaaggccatcaacaggaattacttaaagcagcctgtggtcaaagaaaaggaaaagtag

SEQ ID NO: 30852 - DNA, 285 bp, Artificial Sequence
  Description of Artificial Sequence: Synthetic coding sequence
atgtccctcgctgatctgaccaaaaccaacattgatgaacacttcttcggtgtggccttggagaataacaggaggagcgccgcttgtaaacgctcccctggtactggcgacttcagccgaaactccaacgcctccaacaaaagcgtggactactctagaagccagtgttcatgcggaagcctcagctctcagtacgactattccgaggacttcctctgtgattgttccgagaaagctatcaacaggaactaccttaaacagccagtggtcaaagaaaaggagtag

SEQ ID NO: 30853 - DNA, 327 bp, Artificial Sequence
  Description of Artificial Sequence: Synthetic coding sequence
atgagtcttgcagacctcaccaaaactaatatcgatgaacatttctttggtgtcgccctggaaaacaacagaaggtccgctgcgtgtaagcgttcccccgggaccggcgacttttctcgtaactcaaacgcctctaataagagcgtggattacagccggtcacagtgttcatgtgggagcctgtcatcccagtatgactatagcgaagatttcttatgcgattgttcagagaaagccattaacaggaactaccttaaacaaccggtggtcaaggagaaggaaaagaaaaagtataatgtgagtaaaatctcccagagtaagggatag

SEQ ID NO: 30854 - DNA, 33 bp, Artificial Sequence
  Description of Artificial Sequence: Synthetic coding sequence
atgagtctggctgatctgaccaagacaaactag

SEQ ID NO: 30855 - DNA, 93 bp, Artificial Sequence
  Description of Artificial Sequence: Synthetic coding sequence
atgagtttggccgacctgaccaagactaacatcgatgaacacttctttggggtagctctcgagaacaaccggcggtcagctgcatgtaaatag

SEQ ID NO: 30856 - DNA, 429 bp, Artificial Sequence
  Description of Artificial Sequence: Synthetic coding sequence
atgtcatttctcaccgtcccttataaactgccagtgagccttagcgttggatcttgtgttattatcaaaggaaccttgatcgattcctccatcaatgagccccagctgcaggtagacttctataccgagatgaatgaagactccgagatcgcctttcatctgagagtgcacctgggccgcagggtcgtgatgaatagccgggagttcggcatatggatgctagaggaaaatctgcattacgtgccatttgaagatgggaagccattcgacctgaggatttacgtctgtctcaatgagtatgaggttaaagtaaacggagaatatatttatgcgtttgtgcatcgtataccaccgagttatgttaaaatgatccaagtatggcgggacgtctccctggattctgtcctggtgaataacggaagaaggtag

SEQ ID NO: 30857 - DNA, 1071 bp, Artificial Sequence
  Description of Artificial Sequence: Synthetic coding sequence
atggctttctctggatctcaggctccatacttaagccctgcagtccccttttctggcacgatccagggcggccttcaggatggatttcagataactgtgaatggggcggtgctgtcttccagtggtacgaggttcgccgttgacttccaaactgggtttagtgggaatgacattgctttccatttcaatccccgatttgaggatggggggtacgtggtctgtaacaccaggcagaaaggtaggtggggaccggaggagagaaagatgcatatgccatttcaaaaaggaatgccttttgatctctgtttcctggtgcagtcctcagatttcaaggtgatggtgaatggaagtctgttcgttcaatatttccatagagtcccgtttcatcgcgtcgacacgatatccgtgaacggaagtgtacagctgagctatatttcattccagaacccccggactgtgcctgtgcagcccgccttttcaacagtaccctttagtcaaccagtttgtttcccgccgcgaccacggggtcgccgccagaaaccaccttcagttcgtccagccaaccccgcccctatcactcaaaccgttatacacactgtgcagtcagcaagcggacaaatgttcagccagaccccggctatcccacccatgatgtatccacatccagcatatcctatgcccttcatcaccacaatcccaggcgggctttatcccagtaaatcgatcattctctcagggactgtgctgccttctgcccagagattccacatcaacctgtgcagcggttctcacattgcgttccatatgaatccccgattcgacgagaatgctgtggtgcgcaatactcagattaataactcctggggttccgaggagagatccctgcctcgaaagatgccttttgttcgggggcagagtttcagcgtgtggatcctgtgcgaagcgcactgtttgaaggtcgctgtcgacggccagcatgtgttcgagtattaccatagattaagaaacttgcccaccatcaataaattggaggttggcggcgatatccagctaactcacgtgcagacttag

SEQ ID NO: 30858 - DNA, 1068 bp, Artificial Sequence
  Description of Artificial Sequence: Synthetic coding sequence
atggctttctcgggctctcaggctccgtacctgtcccctgcggttcctttctctggtactattcagggtgggctgcaggatggttttcagatcaccgtgaacggagccgttctatcgtcttcagggacacgcttcgcagtggatttccagaccggcttctccggaaatgatatcgcttttcatttcaatccccgtttcgaagatggcgggtacgttgtgtgcaatactaggcagaagggcagatggggacctgaagagcgcaaaatgcacatgccattccagaaaggaatgccctttgatctgtgctttcttgttcagtcatcagattttaaagtgatggtaaatgggtcactgtttgttcagtattttcatagagtccccttccacagggttgatacaatatccgtgaacgggagtgtccaattgtcttatattagtttccagaacccacgcactgtgcccgtgcagccagcgttctctaccgtgcccttcagccaaccagtctgcttcccgcccaggccccggggtcgcagacagaagccaccgagcgttagacccgccaatcctgcccctataacacaaactgtgattcacacagtccagtcagcttccggccagatgttttctacccctgccattccacctatgatgtacccccatcccgcctaccctatgccctttatcacgacaatccctgggggcctctacccatcaaagtctataatactgtccggaaccgtactgccgtctgctcagcgtttccatataaatctgtgttctggctcacatattgcatttcatatgaatcctagattcgatgagaatgcggtggtccgcaatacccagattaacaactcatggggctctgaggaacgctcattacccagaaagatgccttttgtgcgcggtcagtcgtttagcgtttggatcctatgtgaagcccattgcttaaaagtagcggtagatggtcagcatgtgtttgaatactatcatagactccgcaacctccctaccatcaacaagctggaagttgggggcgacatacagctaacccatgtgcagacatag

SEQ ID NO: 30859 - DNA, 1071 bp, Artificial Sequence
  Description of Artificial Sequence: Synthetic coding sequence
atggctttttccggatgtcaggccccttatttgtcccccgcggttcccttcagcggcaccatccagggcggcttgcaagacggatttcagatcacagtgaacggtgcagtgttgtcttgctctgggacgagatttgctgtcgacttccaaaccggattctctgggaatgatatcgcctttcattttaacccgaggttcgaggatggaggctatgtcgtctgcaacacgcgacagaaaggaacctggggtccagaagagcgtaagatgcacatgccattccagaaaggaatgccttttgatctctgctttctagtgcaaagctcagacttcaaagtgatggtaaatgggagtttatttgtacaatatttccaccgggtccctttccacagggtagacaccatttctgtgaatgggagtgtgcagttatcctacataagcttccaaaaccccagggctgtgcctgttcagcctgccttctctacagtcccgttctcccaacccgtctgttttccccctcgccctaggggacggagacagaagccgcctagcgtaaggccggccaaccccgctcccatcacccagaccgtcattcacacggttcaatcagcaagtggtcaaatgttttcccagacgcccgccattccccctatgatgtatccccatcctgcctatcctatgcctttcattacaaccatcccggggggcctgtatccatcaaaaagtatcatcctgtccggtaccgtgcttccatctgcacagcgtttccacattaatctgtgttccgggtcgcatattgcctttcacatgaaccctcggttcgacgagaatgcagtcgtccgcaacacccagatcaacaacagttggggctccgaggagagatctctcccccgcaagatgccatttgtgcgaggccaatccttctcggtatggatactctgcgaggcacattgcttgaaggtggcagtcgatggacagcacgtcttcgaatactatcacaggctgcggaatctgccaactattaataagctggaggtcggtggagatattcagctcactcatgtgcaaacctag

SEQ ID NO: 30860 - DNA, 807 bp, Artificial Sequence
  Description of Artificial Sequence: Synthetic coding sequence
atgcacatgcccttccagaaaggtatgccctttgacctttgctttctggttcagtcctctgatttcaaggtgatggtcaatggcagcctgtttgtccaatacttccaccgtgtaccttttcaccgagtggatacgatctcagtgaatggatcagttcagttatcttacattagcttccagaatccccgtgccgttcccgtgcagccagcctttagtactgtgcccttcagtcagcccgtgtgcttccccccacggccacgaggccggcggcagaaacccccttcggtgcgccctgccaaccccgctcccatcacacagaccgtgattcacaccgttcaaagtgcaagtggccagatgtttagccagacaccagcaatccctccaatgatgtacccgcatcctgcctatcccatgcccttcattaccacaattccaggcggattgtatccgtccaagtctataattttatcaggaacagtgttgccatcagcgcagaggtttcacataaacttgtgtagcggttcgcacatagcttttcacatgaatccccggttcgatgaaaacgcagttgtccggaacacccaaatcaataatagctggggcagtgaagagagatcacttccaagaaagatgcccttcgtgcggggacagagttttagcgtctggatcctgtgtgaagcacactgtctgaaggttgccgtggatggacaacacgtgttcgagtactaccaccggctacggaatcttcctacaatcaataaactcgaggtgggtggtgacatccagttgacccatgtccaaacctag

SEQ ID NO: 30861 - DNA, 519 bp, Artificial Sequence
  Description of Artificial Sequence: Synthetic coding sequence
atggccggctccgtggccgactctgacgccgttgtgaaactggatgacgggcatctgaacaactctctgtccagccccgtgcaggcggatgtgtactttccccgcttgatcgttcccttttgtgggcatatcaaagggggcatgcgccccggaaagaaggtgttagtaatgggcatcgtggacttgaatcctgagtcctttgccatcagcctgacttgcggggattccgaggatccaccagctgatgtcgctatcgagctcaaagccgtgtttacggataggcaactgttgcgcaactcctgcatctccggcgagcggggggaggagcagtccgccatcccttacttcccatttattcccgaccaaccatttagagttgagatcctgtgcgagcacccacgatttcgggtctttgtagatgggcaccagctgtttgacttttatcatagaatccagacattgtcagccatagatacgattaaaataaatggggacctccagataacaaaactgggctag

SEQ ID NO: 30862 - DNA, 1497 bp, Artificial Sequence
  Description of Artificial Sequence: Synthetic coding sequence
atgtccactttcggctaccgccgggggctgagtaagtatgaatcaatcgacgaggacgagctgctcgcaagcctctctgccgaggaactgaaggaattagaacgcgagctggaggatatcgagcccgaccggaatcttccagtcggattgaggcagaaatctcttacagaaaaaactcccaccggaactttctctcgcgaagcacttatggcatattgggaaaaagaatcccagaaactgttggagaaagagcgactaggagagtgcggtaaggtggcagaggacaaagaagaaagcgaagaagaggaggactctgacgaggaggaacgaactatagagacagccaaggggatcaacggcacagtaaactacgactcagtaaattctgataattccaaaccgaaaatatttaaaagtcagattgaaaacattaaccttacgaatggatctaatgggcgaaatactgagagccccgcagcaatccacccatgtggaaaccccacagttatcgaggatgccctggacaagatcaaaagcaacgacccggacaccactgaagtgaacctgaacaatattgaaaacataacaacacaaacactgacacgctttgccgaagcgcttaaggataacacagtagtcaaaacattctcacttgcgaatacccacgccgacgattcggccgccatggctatcgccgagatgctgaaggttaatgagcacataaccaacgtcaacgtcgagtccaatttcatcaccggaaagggcattctggccatcatgagagcactgcaacacaatactgtgctcaccgagctgcgatttcacaaccagcgtcatattatgggctcgcaagtggagatggaaatcgtcaagctattgaaagaaaacaccacccttctgcgactggggtaccactttgagctgccgggacctcgcatgagcatgacatccatcctgactcggaacatggacaagcaacgccaaaagagactgcaagaacaaaagcagcaggaagggtatgacggtggcccaaatttgcgcacgaaagtgtggcagaggggaacgccctcaagctccccttatgtctccccaaggcacagcccatggtcatccccaaagctgccaaaaaaggtccaaaccgtccggtctagacctctgtctcccgtcgccacaccacccccacctccccctccgcccctccctgagaaaaagctgatcacaaggaacatcgctgaggtaataaaacagcaagagtctgcccaaagggccctacagaatggacagaagaagaagaaggggaaaaaggtcaagaagcagcccaattcaatcctaaaagagatcaagaattctctcaggtccgtgcaggaaaagaaaatggaggatagctcccgaccctcaacgccacagcgatcggcccatgagaatcttatggaagcaattcgagggtctagtatcaagcagctgaaacgggttgaagtccccgaagctttgagatag

SEQ ID NO: 30863 - DNA, 1524 bp, Artificial Sequence
  Description of Artificial Sequence: Synthetic coding sequence
atgtcaacattcggctacaggagaggactctccaagtatgagtcaattgatgaggacgaactgttggcgtccctgagtgctgaagagttaaaggagctcgagcgtgaactggaggacatcgagccggatagaaatttgcccgtcggattgagacagaaatcccttactgagaagacccctactggtacgttctctcgtgaggccttgatggcctactgggaaaaggaaagccagaagcttctggaaaaagaaaggctgggtgaatgtggcaaggttgcagaggacaaggaggaaaggactattgagacagccaaaggtatcaatggaactgtcaactatgattcagtgaattcagataactccaaacccaaaatttttaagagccaaatcgaaaacatcaacctgaccaacggtagcaacggcagaaacactgagtctcccgcagccattcacccctgcggaaatcctaccgtaatcgaagacgccttagataagatcaagagtaacgatcccgacacaaccgaggtaaatttgaacaacatcgagaatatcaccacacagaccttgacacgcttcgctgaggctctgaaggataatacagtggttaaaacttttagcctagctaacacccacgctgacgactcggcggcaatggcgattgccgagatgctaaaagtgaatgaacatataacaaacgtgaatgtcgagtccaatttcattactggcaagggaatactggcaatcatgcgcgccctgcaacacaatacggtattgacagaattgaggtttcacaaccagaggcacatcatgggcagccaggtggagatggagatcgtgaaactactgaaagagaatactacgctgttgcggctggggtatcactttgaactgccaggtccgagaatgtcaatgacgtccatcctaactagaaatatggacaagcaacggcaaaagagactgcaggagcagaaacagcaagagggttacgatggaggcccaaatctaaggaccaaggtgtggcagcggggaaccccatcatccagcccctacgttagtcctagacacagcccttggtcttcacctaagctcccaaaaaaagttcaaacagtgaggtcacgacctctatccccagtcgcaacccccccccccccgcccccgccccctccccctccgcctcccagttcccagcggctaccccctcctccacctcccccccctcctccattgccagagaaaaaactaatcacccgcaacattgctgaggtcatcaaacagcaggagtccgcccagcgcgcactgcagaacgggcagaagaagaaaaaggggaagaaagttaaaaagcagcccaactccatcctgaaagaaataaagaatagcttaaggtccgtgcaagagaaaaagatggaggactcttctcgcccctccacccctcagaggagcgctcacgaaaacttgatggaagccataagagggagcagtatcaaacagttgaaacgcgtggaggtacccgaggccctccgctag

SEQ ID NO: 30864 - DNA, 1644 bp, Artificial Sequence
  Description of Artificial Sequence: Synthetic coding sequence
atgtccacgttcgggtatcggagaggtttgtcaaagtacgagtctatcgacgaggacgaactgctggcctctctctccgccgaagaacttaaagagctagaaagagaactggaggatatagagcctgaccggaatctgccagttggtctcagacagaaatccttgactgaaaagacgcctaccggtacttttagtcgcgaggccctcatggcctactgggagaaggagtcccagaagctgctcgagaaggagcggctgggggagtgcggaaaagtggccgaggacaaggaagagagtgaggaggagcttatcttcaccgagagcaacagtgaggtgtctgaggaagtatatacagaagaagaagaggaagagtcccaggaagaagaggaggaagaagactcagacgaggaggagcgtaccatcgagaccgccaaaggcatcaatgggacagtgaactatgatagcgtgaactctgacaattccaagcctaaaatatttaaatctcagatcgagaacattaatctgacaaatggaagcaatggcagaaacacagaatcgcccgcagctattcacccttgtgggaacccaacggtgatcgaagatgccctcgacaagattaagtcaaacgaccccgatacgacagaagttaacctgaacaacatcgagaacatcacaacacagacccttacccggttcgccgaggctctgaaggacaacaccgttgtgaaaacattttcgcttgctaacacgcatgccgatgattcagccgccatggcaatcgcggagatgttgaaggtcaatgaacatattaccaacgtcaacgtggagtctaattttatcacaggaaagggcatactggcaattatgcgggccctccagcacaacaccgtgttaacggagctgcgctttcacaatcagcgacatatcatgggttcccaggttgaaatggagatagtcaaactcctgaaggaaaataccaccctgctaaggttaggctatcacttcgagctccctggaccaagaatgagcatgacttccatactgacaaggaacatggacaaacagcggcagaagcgtcttcaggagcagaaacagcaagaaggatacgatgggggaccaaacttgagaactaaagtctggcaacggggtactccctcttcatctccatatgtgtcgccaaggcatagcccttggagtagtccaaagcttccgaagaaggttcagacggtgcggtcaagacccctctcacctgtcgccactcctccaccacctccacctccacccccaccaccacctccttccagccaaagattgccacctcccccccctccccctccaccaccccttcccgaaaagaagttaattaccaggaacattgcagaggtcataaaacagcaggaaagcgcccaacgtgccctacagaatgggcagaagaagaagaagggcaagaaggtgaagaaacagccaaattcgattttgaaagaaattaaaaactcgctcagatccgtccaagagaaaaagatggaagattcatctcggcctagcaccccgcagcgcagcgctcacgagaaccttatggaggctattcgcggatccagcataaaacaattgaagcgggtcgaagtgcctgaggctctccgatag

SEQ ID NO: 30865 - DNA, 2208 bp, Artificial Sequence
  Description of Artificial Sequence: Synthetic coding sequence
atgctgcgacttctgcgaccccttctattgctacttcttctgccaccacccggatctcctgagcctccgggcctgacccagttgagtccgggtgctcccccccaagcgccagatctgctctatgccgatggactgagagcctatgccgctggcgcctgggcccccgcggtcgccctactgagagaagccctccgaagccaggccgcactggggagagtgagactggattgcggcgcctcatgcgccgccgacccaggagccgcgttgcctgccgtgttactcggggcacctgaacccgattcaggacccggaccaacacaagggagctgggaacggcagctgctccgggccgccctacggcgggctgactgcctgacacagtgtgcagccaggaggctgggccctggcggcgctgcaagaagggtgggaagcgccctgcgcgacgcttttcgcagacgagaaccttacaactatctccaaagagcttactatcaattgaaaaagcttgacctcgccgccgccgctgcccacacttttttcgtcgccaaccccatgcacctccagatgcgtgaggacatggccaagtaccgccgcatgtctggagtgcggccgcagtccttcagagacctggaaacacccccccactgggcagcctatgacacgggccttgagctgttaggcagacaggaggcaggactggcactcccaagactcgaagaggccctgcagggcagcctggcgcaaatggagagctgtcgggccgattgcgaggggccagaagaacagcagggcgctgaagaagaagaggatggggctgccagtcagggaggtctgtacgaggccattgcaggacactggatccaggtactacaatgtcgacagaggtgtgtgggggaaactgcaacccggccgggccgcagttttcctgtcccagatttcctgcctaaccaactccgccgactacatgaggcccatgcccaggtgggaaatctctcccaggcaatcgaaaatgtgctcagcgtgcttctattttacccggaggacgaggccgctaagcgcgccttgaaccaatatcaggcccagctgggcgagccgcggcctgggctcggtcccagggaagatatccaaaggttcatactgcgctccctgggggagaagcggcaactctattatgctatggagcacctgggtacctccttcaaagatcctgacccatggaccccggctgcactgatccctgaagcccttagggagaaacttcgcgaagatcaagagaaaagaccatgggaccacgagccagtgaagcctaaaccattgacgtactggaaagatgtcttgttgttggaaggagtgactctgacacaagactccagacagcttaacggctccgagagggccgtgctggatggcctgctaactcctgcagaatgtggtgtgctgctgcaacttgctaaagatgcagccggcgcaggggctcgctccgggtatagaggccgcagatcacctcacaccccccatgagcgattcgaggggttgacagttctcaaagctgcacaactggcacgcgccggaaccgtaggctcccagggcgctaaactgctgctggaggtgagcgagcgtgtgcggactctgacacaggcatacttctccccagagagacccttgcatctatcatttacacacctggtatgcaggtccgcaattgagggtgaacaagagcagcggatggacttgtcgcacccggtccacgcggacaactgcgtgctggatcccgatacaggggagtgttggagggagccaccggcctatacatacagggactacagcgggctgctgtacctgaacgacgattttcagggcggtgatctttttttcacagagcctaacgccctgacagtgactgcccgagtcagacctcgttgcggaagactcgtggcgttcagcagcggcgtggagaacccacacggtgtatgggccgtcacccgggggcgtagatgcgccctggctctgtggcacacatgggcaccagagcatagggagcaggagtggatagaagctaaggagctgctccaggagtcccaggaagaggaggaagaagaggaggaggagatgccttctaaagatccctcacccgaacctccgagccgaagacatcaacgtgtccaagacaagactggacgcgcccctcgggtgagggaagaactgtag

SEQ ID NO: 30866 - DNA, 3015 bp, Artificial Sequence
  Description of Artificial Sequence: Synthetic coding sequence
atgcatggctcatgctgcctgggcggcggccaacccttaagtgtctttgctagcctccacatgggccccgagggtttggccctgaaggccgggcgaggctggtgcccaacttttcaatcattccctgagcccacacccagttatggggccccaggcgtagagttcatgggtttacatcaggaaaataatgcggttacccagatccatttgttacccgggcagtgccagctggtcactctcttagatgataattcactgcacttatggagtctgaaggtgaagggcggcgcttccgaattgcaggaggacgagagtttcactctcagagggcctcccggtgctgctccctccgcgactcaaatcacagtggtattaccccacagctcttgcgaattgctgtacttagggaccgagagcggtaatgtgtttgtagtccagcttcccgcgtttcgggccttggaagatcgtacaataagctccgatgctgttttacaaaggctccccgaagaggccagacaccggagggtgttcgaaatggtcgaggccctgcaagagcaccctagagacccaaatcagatccttatcggctattcacgcggcttggtggtcatttgggacctgcaaggctcacgcgttctctaccactttctgagctcacaacaactagaaaacatctggtggcagcgggacggaagactcttggtatcttgccactcagatggctcttattgccaatggcctgtcagcagtgaggcccagcagcctgaacctttgcggtcgttggtaccatacggtcctttcccatgcaaggcaatcacacggatactgtggctgacaacacgccaaggtctgcccttcacaattttccagggtgggatgcccagggcctcctatggcgaccgacattgcataagcgtaattcacgacggtcagcaaactgcctttgacttcacatctcgggttatcgggttcacggtactgactgaggctgatccagcagcaacatttgatgatccttatgccctcgtggtgctcgccgaagaggagctcgttgtgatcgacctccagaccgctggctggcccccggtgcagctgccctatctcgcctctctccactgttccgccatcacgtgttctcaccatgtgtctaatatacccttaaaactgtgggaacgcattatcgctgctggatcgcgtcagaacgcacatttttccacaatggaatggcccatagacggcggaacatccttgacccccgcccccccccagagggacttattactgacaggccacgaggatggtaccgtgcggttctgggacgcctctggagtgtgcctacggttactttacaaattgagcaccgtccgcgtattcttgaccgacactgatcccaacgaaaatttctccgctcaaggtgaggacgaatggcctcccttaagaaaggtggggtcttttgatccatactccgatgacccccgcctcggcattcagaagattttcctctgtaagtatagcggctacctagctgttgctgggacagccggtcaggtgttggtactggagttgaacgatgaagcagcagaacaagcggtggaacaagtggaggccgatcttctccaggaccaagagggatacagatggaagggccacgagcggttagcagcccggtcgggtcctgttcggttcgaacctggctttcagccatttgtcttagtgcagtgccagccaccagctgtagtgacatcattggcacttcacagtgaatggagattggttgctttcggaaccagtcatggtttcggactattcgatcatcaacagcgaagacaggtgttcgtaaagtgcactctccatccctccgatcagctagcccttgaggggccactgtcgagggtgaaaagccttaagaagagtctgcgacagagctttaggagaatgaggaggtctcgtgtttcctcacgcaagcgccaccccgcagggcctcccggcgaggcacaggagggttccgctaaagccgagcgacccggactgcagaatatggaattggctccagtccagaggaagattgaggctcggagcgccgaagactctttcaccggcttcgtccgcactctgtatttcgctgatacctatcttaaggattcaagcagacactgtccttccttgtgggcaggcacgaacggcgggactatttacgcattcagtcttcgcgtgccacccgcagagaggaggatggacgagcctgtgagggctgagcaggctaaggagattcaattgatgcatcgcgccccagtggtgggtatcctggttctcgatggccactccgttcccctgcctgagcctctggaggtggcccacgatctgagtaagtccccggatatgcaagggagccaccagctcctcgttgtgtctgaagaacagttcaaagtcttcacgttgcctaaggtgagtgctaaattaaaattgaagttgacagccctggagggctcccgggtaaggcgagtgagcgtggctcacttcggaagccggagggccgaagattacggcgaacatcatctggccgtgttaacaaacctcggtgatatacaggtagtgagtttgcccttgctgaagccacaggttaggtattcatgtattagacgggaggatgtgagtggtattgcctcatgtgtatttacaaaatatggtcaggggttctacctcatctcgccctccgaattcgagaggttctcgctatctacaaaatggctcgtcgagccaaggtgtctcgtggacagcgcagaaacaaaaaaccatcgcccaggcaacggggcggggccaaaaaaggcaccatcccgggccagaaattccggaactcagagtgacggtgaagagaaacagcctggcttagtcatggagagggcacttctgtctgatgaacgcgccgcaacaggagtgcatatcgaacctccatggggtgctgcctctgcaatggcagaacaatcagaatggctgagcgttcaggcagcgcgttag

SEQ ID NO: 30867 - DNA, 2061 bp, Artificial Sequence
  Description of Artificial Sequence: Synthetic coding sequence
atgggccctaggagcagagagagaagagccggggcagtacaaaacactaacgacagttcagcactatcaaaacgatcacttgccgctagagggtatgtccaggacccattcgccgccctcttggttccaggagccgctaggagagcacccttaattcacaggggctattacgtgcgtgcacgggccgtaaggcactgtgtcagagcatttctggagcagattggcgcgccgcaggctgctctcagggctcagattctgtccctgggagccggctttgattctctttacttcagattaaagacggccgggcgactggcccgcgccgccgtgtgggaagtggactttcccgacgtcgctagaaggaaagccgaacgaataggagagacaccagaattgtgcgcactaaccggtcctttcgagaggggtgagccggctagtgccctgtgtttcgagagcgcagactattgcattttgggcctcgatctccggcagttgcagagagttgaagaggcactcggagctgcaggactggatgcggcctcaccgacgttactgctggctgaagcagtcctcacctacctggagcctgagtccgcagctgcactgatagcctgggcagctcagaggtttcctaacgccctcttcgtggtgtatgagcaaatgcgcccacaggacgccttcggacaattcatgttgcagcatttcagacagctcaacagtccgctacacggcctggaacgtttcccggatgtagaggcccaacggaggagattcctccaggctggctggactgcttgtggcgcggtggatatgaacgagttttaccattgcttcctgccagcagaggagagaaggagagtagaaaacatcgaacctttcgacgagttcgaggaatggcatctgaagtgcgcccactacttcatcctcgctgcttcacggggagatacactgagccatactctggtgttcccttcatccgaggcctttcctcgagtgaatccagcgtccccctcgggtgtctttcccgcgtccgttgtgtctagcgaaggtcaggtgcccaacctgaaacggtacggacatgcctccgtgttcctgagccctgatgtaatactaagcgctggggggttcggagaacaggaggggaggcattgtcgcgtttctcagttccacttactgtctagggactgcgactccgaatggaaaggatcccagatcggctcttgtggaaccggcgtgcaatgggatggaagactgtatcacaccatgacgcgcctgagcgagtccagggttttggttctgggtggcaggttgagccccgtgtctccggccctgggagttttacagctgcactttttcaagtcggaagacaataacacagaggacctcaaagtgacaataaccaaagccgggcgcaaggacgacagtactctttgctgttggcgacacagcaccacagaagtaagctgtcagaaccaagaatacttattcgtgtatggtggccgctctgtggtggagccagttttgagcgactggcacttccttcatgtcgggaccatggcctgggtgcggatccccgtggagggcgaggtcccagaagccaggcattctcactcagcatgtacatggcaggggggtgctcttatcgctggagggctgggcgcctcagaagaacccctcaattctgtactgtttctgcgccccattagttgcgggttcctctgggagtctgtggatatccagcctcccatcactcctagatactcacatactgcccacgtgctcaatggcaagctcctgctggtgggaggaatctggatccattcatcatcctttcctggcgtgacagttatcaacctgaccacgggcctctcatcggaataccaaatcgataccacctatgtaccatggccattaatgctgcataaccataccagtatactcctccccgaagagcagcaactgctactgttaggtggggggggcaattgcttcagctttggcacttactttaacccccacaccgtgaccctggatctctcttctctctctgcaggccagtag

SEQ ID NO: 30868 - DNA, 798 bp, Artificial Sequence
  Description of Artificial Sequence: Synthetic coding sequence
atgaccaggctatccgaaagtcgcgtgcttgtgttggggggacggctgtcccctgtttccccggcactcggagtcctgcagttacatttttttaagagtgaggacaataatacagaggacctgaaggtgaccataaccaaagctgggcgaaaagacgacagcacactgtgctgctggagacattcaactacagaggtcagctgtcaaaatcaggagtacctttttgtgtatggggggagatccgtagtagagccagtactgagtgactggcactttttgcacgtgggtactatggcctgggtccgcattcctgtggagggggaggttcctgaagcaagacacagccactctgcttgtacatggcaggggggtgcgctcatcgccggagggctgggtgcatctgaagagcctttaaattcagtgcttttcctgagacccatcagctgtggatttctgtgggagagcgtggacattcagccccccatcactcctcgctatagtcacaccgctcacgtcttgaacgggaaactgttgcttgtgggcgggatctggatccacagtagcagtttccccggggtcaccgtcattaatttgacaactggtctttcctccgagtaccaaatcgacacaacgtacgtaccatggcctctgatgttgcataaccataccagcatattacttcccgaggaacaacaactgctgttgctgggggggggcggcaattgctttagttttggcacgtattttaatccccacaccgtcacattggatctgtccagtttaagtgccgggcaatag

SEQ ID NO: 30869 - DNA, 399 bp, Artificial Sequence
  Description of Artificial Sequence: Synthetic coding sequence
atggatcatcacatcccgatgcacgccctccccgaagaaatccaaaagatgctcccagaagagaaagtctgtaaatactgcggggtcagttacctgatattgcacgagttcaaagcaatggaggagaaagtgaaagctatggaaaaagagatgaaattctaccaagggtctgtcgatcgcgaaaagaggctccaggaaaagcttcacagtctcagtcaggagttggaacagtacaagattgataacaagtctaagacagagcggatatacgatgtgggcatgcagctgaagagtcagcagaacgagttccagaaagtaaaaaagcaattgtctcatcttcaggacgagctcaagatcaaataccgccagtcttatatttttcgcttgtgtttctgctag

SEQ ID NO: 30870 - DNA, 879 bp, Artificial Sequence
  Description of Artificial Sequence: Synthetic coding sequence
atgggcattgccgaaagtacacccgacgagcttcctagcgacgccgaagaacagctgcggagcggggaccagcaacttgagctgtctgggagacggctgagacgcctgccttcagccgtttgcgccctctcaagactgcagaaattgtatgttagtggaaccggactgcgagaacttcccgaggaaattgaagagctacgcgaactccgaattctcgctcttgacttcaacaaactcgaaagactgcctgacggcttatgtcgcctgcccagacttaccaggctttatctcggtggcaacaggctgttggcccttcccgcagactttgctcaactgcaatctctgcgctgtctgtggattgaaggtaattttctcagacgctttcccagacccttactcagattggtggctctgcagtctcttcagatgggagacaataggcttcgcgctctgcctgccgagctgccaaggatgacaggcctcaggggtctgtggctgtatggtaatagattcgaagagttcccgccagcactgctgaggatgggacgccttcatattctggacctcgacagaaataggctgggaggcttccccgatctgcatcccctgagagccctcagggtctttagctatgaccataatccagtgactggccccccaagggttgccgacaccgtgttcctcgtgggtgaaggagctgtagaacgcatggccgaaagggacgagcctaccccccgcccccccccgcgaagacccgcccgcgccttcgaggatgaagaagaagaggaccttctcattggcggcgcaggctcacgggccctgggggcacctgggggaagttttcgggcccttgaggccgcccccggactgggtacctag

SEQ ID NO: 30871 - DNA, 1482 bp, Artificial Sequence
  Description of Artificial Sequence: Synthetic coding sequence
atgcacacgctggttttcctgtctacacgacaggtccttcagtgccagccagcggcctgtcaggccctccccttactgcctcgtgagcttttcccccttctttttaaggttgccttcatggacaagaagactgttgtgctccgggagctagtacacacttggcccttcccactgctcagtttccaacagctgctgcaggagtgcgcccattgttcgagggccctcctgcaggaacgccctagtacagaaagcatgcaggcggtgatccttggtctcactgccaggctccacacatcagagccaggggcttcaacccagccactttgtcggaaacacgccctgcgggttctcgacatgactggcttgctggacgacggcgtggagcaagaccctggcacaatgagtatgtgggactgcactgcagccgttgcaagaacctgcattgctcagcagcagggcggggctgctgagcccggtccagcccccatcccagtcgaagtacgggttgacctcagagtaaatcgcgcctcatatgcctttctccgagaagcccttcgttcctcagtcggatctccactgagactctgttgcagagacctcagggcagaagatttgccaatgaggaacacagtggcgcttcttcagctgctcgatgcagggtgtctccgtcgagttgaccttcggtttaacaacctgggactgaggggactgtccgtgatcataccacatgtcgccagatttcagcacctggccagcctccgactgcactacgttcacggcgattcacgccagccctccgtagatggggaagataattttcggtacttcctggcgcagatgggtagatttacctgcctcagagagctatctatgggctccagcctgctaagcggacgccttgatcagctcctgagtactcttcaatctcccttggaatctttggagctcgcattttgtgccctgcttcccgaagacctccggttcctggctagatccccacacgccgcccacctgaagaaactggatctctccggcaatgacctttctggatcgcagctggccccattccagggactgctgcaggcatctgccgccacactgctccatcttgagctcacggaatgccaactggccgacactcagcttctggccacactgcccattttgactcaatgtgcctccctgagatacctgggtctctatgggaaccccctcagcatggcgggcctcaaggagcttctgagggactctgtggcacaagcggagcttcggacagtggtgcacccgttccccgtagactgttacgagggtctaccttggccaccaccagcctccgttctcttagaggcctccataaacgaagagaagtttgctagagtagaagcggagctgcaccaacttttattggctagcggccgggctcacgtcctgtggacgactgatatttacgggagattggccgccgattactttagcttatag

SEQ ID NO: 30872 - DNA, 1545 bp, Artificial Sequence
  Description of Artificial Sequence: Synthetic coding sequence
atggacactatgcggtctctgaggtttatctcggcggaagcactggtgagtcatcctcaggtagcccggcagagtcttgatagcgtagcccacaatttgtaccctctactgtttaaagcctcttatctactggagcaggccgaagtaacccgggcagttctgggacggtggccactggaggagttccgcctcggcgcactcctcggccccggcgctgatcaccctcaggaccttagagaccgtacatgcagggcttgcctggaagccctggtgagaggactcgccgaccacgtcttgcaggatcggagccgcaggagactgcgagtcgcagacttgactggaattcgtgatgtccaagtacaaagatgcccctgtgggcgcgccctcggtcggtggggccgtacccagttgctcgcaaggacctgctgcgagcttcaagccgagcccctggccgccggccgacccgttgaagttctagccgatctgttcgtgactgagggcaatttcgaagccgtggtccaggcgctgaggcccgcgggccccgcgcccttacgagtgcattgccctagctttcgggccgatagtctcagccctagtcagctgttgcatgtgttgcggcttgctggtccaggggccctccgaaagctggaggtcgtgcacaatgtccggctgcatgcagggcacgtgcaacagctcctggcccaagtagggttcccccgtttggcctctctcactctgccaacgaaggcgtttgacgcaccacctacatacgcaagcaccccggacggtgaggaccctctacttgccagcatagcgcgggagctgagtaaaatggcccagctgacggaactgagcgtcgcctttagtacacttactggaaaaatcccaacactgttggggcccctgcagacacctctcagggtattagaccttgcaaactgtgccctcaaccacactgatatggcctttctcgccgattgcgctcacgccgcccacctcgaagtgctagacctgagcggacacaacttggtgagtctttatcccagtaccttcttccggctcctttctcaagccagtaggacgctgaggatcctgaccctggaagagtgtggaatcgtggattcccacgtgggcatgctgatcctcgggctcagcccgtgtcaccgactcagacagctaaaatttcttggcaatcctctctccgccagggccttgcgcagacttttcacagctctgtgtgaacttcctgagctgagatgcattgaattccctgttcccaaggactgttaccctgagggtgccgcctatcctcaggatgagctggctatgtccaaattcaaccagcagaagtacgacgaaatagccgaagagcttcgggctgtgctgcttagggcagacagagaagatattcaggtaagtactcccctgttcgggtcattcgaccctgacattcaagaaacatctaacgagttgggtgcctttttgctacaagccttcaagaccgccctggagaacttttctcgggctctgaaacagattgaatag

SEQ ID NO: 30873 - DNA, 1278 bp, Artificial Sequence
  Description of Artificial Sequence: Synthetic coding sequence
atggccatcaagaagcagaagcggtgcaggaagatccggcccgtctctgcgtttatcagcggcagccctcaggatatggagtcgcagttgggaaatttggggataccccctgggtggttctccggtctcgggggctcgcagcctaccgcctccggctcctgggagggcttgagtgagctgcccacccatggctacaaactccggcatcagacccagggtagacccaggcctccaagaacaacaccaccagggcctggaaggccatccatgcctgcccccgggacacggcaggagaacggcatggccacaaggctggacgagggcttagaagattttttctctcggagggtacttgaagagtcaagctcatatccccgcacgcttcgaacagttcggcccggattatcagaagccccactaccacctctgcagaagaagaggcgaaggggtctgttccatttcagacggccacgaagtttcaaaggcgacagaggaccaggatctccgactacaggcctgctcttgcctcctcccccaccacctcctcctacacaggagagcccgcccagcccggacccaccaagcctgggtaataattcttctccttgctggagtccagaggaggagagcagcttgctccctggtttcggaggagggcgtggcccaagcttcaggaggaaaatgggccccggacccgaccaggaaggttccacccaagcctggcagaagagacggagctcagacgatgccggaccaggctcttggaaacctcctcccccacctcagagtacaaagccgagtttttccgccatgagaagagctgaggctacatggcacattgcagaagagagtgcccctaatcatagctgtcagagtccttcccccgcttcacaggacggcgaggaagagaaagaggggactctcttccccgaacggacgcttcccgcgcggaatgcaaagcttcaagatcccgccctggcaccctggcctcccaagcccgttgccgtgccccgaggccggcagccgccccaagaaccaggggtgagggaggaggcagaggcaggagacgccgcacccggggtgaataaacctaggctacgattgtcgtcacagcaggaccaagaagagcccgaggtgcagggtccacccgaccctggtcgccgaaccgcacctctgaagcccaaaaggaccagaagagctcagtcatgcgacaagctggagccagatcgacgtaggccaccagatcccactggtaccagtgaaccaggcacagactag

SEQ ID NO: 30874 - DNA, 4119 bp, Artificial Sequence
  Description of Artificial Sequence: Synthetic coding sequence
atggccaaaccttcggtagaactaacgcgggagttgcaggattctatcaggcgatgtctgtctcagggcgccgtgcttcagcagcaccacgtgaaactcgaaacaaagccgaaaaaattcgaggatcgagtactggcactgacatcatggcggttgcacctgttcttgttaaaggtgccagccaaggtcgaatctagtttcaacgtgctcgagatccgcgcatttaacactctttcacagaatcagattctagtagagacagaacgcggtatggtttccatgagactgcctagtgctgaatctgtggatcaagtgaccagacacgtgtcgagcgcgctttccaaggtctgtcctggtcccgggtgtctcatcagacgtgggaacgccgacaccccggagggaccaagggacacttctcccaattccgaaacctctacttcaacaactcatagcgtgtgcggggggttcagcgagacgtacgccgccctgtgcgattacaacggcctgcactgcagagaggaggtgcaatgggacgtcgataccatttatcatgctgaggacaaccgtgaattcaacctccttgacttctcacatcttgaaagccgggatttagcgctgatggtggctgcattggcctacaaccagtggtttaccaaactgtactgcaaagatttgcgactggggtctgaagtgttggagcaggttttgcataccctgtccaagagcgggagtcttgaggagcttgttctggacaatgccggtctgaaaacagactttgtccagaagcttgccggggtgttcggcgagaatggctcatgtgtactacacgcgctaaccttatcacacaacccaatcgaggataaaggcttcctctccctctcccaacagctgctgtgcttcccttccggattaacgaaactctgtctcgccaagactgcgatctcacctaggggcctgcaggccctcggccaaacatttggcgccaacccggcttttgcttcatcattgaggtatctcgacctcagtaagaaccccggtttgctggctactgacgaggcgaacgctctctattccttcctggcccaacccaacgccttagtccatctggatctatcggggactgattgcgtaatcgatctgctgttgggcgcactattgcacggctgttgctcccatttgacctacctcaatctcgctcgtaattcctgtagccatagaaagggaagagaggctcccccggcgttcaagcagttcttttcctccgcgtatacactgagccatgttaacctgagcgccaccaaactgccattggaggccttacgggccttactccaggggctgagtttaaattcccacctgtctgatctgcatctcgacctttctagctgcgagcttaggtcagcgggtgctcaggcactgcaggaacagttaggggcagtgacctgcgtcggcagtcttgatctgagcgataatggcttcgattctgacctgctgacactcgtccctgccctgggtaaaaataaaagtctcaagcacctgtttctagggaaaaacttcaatgttaaagccaaaacgcttgaggaaatcctgcacaagctggtccagctgatccaagaggaggattgctccctccagagcttatctgtggctgactcacgactcaagttacggaccagcattttgataaatgcgctgggctcaaatacctgcctggccaaagttgatctttcaggaaacggcatggaggacatcggtgcaaagatgctgtccaaggctctccagatcaacagctcattacgcaccatcctctgggatcgcaacaatacatccgcgctggggttcctagacatagccagagctctggaaagtaaccacactctgaggtttatgagcttccccgtctccgacatttcccaggcttaccggtctgctcctgagcgaaccgaagatgtgtggcagaagatccagtggtgtctggtgcggaataatcactcacagacttgcccacaggaacaggccttccgtctccagcagggcttggttacaagttctgcagagcagatgttacagcggctgtgcggccgcgtccaagaggaggtgcgagcgcttcggctctgccccctggaaccagtgcaggatgagctcctgtacgcaagggatctgatcaaagatgccaagaattctagggctctttttccaagcctatatgaactgggacacgtgctggccaacgatgggcctgttcgacagcgactggaatcggttgcgtctgaggtgagcaaggcggttgacaaggaactccaagtcatcctggagtccatggtaagcttaacccaggaactgtgccctgtggccatgcgcgtcgctgaaggtcataataagatgctgagtaatgtggctgagcgcgtcacagtgccaagaaattttataaggggggctctcctagaacaggcgggccaggatatccagaacaagcttgatgaggtcaagctgtctgtcgtgacatacttgacgagcagtattgtagacgagattctgcaggaactgtatcattctcacaagtctctggctcggcacctgacgcaactgcggactctgagtgacccaccagggtgccctggccagggccaggacttgagctccagaggcagggggagaaaccatgaccacgaggagaccaccgatgacgagctgggcactaacatcgacaccatggcaatcaaaaagcagaagagatgcaggaagattaggccagtgtccgctttcatttcggggagcccccaggacatggaaagtcaattgggcaatctgggtattcctccagggtggtttagcggcctaggtggtagtcagcccactgcttctggttcatgggaaggcctgtccgagctgccgactcacgggtacaaactcaggcaccagacccagggtagaccacgtccaccgaggaccaccccacctggaccgggccgccccagcatgccggcgccaggaacccggcaagagaacggaatggctacaagactagatgagggactggaagacttcttttcaaggcgcgtgcttgaggagagttccagctatcctcgcactctgagaacagtacgacccgggctctctgaagcgcccctgcccccactgcagaaaaagcggcgccgcggactcttccatttccggcggcctcggtcctttaaaggcgatagaggtcctggatcccctaccaccggcctgctcctgccgccaccaccgccgccgcctcctacacaagagagtcccccaagtcccgatcccccatctctgggcaacaattcctcaccatgctggtcccctgaggaagagagttccctgttaccagggtttggcggtggaagagggccatccttcaggcggaaaatgggaacagaaggatcagaacctggggagggagggcccgcccccggtaccgcccaacagccccgcgtacatggagtagcactcccagggctcgaaagggctaaaggctggtccttcgacgggaagcgggagggccccggccctgatcaagagggaagcacacaagcttggcagaagaggcggtcttctgacgacgccggccctggcagctggaagccaccacctcctcctcagagtactaagccttcattttctgcaatgcggagagccgaagctacgtggcacattgcagaggagagtgcgcctaatcactcctgtcaatctccttcacctgccagccaggatggggaagaggagaaagagggaaccctgtttcccgagcgaactctccctgcacgaaatgccaagctgcaagatccagccttagccccttggccgcccaagcccgtcgcggtgccacgtgggagacagcctcctcaggagcctggggtgagggaggaagccgaagctggagacgccgcccctggcgtgaacaaacctcgtctccgactctcctcccagcaagaccaggaggagccagaggtgcagggccctcctgacccagggagacgcactgcgccattgaagccaaagcgtactcgcagagcccagtcttgcgacaaacttgagccagacagacgtcgtccaccagacccaaccggcaccagcgaacctgggaccgactag

SEQ ID NO: 30875 - DNA, 555 bp, Artificial Sequence
  Description of Artificial Sequence: Synthetic coding sequence
atgctgaagaaaatgggcgaagctgtagcccgggtagcaaggaaggtgaacgagaccgtggaaagtggttcagatacactcgatctggccgaatgcaaactagtgtcattcccaatcggaatctacaaagttctcagaaatgtcagtgggcagattcatctaatcacactggctaataacgagctcaaatctcttacttccaagttcatgactaccttctcacaactgagagaactgcacctggagggaaacttcctacatagactcccatctgaagtttctgctctgcagcacttgaaagcaattgacctgagccgcaatcagttccaggacttcccggagcagctgactgccctacctgcactggagacaatcaaccttgaggagaacgagatcgtggatgtgcctgtggaaaagctggcagccatgcccgcgctcagaagcataaatcttcgctttaatccgctgaacgcagaagtccgtgtaattgcacctcccttgattaagttcgacatgctgatgtccccggaaggcgccagagccccgctgccttag

SEQ ID NO: 30876 - DNA, 387 bp, Artificial Sequence
  Description of Artificial Sequence: Synthetic coding sequence
atgttaaagaagatgggtgaggcagtggcaagggtggctagaaaagtgaacgagactgtcgagagtggaagcgacacattagacttagccgagtgcaaactggtctcatttcccattggcatctataaggtgcttcgcaacgtctctggccagatccacctgattacactggctaataatgaattgaaaagtctaactagtaaatttatgactaccttctcacaactgcgtgacgttcccgtcgaaaaactggctgccatgccagccctccggtccattaacctccgcttcaacccactaaacgcggaagtacgagtaattgcgccaccgttaatcaagttcgacatgctgatgagcccagagggggcccgggcacctctcccttag

SEQ ID NO: 30877 - DNA, 405 bp, Artificial Sequence
  Description of Artificial Sequence: Synthetic coding sequence
atgttaaagaagatgggagaggcggttgcaagggtggctaggaaagtcaacgaaactgtagaatctggatccgacacactggaacttcaccttgagggaaatttccttcacagactgccctccgaggttagcgccctgcaacatctaaaggccatagatcttagcaggaaccagttccaggacttcccagaacagcttactgcccttccagctttggaaaccatcaacctggaggagaacgagatcgtagatgtaccggtggagaagttggccgcaatgcccgccctcagatccatcaacttacgattcaaccctctcaatgccgaggtgcgcgtcattgcccctccgttgataaagttcgatatgctgatgtcaccggaaggcgcgcgggctcccctcccgtag

SEQ ID NO: 30878 - DNA, 555 bp, Artificial Sequence
  Description of Artificial Sequence: Synthetic coding sequence
atgctgaagaagatgggtgaagcggtcgccagggtggcccgtaaagtgaatgaaaccgtggagtccggaagcgataccctcgatctcgctgagtgtaagctcgtcagttttcctataggtatctacaaggtcttgcggaacgtatccggacagatccacctcatcacattggctaataatgagctgaaatcattgacttcgaagttcatgactactttcagtcagctgagggagctccatttggaaggaaactttctgcacagattgccgtcagaggtatctgctctacaacaccttaaggctatcgacctttcgaggaaccaattccaggactttcccgaacaattgaccgccctgccggcgcttgaaacaattaacctggaagagaacgagattgtggatgtcccagtcgaaaaattagccgccatgcccgccctgagaagtatcaatctccgcttcaacccactgaacgcagaggtccgtgtcatcgcacccccactgattaagttcgacatgctgatgtctccggaaggtgcccgtgcccctctgccctag

SEQ ID NO: 30879 - DNA, 387 bp, Artificial Sequence
  Description of Artificial Sequence: Synthetic coding sequence
atgttaaagaagatgggagaggccgtcgcacgggtcgctagaaaagtgaacgaaacagtagaatccggaagtgatacccttgatctcgctgagtgcaaacttgttagttttcccattggtatttacaaagtgctgcgtaacgtttccggccagatccatctgattacactcgcaaacaatgagctgaagtcactcacatctaagtttatgaccactttcagccaactgcgtgatgtgccagttgagaaattagccgctatgcccgctctcaggtctataaatctgcggtttaaccctttgaacgccgaggtaagggttattgcacctccgcttataaagttcgacatgctcatgagtcctgaaggtgctagagcaccgttgccctag

SEQ ID NO: 30880 - DNA, 405 bp, Artificial Sequence
  Description of Artificial Sequence: Synthetic coding sequence
atgcttaaaaagatgggtgaggccgtagccagggttgcccggaaggtaaacgagactgtcgaatctggctctgatactctggagctgcacctagaaggcaactttctccatcgtctgcccagcgaggtttccgccttacagcatctgaaagccatcgacctgtcaaggaaccagtttcaggattttcctgaacagctgacagctctgcccgccctggagacaatcaacttggaagagaatgagatcgtggatgtcccagtggagaaactggctgccatgccagcccttagatcgattaacctcaggtttaacccgctcaacgcagaggtccgagttatcgctcctcctctaattaaattcgacatgctgatgtcccccgagggcgccagagccccactcccgtag

SEQ ID NO: 30881 - DNA, 528 bp, Artificial Sequence
  Description of Artificial Sequence: Synthetic coding sequence
atgctcaagaagatgggggaagctgttgctcgcgtagcccggaaagtgaacgagaccgtggaaagcggtagcgacacactggacctggctgaatgtaagttagtatcctttcctattggcatatataaggtgcttcgcaatgtgtctggccagatacatcttatcaccttggccaacaatgagcttaagtctctgactagtaaattcatgacaacatttagccaattaagagagttgcacctcgagggcaattttctgcatagactgccgagcgaagtgtccgcgttgcagcatttaaaagcgatagatctgagtaggaaccagttccaagactttcccgagcaacttaccgcactccccgctctggagacaattaacctagaagagaacgagattgtggacgtgcctgtagagaaactggcagccatgcccgcacttcgcagcatcaacttgcgcttcaaccccctgaacgccgaagtgagagttatagcaccccccctgatcaaattcgacatgctcatgtcctag

SEQ ID NO: 30882 - DNA, 1032 bp, Artificial Sequence
  Description of Artificial Sequence: Synthetic coding sequence
atgagcgacgaagatgacctggaggatagtgagcccgatcaggacgactcggagaaggaggaggacgagaaggagaccgaggagggtgaagattacaggaaagaaggtgaggaattcccggaggaatggctaccaacaccactgacggaggacatgatgaaagagggcctgtctctgttgtgcaagaccggaaatggacttgcacatgcttatgtcaagctggaggtgaaggagcgcgatctgacagatatctacctgctcagaagttatatacacctgcgatatgttgacatctctgagaaccacttgactgacttgtctccactgaattacctcacacacctgctgtggctgaaagccgatggcaacaggttacggtcagcgcaaatgaacgagttgccttacctacaaatcgcatccttcgcttacaaccagattacagacaccgaaggaatatctcacccacggctcgagacccttaatctgaagggaaatagcatacacatggtgaccggtcttgacccagagaagctgatttcattgcacacggtcgagcttcggggtaaccagctggagtcaactcttggcattaacctgcccaagctgaaaaatttatatctggctcaaaatatgctgaaaaaggtggagggcctcgaagacctgagcaatctcacaacccttcatctcagagataatcagatcgacacacttagcggcttcagtcgggagatgaagagtcttcagtatctcaacctccgagggaatatggtagcaaacctcggagagctcgccaagctgcgggatctccctaagttgagggcactcgtgcttctggacaacccctgtaccgacgaaactagctatcgccaggaggcactagtacagatgccttaccttgaacggctggacaaagaattctacgaagaggaggaacgcgctgaggccgacgtcatccgtcagcgattaaaggaagaaaaggagcaggagccagagccccaaagagatttggagccagagcagtcactgatctag

SEQ ID NO: 30883 - DNA, 939 bp, Artificial Sequence
  Description of Artificial Sequence: Synthetic coding sequence
atgtccgatgaggacgacctggaggacagtgagcccgaccaagatgactccgagaaagaagaggatgagaaagagacggaagagggtgaggactataggaaagagggcgaagagttccctgaagaatggctacccacacctctgacggaggatatgatgaaagaagggttatcattactttgcaagacaggcaacggcctggcacacgcttacgttaagctggaagtgaaggaaagagatctcactgatatctacctactgaggagttatattcacctgcgctacgttgacataagcgagaaccacctgaccgacctaagccccctgaattacctgacgcacttattatggctgaaagccgatggaaataggctgcgcagcgcccaaatgaatgaactgccctacctccagatcgctagtttcgcctacaatcaaattacagacacagaagggatctcccacccccgtttggagacactcaacttgaagggaaacagcatccacatggtgaccggtctcgatcccgaaaaactcatctccctgcacaccgtagagctgcggggaaatcagctcgagtctactctagggatcaacctgcccaaactcaaaaacctgtacctcgcccagaatatgttgaagaaagtagaaggacttgaagatttgagtaacctcaccactctgcatttaagagataatcagatcgacactctgtcaggtttcagcagggaaatgaaaagcctccagtacctgaatctgaggcggagcaagactctcgctttcaggcccgaccagacacctcgcggctctcatcatatgtacgatcgagaacagcgcatgccagtgttcgctcctaagttggaaattcaccacaacctgcggccaaggatctgcagcgttccagtgctctgggccgtttggggagcagagtggggcgcctag

SEQ ID NO: 30884 - DNA, 285 bp, Artificial Sequence
  Description of Artificial Sequence: Synthetic coding sequence
atgagcgacgaagatgacctggaagacagcgagccagatcaggatgattccgaaaaggaggaggacgaaaaagaaacggaggaaggcgaagattacaggaaggagggtgaggagttcccagaggagtggctgccaactcctctgactgaggacatgatgaaagaagggctgtcacttctgtgtaaaaccggcaatggactggcacacgcatacgtaaagcttgaggtgaaagagcgcgatctcaccgatatctacttgctacgcagttatatccatctacgatag

SEQ ID NO: 30885 - DNA, 1032 bp, Artificial Sequence
  Description of Artificial Sequence: Synthetic coding sequence
atgagcgacgaagacgatctggaagactcggagcccgaccaagatgatagcgaaaaagaagaagatgaaaaggagactgaagagggcgaagattacagaaaggagggggaggaatttcccgaagaatggctgccaacaccgctcaccgaagatatgatgaaggagggcctatccctgctctgtaaaactggcaacggcttggctcacgcatacgtgaaactcgaggtgaaggaacgagacctgacagatatttacctgctaaggagctatatacacctgcgatacgtggatatttccgaaaatcacctcactgatcttagcccactcaactacctcacccacctgctttggctgaaggcagacggtaaccggctgagatccgcccaaatgaatgaactgccatacttgcaaatagcctcttttgcctataaccagatcacagatacagagggtattagccatcccaggctagaaactctgaacctcaaaggcaactccatacacatggtgacgggtctggatcccgagaagctgataagccttcacacggtcgagttgcgaggaaatcaactggagtctaccctagggatcaatctcccaaagctgaaaaacctgtacttagcccagaatatgctgaagaaagtcgaaggacttgaagacctgtccaatctcactaccctgcacttgcgggataaccaaattgacacactgagtggcttctctagggagatgaagtctctacagtatttgaatctgagaggtaacatggtggccaatctgggggaactggcaaaacttcgggacttacctaaactgcgggccctggtgttgctcgataatccttgtacagacgagacatcctacaggcaggaagctctagtccagatgccttacttagagaggcttgataaagaattctatgaggaagaagagcgcgccgaggctgatgtcattcgacagcgtctaaaggaggaaaaggagcaggagcccgaacctcagagggaccttgagcccgagcaaagcctgatttag

SEQ ID NO: 30886 - DNA, 1032 bp, Artificial Sequence
  Description of Artificial Sequence: Synthetic coding sequence
atgtccgacgaagacgacctggaggattcggagcccgatcaggatgactccgaaaaggaagaggacgagaaggagactgaagaaggtgaggactaccgcaaggagggagaggagttccccgaggagtggctgcccactccactcactgaggacatgatgaaggaggggctgtccctgctgtgcaaaacgggaaacggactggcgcacgcctatgttaaattagaggtgaaggaacgggatctaactgacatctacctgcttcggagttacattcacctccgttatgtagacattagtgagaatcacttgacagacctaagtccactgaattaccttactcatttactctggctgaaagccgatggtaatagattacgcagcgcacagatgaatgagcttccttatctgcagattgccagcttcgcctacaaccagattacggataccgagggtatctcccatcctcgcctcgagacactgaacctgaaagggaattctattcacatggtgacggggctcgatccggaaaagctgatttcactgcacaccgtggagctgcgtggtaaccagctcgagtcaacattgggaattaacttacccaaactcaagaacctgtatttggcacagaacatgttgaagaaagtggagggactcgaggacctatccaacttgacaaccctccacctgcgtgacaatcagatagacactctgtctgggttctcgagggagatgaagtctctccaatatctgaatttgagaggaaacatggtggccaatctcggcgaattggcaaagctgagagacctccccaagctccgcgctttagtgctgctggacaacccctgcacggacgagacaagctatcggcaagaagctctagtccaaatgccatatctggaacggctggataaagagttctatgaggaagaggaaagggcggaggcagatgtgataagacagcggcttaaggaggagaaggaacaggaacctgaaccacagagggatcttgaacctgagcagtccttgatttag

SEQ ID NO: 30887 - DNA, 1032 bp, Artificial Sequence
  Description of Artificial Sequence: Synthetic coding sequence
atgagcgacgaggacgatcttgaggactccgagcctgaccaggacgatagcgagaaggaggaggacgagaaggagacagaagagggcgaggattacaggaaagaaggggaggagttccccgaagaatggttaccgaccccactgaccgaagatatgatgaaagaggggctgtctctgctctgcaagacaggaaacgggctggcgcatgcatatgtcaagctggaagtaaaggagagggaccttactgatatttatcttctgcggtcttacattcacctgcgttacgttgatatctccgaaaatcacctgacggacctatccccactgaattatctgactcacttattatggcttaaggctgacggcaatagactgaggtccgcccagatgaatgagcttccttatcttcaaatcgcctcttttgcctacaaccagatcacagatacagagggcatcagccacccgagactcgaaactctcaatctgaagggcaattctatccatatggtcactgggttggacccggagaaacttatttccttgcacaccgtggagctccgaggaaatcagctggagagcacactcggaatcaacttgccaaaactgaagaacctgtatcttgctcagaatatgctgaagaaagtggaaggtctggaggatttgtcaaacctgaccacccttcatctgcgcgacaaccagattgatactctgtctgggttctcccgcgaaatgaaaagtttgcagtacctgaacctccgggggaacatggtggccaacctgggggaacttgccaagttgagagacctccccaaactgcgtgctctcgtgctccttgataacccatgcacagacgagacttcctacagacaggaagctctagtgcagatgccctacctggagcgtctggataaggagttttacgaagaagaagagcgcgccgaagcagatgttatccggcagcgactgaaggaagagaaagagcaagagcctgaaccccagagagacctcgaaccggaacagtccctgatatag

SEQ ID NO: 30888 - DNA, 1152 bp, Artificial Sequence
  Description of Artificial Sequence: Synthetic coding sequence
atggaagggtcgtcttcctatgaagtgccctcagtcgccgcagccgatcttgaggaaggtgctggccagacaagatcactgcctgcaacacctagcaaagacgtacataagggggttgggggaatcatcttcagctcttccccgatcctggatctgtctgaatcaggactctgtagactggaagaagtcttccgaattccctccctccagcaactgcatctgcaacggaatgccctgtgtgtaataccccaggacttcttccaactcctcccaaaccttacttggctggacttacgttacaacagaataaaagccctgccatctggaatcggcgcccatcagcatctgaaaactttactgctggagcggaatcccattaaaatgctccctgtagagctaggtagtgtgacaaccttgaaagccctgaacctacgtcactgcccgctggagttccccccgcagcttgttgttcagaaaggtctggtggcaatccagagattcttgaggatgtgggctgtggagcatagtctgccgcggaatcccacaagtcaggaagccccacccgtgcgggagatgacccttagagacctgccttcaccagggttagaactctctggggaccacgcatccaaccagggtgcagtgaatgctcaggacccggagggcgcagtcatgaaagaaaaggcaagcttcctgccaccagtggaaaagccagacctgtcggaacttagaaaatccgctgatagctccgagaactggccttcagaggaggagattaggcgcttctggaagctgagacaggagattgtagagcacgtgaaggcagacgtcttaggagatcagctgcttacacgcgaattaccccctaatttgaaggcagccctcaatattgagaaggaattacctaaacctcgccacgtttttcggacaagggttccacgtaaacaagcactgcagcgattacacgagcggaaaacgagaattatgggagtagtggggcgagcacctacacacatgggagagggccgacagccccccccaggggcttcctaccctacctcctgccacaggacaaagtggagatccgaacagaaggattggaagcgcgccgagagacgaagatccgagtcctccagacggtcgcggctgtag

SEQ ID NO: 30889 - DNA, 510 bp, Artificial Sequence
  Description of Artificial Sequence: Synthetic coding sequence
atggaggggtcctcatcctatgaggtgcccagtgtggcagccgccgatctggaggagggtgctggacagaccaggtctctgccagccaccccctctaaggacgtccacaaaggagttgggggtatcatcttcagcagtagccctatactggacctcagcgaatctggtttgtgccggctggaggaggttttccgaattccctctctgcagcaactccacttacagcggaatgcattgtgtgtgataccacaagactttttccagcttctgccgaacctgacatggctggatttgcggtacaaccgaattaaggccctcccctctggaatcggtgcccatcaggagcgcaatcacgccgagtcaactgagcccaagacccttccatcggggatccctagctccgcccgatgcgccgaaggaatcggtgggtatcccgctcttcctgcagacgtcggtagccgcactctgagtccccaaaagagtaacttcagcagaggctccactggctag

SEQ ID NO: 30890 - DNA, 1407 bp, Artificial Sequence
  Description of Artificial Sequence: Synthetic coding sequence
atggatatcaacacatacaacaaccagctgcacctccagaggaatgcactgtgtgtgattcctcaggatttctttcagctgttgcccaatcttacttggctggatctgcggtataatcgcatcaaagctttgccatcaggcattggcgcacatcagcatctgaaaaccctgctccttgagaggaatccaatcaagatgctacctgtcgagcttggctctgtcaccaccttgaaggccctgaatctgcgacattgtccattggaattcccaccccagttagtggtgcaaaaaggcctggtagccattcagcgctttctgagaatgtgggccgtagagcacagcttaccaagaaatccaacttcccaggaggccccccccgtgagggaaatgactttacgtgatctgccatcgcccggtttggagctgtctggggatcatgcttctaatcagggtgcggtgaatgcacaagatcctgagggggcggtgatgaaggagaaggcatctttcctcccgcccgttgagaagcccgacctttccgaactacggaaatcagccgactctagtgaaaattggccgtctgaagaggagataagacggttctggaaacttagacaggagatcgttgaacacgtgaaggcagacgttctgggtgatcagctgttgacccgggaactcccgccaaatttaaaagctgccctgaacatcgagaaggaactgcccaagcctagacatgtgttcaggcgaaaaaccgccagcagccgctctattcttcccgatttactgtccccctatcagatggccattagggccaagcgtctcgaggaatcaagagctgctgccctcagagaactgcaggagaaacaggccctgatggagcagcagaggagagagaaaagggctctacaggaatggagggaacgggcccaacgcatgagaaagaggaaggaggagctgagcaaattgctgccgcccagacgctcaatggttgcctcgaagatacccagtgccaccgacctgatagataatagaaaggtacccctgaatccccccggcaagatgaagccctccaaggagaaatccccccaagcaagcaaggaaatgagcgctctgcaggagcggaacttggaggaaaaaattaaacaacacgttctccagatgagggagcagagaagatttcacgggcaggcgccccttgaagaaatgcgaaaggctgcagaagacttagagatcgcaactgagctccaggacgaggtgcttaaactgaagttgggcctcactctgaacaaggatcggcgaagagctgcccttacagggaacctgagcctcggtctgccggccgcccaacctcagaatactttcttcaacaccaagtacggcgagtcagggaatgtgcggcggtaccagtag

SEQ ID NO: 30891 - DNA, 1407 bp, Artificial Sequence
  Description of Artificial Sequence: Synthetic coding sequence
atggatataaacacctataacaatcagctgcatctgcagcggaacgccctgtgtgtgatccctcaggatttctttcagttgctgcctaacttgacctggctggacttaagatacaaccggatcaaggcacttccaagcggcattggcgcccatcagcacctcaagacattacttcttgaaaggaaccctatcaaaatgctacccgtcgagttagggtctgtgactactctcaaagccttgaacctgaggcactgtcctctggagttccctcctcagcttgtggtccagaaaggtctggtggcaattcagcgcttcctgcggatgtgggcagtggaacacagtctgccccggaatccaacatctcaggaagcgccccccgtaagggagatgacactccgcgatctcccaagcccggggctggagctgtctggcgaccatgcatcgaaccagggggctgtaaatgctcaggacccagaaggcgcagtgatgaaggaaaaagctagctttctgcctcctgtggaaaaacccgatctgtccgaactccgcaaaagcgccgactcgagtgagaactggccatccgaagaggagatacgcaggttttggaaattgaggcaggaaattgtagagcatgtgaaggccgatgtgcttggcgatcagctgctcacacgggagctcccgcctaaccttaaggccgcgctgaacattgagaaggagctacctaagcctagacacgtctttaggaggaagaccgcttcctccaggagcatcctccctgatctgctgtccccctatcaaatggccattagagccaagagactggaggagtcaagggctgctgctctcagagaactacaggagaagcaagccctgatggagcagcaacggagggagaagagagcccttcaggaatggcgggagagagcacagcgcatgcgcaaacggaaagaggaactgtccaaactgctgcccccaagaagatccatggtcgcttctaagattccctcagcgactgatttaattgataatagaaaggtacccttgaatccgcctggaaaaatgaagccgtctaaggaaaaatcaccccaggcttccaaagaaatgtcggccctccaggagcgcaatttggaggagaagataaagcaacatgtcctgcaaatgcgtgagcagaggcgctttcatggccaggcaccccttgaggagatgcgcaaagctgccgaagacctcgagatcgcaacagagctccaggatgaagtcctgaagctgaaactgggccttacgcttaataaggacagacggagggccgctttgacgggaaatttatcactgggcctgcccgctgctcagccccaaaacactttcttcaatacaaaatatggagagagcgggaacgtgaggcgttatcagtag

SEQ ID NO: 30892 - DNA, 1593 bp, Artificial Sequence
  Description of Artificial Sequence: Synthetic coding sequence
atggaagggagctcctcatacgaggtcccaagcgtggcagctgccgatctagaagaaggagcagggcagactcggtcgcttcccgccaccccctccaaagatgtacacaagggcgtgggtgggataatattttcttcctctccaatccttgatctgagtgaaagcgggctgtgtcggctcgaggaggttttcaggatcccatctcttcagcaactgcacctgcagcggaacgccctctgtgtgatcccccaggatttcttccagttgctgccaaatctgacatggttagacctccgctataaccggattaaagctctgccgagtggaatcggcgcccaccagcacctaaaaaccttgctgttggagagaaatcccatcaagatgctgcccgtcgaactcgggtctgtgaccactttaaaggctctgaatttacgccactgtccactagagttccctccccaattagtagttcagaaaggcctagtggctattcagcgttttctccggatgtgggcagtggaacactcactcccaaggaatccgacctcccaagaagcacctcctgttcgcgagatgaccctgcgtgacctgccatcgcctggcctggagctgagtggggaccacgcctccaatcagggtgccgtgaacgcccaagatcccgagggggccgtcatgaaggagaaagccagctttctcccgcctgtggaaaagcccgacctgtctgagcttcgcaagagtgcagatagctccgagaactggcctagcgaggaggagattcgccggttttggaagctgaggcaggagatcgttgagcatgtgaaggccgatgtgctgggcgaccagctcttaacccgggaattgccacctaatcttaaggcagccctcaacattgagaaggagcttccaaagccacgacacgtgttccgacgcaaaaccgctagcagtcgctctatcctccctgacttactgagcccttatcaaatggcgataagggcaaaacggctggaagagagccgggcagccgccctgcgcgagctgcaggagaaacaggcactcatggaacagcagagacgcgagaagagggctctgcaggaatggcgcgagcgggcccagcggatgcggaagcgaaaagaggaactgtccaagctgctgcctccgcgacgatccatggtagcttcaaagattccatctgccaccgatttaatagacaatagaaaggtccccctgaatcctccgggcaagatgaaaccttccaaggagaagtcacctcaggccagcaaggaaatgtctgccctccaggaaaggaaccttgaggagaaaatcaaacagcatgtgctgcagatgcgagaacaaagacggttccatgggcaggcaccattggaagagatgcgcaaagcagcggaggaccttgaaatcgccaccgaattacaggacgaagtcctgaagctgaaattaggtctgaccttgaacaaggatcggaggcgagctgccttgacaggtaatctttcattgggattaccggcggctcaaccccagaataccttttttaatacaaaatacggtgagtccggcaatgtacgcaggtatcagtag

SEQ ID NO: 30893 - DNA, 1593 bp, Artificial Sequence
  Description of Artificial Sequence: Synthetic coding sequence
atggagggcagtagcagctacgaagtgccaagtgtagcagctgctgaccttgaggagggagccggccagacacgaagccttccagctacaccatcaaaagatgtgcacaagggggtcggaggcatcatatttagcagtagtcctatccttgatctgagtgagagcggcctctgccgcttagaggaagtatttcgtattccatcccttcagcagctacatttgcagaggaatgccttgtgtgttattccgcaagacttcttccagctgcttccaaatctgacatggctggatcttagatacaaccggattaaagctttacccagcggaatcggggcacatcagcacttgaaaacactcctgctagagcggaaccctatcaaaatgttaccagtcgagttgggaagtgtcacgaccctcaaggccctgaacctgcggcattgcccactcgaatttccaccgcagctggtggtccaaaaaggtctggtggcaattcagcgtttcctaagaatgtgggccgtggagcactcgttgcctcgcaatcctacaagccaggaagcccctcccgtgcgcgagatgactctgcgggacctacccagccccggcttagagctgagcggcgaccacgcgagcaatcagggcgctgtgaatgcccaagatcccgagggcgccgtgatgaaagagaaagcctcgtttctgcctcctgtggagaaacctgacctgtccgaactgcgtaaatcagcagacagttctgaaaactggccctcggaagaagaaatcagacgattttggaagctccgccaagagatcgtcgagcacgtgaaagccgacgtcctgggcgatcaattgctgaccagggaactgccacctaatcttaaagccgcgctgaatatcgaaaaggaactgccgaaaccccgacatgtctttcgaagaaagaccgcctcatcacggtcaattctaccagatttgctgtctccataccagatggccattcgagccaagcgcctggaagaatccagggccgccgccttgcgtgagctgcaggaaaaacaggcacttatggagcagcagcgtcgcgagaagcgcgccctgcaggagtggcgggaacgggcccaacggatgagaaagaggaaggaagaactgtctaaattgcttcctccacgaagatcaatggtggctagcaagattcccagtgcaaccgatctgatagacaaccgaaaagtcccattgaacccacctgggaaaatgaagccatccaaagaaaaaagccctcaagcgagcaaggaaatgtccgcgctacaggaacggaatcttgaggaaaagattaagcagcacgttctccagatgcgtgagcagcgcaggtttcacggacaggccccgttagaggagatgcggaaagcagcagaggatttagaaattgccaccgaattgcaggacgaggtccttaaattgaagcttggactgacgctgaataaagatcgacgcagggctgcactcaccggaaatctcagtctgggtctccctgctgcccagccgcagaacacatttttcaacaccaagtacggtgagtccggaaatgttagacggtaccagtag

SEQ ID NO: 30894 - DNA, 1152 bp, Artificial Sequence
  Description of Artificial Sequence: Synthetic coding sequence
atggaggggtcctcaagctatgaggttccttctgttgcagccgctgacctagaagaaggcgcaggtcagaccaggtccctgcccgcaactcccagtaaagacgtgcacaaaggggtggggggtataatctttagctccagcccaattctcgacctgtcggagagtggcctgtgtaggctggaggaagttttccgtatcccctctctacagcagttacacctgcagaggaatgctctctgcgttatccctcaggacttttttcagttgctgccgaacttgacctggcttgaccttcgctacaatcgcatcaaggctttaccgtcaggcattggggctcaccaacatctgaagacattattactggaacgcaaccccataaagatgctccccgtggagctgggctcagtgaccacccttaaagctctgaatttgagacattgtcccttggagttcccgccccagctggtggtccagaaaggactagtggcaattcagcgctttttacgcatgtgggcggtggagcattctttacctaggaatccaacttctcaagaagctccccccgtcagagagatgaccctgagggacctgccttcaccaggtttggaactttccggagatcacgcttcgaatcagggcgcggttaacgctcaggaccctgaaggcgctgtcatgaaggagaaggccagcttcctgccccccgtggaaaaacctgacctttccgaactgcggaaaagtgccgactccagtgagaattggcccagcgaggaagagatccgtcggttttggaaactccgacaggagattgtagaacatgtaaaagcggacgttcttggtgatcagctgctcacacgggaactaccccctaatcttaaagctgctctcaacatcgaaaaagagctcccaaagccaagacacgtgttcagacggaagactgcatcaagccgcagcatcttgccggacctcctgagcccctaccagatggctatacgcgctaaacgcctggaagaaagcagagctgccgccttaagagaactgcaggaaaaacaagccctcatggagcagcagaggaggccttttcttctcatcttccctcgtgttttccaggccctcacaaggtcgtcaggtcgatttatacttgtcttgctttag

SEQ ID NO: 30895 - DNA, 1152 bp, Artificial Sequence
  Description of Artificial Sequence: Synthetic coding sequence
atggaaggctcaagctcctacgaagtgccgtcagttgctgccgccgacctagaggaaggcgctggacaaacccgcagcctccctgctacgccatccaaagacgttcacaagggggtgggcggaatcattttctccagctctcccatcttagacctctcagagtctgggctctgtcgcctggaggaggtgtttcgcatcccctccctccaacaactgcacctacagcgcaacgcactctgcgtgattccccaagacttcttccaactgctcccgaatctgacttggttggatctgagatacaatcgcatcaaagctttaccctctggtatcggcgcccaccagcatctcaagacactgttgctcgaacggaatccgatcaagatgctccctgtcgaacttggcagtgttactacccttaaagccctaaacctccggcactgccccttagagtttccgccccaactcgtcgtgcagaaaggtttagtggcaatccagcgtttcctgcggatgtgggcggtcgagcactcgctgcccagaaatcccacctcacaggaggccccacctgtacgggagatgaccctgcgggacctgccaagtcctggactggagttgagcggtgaccacgcatccaatcaaggagctgtgaacgcgcaggatccagaaggcgcggtgatgaaagagaaggccagctttttacctcccgtagagaagcctgacctctcagaactgcgaaaatctgctgatagctccgaaaactggcctagtgaagaggaaatccggcggttttggaaactgagacaagagattgtggaacatgtgaaagcagatgtactcggcgatcagctgctcacacgggagctgccccccaatcttaaagctgctctgaatatcgagaaagagctgcccaaaccaaggcatgtgtttcgcacacgggttccaaggaagcaggccctccagcgactgcacgagagaaagacccgcattatgggtgtcgtgggtcgagcgccaactcatatgggtgaaggtcggcaacctccccccggcgcgtcctacccaacttcctgtcaccgcacaaagtggaggtctgaacagaaagactggaagcgggctgagcgccgaagatccgagtcatccagaaggtcacgtctgtag

SEQ ID NO: 30896 - DNA, 1107 bp, Artificial Sequence
  Description of Artificial Sequence: Synthetic coding sequence
atgcttccagtggagctgggctcagtaacgactctgaaggcgctcaacctccgacattgtccacttgaattccccccccaactcgtggtgcagaaaggacttgtggcaattcaaagattcctgcggatgtgggcagttgaacactctctgccacgcaatcccacatcccaggaggcaccacctgtgcgagaaatgactttgcgtgacttgccatctcccggactggaactgtcaggggaccacgcctctaaccaaggagccgttaatgcccaggatcccgaaggcgcagttatgaaagagaaagcctcattcttgccacctgttgagaagcccgacttaagcgaattgagaaaatcagctgactctagtgaaaattggccatccgaggaggagattcggcgattctggaagttgcgtcaagaaatcgtggagcatgtgaaggcagacgtgttaggggaccaactgctgactcgagaactcccgccgaacctgaaggcagctctaaatattgagaaagagcttccgaaaccgcggcacgtcttcaggcgaaagacagctagctctcgaagtatcttgcctgatctgctatctccataccaaatggccatacgggctaagcgactggaggaaagcagggccgccgcactgcgggaattacaagagaagcaggccttgatggaacagcaaaggagagaaaaaagggccctgcaggaatggagggagcgagctcaacggatgcggaaaaggaaggaggagttatccaaactcctgccgcctcggcgctccatggtggcatctaagattcccagcgcgaccgatctcatcgacaatcgtaaagtccctctgaatcctccggggaagatgaagccctctaaagaaaagtctccacaagccagtaaggagatgtccgcattacaggaacggaacctcgaagagaagataaagcaacatgtgctgcagatgagggagcagcgcagatttcacggacaagcgccactggaggagatgagaaaagctgcagaggacctggaaatcagtcggcgctgggaaagaggcgggatgcgggcaggctgtggggccacttcgtggagacctcacccaacttag

SEQ ID NO: 30897 - DNA, 777 bp, Artificial Sequence
  Description of Artificial Sequence: Synthetic coding sequence
tagttccggacatccgtgagcactccctctggaaataccgacatggacatcaacacttacaataatcagctccatttgcaaaggaacgcactgtgcgtgatccctcaggacttttttcagttacttcctaatctgacatggctagaccttcggtataatcgcataaaggctctgccatccgggattggcgctcatcagcacttgaagaccctccttttggagcgcaaccccatcaagatgttgccagtggaactggggtctgtcactactctcaaagctctgaatctgaggcactgccccctggagttcccaccacagctggtggtgcagaagggactggtggcgatacagagatttcttcggatgtgggcagtcgaacattcgctgcctcgaaatcccacatcacaggaagcccctccagtgagggagatgaccctgagggaccttccttctccaggattggaactgagcggtgatcacgccagcaaccagggggctgtgaatgctcaggatccggaaggcgctgtgatgaaggaaaaggcatccttcttgccacccgtggagaagccagatctgtccgagctgcgcaaatccgctgattcaagcgagaattggccaagtgaagaagagatcagacgattttggaagctgcgccaggaaattgtcgaacatgtgaaggctgacgtgctaggagaccagctgctgacgagagaattgcctccaaacctgaaggccgccttaaatattgagaaagagcttccgaaacctagacactag

SEQ ID NO: 30898 - DNA, 1104 bp, Artificial Sequence
  Description of Artificial Sequence: Synthetic coding sequence
atggcctccgaactctgtaagacaatctcagtggcgcgtctggagaagcacaaaaacctgttcctcaactacaggaatttgcaccacttccctttggaactgctcaaagacgaaggactccagtacttggagcggctgtacatgaagcgcaattctctgacctccctgccagagaacctagctcaaaaacttcctaacctggtggagctctacctgcactccaataatattgtggtggttccggaagctatcggtagtctggtgaaactccaatgtctcgacctgtccgataatgccctggaaatcgtgtgcccagagattgggcgtcttcgggccctaagacacttacgtcttgccaacaaccagctccagttcctccctcctgaggtaggcgacctgaaggagctgcagactctcgacatctccaccaatcggttgttaacattaccggaaaggctgcacatgtgtctatccttacagtatctgaccgttgacagaaaccggttgtggtatgtgcccaggcatctgtgtcagttaccttccctgaacgagttatccatggctggcaatcgactagcttttctcccactagatcttgggagatcaagagagctgcaatatgtgtacgtcgataataacatccaccttaaaggcctgccatcgtatctgtacaataaagtcatcggctgttcaggttgcggagctcccatccaggtttccgaggtgaagctgctctccttttcgtctggtcaaagaactgtttttctacccgccgaggtcaaggcaatcggtactgaacatgaccacgtactgcctctccaagaactagccatgcgaggcctatatcatacgtatcatagcctcctcaaagacctcaacttcttgtcaccaatcagtctgccacgatccctgctggaattactgcactgtcccttggggcactgccaccgatgtagtgagcccatgtttacaatagtgtacccgaaactgtttcccctgagagaaacccccatggctggactccatcagtggaagaccactgtatctttcgtggcctattgttgttcaacacagtgcttgcaaactttcgatctactttcctag

SEQ ID NO: 30899 - DNA, 897 bp, Artificial Sequence
  Description of Artificial Sequence: Synthetic coding sequence
atggcaagcgagctatgtaagacaatttctgttgcccggcttgagaagcataagaatctgttcctgaactaccgcaatctgcaccacttcccattggagctcctgaaggacgaaggcttacagtatctggagcggctgtatatgaagagaaacagtttaacctctcttcccgagaaccttgctcagaaacttccaaatctcgtggagctgtacttgcactctaataacattgttgtagtgccagaggccataggatccttggttaagctgcagtgcctcgacctcagcgataatgcgctggaaatcgtgtgcccagagataggccgactgcgcgcacttcgccacctgaggttggcaaataatcagctccagtttcttccccctgacctgggcaggagccgcgagttgcagtacgtctatgtggacaataatattcatctcaagggtctcccatcttacctatacaacaaggtcataggttgttccgggtgtggtgcgcccatccaggtcagtgaagtcaaactcctgtcctttagcagtggacagcggacagtatttctgcctgccgaagtaaaggctatcggaacagagcatgaccacgtcctgcccctgcaggagctggctatgcggggactgtaccacacataccactccttactgaaggacctcaactttctctcgccgatttccctgccccgatccctgctggaactactgcattgtccactcggccattgccacagatgctcagagccaatgtttactatcgtctaccctaagctattcccactgagggaaacgcccatggccggactgcatcaatggaaaaccacagtgtcctttgttgcctactgctgttcaacccagtgcctgcagaccttcgacttgttgtcttag

SEQ ID NO: 30900 - DNA, 456 bp, Artificial Sequence
  Description of Artificial Sequence: Synthetic coding sequence
atggcttccgaactgtgcaagacaatttctgtagcaagattagagaaacataagaatctgtttcttaattaccggaatctccaccacttccccctggagttattaaaagacgaaggtttacagtatctagagcgactctacatgaaacggaattctctgacttctttaccagagaaccttgcgcagaaattacccaatctggtggaactctatctgcactcgaataatattgtcgttgttccagaagccatcggcagtctggtcaaactccagtgcttggacctctcagataatgctctagaaatcgtctgtcccgaaatcggaaggctgcgagccctacgacacctgagactcgccaataatcagctacagttcttaccacctgtgccacattgtggcccaaaatcatctatggtttgcgctgctccgtcattacccgcggcacaacctcagtag

SEQ ID NO: 30901 - DNA, 939 bp, Artificial Sequence
  Description of Artificial Sequence: Synthetic coding sequence
atggcttctgaactttgcaaaacaatctctgtggctagactggaaaaacacaagaacctgttcctgaattaccggaatttgcatcacttccctttggagctcctgaaagacgaaggcctccagtatctggagaggctctatatgaaaaggaattccctgacaagcctgccggaaaatctcgcccagaagctcccgaatctggttgaactgtacctccactcaaataacatcgtcgtggtgcctgaagccattggttctctagtaaagctccaatgtcttgacctttccgacaacgcgctggagatcgtgtgccctgagatcggacgcttgcgtgcgctacgacatctgcggttggctaataaccaactgcagtttttaccacccgaagtcggcgatctgaaagagctgcagactttagacatcagcaccaatagactcctgacacttccagaaagactgcacatgtgcctctcccttcagtacctgacagtggataggaacaggctgtggtacgtgccccgccacctctgccaactgccatcattgaacgaactgtctatggcaggaaacaggcttgccttcctccctctcgacttgggtcggagcagggagctccagtacgtatatgtggacaataacattcacctaaagggcctaccctcttacctgtataacaaggtgatcggctgcagcggctgcggagctcccatccaagtgtccgaagtgaaactgctgtccttttctagtggtcagcgcaccgtcttcctgcccgctgaagtgaaagccattgggactgaacatgatcacgtcctgccgctacaagaactcgctatgagaggtttgtaccatacttaccatagtctcctgaaagggcggcaacttttagtgctgtggctgactgcggctccccccagcgtctgcaggctgctcacatgctag

SEQ ID NO: 30902 - DNA, 513 bp, Artificial Sequence
  Description of Artificial Sequence: Synthetic coding sequence
atggcctctgaactctgcaagactatttctgtcgctaggttggagaagcataagaatctgtttctgaattatcgcaatctgcaccactttccactcgaactgctcaaggacgaggggctccagtacctggaaaggttatacatgaaaaggaactctcttacctccctccccgagaacctggcccaaaagcttccgaatcttgtggagctgtatctgcatagtaataacattgtcgtggtgcctgaggctattggttccctggtcaagctgcagtgcctcgatctgagcgacaacgccttggagatcgtttgccccgaaatcggcaggcttagggcgctgcgccacttgaggctggccaacaatcagctccagttcctcccacctgaagtgggggacctaaaagagctccagacactcgatatttccaccaataggttgctgaccctgcctgaaagattacatatgtgtttaagccttcagtatcttactgtcgaccgaaatcgtctttggtag

SEQ ID NO: 30903 - DNA, 672 bp, Artificial Sequence
  Description of Artificial Sequence: Synthetic coding sequence
atgtattcctcaggttggcctgcaggggcagctgaacctaggcacggccgcggcagagaattggctcaggcactgggctgcatgcatggagctccttcccaattggcaagcctgtccttggcacattgctccagtctgaagtctcgcccagaacttgagcaccaggcttccggcacaaaagacgcttgccccgaacctcaaggccccagtcttttgacactgcgggctttacaggaacttgatctgaccgcctgtagtaagttgacagacgctagtctcgccaaggtactgcagtttctgcaattaagacaactgtcactctccctgctccctgagctcactgataacggcttggttgctgtggctcgtggctgcccctctctggagcacctggcactatcacattgcagtaggctgtctgataagggttgggcccaggcggccagcagttggcctcgccttcagcatctcaatctcagctcctgctcgcaactgattgagcagactctagatgcaatcgggcaggcgtgtcgacaacttcgagtgcttgatgtcgctacgtgcccaggtatcaacatggctgcagtgcggcgcttccaggcccaactcccgcaagtgagttgcgtgcagagtcgtttcgtggggggagccgatctgacactaacactttag

SEQ ID NO: 30904 - DNA, 672 bp, Artificial Sequence
  Description of Artificial Sequence: Synthetic coding sequence
atgtattcttcaggctggcctgctggagctgctgaaccacggcacgggaggggcagggagctggctcaagcgttaggatgcatgcatggcgcaccttcccagctcgcctccctttcgctcgcccattgcagcagccttaagtctcgaccagagctggagcaccaggcctcgggtaccaaggatgcctgccctgagccccagggcccctctttgctgactctacgggcactccaggagctagaccttaccgcttgttctaaactaaccgatgcgagcctcgccaaggtgttgcaattcctgcagctcaggcaactgtctctctccttactcccagaattgactgataacggcctggtcgcagtggctaggggatgcccttccctggaacatctggcccttagtcattgttctagattgtccgacaaaggctgggcacaggcggccagttcctggcctaggctgcagcatcttaatctgagcagctgcagtcagttgatcgagcaaacactcgatgctatagggcaggcttgccgccagttgcgtgtgctagatgtcgccacctgccccggaatcaatatggctgccgtccgtaggttccaggcacagttgcctcaagtaagctgcgtgcaatcacgcttcgtcggtggggcagatctgactctcaccctgtag

SEQ ID NO: 30905 - DNA, 672 bp, Artificial Sequence
  Description of Artificial Sequence: Synthetic coding sequence
atgtactcatctggctggcctgccggcgctgcggaacctaggcacggacgcgggcgcgagttggcacaggcgctgggttgtatgcacggagctccctctcagctcgccagcctgagcctggcccactgcagcagtttgaaaagtcgacccgaactagagcaccaggctagtgggacaaaggatgcttgtcctgaacctcaaggaccaagtctactgaccctccgagccctgcaggagctcgatctgactgcatgtagtaaactcactgatgctagcctggccaaggttctgcagttcctccagttgcggcaattgtccttaagccttttaccagagctcacggacaatggtctggtggcggtggcccgggggtgcccatctctcgaacacctggctctatctcattgctctcgcctttcagacaagggatgggcccaggctgctagttcttggcctcgattgcagcatttaaacctgtctagctgctcccaactgattgaacagaccttggatgctattggccaggcgtgtcgccagcttagggttctggacgtcgctacctgcccaggcataaacatggctgctgtccgaaggtttcaggcccagctcccccaggtgtcctgcgtgcagagtcgtttcgtaggcggggctgacttaacgctcaccttgtag

SEQ ID NO: 30906 - DNA, 672 bp, Artificial Sequence
  Description of Artificial Sequence: Synthetic coding sequence
atgtacagctctgggtggcccgctggcgcggccgaaccacggcacggtagggggcgcgagttagcccaggcattgggatgtatgcatggggcgccctcgcagcttgcctctctgtctctggctcattgtagctccttgaagtcaaggccagagctcgagcatcaagcctcaggaacaaaggatgcctgtcctgaaccacagggcccctcactgcttactcttcgcgctttacaggaactcgatctaaccgcgtgcagcaaattaaccgatgcttcactggccaaagtactacagttcctccagctgcgccagctgagcctgtccctgcttcccgaactgacagataacgggctggtggctgtcgcgcgggggtgtccatccttggaacatctggctctgtctcactgttcacgtctgtcggataaggggtgggcccaggcggcatcatcctggcccagactccagcacttaaatcttagctcctgctctcagttgatcgagcagactcttgacgctatcggtcaagcctgccggcagctccgggtgctcgacgtagcgacatgccctggaattaacatggcagccgtgaggcgcttccaggcccagttgccgcaagtaagctgcgtccagtcacggttcgtgggaggcgctgacctgacccttactctgtag

SEQ ID NO: 30907 - DNA, 498 bp, Artificial Sequence
  Description of Artificial Sequence: Synthetic coding sequence
atgtatagctctggttggccggctggagccgctgagccccggcacggccggggacgggaactggcccaggctctgggctgtatgcatggagctccaagccaactggctagtctgtctctggcacactgttctagtctgaagagccggcccgaactggagcatcaggcttcgggcacgaaagacgcttgccctgagcctcagggaccgagtctgcttacgctccgggccctccaagaactcgatctgacagcttgttcaaaactcacagatgccagcctcgcgaaggtgctgcaattcttacagctgagacagctgagtctttctctactgcctgaattaaccgataatggcttggtggctgtagccagaggttgcccaagtctggagcatctggcactgagccactgctctaggctttctgacaaaggctgggcacaagctgccagcagttggccaagacttcaacacctcaacctctcctcctgtagccagctgtag

SEQ ID NO: 30908 - DNA, 906 bp, Artificial Sequence
  Description of Artificial Sequence: Synthetic coding sequence
atgggcgcacgtcaatcccgcgcctcgtccaaagacaagggtcccaagcgcatgctgttcacaggacgtaggcagaaatttagtccatgggacgatgcactactgagcggacgcgaccccagatccctgctgaagcgtggcatgcatcacgttagcttttccctcgtgactaggggaatgacagatattccagactttctctgggggctctccgaagtacagaagttaaacctgagccacaatcaactgcgtgttctccctcctgaggtaggtaaattgaccagaatagttgtgctcaacctgtgcggaaaccggctgaagtctttgcctagagaagtgtcccttctgcagtgtctcaaggttctgttcgtcaatatgaattgcctgaccgaggtcccagccgaactgagcctatgtcggaaactagaagtcctgtctctgtcccacaactgtctgagtcagctgcccgcatgctttgcagatctgtcacggttgcggaaacttaatttgtccaataatttctttgctcacatcccaatgtgcgtctttagtctgaaggaattgatctttttgcatgtgggatccaaccggctggaaaatatcgctgagtctatacagcatctggcaagcctccagattttcattgcagaaggtaataacatccactcgtttcctcggtccctctgcctagtgacgtctctggagctcctgaatcttaacaataatgatatccagactctcccttctgaactgcacctgttgtgtcgactggtgaggatcgcatggaacccaatggacaagggattgcacattagccacaaccctctgtcaaaaccgctgcctgaattagtcgaaggtgggctcgagatgctcttcgggtacctgaaggacaaaaaacatacttag

SEQ ID NO: 30909 - DNA, 1491 bp, Artificial Sequence
  Description of Artificial Sequence: Synthetic coding sequence
atgtcacagacccgcaaaaaaacaagctccgaaggcgagaccaagccacagacctccaccgttaataaatttcttcggggatcaaacgcagaaagcaggaaggaagataacgacttgaaaacttctgactcacagccctccgactggattcaaaaaactgctacatctgaaaccgctaagcctctttcatccgagatggagtggcgcagctcgatggaaaagaacgagcacttcttacagaaattggggaagaaagcagtgaacaaatgcctggatctgaataattgcggcctgaccacagctgatatgaaggagatgggggaggcctttgagatgatccccgaattagaggagctgaatcttagctggaattctaaagttggggggaacctgccactgattttacagaaattccagaaggggtccaagatccagatgatcgaactggtggactgctccctgacgtccgaggacgggacattcttagggcagctgttgcccatgctccagtccctggaggtgcttgatctcagcattaatagagacatcgtgggtagcctcaactcaatcgctcagggcctaaaaagtacaagtaaccttaaggttctcaaactgcactcctgtggcctttcccagaagagcgtaaagattctagacgcagcttttcggtatctgggagagctgaggaaactagatctgagctgcaacaaagacttggggggcggtttcgaggacagcccagcccagttggtgatgctgaagcatctgcaggtgctcgacctgcatcagtgctctctgacagctgatgacgttatgtcacttacgcaggtcataccactgctgagcaatctccaggagctggatctctcagctaataaaaaaatgggatccagctcagaaaacttgctcagccgactgagatttctgcctgccctcaagtctctcgtcatcaacaattgtgctctggagagtgagaccttcacagccctcgccgaggcctccgtgcatttgagtgcgctggaagttttcaacctgtcctggaataagtgcgttgggggaaacctgaagctgctgctggagacgttgaaactttctatgagtctccaggtgttgcggttgagttcctgctctctggtgactgaagacgtggccttactggcttctgtgatacagaccggacacttagcgaaacttcagaagttagacctgagttataatgattcaatatgtgatgccgggtggaccatgttttgtcaaaacgttcgttttttgaaagagctgatcgagctggacatctccctgcgaccatcgaatttccgcgattgtgggcagtggttcagacatctgttgtacgccgtcacaaaattgccacagatcaccgaaattggcatgaagcgttggatcctccctgctagccaggaggaggagctggaatgtttcgaccaagacaaaaaacgctctattcacttcgaccatggggggtttcagtag

SEQ ID NO: 30910 - DNA, 1659 bp, Artificial Sequence
  Description of Artificial Sequence: Synthetic coding sequence
atgagtcagacacgcaagaagacttcaagcgaaggagaaaccaagcctcagacatcaaccgtgaataagtttctaaggggctccaacgccgagtcacgcaaggaagataacgaccttaagacttccgattcacagccttccgactggatccagaagacagctacttctgaaaccgctaagcctcttagtagcgaaatggaatggagaagctctatggagaagaatgagcacttcctgcagaagttgggaaagaaagccgtaaacaagtgccttgacctcaataactgcggacttactactgccgatatgaaggagatggtggctctcctgccatttctgcctgacctggaagaattggacattagttggaacgggtttgtaggaggcacccttctgagcatcactcagcaaatgcacctcgtgtcaaagctgaaaattctgagattgggctcttgccggctgactaccgatgacgtgcaggccttaggagaggcattcgaaatgatcccagagttggaagagctcaacctcagctggaacagtaaggtgggcgggaatctgccattgatactgcaaaaattccagaaaggctcaaaaattcaaatgatcgaactggtagattgttctctgacctccgaggatggaacttttcttggccagctgctgccaatgctacagagtctggaagttttagacctttccatcaatagggacattgttgggtcacttaactcaattgcacagggcctcaagagtacaagcaacctgaaggttttgaagttgcacagctgtggactgagccagaaatctgtgaaaattctggatgcagccttccggtaccttggggagctgcgaaagctggacctgtcttgtaataaagacctaggaggcggcttcgaagacagtccagcacaactggttatgctcaaacacttgcaggtgctcgacctgcaccaatgttcccttactgcggacgatgttatgtctctgacccaggtcatccccttactcagcaacctgcaggagctcgacctatctgctaataagaagatgggttctagctctgagaacctgctctcccgcttacgtttcctgcctgccctgaagtcactcgtgattaacaactgcgccctggaaagcgagaccttcaccgcattggccgaggcaagcgtgcacttaagcgcactagaggtattcaatctctcatggaacaaatgcgtgggtggcaacctcaaactcttgctcgagaccttaaaactaagcatgtctttacaagttttgagactgagcagctgtagtctagtgacagaggacgtcgcacttttggccagtgtaatacagactgggcacctcgcaaagctccagaaactggacctgtcgtataatgacagtatttgcgacgcgggttggacgatgttctgccagaatgtacgcttcctgaaagagttaattgagctggacatctctctgagaccctcaaacttccgtgactgcggacagtggtttcggcatctgctttacgcagtcactaaactcccacaaatcacagaaatcgggatgaaacggtggatcctccccgcatcccaggaagaagaattggagtgtttcgatcaggataaaaagcgatctattcactttgaccacggaggctttcaatag

SEQ ID NO: 30911 - DNA, 1260 bp, Artificial Sequence
  Description of Artificial Sequence: Synthetic coding sequence
atgggctcttctagagaggctgctagagcacctgcccggagccccgcgtgggcttctacacaagctagcacccctggtgcagccttggctgtgcagcgagagagccctgagtcgggcttgcagaagcattacagcaatctttgcatggagaagtcccaaaagatcaatccattcatccttcatatcttgcaggaagtggatgaggaaataaagaaggggctcgccgcgggcataacacttaacatcgctggcaataatcgattggtcccagtggagcgagtcaccggggaagacttttggatccttagcaaaattctcaagaactgtttatatattaatgggctagatgtcggctataacctactttgtgacgtcggagcttactacgctgccaaattgctgcagaaacagctgaatctcatctatcttaacctcatgtttaacgatattgggcctgaaggtggtgagctgatcgctaaagtgctgcataaaaaccggacacttaagtacctaaggatgactgggaataagatcgagaataaaggcgggatgttttttgccgccatgctgcaaatcaatagttccctagagaagctcgatttaggtgattgcgaccttgaggaatccaccgtacatgtcggccgtatgcttaaggaaaaccactgcctggtggcgctgcatatgtgtaagcatgatataaagaattccggcatacagcaactgtgtgacgccctgtacctgaactcgtcgctgagatacctggacgtgtcctgcaacaagattacacacgatggaatggtatacttggccgatgtcttgaaaagtaacacaacgctggaagtgattgatttgtcgtttaataggattgagaatgccggggcaaattatctgtcagagaccctgactagccacaacaggagcctgaaggcactgagtgtcgtttctaacaacattgaaggcgaaggtctggtcgctctgtcccagtctatgaagacgaatctgacattctcgcatatatacatttgggggaacaagttcgacgaggcaacttgcatcgcttactcagacctgatccaaatgggttgcttaaaaccagataatacggatgttgaaccttttgtcgtggacgggagggtgtacctggctgaggtaagtaacggtctgaagaagcattattattggacaagcacttacggtgaaagctacgatcattccagcaacgcagggtttgctctggttcccgtcgggcagcaaccatag

SEQ ID NO: 30912 - DNA, 1395 bp, Artificial Sequence
  Description of Artificial Sequence: Synthetic coding sequence
atggctgcccagccacctcggcccgtcggtgaaaggagtatgggctccagtcgagaggctgcgagagcccccgcgagatcccctgcctgggctagtacgcaggcatctacacccggggcagcactggccgtgcagagggaaagcccagaatccggcttacaaaaacactactcgaatttgtgcatggagaagagccagaagataaacccgttcattttacacattcttcaggaagtggacgaggaaatcaagaagggcctggcggccgggattaccctgaacatagcagggaataatcgcctggtgcctgtcgaaagggttactggggaggatttttggattttaagcaagattctgaagaactgcctgtatattaacgggttggatgtcggatataacctgctctgtgatgtcggagcatattatgcagctaaactgctacaaaagcagttaaatttaatctacctaaatctcatgttcaatgatattggtccagagggcggtgaactaattgccaaggtgcttcataaaaaccggactcttaagtatttacgtatgacaggtaacaagatagaaaacaagggcggtatgttcttcgctgcaatgcttcagatcaatagctcgctggagaagttggatctcggagactgcgatctaggaatgcagtctgtgatagctttcgcaacagtcctgacacagaaccaagccattaaggcgattaacctgaataggccaattctgtatagcgagcaggaagaatcaacagtccatgtgggccgaatgctcaaggaaaaccactgtctcgtggcattacacatgtgcaagcatgatattaagaactccggaattcaacagttgtgtgatgccctgtatcttaatagctcactgcggtacctcgacgtatcgtgtaataagattacgcacgatggaatggtctatctggccgacgtactgaagtctaatacaactcttgaggtaatcgatctgtcatttaatcggatcgaaaatgccggagcaaattacttatccgagacccttacctcccacaatcggagcttgaaagcactgtcggtcgtcagcaacaatatcgaaggcgaaggcctggttgcgctaagccagtctatgaaaaccaacctaacattttctcacatttatatatgggggaacaagttcgatgaagcaacctgtatcgcctattccgatctcatccaaatgggctgcctgaaacccgataataccgacgtggagcctttcgtggtcgatggaagggtctacctcgctgaggtcagcaatggacttaagaaacactactactggacttccacgtatggggaatcatacgaccattcttcaaacgcggggttcgccttagtcccagtgggccagcagccctag

SEQ ID NO: 30913 - DNA, 1299 bp, Artificial Sequence
  Description of Artificial Sequence: Synthetic coding sequence
atggctgcccagccgccaaggcccgtcggagagcgctccatgggctctagcagagaagcagctagagcccctgctcgatccccagcctgggcaagtacccaggcgagcacacccggcgcagcactggctgtccagcgggaaagccccgaaagcggactgcagaagcactactctaatctctgtatggaaaagtctcaaaaaatcaatccattcatcctgcatattctccaggaggtagatgaagaaataaaaaagggtctcgcagccggcatcaccctaaacatcgccggcaataaccgcttagttcccgttgagagagtaactggagaggacttctggatattatcgaagattctgaagaactgtctgtacatcaatgggctcgatgtcggctataatctgttgtgtgatgtaggtgcttattatgccgctaaactcctccagaagcagctcaacctcatatacctgaatctgatgttcaacgacatcggccctgaggggggtgagctgatcgctaaggtcttgcataagaacaggacactgaagtatctccggatgacaggtaacaaaatcgaaaacaagggaggcatgtttttcgcagctatgctccaaataaacagctcgctcgagaagctggacctgggagactgtgatcttgaagaaagcactgttcacgtaggccgaatgcttaaggaaaaccactgtctcgttgcactgcacatgtgcaaacacgatatcaaaaattcaggcatacagcagctgtgcgatgctctttacctcaactcaagccttaggtacttggacgtaagctgtaacaagatcacccacgacggaatggtctacctggcggacgtcctgaaaagtaatacgaccctggaggtgatcgatctcagcttcaaccgcatcgaaaacgctggcgccaattacttatcagaaactttgacaagccataatagaagcctgaaggccctctctgtagtgtccaacaacattgagggcgaggggctggtcgcgctgtcacaaagcatgaaaactaacctgacgttctctcacatatacatttggggtaacaagtttgatgaagcgacctgcattgcctacagcgaccttatacagatgggctgcttgaagccagataacacggatgtggaacccttcgtggtggacggaagagtctatcttgctgaggtgtcaaatgggctgaagaaacactactactggaccagcacttatggtgaatcctatgaccactcatcaaacgctgggtttgccttagtcccagtgggccaacagccatag

SEQ ID NO: 30914 - DNA, 981 bp, Artificial Sequence
  Description of Artificial Sequence: Synthetic coding sequence
atgacccgtgaagggtaccaggtgtctttcctcgataataaaagcagtggctcctccccggagaaggagctgatccctaaacccgatacatttcacttgacgcacgatgctagcctgtcaaagtgcctggacgtgggagattcttcacagatccacccatatcagctgccgtcagatgtcggactcgaaaattacgatagttgttacagccagacactctccttgcatggcagcctcggcaaaagaccacagaggtctaagaactaccaggagtattcaatcaagcccagcaatgacatcaaaacaaccgcatcgcatagctgtggtgacttgttaacaagtctctcaaaccccgactcaagtacaggccggctcctgaagctctccagtgatctgtatgccacgactcactttaatagtgacccagcagtgctggtaaatgttgaacagcagctttccacatcactcgatgatctgacccccgcacacgggtcagtcccaaataatgcagtcctgggaaaccggacaacacccctccgaacactgctgctcagtcccgggactagcgaacacagaaaaatttttaccaagagatctctgagccctagtaagagaggcttcaaatggaaagataacatcctcgccaatctcaatcttaagcatggctttcaggatgctacaggtagcgagcccttgtcttccgaccttggtagcctacatggtttggccggaaaccactccccaccaatatcggcaagaacccctcatgttgcaactgttctcagacaactccttgaattagtggacaaacattggaacggtagcggtagtctcctgctcaacaagaagttccttggcaaatttgaggcaaagaccggacagtctgcaggagggaagccccactttgtgaggaagaactcaactgtcggcggaagatgctgtcacctcaactgcgagtgggctactgtcacatatctctag

SEQ ID NO: 30915 - DNA, 2265 bp, Artificial Sequence
  Description of Artificial Sequence: Synthetic coding sequence
atggctgaacagtgggagctagacgaagagggaattcgtcgtctgggagcactgacccttgaacaacctgaattggtcgagtcgttgtcattgcagggaagctatgctgggaaaatccactcaatcggcgacgcctttcggaatttcaaaaacctcaggtcactggacttgagccggaacctgatcacctcccttaagggtattcaatacttgtgtagtctgcaggacctgaacttgtattataacaacataccttcactggtggaggttagccggctgcaaccactgcccttcctgaaagaattagacctgagattaaatccagtagttagaaaagacacagattatcgcttgtttgccgtgtatacattgcaaactctcgaaaaattggatgatcgtactgtcagagaaggggagaggaaagctgccaagctccacttctctcagttgggcaactctgaaaacttcctgctcgaagtagaaaagagcagtagggagaagaccatgaaaaactgcgtgaccggcgaatctagcgcaagcaaggtgagtgctaacgtggactcaagaatcgaaatggacagtaacaaaggcttgtttatcccatttccaaatcgagagatcaaggactcactgtctacgagtgcaacgcagggaaacggtacccgcgatcagaaactggatacttttcctctggggacccagacccaagaagtggcacgtagggagatgcctagtgacaatcatcaagaggacgaattccgtcactattccccacgtcaaagcacagtcagatctccagaaaaaatgactcgggagggatatcaggtatccttcctagacaacaaaagttctgggtcttccccagaaaaggagctgattcctaaacctgacacatttcacctgactcatgatgcatcactgagcaaatgcctggacgtcggtgactcctctcaaatccacccatatcagttacctagcgatgtaggcttggaaaactacgattcatgctattcccagactctgtctcttcacggatctctgggtaagaggcctcaacgtagcaagaattaccaagaatattctatcaagccttctaatgatattaagacaaccgcctctcacagttgcggagacttgctcacttctctgtctaaccctgattctagtacaggccgcttgctgaaattgtcctctgacctgtacgcaactactcattttaatagcgaccccgccgtgctagttaatgtcgagcagcaattgtcaacatcgctggacgatctcactcctgcccatggctctgtgccaaacaatgctgtcctgggaaaccgcaccactccactgcggactctgctgctatctcctggaactagcgaacaccgcaagatttttacaaagaggtcgctgagtccaagcaaaagaggcttcaagtggaaggacaacatcctggccaatctgaatcttaagcacgggtttcaggatgcgacgggatcggagcctctttcgagtgatctggggtctttgcacggccttgccggaaaccattctccaccgatttcagcccgcactccccatgtggctactgttttgcgccagcttcttgagctcgtggacaagcactggaacggcagcggaagcttgttgttaaacaaaaaatttctgggtcccgcaagagatctcctgttatccctggtcgtaccagcccccagtcaacccaggtgttgcagccatcccgaggataccatgaaagccttttgccgccgcgaacttgaactcaaggaggctgctcagctggtgcccaacgacatggaatcgcttaagcaaaagctagttcgggtcctggaagagaacctgattctgtcagagaagatccagcagcttgaagagggagctgccattagcatcgtttcggggcagcagagccatacctatgacgatttgttgcataagaaccagcagctcactatgcaggttgcgtgtcttaaccaggaactcgctcagctcaagaagttggagaaaacggtggccattcttcacgaatcacaacgatcacttgttgttaccaatgagtacctgctacagcagctgaataaagagcctaagggatactcgggtaaagcgcttctgcccccggaaaaaggccaccaccttggccgctcttcccctttcgggaaatcaaccctctcatccagctcccccgtggcgcatgagacagggcagtatctaatccagtcggtgcttgacgccgcgcctgagcccggattatag

SEQ ID NO: 30916 - DNA, 1590 bp, Artificial Sequence
  Description of Artificial Sequence: Synthetic coding sequence
atgcttcgcccccgctttttgccccctgacgatcggaccgtgcgcgagggagagcggaaggccgccaagctgcatttctcccagctgggcaactcagagaacttcctgctcgaagtggagaaatcttcaagagaaaagactatgaagaattgcgttacaggcgaaagttcagcaagcaaagtttccgcaaacgttgatagcagaatcgagatggactctaataagggtctgtttatcccgttccccaatagggagattaaagacagtttgagtaccagtgcaacccagggcaacggcacccgtgatcagaagctcgatacctttccactgggcacacagacacaagaagtggccagacgggagatgccaagtgacaaccaccaggaggatgaattcaggcattactcacctcggcagtctaccgtgcgatctccagagaagatgactagggaaggttaccaggtgtcctttctggacaacaagagctcaggctccagcccggagaaagagcttatacccaaaccggatacctttcatttgacgcacgatgcaagtttaagtaagtgcctggacgtgggagactccagccaaatccacccctatcagctcccctcggatgtcgggctggaaaactatgattcctgctatagccagactctctcactgcacggatcattaggcaagcggccccagcgcagcaaaaactaccaggaatatagtatcaagccttcaaacgatatcaaaaccacggcttctcactcttgtggggatttgttgacgtcacttagtaaccccgactcgagtaccggacgtcttctgaagctgtcaagcgacctctatgccaccacacattttaatagcgatccagcagtgctagtgaatgtggaacagcaactgtccaccagtctggacgatttgactcccgcacatggaagtgtgccaaacaatgcagtcttaggcaacagaaccacccctctacgaacactccttctgagccccggcacttccgagcaccggaagatctttacaaaacggagtctctctccaagtaaacggggatttaagtggaaggataatattctggctaatctgaatttaaaacacggattccaggacgccactggaagtgaggaatcccttaagcagaaactcgtacgagtcctggaggagaatctgattctatcagaaaagatccaacagttggaagagggagctgctattagcatcgtcagcggccagcagtcccatacgtatgacgacctgctccataaaaaccaacagttaacaatgcaggtggcctgccttaatcaggagcttgcccagctcaaaaagcttgagaagactgtggccatcctgcatgaatctcagcggtcactggtagtgacaaatgagtatctccttcagcaactgaacaaggagcccaagggttattcggggaaggccctgctgcccccagaaaaaggacaccacctaggccgaagctccccctttggaaagtctacactcagcagctcctctcccgtggctcacgagacaggacagtatcttatccaaagcgtgctggacgctgccccagagccaggactatag

SEQ ID NO: 30917 - DNA, 681 bp, Artificial Sequence
  Description of Artificial Sequence: Synthetic coding sequence
atggaagggcagtacccatgccagcctgaatctaaagcgtggttcccccggtgttatcggcaaagggtgacatgggtagtttgtactgtgtggcttgagacaacagtgccaccgagcttgcccgagcctcctatgtggccactttccagcgacagctcgtggtcattgtggatcagcactggtatggctcctgcccccagcagctcgaccaggagtttctccgagtctctcaaacagaagctcgtccgggtgctcgaggagaatctgatactgtcagagaagattcagcagttggaggagggcgccgccatatccatcgtctctgggcaacagtcacacacttacgacgatcttctacacaaaaatcagcagctcaccatgcaagttgcgtgcctgaatcaagaattggcccagcttaagaagttggagaaaacagttgctattctgcacgaatcacagaggagcctggtcgttaccaatgaatatcttctgcaacagctcaacaaagagcccaagggatacagcggtaaagccttgttgcctccagagaaaggtcatcacctgggccggtctagtcctttcggcaagtctactctttcctctagctcaccagtcgctcacgagacaggtcagtacctaattcagagcgtgctagacgccgcacccgaaccaggattgtag

SEQ ID NO: 30918 - DNA, 1902 bp, Artificial Sequence
  Description of Artificial Sequence: Synthetic coding sequence
atgctgcggcctcgcttcttacccccagatgatagaacagtgagggagggagaacgcaaggcggccaagcttcatttctcccaacttggtaatagcgaaaattttctactggaagtcgaaaagtcatcacgggaaaagaccatgaagaattgtgtcactggagaaagttccgcctcgaaagtgtctgccaatgtggatagccgaatcgaaatggatagcaacaaagggctgttcatacctttccccaacagagagattaaagactctctaagtacatctgctacacagggaaacggcacccgggaccaaaagctcgatactttccccctgggaactcagactcaggaagtggcccgacgtgagatgccttccgacaaccatcaggaggacgagtttaggcactacagtccacgacagagtacagtgcgaagtcccgagaagatgacacgtgaagggtatcaggtgtcatttttggacaacaagtcatcagggtccagccccgaaaaagagttgattcccaaacctgacacgtttcatctgacccacgatgctagcttgagcaaatgtcttgatgtgggagactcatctcagatccacccatatcaactaccctccgatgtgggcctggagaattacgatagttgttattcccagaccctgtccctccatggctccttaggtaagcgcccacagcgtagtaagaactatcaggaatactctatcaaacccagtaatgacattaagacaactgccagtcactcttgcggtgaccttctgaccagcctcagtaatccggattcttcaaccggtcggctcctcaagctcagctccgatctgtacgcgaccacacacttcaatagtgaccccgccgtgctcgtgaatgtggagcagcagttatctacaagtctcgatgacttaacgcccgcacatggctctgtccccaacaatgccgtgctgggcaacaggaccacgccattgaggacactgctgttgtctcccggaacttccgagcatagaaagattttcaccaaacgttctctgagcccgagcaaacgagggttcaaatggaaggataacattctcgcgaacttgaacctaaaacacggcttccaggatgccacgggaagcgaacctctgagctccgacctgggatctcttcacggcctcgcaggtaatcacagtccccccatttcggcacgcaccccacatgtggccacggtcctgcggcaactcctggagctagtcgacaagcactggaacggctcgggctcgctgctgctgaataagaagtttctgggtcccgctcgggatctgctgctcagtctggtagttcctgccccgtcacaacccaggtgttgcagccatccagaagacacgatgaaagcattctgtcgtagggagctggagttgaaagaggctgctcaacttgttcctaacgatatggagtcattgaaacagaagctggtgcgagtgttagaggagaacttaatcctgagtgagaaaattcagcagctcgaagagggggcggctatttcaattgtcagtggccaacagagccatacttacgacgacctgctgcacaaaaatcaacagctaacgatgcaggtggcctgcctgaatcaggagctcgcccagctgaagaaactcgaaaaaactgtggccatcctgcacgagtcccaaagatcacttgtcgtcaccaacgaatacctcctgcagcagctcaataaggaaccgaagggatacagcggaaaggcactgctacctcccgaaaaaggacaccatctgggccgatcatccccattcggcaaatctacactttcatccagctccccagtggcccatgagacagggcagtatctgattcagagtgtattggatgccgctccggaacccgggctttag

SEQ ID NO: 30919 - DNA, 5103 bp, Artificial Sequence
  Description of Artificial Sequence: Synthetic coding sequence
atgtcttccgcacagtgtcctgccctggtgtgcgtaatgagcaggctgcggttctggggcccctggccgcttttaatgtggcagctgctctggctgctggtgaaggaggcccagcctttagagtgggtgaaagacccgttacagcttacgagtaatccactgggcccccccgactcatggtcgagtcattcctcccactttcctcgtgaatcaccccacgcaccgactctgccagccgacccctgggactttgatcacctggggccttccgcgagttctgaaatgccagctccacctcaagagagtactgaaaacctagtgcctttcctggatacctgggattccgcaggcgaacagcccctcgagcctgaacagttcctggcgtcccagcaagatctcaaggataagctgagcccccaagagcgcctaccagtatcacccaaaaagcttaagaaggatccagcccaaaggtggagtttagctgagataattggcatcacaagacagctctcaaccccccagtctcaaaaacagactctgcaaaatgaatatagctctactgatacgccttatcccgggagcctgccgccagaattgcgggttaaatcagacgagccccctggccccagtgaacaggtgggaccgagccagtttcatttggagccagagacacagaatcctgagacacttgaggacattcagtcctcctcactccagcaggaagctcctgctcaattgccccagctgttggaagaggagccttccagcatgcagcaagaagcccccgcactcccacccgagtcctctatggagtccctaacccttcctaaccatgaagtcagcgtgcagcctcccggtgaagatcaagcttactaccatctaccaaacatcactgtgaagccggctgatgttgaggtcacgatcacgagtgaacctacaaatgaaaccgagtccagccaggctcaacaggagacacccattcagttccctgaggaggttgaaccttctgccacccagcaggaggctcccattgaacctcccgtgcctcccatggaacacgagttaagcatcagcgagcagcagcagcccgtgcagcccagtgagtctcccagagaggtggagtcttcacctactcagcaggaaacccccgggcagcctccagagcaccacgaggtaactgtgtcacctccaggccatcatcagacgcaccatctggcatccccaagtgtttcggtcaagccccctgatgttcagctcaccatcgctgccgaaccttccgccgaggtcggcactagtctagtccaccaggaagccaccacaagactgtcaggctcaggaaacgacgtagaaccccccgccatccagcacggcgggccaccattattaccagaatctagtgaggaggccggacctctagcggtgcagcaggaaaccagtttccagtcccctgaacctatcaataacgagaaccccagcccaacacagcaagaggctgccgccgaacacccacagacagcggaggaaggcgaaagcagtctaactcatcaggaagcgccagctcagacccccgaatttcccaatgtggtggtcgcccagccaccagaacattcccacttaacacaggctaccgtacaacctctggatttgggctttaccatcactccggaatccaaaaccgaagttgagctcagccccactatgaaggaaactcccactcagcccccgaagaaagttgtgccccagctgcgcgtgtaccaaggggttacaaacccaacaccaggacaagaccaggcacagcatcctgtcagtcccagcgtaacagtacagttgctcgacctggggctgacgatcactcctgaacccactacagaagtgggccatagcacaccgcccaagagaaccatcgtttcccccaagcacccagaggtcacgttgccacaccctgaccaagttcaaacacagcattcccatttaactagggcaaccgtgcagccattagatttgggcttcacgatcactccaaaatcaatgacggaagtcgaaccgagcactgccctcatgaccacagccccccccccgggccacccagaagtaacactccccccctcagacaagggacaggcccagcattcacacctcacccaggcgaccgttcagccattggatctcgagctgacgatcactacgaaacccacaactgaggtcaagccatctcctaccaccgaggagacatcaacgcagcctccagatctgggcctggccataatccccgagcccacaacagagaccagacattccaccgcactggaaaagactacagctccccggcctgaccgggttcaaaccttgcatcgctcacttacggaggttaccgggcccccgaccgagttagaaccagcccaggattcgttggtgcaatccgagtcatacacgcagaataaggctttgaccgcaccggaagagcataaggctagcacgagcaccaacatctgcgagctttgcacatgtggggatgagatgttaagttgtatcgatctcaaccccgaacaacgcctgagacaagtccctgtgcccgagcccaacacccataatggtacgttcactattctcaacttccaaggaaactatataagctatattgacggcaacgtgtggaaggcgtactcgtggaccgagaagctgattttgcgggagaacaatctgaccgaactgcataaggatagttttgaggggttactgagcctacagtatctggacttgtcttgcaacaagattcagagcattgagcgtcacacctttgagcctctgcccttccttaaatttattaacctttcatgtaatgtcatcaccgagttgtcctttggaactttccaagcatggcacggaatgcagttcctccacaagctgattttgaaccacaaccctctgacaacagttgaggatccttacctctttaagcttcctgccctcaagtacttagatatgggtactacgctggttcccctgactaccctgaagaacatcttgatgatgaccgtggagctggagaagctcatccttccctcgcatatggcttgttgcctttgtcagttcaaaaattcgattgaagcagtttgtaagactgtcaaactacattgtaactcagcttgcttaaccaacacaactcactgtcccgaggaagcgagtgtgggtaatcccgagggtgccttcatgaaagtccttcaggcaaggaagaactatacatcaaccgaactgatcgttgagcctgaggaaccatcagatagcagtggtattaatttgagcggattcggaagtgaacaactggacacgaacgacgagtcggactttatatctactctgagctacattctcccctatttcagcgcagtgaacttagatgtgaaatcactgctccttccttttataaaactgcccaccaccggcaacagtctggcaaagattcagacagttggccagaataggcagcgggtgaaacgcgtactgatggggccaagaagtatccaaaaacggcacttcaaagaggtgggcaggcaaagtatcagaagggagcaaggcgcccaggcttctgtagagaacgcggccgaggaaaagcgtttgggctctcccgcaccaagagaggtggagcagccccacactcagcaggggcctgaaaaactggcaggcaacgccgtctacaccaagccgagcttcacacaggaacacaaagcggcagtgtctgtactcaaaccattttctaaaggggcacctagcacatcatcacccgccaaggctctaccccaggtccgagaccgctggaaagacctcacccacgctatctccatactcgagtcagctaaagctagagtgacgaatacaaaaaccagcaaaccgatagtccacgcacgcaagaagtatagattccataaaacgcgctcacatgtaactcacaggacacccaaagtgaagaaatctcctaaagttaggaagaagtcttacctgtcccgcctgatgctggccaaccgcctgcccttcagcgcggcaaaatcccttattaatagccctagccagggtgcttttagctctctcggggatctcagcccacaggaaaatcctttcctcgaggtttccgcaccttccgaacatttcatagagaacaataataccaagcacaccactgctcggaatgctttcgaggaaaatgatttcatggaaaataccaatatgcccgaggggactatctccgagaacacaaattataaccacccgcatgaggctgacagcgcgggaaccgcctttaacctcgggcccaccgttaagcaaaccgaaactaagtgggaatacaacaacgtggggaccgacctcagccccgagcccaagtcctttaactaccccctcttaagtagccccggagaccagttcgaaattcagctgactcagcagttacagtcgctaattcctaataataacgtgcgcagactgatcgctcatgtgattaggacccttaaaatggattgctccggagcacacgtgcaggttacttgtgcaaagcttattagtcggacgggacatcttatgaaactgctttcaggacagcaggaagtgaaggcaagcaagatcgagtgggataccgatcagtggaagattgaaaactatattaacgagagtactgaagcccaatctgagcagaaggagaagtccctcgaactcaaaaaggaagttcccgggtacggctacacagataaactcatactcgctcttatcgtgaccggcatcctgaccatcctgattattctattctgcctaatcgttatttgttgccaccggaggagtttgcaggaggacgaagaagggtttagccgcggtatttttaggtttctcccctggcgcggttgctcttcccgcagggaaagccaagacggtctgagcagctttgggcaacccttgtggtttaaagacatgtataaaccgctcagtgccactcgcatcaacaaccatgcttggaaactgcataagaagagcagcaacgaggacaagatcctgaatagggatccaggggacagcgaagcgcccaccgaagaagaggaaagtgaggcgttgccgtag

SEQ ID NO: 30920 - DNA, 5103 bp, Artificial Sequence
  Description of Artificial Sequence: Synthetic coding sequence
atgagcagcgcacagtgccccgctctggtctgcgtgatgtcccgcttgcgcttctggggcccatggcctctactcatgtggcagcttctctggctactcgtgaaggaagcccaacccttagaatgggtgaaggatccactgcagctgacatccaacccactaggaccccccgattcttggtctagccattctagtcatttccctagggagagcccccacgcacccacgcttccggccgatccatgggacttcgaccacttaggaccctccgcaagcagcgagatgcccgcacccccacaggaatccaccgaaaatctggtgcctttcctagacacatgggacagtgcaggtgagcagccattggaacccgagcagtttttagcttcccagcaggatttgaaggataagttgagccctcaggagcgactacctgtatcccctaagaagctaaagaaagatccagcacaaagatggtcactggctgaaatcattggcataaccagacaactctccactcctcagagccagaaacaaacccttcagaatgagtactcttcaactgacacaccctaccctggctctctcccacctgaattaagagtgaagagcgacgagcctcctggcccctctgagcaggtcggccccagtcaatttcatctcgagcctgaaacacagaatcctgagacactcgaagacatacaatctagctccttacaacaagaggcacctgcacagcttccccagcttcttgaagaggaaccttcgagcatgcagcaagaagccccagctctgccgcccgaaagcagtatggagtccctgactctcccgaatcacgaagtatcagtacagcccccaggggaagaccaagcctattaccacctgcctaatataaccgtgaagccggccgacgtggaggtgaccattacgtccgagccaaccaacgaaacagagtccagccaagcacagcaagagacacccattcagttcccggaggaagtagagccgtccgccactcagcaggaggcccccatagagccacccgtaccaccgatggagcatgaattatcaattagtgagcagcagcagcccgtgcagccatctgaatcccccagagaggtggagagctcaccaacgcaacaggaaacccctggacaacctccagaacatcacgaggtgacagtgagcccacctggtcatcaccagacacaccatctggctagcccatctgtgtctgtgaagcctccagacgtccagcttactatcgcagccgaaccctccgccgaagttggcacatcacttgtacaccaagaggccaccactaggttatctggttctggtaatgatgtggagccgcctgcgattcaacacggcggcccccctttgttgccagagagctcagaagaggcagggcccctggcggtgcaacaagaaactagtttccagtcccctgagccaattaacaacgaaaaccccagccctacccagcaggaggctgccgcggagcacccgcagactgctgaagagggggaaagtagtctaacacaccaggaggcacccgcccaaactcctgaatttccaaacgtcgtggttgcccaaccgcccgagcactcccacctcacacaagccacagtgcaacctttggacctagggttcacaatcacacctgagagtaaaacagaggtagagctcagccctaccatgaaagagaccccgacccagccacctaagaaagtggttccccagctgagagtgtaccagggggtcacgaacccaacacccggacaggatcaggctcagcaccctgtgtcaccatctgtgaccgtacaacttctggatttagggttaacgatcacaccagagccaactaccgaggtcggccattcgactcccccgaagcgaacgatcgtgagccccaaacacccagaggtgaccctgccacatccggatcaggtgcagacacaacactcacatctgacacgagccaccgtgcagcctttagatctcggctttaccattacccccaaatctatgacagaggtggagccttcaaccgcgctgatgaccacggcccctccccctggccaccctgaagtgacattgccaccaagtgacaagggacaggcccagcactctcatctgacacaggcaaccgtacaaccacttgatctcgagttgacaattactaccaagcccacaaccgaggtgaaaccatcccccacaaccgaggaaaccagcacacagccaccagatctgggcctggcgataatccccgaacccactacagaaacacggcatagcactgcacttgagaagacaacagcaccgcgaccagatcgcgtgcagaccctgcatcgttcactgaccgaggtaaccggcccaccaactgagctagagcctgcccaggattccctcgtgcagagcgaaagctatacccagaacaaggccttaaccgcgccagaggagcacaaagcaagtacaagcacaaacatctgcgaactatgtacttgtggcgatgagatgctctcatgtattgatcttaaccccgaacaaaggttgcgtcaggtgccggtgcccgagcccaatacacataacggtaccttcacaatcctgaactttcagggcaactacatctcctacattgatggcaacgtgtggaaggcatacagctggaccgaaaagttgattctaagggagaacaaccttactgagctccacaaagactcctttgagggcttgttatccttgcagtatctggatctgtcttgtaacaagattcagtcaattgagcggcacacgttcgaacctttgcctttcctgaaattcattaacctcagctgtaatgtcatcactgagctgtctttcggaacatttcaggcctggcacggaatgcagttcctgcacaaactcatactaaatcacaaccctctaacaaccgtcgaggatccgtatctgtttaagctgcccgcgctgaagtacctggatatgggcacgaccctcgttcctcttacaaccctgaagaatattctgatgatgaccgtggaactcgaaaagctgatactgccatcgcacatggcctgctgtttgtgccaattcaaaaacagtatcgaggctgtgtgcaagactgtgaaactacactgcaactcagcttgtctgaccaacaccactcactgcccagaggaagcctctgtaggaaaccccgagggagcctttatgaaagtgctgcaggctcgtaaaaactatactagcaccgaattaattgtggaacccgaggagccctctgactccagcgggattaacctctccggtttcggctcggaacagttggacaccaatgacgagtccgacttcattagcacgctgtcgtatattttgccttacttcagcgccgtcaaccttgacgtgaagtcacttctcctccctttcatcaaattgcccacaaccggcaattctctggccaaaatacagaccgtgggacagaacaggcagagagtgaagcgggtgctcatgggccctcggtctattcagaagcgccattttaaagaggtcgggcgacagagtattcggcgtgagcagggcgcccaggcttctgtggagaatgctgcggaagagaagcggctcggtagcccagcgcctagagaggttgagcagccgcatacccagcaggggcctgagaagctggcagggaacgccgtctatacaaaaccgtcttttacccaggaacacaaagccgccgtgtctgtcctgaagccattctctaaaggcgcgccaagcacgagctcacccgccaaggctctgcctcaagtgcgggatcgatggaaggacctaacgcacgccatcagtatactagaatctgccaaagcccgggtcaccaataccaagacctctaaaccaatcgttcatgcacgaaagaagtacaggtttcataaaacacggtctcacgtgacccaccgaacaccgaaggtgaaaaaaagcccaaaggttaggaagaaaagttacctgtctcggcttatgctggctaatcggctgcccttcagcgctgctaagtccttgattaattcacctagtcagggcgcattttccagtctcggagacctatccccacaggagaacccttttctcgaagtgagcgctcctagtgagcacttcattgagaataacaataccaaacacacaacagctagaaatgccttcgaagaaaatgactttatggagaacaccaacatgcctgagggtaccatctccgaaaacacaaactataaccaccctcacgaggccgattctgctggaacagcattcaaccttggaccgaccgtgaaacaaactgagactaaatgggagtataataatgtcgggacagatctgtcacccgagcccaagagtttcaactatcccctgctgtcctcccccggcgaccaatttgaaatccagctgactcaacagctacagtcccttattcccaataacaatgtacgtagactgatcgctcacgtgattcggaccttaaaaatggattgttccggggcacacgtgcaggtgacatgcgcaaaactcatttccagaaccggccacctgatgaagctgttgtcgggccagcaggaggtgaaagcgtccaagatcgagtgggacacagatcagtggaagattgagaattacatcaacgagagcacggaggctcaatctgagcaaaaggaaaagtctctggagctcaagaaggaagtacccggctacgggtacaccgacaaactgatcctcgcgctgatcgtgaccggaatcctcaccatattaattatcttgttctgcctgattgtcatctgttgtcataggcgcagtttgcaggaagatgaagaaggttttagtcgaggaatattccggttcctgccctggcggggctgctccagtcggagagagtcccaagatgggctctcttcgttcggccagcccctgtggtttaaggacatgtataaaccgctctcagccaccagaatcaataaccatgcctggaagctgcacaagaagagttccaacgaagataagatactgaatagggatccaggcgatagtgaggcgcctacagaagaagaagagtcagaggcgctcccttag

SEQ ID NO: 30921 - DNA, 1008 bp, Artificial Sequence
  Description of Artificial Sequence: Synthetic coding sequence
atgactgaaaatgtggtatgcacaggggccgtaaacgccgtgaaagaagtgtgggaaaaacgaatcaagaaactaaacgaggatctaaaacgtgagaaggaatttcagcacaagcttgtgcgcatttgggaggagagagttagtctgaccaaattgcgagagaaggtcactcgggaggacggtcgcgtgatactcaagatcgaaaaggaggaatggaagactttacctagttccctcctcaagttgaaccagctgcaagagtggcagttacacaggacgggactactgaagatccctgagttcattggcagattccagaacctaattgtgctggatctgtcccgaaatactatctccgagatcccgcccggtattggcttattgacaagactgcaagagctgatactgagctacaataagattaagacagtgccaaaggagctttctaattgtgcgtccctcgagaagctcgagttggcagtgaatcgggacatttgcgacttgccacaggagctctcgaatctcctaaagctgactcacctagatttgtctatgaatgactttacaacgatcccacttgccgtccttaatatgccggcactggagtggttggatatgggtagtaacaagttagaacaactgccggatactattgagcgaatgcagaaccttcataccttatggttgcagcgaaacgagatcacctgtctcccacagaccatttcaaacatgaaaaacctgggcactctggtgctgtccaataataagttgcaagacattccggtatgtatggaggaaatggccaacctcagatttgtgaatttccgagacaaccccctcaagctaaaagtgtcactgcccccttctgagggtaccgatgaggaggaagagcgcgagctattcggcctccagtttatgcacacatatatccaggagtctcgcagacgtgccgatcaccaggtcaatggttcaacaacgttgcccatctctataaatactgacgggtag

SEQ ID NO: 30922 - DNA, 1020 bp, Artificial Sequence
  Description of Artificial Sequence: Synthetic coding sequence
atgaccgaaaacgtagtttgtacgggtgccgtgaacgctgtcaaagaagtgtgggagaagaggataaagaaactgaatgaagacttgaagcgcgagaaagaattccagcataagttagtccgtatctgggaagagagagtgagcctgactaaactacgagaaaaggtgacgagagaagacggaagagtgattctaaaaatagaaaaggaagagtggaagacactcccttcttcgctcctcaagttaaaccagctacaggaatggcaactccatcgcactggattactcaagatcccagaattcatagggagatttcagaacctaattgtgctggacttgtccaggaacacaattagcgagattccccccggcataggactgctgactaggttacaagagttgatcctgagctacaataaaatcaaaactgtgcccaaggagctctctaactgcgcctccctggaaaagctggagctggctgtaaatagagatatctgcgatctaccacaagaactgtcaaacctgctgaagctcactcacctggatctgagcatgaacgattttacgaccattccattagctgtgctgaatatgcccgctctagaatggctggacatgggctcaaacaagcttgaacagctccctgacacgattgagagaatgcaaaacctccatactctttggctgcagcggaatgagataacgtgtctaccccaaactatcagtaatatgaagaacctaggcaccctggtgctctctaacaataaactgcaggatatacctgtgtgtatggaagaaatggctaatctccggttcgtcaacttcagggataacccactcaagctgaaggtgagtctgcctcctagcgaggggacagacgaagaggaggaacgagagctgtttggcctccagtttatgcacacctacattcaggagagccggcgccgagccgccctgcagttttgcgtgtgccatggacaaattctgactatctatacctgcatggccctggagatatag

SEQ ID NO: 30923 - DNA, 1008 bp, Artificial Sequence
  Description of Artificial Sequence: Synthetic coding sequence
atgacggaaaatgtcgtatgtactggcgctgttaacgctgtgaaagaggtgtgggagaagcggataaagaagctgaatgaagacttgaagagggagaaagagttccagcacaaactggtaaggatctgggaggagcgagtatcgctgaccaaactgcgggagaaggttactagagaggatggtcgagttatcttaaagatagagaaggaggaatggaagaccctgcctagttcgctcctaaagttgaaccaactccaggagtggcagttgcatcggacagggctcctgaaaatcccagagttcataggaaggttccagaatcttatcgtgttggacctgtctcgcaataccatttccgagattccaccaggtattggactactgactagactccaggaacttattctgagctataataagataaaaactgttccaaaggaactttcgaattgtgcaagtctggaaaaactcgagttggctgtaaaccgggatatctgtgatcttccgcaggaactgtccaatctgctcaaattgactcacctcgacttgtctatgaacgactttaccaccatccctttagccgtgctgaacatgcccgcacttgagtggctggatatgggatccaacaaactggagcagctcccagatactatcgagcgtatgcagaacctgcataccctgtggttgcagcggaacgagataacctgcctccctcagaccatctccaatatgaagaatctggggactctggtacttagcaacaacaagcttcaggatatcccagtgtgtatggaagagatggctaacttgcggttcgtgaattttagggacaaccccctaaagctgaaggtttccctcccacccagcgaggggaccgatgaagaggaggagcgcgaactcttcggtctgcagtttatgcacacatacattcaagaaagtaggcgtagagcggatcatcaggtgaacggcagcacaacactgcccatcagcatcaacaccgacggatag

SEQ ID NO: 30924 - DNA, 1020 bp, Artificial Sequence
  Description of Artificial Sequence: Synthetic coding sequence
atgacagagaatgtggtttgcaccggcgccgtcaacgccgtgaaagaggtgtgggagaaacgaatcaagaaactgaacgaggatcttaagagggagaaagagttccagcacaagctggtaaggatctgggaagaacgcgttagtcttacaaagcttcgagaaaaagttacccgcgaagatggcagggtgattctgaagatcgagaaggaggagtggaagacccttccttccagcctcctcaaactcaaccagctgcaggagtggcaactccatagaaccggactactgaaaatccccgagtttattgggagatttcagaatctgatcgtgctcgatctttcacgaaataccatcagcgaaatccccccggggattggcttactgacccggctgcaggagctgatcctcagttataacaaaatcaaaactgtcccaaaggagttgtctaattgtgcctctctggagaagcttgagctcgccgtgaaccgggatatatgcgatctgccccaggagctgtccaacctactgaagttgactcacctcgacctttccatgaacgacttcacaaccattccgctagcagtgttaaacatgcccgccctcgaatggttggacatgggttccaataaattagagcagctgccagatacaatcgaacgcatgcagaacctccataccctgtggttgcaacgtaatgagattacctgcctcccacaaacaatctctaatatgaagaacctcggaacactggtgctctcaaataataagcttcaagacatcccggtgtgtatggaggaaatggccaatctccgcttcgtgaacttcagagacaacccactcaagttgaaggttagcctgcctccctcggaaggaacagacgaggaagaggaacgggagctattcggccttcaattcatgcacacttacatacaggaatcccgccgcagagcagcacttcagttctgcgtatgtcacggtcagatcctcacaatttatacctgcatggcactggagatttag

SEQ ID NO: 30925 - DNA, 1809 bp, Artificial Sequence
  Description of Artificial Sequence: Synthetic coding sequence
atgtctagattaaagcgcatcgctggtcaggacctgcgggccggattcaaggcaggaggccgcgattgcggcacctcagtaccgcagggtcttctcaaggcagccagaaagagcggccagctcaacctctcaggacgcaatctctcagaggtgccccaatgcgtctggcggattaacgtggacattccagaagaagctaatcagaacctgagctttggcgcaacagagcgttggtgggaacaaaccgacttgacaaagctaattatcagtaataacaaactccaatcccttacagacgatttgcgtctgttgcccgccctcactgtcctagacatacacgataaccaactgacctcactgccatctgctatacgtgaattggagaacctgcagaagctcaacgtgtcgcacaataagcttaagattctgccggaagagataactaatctgagaaatcttaaatgcctgtaccttcaacacaacgaattaacatgcattagtgagggttttgagcagttgtccaatttggaggacttagacctcagcaacaaccatctgaccaccgtaccggcttcgttcagcagcctctcttcactggtgaggcttaatctgagctctaatgagttaaaatccctccccgccgagatcaacagaatgaaaaggttgaagcacctggattgtaacagcaaccttctggaaacaatccctccagagctggcaggaatggagtcactggagttgctgtacctgcgaagaaataaacttcggtttctccccgagttcccttcctgctctctcctcaaagagttgcatgttggggaaaaccagatcgaaatgttagaagcggagcacctgaaacaccttaatagtattctggttcttgatttgcgtgacaacaaactgaagagtgtacccgatgaaattatcctgctgaggtctctcgagaggctggacttgagtaacaacgatatctcctcactgccctacagtcttggcaacttgcacctgaagtttctggctctagaaggaaaccccctgaggacaattcgccgggagataatttcaaagggcactcaggaggtgctgaagtaccttaggagcaagattaaagacgacggaccctcccaatcagagagcgccaccgaaaccgcgatgacactaccttccgagagcagggtcaatatccacgcaataatcacactgaaaattctggactatagtgacaagcaagccactcttattccagatgaggtgttcgacgcagtaaagtcaaatattgtgacttccattaattttagcaaaaatcaactttgcgaaatccctaaaaggatggtggagttgaaggagatggtgagtgatgtcgacctgtcttttaacaaactgtcattcatttctctggaactgtgcgtgttgcagaagctgacctttctggacctccgaaataatttcctcaattcccttcccgaggagatggagtccctggtgaggctgcaaaccatcaacctgtcatttaataggtttaagatgctgcctgaagttctctatagaatttttaccctagagaccatccttatctccaacaatcaagttggctcggtggatcctcagaaaatgaagatgatggagaacctgactactctcgatctgcagaacaacgatctgctgcagataccgccggaactgggtaactgtgttaatcttaggacattactcctcgacggaaatcctttcagagtgcccagagcagctattctgatgaaaggtacggccgccattttggaatacttgagggacagaattccaacttag

SEQ ID NO: 30926 - DNA, 651 bp, Artificial Sequence
  Description of Artificial Sequence: Synthetic coding sequence
atgctgcagggggccacggaattggttgccgaacccaacaggcgcgtgctcgagaccctagccagttcccttcacactctgaaatttaggcatcttctgtttagcgatgtggctgcccagcagtccctgagacaattgcttcaccaattgatacaccatggcgctgtatcccaggttagcctgtattcatggccggtgccagaatctgctctatttatactgattctgacaatgtctgcagggttttggcagcccggaccaggcgggcccccgtgccgactgtgcggggaagccagtagaggaagagccccctccagggatgagggttccctccttctgggatctagacggcccaggagagacgctgccgagaggtgcgccgcagccttgatggcctctaggcgcaaatccgaagcaaaacagatgcctagggccgcacctgctacgcgggtgacacggcgctcgactcaggagagtctcacagctgggggaactgacctaaagagagaactgcaccctcagccgcctcctatgcgtttactggccccatctggccacctactcttacagcaaccacctcccctgcccctgctcctgcatccacatacaaatgggcaccaactggctcagcctcattcgttgagtccctag

SEQ ID NO: 30927 - DNA, 2439 bp, Artificial Sequence
  Description of Artificial Sequence: Synthetic coding sequence
atggcagccccagaggcctggcgggccagaagctgttggttttgtgaggtcgcggcagccactaccatggaagcaacctctcgcgaagcggcccccgcaaaatcaagcgctagcggccccaatgcaccgccagcgctctttgaattatgtgggagagctgtgagcgcccacatgggagtacttgaatcaggtgtctgggccctgccaggacctattctgcagtccattctgcccctactaaacatatactatctggaaagaatcgaagagaccgctctaaagaagggcttatcgacccaggccatttggaggcggctttgggatgagcttatgaagactcgcccttcaagcctcgagtccgtgacgtgttggcgggccaagttcatggaggcttttttctctcacgtgttacgcgggactattgacgtatcttccgacaggcggctttgtgaccaacgcttctccccactcctgcactcctcaagacacgttcggcagcttactatttgtaatatgctccagggagcgaccgagcttgtggccgagccaaatagaagagtcttggaaacactggcctcatcactgcacacgctcaaattccggcacctcctcttcagtgatgtggctgctcaacaatccctgaggcaactgttacatcagctcatccaccatggggcagtctctcaagtctcactgtactcttggcccgtgccagagtctgcccttttcatccttatactgaccatgtcagcaggtttttggcagcctggaccagggggcccgccttgtagactctgtggtgaggcatctcgaggacgagcaccatctcgagacgagggcagtctcctgctcggctctcgccgcccacggcgggacgccgctgaaagatgcgccgccgccctcatggcaagccgcagaaagtctgaggccaagcagatgccccgcgctgcacccgctacaagggtcacacggaggtctactcaggagtctctgaccgctggtggtacggacttgaaaagagagctccaccctcccgccacctcacacgaggctcctggtaccaagcgttctccatccgcccctgctgccacgagttctgccagtagcagtacttcttcatataagagggcgcctgcttctagcgctcctcagcccaagccactgaagcgctttaagcgcgcggcaggcaagaagggcgccagaactcgacagggcccaggagccgagagtgaggatctgtacgatttcgtattcatagttgctggagagaaggaggatggagaggagatggagatcggcgaggtcgcttgcggcgctctggacggcagcgatcctagttgtttaggtctcccggctctggaggcgagccagcggttccgcagcatctccactctggagttattcaccgtgccactcagtactgaggctgcccttactctctgccacttgctaagtagttgggtatctttagagtcactcaccctcagctataacggtctgggctccaatatctttcgccttctagattcactcagagccctgtccggacaggcaggctgtcggctgagagccctgcatttaagtgatctgttcagcccactacccattctggagctcaccagagcaatcgtgagggctcttccgttactccgagtgctctccattagggtggatcacccgtcccagcgtgataaccctggagtccctgggaacgctggacccccttctcacattataggtgatgaagaaatcccagagaactgcctcgagcagttggagatgggttttcctagaggagcccagcccgcgccacttctgtgctccgtcctcaaagccagcggatctctacaacagctgtccctcgattcagcgacgttcgcatccccccaggatttcggcctggtcctgcaaaccctgaaggagtacaatctggccctcaaacgactaagctttcatgatatgaacctggccgactgtcagtctgaggtgctcttcttgttgcagaatctaacactacaggaaattaccttttctttttgtcgcctgttcgagaaaagacccgcacaattcctgccggaaatggttgccgcaatgaaggggaatagcacactcaaaggtttgcgcctgccaggaaatagacttggaaacgccggtctgttagcactggcagatgtgtttagcgaagactcctcgagttcgctgtgccagctggacataagctctaattgtattaagccagatggactcctggaatttgccaaaagactcgaaaggtggggcaggggagcctttggacatctgcggctcttccaaaattggctggaccaggatgccgtcaccgccagggaagccataaggcggctgcgtgccacctgccacgtcgtctccgattcctgggactcctcacaggcattcgccgactacgtgagcacaatgtag

SEQ ID NO: 30928 - DNA, 2088 bp, Artificial Sequence
  Description of Artificial Sequence: Synthetic coding sequence
atggaagctacttcgcgggaagcggcccctgccaaatcaagcgcgtctggccctaatgcaccgcctgccctgttcgagttgtgcggccgtgccgtcagcgctcatatgggcgtactggaatccggcgtgtgggcgctaccaggacctatcctccagtccattttgcccctgcttaatatctactacctggaacggatagaggaaacagccctgaaaaagggcctctcaacacaagccatctggcgtagactctgggacgagctgatgaagactcggccatcaagcttagagagcgtgacgtgctggagggctaaatttatggaagccttcttctctcacgtcctgcgtggtacaatcgacgtgtcatccgataggagactttgcgaccaacggttcagtcctctgttacacagctcacgccacgtccggcagctcaccatatgcaatatgctgcaaggcgccactgagctggtagctgagccaaaccgacgagtcctggagacactcgcctcatctttacacacactaaaattccgacacctgctttttagtgatgtcgcggcccagcagagccttcggcagctcctgcaccagcttatccaccatggagctgtatcacaagtgtcactgtactcatggcctgtcccagagagcgccctgttcattttaatactcaccatgtctgctgggttttggcagccaggcccaggtggacctccctgccgcctgtgcggtgaggctagtcgaggacgagctcctagccgggatgagggttccttgctcttgggaagccgaagaccgagacgggatgcggcggagcgatgtgctgccgccctgatggccagtcgaaggaagagcgaagccaagcagatgccccgcgccgctcctgcgacccgcgtgacacggcgctctactcaagagtcccttaccgccggaggcactgacttgaagcgcgaactccaccctccagccacgtctcatgaggccccgggtacgaaaagaagccccagtgcccctgctgcaacttcttccgctagcagtagtacctcgagttacaagcgtgcaccagccagtagtgctccgcagcccaagccgcttaagcggttcaaaagagccgccggcaaaaaaggagctcgaactcgtcaaggacctggggcagagtccgaggacctgtatgacttcgtcttcattgttgcaggcgaaaaggaagatggagaagagatggagattggagaggtcgcatgtggtgcgctcgacggctcagacccatcttgtctgggcctgcccgccttggaagcttcacagcggttccggagtatatccaccctggaattgttcaccgtaccactgtcaacagaggcggcactgaccctgtgccacttgctttcaagctgggtatccctggagtcccttactctatcctataatgggctagggtctaatattttcaggctccttgattcacttcgggcacttagcggacaggccggatgccggttgcgggccctgcatttgagcgacctcttctctccattgccgattctcgagctaaccagggccattgttcgggccctgcctctgctgcgagttctgtccatcagggtagatcacccaagccaacggcattcctggggaatgctcgcttgttggccgtggcagatgttctcacagaggatacatccgcctctgtcagtaagttggaccagcgttccgacagcttctagccagatgggcttctggagttccccaagtgggtggtctgctggagctgtggaaccgctggtgacctgcgcctctagtaaaaccggatggacgaggatgcagtcacagccaggaaaaccatctggggggtcggggttgcccgccatgtggctggcaacccacggcactcaccctcgcccctctcaaatcatgctggcgccttgtgatggggccaggacttcccagtcacacgcccgctatcatcaacttgctggagcagaggcttgggcagctcagaaccctaaccaccagttttacctgtcattatctgtgacctttttcctctttttcccatcttccctggccttgcgctcctggagaccctag

SEQ ID NO: 30929 - DNA, 1287 bp, Artificial Sequence
  Description of Artificial Sequence: Synthetic coding sequence
atgtcttattatctgagtagtgaaaatcacctcgaccccgggcctatttatatgcgtgagaatggccagcttcacatggtaaaccttgcacttgacggggtgagaagcagcctgcaaaagccaagaccatttcgcctgttcccgaagggattctctgtcgagttgtgtatgaatcgggaggatgatacagctcggaaggagaagactgatcattttatattcacctatacgcgcgaagggaacttacgatactcagcaaagagtctttttagcctggtcctcggctttatcagcgacaacgtcgatcacatcgatagcctgattggctttcccgagcaaatcgcagaaaaactgttcagtgcggccgaagcaaggcaaaagttcacggaaccaggcgccggtttgagagctctgcagaaattcactgaggcgtacggtagcctcgtgctgtgcagtctctgtttgcggaaccggtacctagtgattagcgagaaacttgaggaaattaaatcctttcgggaactgacgtgtcttgacctgtcttgctgtaagctgggagacgagcacgaactgttggaacatctgacaaacgaggccctgtctagtgttacccagttacacctgaaggataactgtctgtctgacgctggtgtgcgcaaaatgacggctccagtgcgggtgatgaaacggggattagaaaatttgactctgttggacttgtcttgtaaccctgaaatcacagacgcaggcatcggataccttttcagtttcaggaaactgaactgcctcgacatatccggaaccgggctgaaggatattaaaacagtcaaacacaagttgcagacccacatcgggttggttcactcaaaggttcccctcaaggagttcgaccactcaaattgtaagacggaggggtgggccgaccagatagtgctacagtgggagagggtgaccgcggaggcggtgaaaccacgggagaccagcgagccaagggccgcagcccagcgcttctatgggaagcggagccgcgctgaagcccctcttaagtgcccactggcagacacccatatgaactcctctgaaaaactgcagttctataaggaaaaggctccggattgccacgggccagtgctcaaacatgaggccatctcttcgcaagagagcaagaaatcaaagaaacggccatttgaagaatctgaaactgagcagaacaactcctctcagccctctaagcagaagtatgtctgtctggccgtggaggattgggatctgctcaactcttattag

SEQ ID NO: 30930 - DNA, 579 bp, Artificial Sequence
  Description of Artificial Sequence: Synthetic coding sequence
atgtcttactatctgagcagtgagaaccatttagaccctggacctatctatatgagggaaaacggacagctgcacatggttaatttggcactcgacggagttagaagtagcctccagaagccacgtccatttcgccttttcccaaaaggctttagtgttgagctgtgcatgaaccgggaggatgatactgcacgaaaagaaaaaaccgaccactttatctttacctacacccgcgaggggaatttaaggtactctgccaagagtctgttctccctggtactgggatttatcagcgataacgttgatcacatcgattccctgataggcttccccgaacagattgccgagaagttattcagcgctgccgaggcccgacaaaaatttactgagccaggagcagggctgcgagcactgcaaaagtttaccgaggcctatggatctttggtgttgtgtagcttatgtctacgcaaccggtatctggtgatctcagaaaaacttgaagagatcaaatccttccgtgagctaacatgcctggacctgagctgttgtaaactgggggatgaacatgaactgctgtag

SEQ ID NO: 30931 - DNA, 1287 bp, Artificial Sequence
  Description of Artificial Sequence: Synthetic coding sequence
atgtcatactacctgtcgagcgaaaaccacctcgaccccggaccgatttatatgcgagagaatggccagctacatatggtgaacctggccctcgacggagttcggtcttccctgcagaaaccgaggccctttcgtctgttccccaagggtttcagcgtggaattgtgtatgaaccgggaagacgacaccgcacggaaagagaaaaccgaccattttatcttcacgtacacaagagagggcaacctgaggtactctgctaagagtctgttttcacttgtgcttggattcatctcagacaatgtggatcatatcgatagcttgatcggcttccctgagcagatagccgaaaaactgttttccgctgctgaagcgcggcagaagttcacagaacccggcgctggcctgcgcgctctccaaaaatttacagaggcttatggatccctggtactgtgtagcctgtgcctgcgaaacagataccttgttatatccgagaagcttgaggagatcaagtcgtttcgggaactcacatgcctggatctctcttgttgcaaattgggagatgagcatgaactgttggagcatctgactaatgaagcccttagctctgtaacccagctacatctcaaggataactgtctgtctgacgccggtgtccgcaaaatgactgcgccagtgcgggtgatgaagagaggcttggaaaatttgacacttctggatctgagctgcaatcccgagattaccgacgctggtatcggttaccttttctcattcagaaagctcaactgccttgacatctcaggcactggactcaaagacatcaagacagtgaagcacaagctgcagacacacattggcctcgtgcactcaaaagtgcctttaaaggagtttgaccattctaattgcaagaccgaagggtgggctgatcaaatcgtcctacagtgggaacgtgttaccgccgaagcggtcaaaccaagggagacatccgaaccccgagcagccgcacagagattctacggtaagcggagccgcgcagaggcacctttaaagtgtccgcttgccgatacccatatgaattcatccgagaagctccaattctacaaggaaaaagcgccagattgccacgggccagttttgaagcacgaggccatcagctctcaggaatcaaaaaagtctaagaaacgtcctttcgaggagtctgaaacggaacaaaacaattcctcccagccatccaaacaaaagtatgtgtgtctggccgtggaagactgggacctgttgaattcatactag

SEQ ID NO: 30932 - DNA, 720 bp, Artificial Sequence
  Description of Artificial Sequence: Synthetic coding sequence
atgagttattatttgtcctcagagaatcaccttgaccccggccccatatacatgagagaaaatggacaactccacatggtgaacctagctttagatggggtgcgcagcagtctccagaagcccagaccgtttagacttttcccgaaaggcttctctgtggaactgtgtatgaacagagaagacgacacagcccgtaaggagaaaaccgatcatttcatattcacctatacaagggagggcaacctgcgatactcggctaagtccctctttagtcttgtgctcggtttcatcagtgacaatgtggaccacattgattctctcatcggattccctgaacagatagccgaaaagttgttcagtgctgccgaggctagacagaagttcacagaaccaggggctggcctccgggcgctccaaaagtttacagaggcatacggatcactcgtcctgtgtagtctctgtctccgaaatagatatctggtcatcagcgagaagctggaggaaatcaagagcttccgcgagctgacctgtctcgacctcagttgctgcaagctgggtgacgaacacgagctactggagcacttgacgaatgaggctttaagtagcgttacgcagcttcatcttaaagacaactgcctgtccgacgctggagtcagaaagatgaccgcccctgttagagtgatgaagcgtggcctggaaaacttaacccttctggactag

SEQ ID NO: 30933 - DNA, 1584 bp, Artificial Sequence
  Description of Artificial Sequence: Synthetic coding sequence
atggagtgcttatgtgcccatcctccagcaggtctgcagcacttgggcctgggtcataacaaactactgggcccgcttgagtccctctatgtaaccgctaaccactggggacgcgtcagactgggtctaggtgacgctgtgcttaccgcagctgcatgtgtcttcctcttgttctccgaacctagatcgatctgtttcctggtctgcggatctcgcctgctggccccctgttctcccgggttcttaactcctcggcgttcctgttcaccttcgcgtcctaatctggtctcactggacttaggattcaacgacttaaccgatctccagtctatggtgacttctctcaggactctacgccaccttaggctcctggtactgcaaggtaatcccttggcccttgtgccctattatcggggcttaacgatagactccctcgcccagctgtgtgttctcgatgatatcactgtctccccaaacgaaaagcacctctttagggggctaagcctgaacggtgacctactggcacaggaggcacagtttgtggttacaatcggaaacatccgcggcgttcttgataccagcgtgctggatccggagcctcgtcccgaaggacccttcattacatataactactatgtcacctatgatttcgtgaaagacgaagaaggtgagatgaacgaaagcgctggtgtgctggctgaaatcgtcaagccctcaccgagtcttgaattactcgttgaagaatcacctgaagaggtagtggaggatgtgatagaagatatcgtagaagaagtcaccgaagaagtcgaggggtcacttgagtctgaagtagaagaatcaggtgaatctgaactttctgtgatcagtgggcctagcactatactacaaatgccgcgggcctcggccgaggagttagctaaactccgcctgcgtattgaccctcgcctgtgtccttcaccagggacggtgctattcagtacagctcacaagccctgggcagaagtgattccctgttcatacgaaatgcagcacagtctcagggatctagtcccgcttaaggccttcctactggccggcactaccgtgactatcgtagaggaaaagattctgagctggcccgtggtcctacctgcagtggacagtccactgagtgccaaaaaaggaaagggtgagaaagataagaaaggcaaagagaaggatcggaccggcaaaggagagaaggagcccgccaaggaatggaaggtgctcaagaagaaaaaagagccaccaaaagagctaagacaggacccacctattctgcaggtgcttggaaggggacttgtcatcttagagccactcttagccggtgagcccctggtgtccaccgtgtgtaatttcggtgtggtgcgaaccctgacaagcgaccggctcactctcgcgcgggattccaaaaaaataaagaaagtcgctaagaaagagaagcctaaggcagttatccccatttacgaaggcgattaccatcccgagcctctcacagtggaggtgcagatccagctgaatcagtgccgtagcgccgaagaggccctgcgtatgttcgcagtatag

SEQ ID NO: 30934 - DNA, 1971 bp, Artificial Sequence
  Description of Artificial Sequence: Synthetic coding sequence
atggaagcgtcttatgagtcagagtccgaatctgaatctgaggcaggcccaggcactcagcggcccggtaccggaaccgtcagcgcagccgtgagggaacacttgagaaaactttgcctgcgtgagtttccttgtggggctggcagctggaacaaaagcagattcctcccccaaacatggcggacatggcgagaattggtgccaagggaggaggatgttgtttccccaggcgaagaaaccgtggaagctctgctcggccttgtccgatctagacattccccatgggcactgctgaacaattcaaacgcggaggattccttcttacgtgagctggcaataagaaaccccctgactattacggacacctttttctattcttatttccggtccctacgggtgattgataaaaaggtgactctggtcgataaagacttgctgaaatttttgaagctcgaggagttagtgttaagtgctaacagaatcaaggaagtggatgcgactaatcttcccccaactctgaaggtgctagaactgtacggtaacgaaattagctcaatggaatgcctctgcgcacacccccctgctggccttcagcacctgggactgggtcacaataagctgctgggcccccttgagagcctgtatgtgaccgcaaaccattggcccaaccttgtctccctggatcttggattcaacgacctgaccgatttgcagtctatggtaaccagtctgcggactttgcgtcacctgcgcctcctcgtcttgcaaggtaatcccctggcgctcgtgccctattacagaggactgacgatcgatagcctggctcagctttgcgtgctggacgacattaccgtctcaccaaacgaaaaacaccttttcaggggattatcactcaatggcgacctcctggcccaggaagcacagttcgtggttactattggaaacatcagaggtgtcttagatacctcagttctggatccagagccacggccagagggaccctttattacttacaattattacgtgacctacgattttgttaaagacgaggaaggtgaaatgaatgaatccgctggggtcctcgcagagattgtcaagccctccccgtccttggagcttttagtggaggagagtcccgaggaggtggtggaggacgtgatcgaggatattgtagaggaggtgaccgaggaagtggaaggcagtttggagagtgaagtcgaagaaagtggtgagtccgaactgagcgtcatcagcgggccaagcactatattgcaaatgcctcgtgcgagcgccgaagaactcgccaaactgagactgaggattgacccccgcctatgtcctagtcctggcactgtgctgttctctacagcccacaagccttgggctgaggtcataccttgttcatatgaaatgcagcactcattgcgtgacctcgtccctctaaaagcgttcttgcttgctgggaccactgtcacaatcgtggaagagaagatcctgtcctggcctgtggtgctccctgccgtggactcccccctgtctgcaaagaagggcaaaggagaaaaagacaaaaagggtaaagaaaaggaccgcactggaaagggagaaaaagaacccgccaaggagtggaaagttttgaagaagaagaaagagcctccgaaggaactccgacaggaccctcctatcttacaagtcctagggaggggattagtgatcctcgaacccctcctggcgggcgaacccctggtgtcaacagtgtgcaacttcggcgttgtcaggactctgacgtctgaccgcctcaccctggcccgggactccaaaaaaataaagaaggttgctaagaaggagaaacccaaagcagtgattcctatttacgaaggggactaccatcccgagccccttacggtggaggttcaaatccagttgaaccagtgtagaagtgccgaagaagccttgcgcatgttcgccgtctag

SEQ ID NO: 30935 - DNA, 1416 bp, Artificial Sequence
  Description of Artificial Sequence: Synthetic coding sequence
atggagtgcttatgtgcccacccccctgccggtttgcagcatcttggccttggacataacaagctgctgggaccactggagtctctgtatgtgaccgcaaatcactggccaaacctggtgagcctggatctgggcttcaatgacctgacggatctgcagagtatggtgacaagtcttagaacactccgccacttgaggttactggtcctccaaggaaatccgttagccttagttccttattatcgtggactgactattgattctctagcgcagctttgtgtgcttgatgacatcaccgtctccccgaacgaaaagcacctttttaggggactctccctaaatggggatctgttggctcaggaggcccagttcgtggtgaccattgggaacatccgtggggtactggacaccagcgtgctagacccagagcccagaccagaaggcccattcatcacatacaattactacgtcacttatgatttcgtaaaggacgaagaaggggaaatgaatgagagtgcgggggtactggccgagatagttaagcctagtccctccctcgagttgctggtggaggagtccccggaagaggttgtggaggatgtgattgaggatatcgtagaggaagtgaccgaagaggtcgagggatcgctggagtcggaggtcgaagagagcggagaaagtgagctgtcggttattagcggacccagtacgatactccagatgccaagagctagcgccgaagaactggccaaactgcgcctgcgcattgatccacgactctgtcccagtcccggaacggttctgttttctaccgcccacaagccctgggcagaggtgatcccctgctcatatgagatgcagcattctcttcgcgatttggtcccactgaaagcctttctattggccggaacgacagtaacaattgtggaagaaaagatcctgtcttggccagtcgtgctgcctgcagtggatagcccactgtcagctaaaaaaggtaaaggagagaaggataagaagggcaaggagaaggatcgcaccggaaagggagagaaggaacccgcaaaggaatggaaagttctcaagaagaaaaaagagccacccaaagagctgcgccaggatccacccatcttacaggtgcttggtagaggtctcgtcatccttgagccattgctcgcaggcgaaccgttggtctctacagtgtgtaattttggcgtcgtgaggacgctgacctctgatcggctgacacttgccagagattcaaaaaagatcaagaaagtagccaaaaaggagaaaccaaaggctgttattcccatttacgagggcgattaccaccctgagcctctaacagttgaagtccagatccagctcaaccagtgccgttcggcagaggaagcactgcggatgttcgctgtgtag

SEQ ID NO: 30936 - DNA, 966 bp, Artificial Sequence
  Description of Artificial Sequence: Synthetic coding sequence
atgtctgggggaaaaagcgcacagggacccgaagaaggcggggtgtgcattacggaagcattgattaccaaaagaaacttgaccttcccagaagacggagaactatccgaaaagatgttccatactctagacgagctccagacagttcgcctcgatcgcgaaggaatcaccacgatacgcaacttggaaggcctgcagaacttgcatagcctgtacttgcagggaaacaaaatccagcaaatcgagaacctcgcttgtatcccatctctgcgtttcctgtcccttgccggcaaccagattagacaggtggagaatctcctcgacctgccctgcctgcagttcctggatctcagcgagaacctcatcgaaactctcaaactagatgaattcccccagtccttgcttatcctcaatctgagcgggaacagttgcactaatcaggacggttatagagaattagttactgaggcgctgcccctgctgctcgacttggacggacagcctgtcgtggagcggtggattagtgatgaagaggacgaggccagttcggacgaggagttccccgaactttctggacccttctgcagtgaaaggggattcctgaaagaactggagcaggagctgagtagacatagagaacacaggcagcaaacggccctgactgaacatttgctgcgcatggagatgcagcccactttgaccgatctgcccctgctcccgggcgtgcccatggccggcgatagtagcccaagcgccacgcctgcccagggagaggaaaccgtcccggaggccgtgtcaagccctcaggcgtcctcaccaacaaagaagccttgctctctgatccctcgtggccaccagagctctttttgggggagaaagggagcacgggctgctacagcacccaaagcctcagttgctgaagccccgtccaccactaagaccacagctaaaagatcaaaaaagtag

SEQ ID NO: 30937 - DNA, 1752 bp, Artificial Sequence
  Description of Artificial Sequence: Synthetic coding sequence
atggcggctgcagccgtctcggagagctggcctgaactcgagctggccgagagggagcggagacgtgagttgctcctgactggccccggactggaggagcgcgttcgggcagcaggcggacagctgcctccccggcttttcacactccctctcctgcactacctggaggtgagcgggtgtgggagcctgcgggctcccgggcccgggctggctcaggggttaccccagttacacagtctcgtgctgcggcgcaatgcgctcgggcccggactcagtccagagctgggccccttgccagcgcttcgggtcctagatttgagcggcaacgcactagaggccctgccacccgggcaagggctgggcccggctgagccccccggactgccgcaactgcagagccttaacctgtctgggaaccggctccgggagctgcccgctgatctggcgcggtgcgcaccacggctgcagtccctgaacttaacaggcaattgcctggactcttttccagccgagctgtttcgcccaggcgcactaccactgttaagcgaactggcagctgctgataactgcctaagagaactttctcccgatatcgctcatcttgccagtctgaagacacttgatctctcaaacaaccaactctcagaaattcctgccgagctggccgattgcccaaaacttaaggaaatcaatttccggggcaataaattgagggataaacgactcgagaagatggtcagtggctgccagacccggtctatccttgaatatctcagggtgggtggtcgggggggcggtaagggcaaaggtagagccgagggctccgaaaaagaggaatcaagaaggaaacgccgcgagcgaaagcaacgacgggagggtggtgatggtgaagagcaggatgtgggagatgcgggaaggttgttgctccgagtgctgcatgtgagcgagaaccccgttccccttactgtccgggttagccccgaggtccgagacgtgagaccatacatagtcggagccgtggtgcgtggcatggacctgcagcccgggaacgccctgaagagatttctcacttcgcagactaagctgcatgaagatctctgcgagaagcgaaccgccgcgacactcgccacacatgagttgagagctgtcaagggaccattgctttactgcgctagaccccctcaggacctaaaaatcgtgcctttgggtcggaaggaagccaaggcaaaagaattggtgcgtcagctgcagctggaagcagaggaacagcgcaaacaaaaaaagagacaaagcgtgtccggcctgcaccggtatctccacctgctggacggaaacgaaaattacccctgcttagtggacgcagatggggacgtgatcagcttcccgcccataaccaactcagaaaagacgaaggtaaagaagactactagcgacctgttccttgaagttacaagcgccacatcactccagatctgcaaagacgtcatggacgcgcttatcctcaagatggctgagatgaaaaagtacaccctcgagaacaaagaggagggatcgctgagcgataccgaggctgatgcagtgtccgggcaactgccggatcccaccacaaacccctctgctgggaaagacgggccaagcctgctcgtggtggaacaagtgcgcgtggtggacctggagggctccctcaaggtagtatacccgagcaaggccgacctcgccacagcgccaccccacgttaccgtggtccggtag

SEQ ID NO: 30938 - DNA, 1515 bp, Artificial Sequence
  Description of Artificial Sequence: Synthetic coding sequence
atgctccgtctagtcgcggcctgtcccgagtcctgtgttgtatgcacgaaagacgttacactctgccatcagcttacttatattgtggctgctcctatgactactagagtccttattattaccgatggttatctgtcctccatcgaaagtacaaatctgtctctgttgtttaacttggccctgttgtctttgtctcggaatggaatagaagatgttcaggaagacgcccttcacgggctaacaatgctgaggactctactgttagagcataaccagattagcagctctagcctgacagaccacaccttctctaagttacactccctgcaggtcctggtactcagcaacaacgcactgcggactctccgtgggagttggttcaggaacacctccggactcacgcgcttgcaactggatggtaatcagatcaccaacctgacagacagtagtttcggcggcacgaatctacattctttacgctacttagatctatctaataacttcatctcctacatcggcaaggacgctttcaggcctctaccacaactgcaggaggtcgacctgtctagaaatagactcgcccacatgccagatgtgttcacacctctcaagcagctgattctgttaagcctggacaagaaccagtggagctgcacatgcgatttgcatccgctggcacgcttcctgagaaattacataaaatcaagtgcacatacattgagaaacgccaaggacctgaactgtcaaccctctactgccgctgttgccgccgcgcagtcagtactcaggctaagtgagactaactgcgattccaaggctcctaacttcacactagtgcttaaagacagatctccactgcttcctggtccagacgtagcactgttgacggtattaggatttgcgggtgctgtgggcctgacatgccttggcctcgtcgtattcaactggaaactccatcagggtaaagcaaatgaacacacgtcagagaatctgtgttgtaggaccttcgacgaacccttatgtgcacacgaggcacgaaactaccatacaaagggctactgcaattgtcacctcacacaggagaacgaaataaaagtcatgtcaactgtcggctctcggaaggagatgcccctgctgcaggagaactcccaccaggccacgagcgcctccgagagtgccactttagatggaagctttaggaatcttaaaaaaaaggaccggggtgttgggagcaccctgttctgtcaagacgggcggcttttgcactcagaatgtagcgagccgccaggcaacatgagagctttcaacgaagccggactgctaacgacctacaatcccaggaaagtacagaagttgtggaacctagaaccaggagaggtccaaccccagacactgcagcatcacattattcgcacagaggacatctcttccgatatttttcggcggcgctatgccactccagccagtgctttggcaggggagtcattggagaagaggctaactaacgaatcctag

SEQ ID NO: 30939 - DNA, 1533 bp, Artificial Sequence
  Description of Artificial Sequence: Synthetic coding sequence
atgctccgcctggtcgcagcctgcccagaaagctgcgtcgtgtgcacgaaagatgtgacgctgtgccaccagctgacatatattgtggcggctcccatgacaactagagtattaatcattacagacgggtacttgtcatctatcgaatccacaaatctgtccttgctgttcaacctggctcttctctcattgtcccgcaacggaattgaggacgtgcaggaggatgcgctacatgggttaacaatgttaagaacactgctccttgaacacaaccagattagcagtagctccctgacagaccataccttctcaaagctccattcgctgcaagttctggtgctcagcaacaacgcccttcgaacattaaggggatcctggttcaggaacactagtgggttgacacgcctgcagctggatgggaatcagataactaacctgactgatagctcctttggagggacgaaccttcattcactccgctatctggatttgtcgaataactttatatcatatatcgggaaggacgctttccgcccattgccccagttgcaggaagttgacctttcccggaataggctggcccacatgcccgatgtattcacacctttgaagcagcttatcctgctatccctcgacaagaatcaatggtcgtgtacatgtgacctccaccctctggcccgttttttgcggaactatattaaatcctcagcacacacccttaggaatgcaaaagacctgaattgtcagccctccactgctgcggtcgctgcagcgcaatccgtactgagattgtctgagaccaattgtgattccaaggcacctaattttactttagtactcaaggatcggtcccctttgctgcctggccctgacgtagccctgctaacagtgctgggattcgctggcgcagtggggcttacatgtctggggcttgttgtgtttaactggaagctgcaccagggcaaggccaacgagcatacctccgagaatctgtgctgtagaacgtttgacgagcctctctgtgcccatgaggccaggaactaccacacaaagggttactgcaactgccacctgacgcaagaaaacgaaattaaggtcatgtccacagtaggttcaaggaaagagatgccgcttcttcaagaaaactctcaccaggcaacctcagccagtgaatctgcaacgctggatggcagcttcaggaacttgaaaaaaaaggaccgcggggtggggagcacgcttttctgtcaggacggacgcctgctgcattcagagtgcagcgagcccccaggcaacatgcgggcattcaatgaggcaggactcttgaccacttataaccccagaaaggtgcaaaaactttggaacctggagcccggggaggtgcagccgcagaccctgcagcatcatattatcagaaccgaagacatctcgtcagacatcttccggcgcagatatgccacgcccgcatccgccctagcaggggaaagtttggaaaagagactcacgaatgaatcttggcagcctccaattgagtag

SEQ ID NO: 30940 - DNA, 1629 bp, Artificial Sequence
  Description of Artificial Sequence: Synthetic coding sequence
atggacctgggttgggatagaagtaggggcccacgcagaagtacaagcagcgtgagagttagagagttgtcctggcaagggctgcacaatccctgcccgcagtcgaaagggccgggatctcagcgagatcggttgggcgagcagctggtggaagaatacctatcccccgcacggttgcaagcgctggctagagttgacgatctgcggctggttagaaccttggagatgtgcgtggatactcgcgaaggctcactcggaaatttcggcgtgcacctgccaaacctggatcagttgaaattgaatggctctcacctagggagcctacgtgatttaggcacttcactaggccacctgcaggtgctttggctcgctagatgcggattggctgacctcgacggcatcgcgagtcttccagcgcttaaggagctgtacgcaagctataataacatttccgacctatcaccactgtgcctgctggaacaactcgaagtacttgatctggaaggcaattccgttgaagacctgggacaagtgagatatttgcagctctgtccacgtctggccatgctaacgctcgaaggaaatctggtatgtcttcagcccgcgccagggccaacaaacaaggtgccccgtggttacaattatcgggctgaggtgcgcaaactcattccccagctccaggtgctggatgaggtgcccgccgcgcacaccggaccccccgccccaccccggctttcacaggactggttggctgtgaaagaagcgatcaaaaagggaaacgggttaccccctttagactgtcctcgaggagcccccattcgccggctagaccccgagttgtcccttccggagacccaatcaagagcctcccggccatggcccttcagtctgcttgtgcggggcggtcccttacccgagggactgctgtctgaggatttagcccccgaggataacacttcatctctgacacatggcgcaggccaggtactatgtggtaaccccacaaagggtctgcgggagaggagacatcagtgtcaagcacgggagccacccgagcagctcccccaacaccggccgggggatcctgcagccagtactagcacaccggagccagatccagccgattctagcgactttctggcacttgctggtctaagagcttggcgcgagcacggcgtgagaccccttccatatagacacccagagtctcagcaggagggagcggtcgcaccttgggggccacgcagagtgcctgaggagcaagtacaccaggcagaacctaaaaccccaagctccccgccatctctagcttccgagccttcagggacttctagccagcacctggtgccaagccccccaaagcatccaagaccaagagactccgggagctccagccccaggtggtccaccgacttgcagagtcggggtaggaggctccgggttctgggatcctgggggcctgggctcggagatggggtggccgcggtgcctgtgctgagagcattggaagtcgcttcccgcttgagccctcgcgcgcagggctgtcctggccccaaacccgcccccgacgctgctgccagaccccctcgcgccgctgaattgtcccatccttccccggttccaacgtag

SEQ ID NO: 30941 - DNA, 720 bp, Artificial Sequence
  Description of Artificial Sequence: Synthetic coding sequence
atggggaactctgcactgagggcccatgtcgaaactgctcagaagaccggagtgtttcagctgaaagatcgagggctgacggagttccccgcagacctgcagaaattaacaagtaatctgcgcaccatcgatctctccaataacaagatcgagagcctcccccccctgttaatcggaaagtttacacttttgaaaagtctgtcgttaaacaataataagctcactgtcctccctgatgaaatttgcaacctgaaaaaactggagactctgtctctgaacaacaaccatttgagggaattgcctagtacttttggtcagctgagtgcgctcaagacactgtcattatcaggcaatcagttgggcgccctgcccccccaactctgctccttgagacacctggacgtcatggatctcagcaagaatcagatccggtcaattcctgacagtgttggggaactacaggtaatagagctaaacttaaatcagaatcagatttcccagatttcagtgaagatctcatgctgcccccgtctaaagatcctacgtctcgaggagaactgcctggagctgtcaatgctccctcaatccatcctctccgattcccagatctgtcttttggctgtggaaggtaacctattcgagatcaaaaagctccgagaactcgaggggtacgataagtacatggaaagattcacggctaccaagaagaaattcgcatag

SEQ ID NO: 30942 - DNA, 720 bp, Artificial Sequence
  Description of Artificial Sequence: Synthetic coding sequence
atgggcaattccgcacttcgggcacacgtagagactgctcagaagacaggcgtgttccagctgaaagatcggggcttaacagaatttcctgccgacctgcagaaactgacttccaacctgcgcacgatcgatctgtctaataataagatcgagagtctccctcctctcctgatcggaaagtttactctcctgaaatcgctctcattgaacaacaataagctgaccgtcctccccgatgaaatttgtaacctgaagaagctcgaaacactgtctctgaataataaccatctgcgggagctgccctcaacatttggccagctttctgctctgaaaactctcagcctgtccggtaatcagctgggagccctgcctccacaactgtgtagcctcagacacctggacgtgatggacctctcaaagaatcagatccgctcaatccctgattctgtgggcgaactgcaggtcatagagctcaacctgaaccagaaccagatctcgcagatttccgtgaagatatcttgttgtccccggctgaagattttgaggcttgaagagaattgcttagaacttagcatgttaccccagtccatcctctccgatagccagatatgcctactggccgtggaggggaacctgtttgagatcaaaaagctgagagagctcgaaggctacgacaagtacatggaacgattcacggccacaaagaagaagtttgcatag

SEQ ID NO: 30943 - DNA, 1116 bp, Artificial Sequence
  Description of Artificial Sequence: Synthetic coding sequence
atggaggaggctggcgccgcagtcgtgactgccggtgaggcagagctaaactggagccggttgtcagtttctactgaaaccctggagtccgagctggaggcgcgtggggaagagcgccggggcgcacgcgaagctctgctgcgactcctgctgcctcacaaccgcctcgtgagtctccctcgcgccctgggcagtggctttccgcaccttcagctgctcgacgtcagtgggaacgccctcacagccctgggaccagaactgctggctcttcggggactcagaaccctccttgcgaagaataatagactgggcggcccgagcgcactgccaaagggacttgcgcagtcccctctgtgccgcagtctccaagtgctaaacctgagcggtaactgttttcaggaggtaccagcctctctgctcgagttaagagccttgcaaactctgtcattaggtggcaaccagttacagtccatccccgcagaaattgagaatctccaatctctggaatgcctttacctcggaggcaacttcataaaagagattccacccgaattaggtaacctgcccagcctcaattacttggtgctttgcgacaataaaattcagtcaatcccgcctcaactaagtcaacttcacagtctgaggtctctgagccttcacaataacctgcttacttacctgccccgtgaaatactgaacctgatccacctggaggagttatcattgcgtggaaacccacttgtggtgaggttcgtgagagatctgacctacgatcccccaacacttctggaactggcagcacgcactatcaaaatccgcaatatctcgtatactccctacgatctgccaggcaacctcctccgttatcttggtagcgcatcaaattgccctaatcctaaatgtggcggagtctatttcgactgctgcgtgcgtcagatcaaatttgtggacttctgtggaaaatacagactgccgctgatgcactacttgtgctcaccagagtgcagcagcccctgttcatctgcgtcccatagttccacctcacagtccgaatctgattctgaagacgaggcgagcgtggctgcgcgcagaatgcagaaagtcctattagggtag

SEQ ID NO: 30944 - DNA, 780 bp, Artificial Sequence
  Description of Artificial Sequence: Synthetic coding sequence
atggatccaccagctgagaaacccggggaggccggaggcctgcagataacaccccaactccttaaaagcaggactggagagtttagtttggagtccattttactcctcaagttacgtggtctgggactggctgaccttggatgcctgggagagtgtcttggactggaatggctggacctgagcgggaatgctctgactcatctgggccccctcgcctccctcagacagctggccgttctgaatgtgtctaataacagactcacaggcctagagcccttggctacctgtgagaacctccagtcgctgaatgccgcaggaaaccttctggccactcccggccagctacagtgtctggctggcctgccgtgtctcgaatatttacggctgagagatcctctggccagactatcaaatccgctgtgcgccaaccccagctattgggcggccgtcagagaacttctgccgggtctgaaagtgatagacggcgagagagttattgggcgtggctcagaattttaccagctttgccgcgatcttgacagttcactccgcccaagcagcagtccaggacctagagcaacggaggcacagccctgggtcgaacccgggtactgggaaagttggccatcccgctcttcctccattttagaagaagcatgtagacagtttcaggacaccctccaggaatgttgggacctggataggcaagcctccgacagtctagctcaggcagaacaggtgctgagttcggcagggcccacctcatctttcgtattctag

SEQ ID NO: 30945 - DNA, 780 bp, Artificial Sequence
  Description of Artificial Sequence: Synthetic coding sequence
atggaccctcctgccgagaagcccggggaggccggcgggttacagatcacaccccaactcctgaaatccagaacaggggagttttctctggaatccatcttgctcctaaagctgcggggcctgggtctcgccgacctcggctgcctcggggaatgcctcggcctcgagtggctggatctgtccggcaacgccctgacccacttgggccccttggctagcctgaggcagctagccgtattgaatgttagtaacaaccggcttacagggctggaacctctggctacgtgcgaaaatcttcagagcctgaatgcggcagggaacctcctagctacccccggtcaactgcaatgtctcgcaggcctcccttgcctagagtacttgagactgcgggatcccctcgctcgactaagcaaccccctgtgcgccaacccttcttactgggctgccgtgcgggagctactccctggtctcaaagtaatcgacggtgagagagttattggacgcgggagtgaattttatcagctgtgccgggacctggactcaagtcttcgacccagcagcagccctggcccccgagccacggaggcccagccttgggtggaacctgggtactgggagtcatggccctcccggtcatccagtatactggaggaggcttgccgtcagtttcaggacacgttgcaagagtgttgggatttggatagacaggccagcgactcattagcacaggctgaacaagtcctgtctagcgccggtcctacttcatcgttcgtgttctag

SEQ ID NO: 30946 - DNA, 780 bp, Artificial Sequence
  Description of Artificial Sequence: Synthetic coding sequence
atggatcctcccgccgagaaacctggagaggcaggaggcttgcagattacaccccagctgctgaaaagtcgcacaggagagtttagtctcgaaagcatcctcctactcaagctacgcggccttggtctcgcagacctgggctgtctcggcgaatgcttggggttagagtggctggatctgtctggaaatgcgctgacacatctgggccccctggctagtctgcgccaactagcagtgctaaatgtttccaataatcgtttaacaggcttagaacctctcgcaacctgtgagaacttgcagtcactgaatgccgccgggaacctgctggccacacccgggcagttgcagtgcttggcggggctgccctgcctcgaatacttgagactccgtgatccgctggccagactgagtaaccctctgtgtgcaaacccttcatactgggccgctgtcagagaactgctcccaggtctaaaggtcatcgatggggagcgcgtaattggtcgtggatctgagttttatcagctttgcagagacctggactccagcctgcggccgtccagctcgcctggaccacgcgctacagaggctcagccgtgggtagagccgggctactgggaatcttggccttcacgctccagctcaatcctggaagaggcctgcagacagttccaagataccctgcaggaatgctgggacttggatcggcaagcgagcgacagtctggcccaggcggagcaagtgctcagctccgccggtccaaccagctcatttgtgttttag

SEQ ID NO: 30947 - DNA, 1746 bp, Artificial Sequence
  Description of Artificial Sequence: Synthetic coding sequence
atgcagaaaccgcccttgctgctgcgccgccctcttcccccaaagtttacaaagctgagcctgcacgagaagaagacacatactgccaagaccggaaagattgagtcactccacgtggcatttactgaggatgagacaacatcaatcaaaatggacaggactagattccctgacgtccttcgcaatcagtcactaacccccattaatatccaaaacatcttccttgaccactgtgtgcaggaacgtgttacagcgataagttctccacagaaaagcacaaagcacgtgcgagagcagattcccgataccgccacaggctcaatcttctttccgcactgcaattcagcaagcacccgcatcttcggcaaacaaactaataagatggagagtagccggaagttcaagacgatgaaggatgtgtacacagaaaaacggctcgaaaatatcctgatcctaagctccaaattctcaaagcctaagtccacaccaggctctgtcatagcccagaaactggaaaagatgcaccccaagcaccagcctttgcctgaaagccctggatacacataccagcacatatcacgcgacttatccgctactgtaccaagccctccccccatgacagtgtccatgaagcctgagggtcaatggcctgagcacttcaaaagcactgccactctgacactccgcgtgaccgagtttccggggtttgttagtctccccactccagtgctacccaggaagccccaccgacagagtgtgatagagacactagtaaccgaaaacggcaatattgaatctgtgccaaagcagatccctccgcgtcctccggaaggcctgactaagaccgagaagatcgagtccgagattcacgtcgtccggggagagggatttaagacggtggccgcaacacgttacgagacaatcaccgcaatgactaaccttgctatcgtgaattgccaagtttacggacgcaacgccctcaacctgaagggattctttattcttaactgccctgatctgacaccccttgcctttcagttaatatacctgaacctttcgttcaatgatctgcactacttccccaccgaaattctgtgtctgaagaaccttcaaatactcaaactgaggaataatcctatcaaggagatcccctccgagatccagcagcttgagtttctcagaatcttcacgattgccttcaacctgattaccgtgttgcctataggcctgttctcattgtcttatttagaggagctggatgtgtcatacaacgagctcacctttattccaaatgaaatacagaagttaagatcactcgaaaagctcactgtcgatggaaatgaactgtcctttttcccccacggaattctgaagctcaatctgacaaagatccagttcgagaacaattttacccacccttgcttctggcgagataattacctcaataacccccagcagctgactcagattataagcctgtttatagtgcagaataagttacataaattctatgataagattccagtcgaagtccaaaagttactgaagtggtggggggctcagttcctaacggaacttgcccctctttccatctacagttcccggaaagctataactgaaggatacatcgccgtggagctgcccaagtttgaggagagcaagaacatcacagaaggacttctgacccagaagagatacgaagaggtcatggtcaagtgcataaacgccactaccgtaacttcctag

SEQ ID NO: 30948 - DNA, 576 bp, Artificial Sequence
  Description of Artificial Sequence: Synthetic coding sequence
atgaccgagagactcctgataaaggcactatcaggcggaaaaaacacgaaaatcatcaccctgaacggcaagaagatgacaaagatgccctccgcactgggtaagcttccaggccttaagacgctagtgttacaaaataacctcatccctaaggtctgcccagagctgtgtaatctgacccagttccaagacctaaaattacgagagttttactgcgaaggaaaccctttgttcctgcagcagcccgtgattagtacacagcaggagaatgtctggagcctccaagagatcacttctaggttcgttatgaatcagctggctgagaataacccttttcttatggacgatatagaacgctatcctcaggtaagatcaatgatttcccagggcaaaacctgcgcgatatgtgggcaatatttcatcacggtgtggctggaatgtgtgagatttgtacccccaccgaaggactggaaaataagtaaaaacttaaagctcgtgccgctgcaggtgctgatctgtagttacaagtgtttcactcagagggaccctaacctgttcggcatagcgcaggtctag

SEQ ID NO: 30949 - DNA, 153 bp, Artificial Sequence
  Description of Artificial Sequence: Synthetic coding sequence
atgacagagcgcttactcatcaaggccctcagcggtggcaagaacaccaaaataattacattgaatgggaagaaaatgacgaagatgccatcggcacttgggaaattaccaggtctgaaaaccctggtattgcagaacaacctcattccttag

SEQ ID NO: 30950 - DNA, 1044 bp, Artificial Sequence
  Description of Artificial Sequence: Synthetic coding sequence
atgaccgagcgcctgctcattaaggccctctccggcggtaagaatactaaaataattactcttaacggcaagaaaatgaccaaaatgcccagcgccctgggtaagctgccgggcctcaagactttggtgttacagaacaatttgatccctaaggtctgtcccgaactgtgcaatcttacgcagttaactacactgaacttaggtaataatctgcttgaggaggtccccgaggaaatgaaatatttgacatcattgaagaacctccatttgagcggaaataggatatgtcgctttgccccgggtgcttgtgacggcctccaaaatctaatcctgttaaatctcaacaacaatcatctaacccagttgccacaggaggtgtccagacttaaatcgctgacatatatgtccatcaactacaatcagttggcgtctattcccagggagctctgttttttggaaaatctcgtggagctgcagctcaactacaaccagttaatttgcatccccgaagaaattaagtttttgaagaagctgcagaagcttcttctagcaagaaacaacattggagtcctccctgaagaactctgcgatctgaagaagctgagaatactggacattgcaggcaacatcattcagattttcccctctggattccaagacctgaagctgcgggagttttattgtgagggtaatcccctctttcttcaacagccggttattagtactcagcaggagaacgtttggtccctgcaggagatcacatctcgtttcgtgatgaaccagctggcagagaacaatcccttcttaatggacgacatcgaacgataccctcaggtaagatcaatgatttcacaaggcaagacctgtgctatctgtggtcagtactttattacggtctggcttgagtgtgtacgctttgtgcctcctccaaaagattggaagattagcaagaatttaaagctggtgcctctgcaggttctgatctgcagttacaaatgcttcacccagagggacccaaatctctttggaatcgcccaagtctag

SEQ ID NO: 30951 - DNA, 1680 bp, Artificial Sequence
  Description of Artificial Sequence: Synthetic coding sequence
atgagctccgagcagtcggcccccggtgcctcacctagagctccccggccaggtactcagaaatccagcggcgcagtgaccaaaaagggcgagagggccgccaaggaaaaacctgcaacagtgttgccacctgtgggggaagaggaaccaaagagcccggaggagtatcaatgtagcggcgttcttgaaacagatttcgccgagctgtgcactaggtgggggtatacagatttcccgaaagtcgtcaaccgtccgagacctcatccgccattcgtccccagtgctagcctctctgaaaaggcaacattggacgacccccgactgagtgggtcatgcagtttgaactccctggagagcaagtacgtcttctttcgacctaccattcaggtggaacttgaacaggaagacagcaaatcagtgaaggagatctacatccgcggctggaaggtggaggagaggattctcggggtgttctctaagtgcttgcccccacttacccagttgcaggctatcaacctgtggaaagtcggtttaactgacaaaaccctgaccacgtttattgagctgctcccattgtgctcatctacattgaggaaggtttccctagagggtaatcctctgcccgaacaatcttaccataagttgatggctctagacagcaccattgcgcatttgtccctgcgaaataataatatcgatgaccgcggcgcgcagctcttaggtcaggccctgtctacccttcacagctgtaatcggacactagtgtccctgaacttgggcttcaaccacatcggggacgagggcgccggatacatcgccgatgggctgagacttaaccggtccttactctggctttcactggcgcataaccgcattcaggacaaaggggccttgaaactggccgaggtgctgcgcgcatttgagctgacccacaccgaagtggttgaacggagacggctcttactggaaaaaggaacacaggagagaagccgcagcccgtccagctcccgccatggagactcaaagaccgacagagagaaaagtcaaatggtgggcatctcaaacagtgccctggtcgacaagaccgataaaacacaaactatgaagacacctaagggtctgggaaaaaaaaaggagaaaagctgggaactggccaaaaaggaagaaaaactgggcagcggtcagagtccaacacaaggcacgcctaagaaggaggacgccacgaaagcagggaaaggtaaggtcactatcccagagcagaagccctcccgggccaagggcattaagattgggagcagagagaaaaggtccatcctcctggagtccgagctggtggtcgaagctaccgaagtagtcaacccactactggagcctgttgagcaccgagatggtaaggttttcatgccaggaaacaaggtactcctgcacctcaacttgattagaaaccgtataaccgaagtggggctggaaggctttctggcaacagtgcaatatcagatgcagttctccaaagctaagtccgcctccaaaggccctgtcgggttgctctggctctctctcgctaaaaactgctttgctccacaatgtcccgcgtacgcgatcattcaggagctgatgctacccagagaccctatcaaagccaaactacgggaggatgaagccatggcattctttccctag

SEQ ID NO: 30952 - DNA, 864 bp, Artificial Sequence
  Description of Artificial Sequence: Synthetic coding sequence
atgtcttgggacccaaacccagtgccccggactcttaggtgctggaggctgcgtagggcgtctgaaactgcccttcagtcctcccggcgggccgtggaggatcagttgaagatctgtggacatagacgtgacgcagacgtgtttgaacttttcctctccaaaaaggagttaactgaggtgatagatctgagcaggttcaaaaagttgaagtacctttggttacaccataataaattgcatgggatcacgttcctcactcgcaactactgtctgactgaactttacctcaataataacgcaatctttgagatcgagggtcttcattaccttcccagtcttcatatcctgctgctgcaccacaacgaactcactaacatcgacgcaactgtgaaagaactaaagggcatgctcaacctgaaaatcctaagtctctatcagaacccactctgtcaatataatttataccgcttgtatatcatctaccacttgcccggcgtggaactcctggatcggaaccaggtgaccgaaaaggaaaggcggtcaatgataacaatctttaaccacaagaaagcccatatcgtacagtccatcgcttttggcggcaaggtggatgcttcctgggatccgaaatcacctttcaagcagaagcccgcccagcgagtccctagcgatttcgcttttgccaacaacgtggataaaactgttttagacgatcctgaggacgcagtctttgttcgcagtatgaaacgatcagttatgacactgacaagcatgaactgggacaccgttccaactagggaagagcgatacttagaagaagaagggactgaaaccgctcagatgctaactgtgaccctgcggtag

SEQ ID NO: 30953 - DNA, 951 bp, Artificial Sequence
  Description of Artificial Sequence: Synthetic coding sequence
atgctgccatcatctatccagatttctggcgagcccctgagtggagccgaagtgcgagatatctgcagggggctgagggacaacgcagtcagactccttagcctcagaggatgtcgcctgtgtgacagagattttggacggatctgtcgggcccttgctggagccacgtccctggcccagttgaatctcaatctgggagtcgtcagttcaccaagtcggatcaagcagctagcagaggcccttcgtacaaatagaagcatacagtcgctgtttctccacggctctcccctcacagacgcagggctggccctgttgaaccccgccctcgccctccatccggcactcgtggccttagacttaggagactgcatgctgggagacgaggcgatcaatcttatctgcggcctgttgcctcctgatggtgcaaaatctggcttgaaagagcttactctctccgcaaatcccgggatcaccccaaagggctggtccagactcgcaatcgctgtcgctcatagcagtcaggtgagagtcttgaacctggactacaacccactgggcgaccacgtcgccggcatgctggctgtagctgtggcctcgagtcgcacactggaagtcttggatctcgagggtactgggctcacaaatcagtctgcacagacacttttggacatggtggagaactaccccactgccttacgctctctggtgctggccgaaaattcaatttcgccagaattgcagcagcagatctgtgatctgctctccgaaggcgaagaagaggaggaggtggccgggggagcgggtgatactcaggaatgggagcgaggtcgcgagccggccgcccaccaacggggttcgagctcatggatgtgcccatcagacccttccagtcagatggtcttgatgactagtggactgggcgacagcctattggccgagacagagatgtag

SEQ ID NO: 30954 - DNA, 1245 bp, Artificial Sequence
  Description of Artificial Sequence: Synthetic coding sequence
atgaagctacattgcgaagtagaggtgatctcccgtcacctccccgccctcgggcttcgaaacaggggcaaaggagttagggctgtcctctcgctctgccagcagaccagccggagccagcctcctgtgcgagcattcctccttatttctactctgaaggataaaagaggcaccagatacgagctgagagagaacattgagcaattcttcacaaaatttgtggacgaagggaaagctacagtcaggctaaaagagccaccggtggacatctgtctctccaaggccatctcatcatcactgaaggggtttttaagcgccatgagactcgcgcatcgcggatgtaatgtggacacccctgtgtcaacccttacacccgtgaagacctctgagttcgagaacttcaagaccaaaatggtgatcacctcaaagaaagattaccccctgtccaagaatttcccatactccctggaacacctccaaacttcgtactgcggactggttagggtggacatgagaatgttatgtctaaaatcactgcggaagctggacctctcgcacaatcatatcaagaagttgccagcaactattggtgatctcatccatcttcaggagttaaacctgaatgataaccacctggagtcattctctgtggcgctgtgccacagcaccctgcagaagagtctcagatccctggatctgagtaagaataaaatcaaggcactgcccgtgcaattttgtcagttgcaggagcttaaaaaccttaaactcgatgacaatgaattaatccagttcccatgtaagatcggtcagctgataaatttgcggttcctgtctgccgcccgcaataagctgccgttccttccctcggagtttaggaacctttctctcgagtacctggatctgttcggaaacacttttgagcagcccaaggtccttcctgttatcaagctgcaggcgcctcttaccctgttagagagctccgcgcgaaccatcctgcacaaccgcattccatatggctcccacattatcccgtttcacctatgtcaggacctcgataccgccaaaatctgtgtgtgcggacggttttgcttaaattcattcatccaagggacaaccaccatgaatctgcactccgtggctcatactgtcgtcctagttgataacctgggtggaactgaagccccaatcatcagctatttttgttctctggggtgctatgtgaattcttccgacatgctcaaatag

SEQ ID NO: 30955 - DNA, 441 bp, Artificial Sequence
  Description of Artificial Sequence: Synthetic coding sequence
atgaaactgcattgtgaagtcgaggtcatcagccgccatcttcccgctctgggcctgcggaacagaggcaagggcgtcagggcggtgttgagcctgtgccagcaaacctcccgaagccagcccccagtcagagcctttctgctcatttccacactgaaagataaacggggcacaaggtatgagctgagggaaaatatcgagcagttcttcaccaaattcgtagacgaaggaaaggctacggtgcggctgaaagaacccccagtcgacatttgtctaagcaaggacagcatctggctgtcgtatcacagcattccatcgttacctcggtttggttacaggaaaaacctatgcctgtggaaaatcctgagcgaactgttccattccaggaactattaccacgagtccgccttctgctgtccacattgcggtctctcacgttag

SEQ ID NO: 30956 - DNA, 1269 bp, Artificial Sequence
  Description of Artificial Sequence: Synthetic coding sequence
atgaagcttcattgcgaggtcgaggtaatcagtcgccatctcccagccctgggtctcagaaacaggggaaagggtgtgcgcgctgttctgagcctttgccagcagactagtcggtctcagccaccggtaagagcattcctcctcatttccacactgaaggataagcgtggtaccagatatgagctcagagaaaatattgagcagttcttcaccaaatttgtagatgaaggaaaagctacggtacggctgaaagagccgcccgtggacatctgcttgagcaaaatggaatctcatagtgtgacccaggtgggggtgcagtgggaagagctgggatcactgcagccaactggacacttccagcagtttaaaaggttcccttttagctatgagaccggccaccgagggtgcaatgttgatactccagtctccacacttacacccgttaaaacatcagaatttgaaaattttaaaactaagatggtgataacaagtaaaaaggactaccctctgagcaagaacttcccgtattctctggaacatctgcagacgtcttattgcggactggtgcgggtcgacatgcgtatgctgtgcctgaagtccctccgcaaattggatttgtctcataaccatataaaaaagctccctgcgactataggcgatcttattcacctacaggaattaaatctgaacgacaatcacctggaatctttctccgtcgccttgtgccacagcaccctgcagaagtcacttcggtccctagacctgagtaagaacaaaattaaagcccttcccgtgcagttctgccagctgcaggagctaaagaacttgaaattagacgataatgagctgatccagtttccttgcaaaattggccagttgatcaatttacgcttcctcagcgccgctcgtaacaagctgccctttctgccttcggagtttcgcaatctgtccctcgagtaccttgacctgttcgggaacacgtttgagcagcccaaggttctgcccgtgatcaaactccaggcgcccttaactctgttagagtcatcggcacgcacgattctccacaaccgcacaatataccctaaagaaattaatgtcaacatgtgggaaaccctccctggtagaatatctctggggtgcatgtacgatttcgccgcatctaattggtccaagggacgcttcctgtatacttgttggcgggggggtatgtgtatcgtgacgcatcttgatgactccaaaacctttattaaaactaacttcagtttctag

SEQ ID NO: 30957 - DNA, 507 bp, Artificial Sequence
  Description of Artificial Sequence: Synthetic coding sequence
atgcacccaagcttggctactatgggaaagctggcatctaagctacagcttgatctctccgttgtgaagatctggttcaagaatcagagggctaagtggaaacggcagcagcgccagcagatgcagacacggccgtcacttggaccagccaaccagacaacaagtgtgaagaaggaggaaactccatctgcaatcactaccgccaacattcgacctgtgtctccagggatatcggacgccaacgaccatgatctgcgcgagccgagcggcattaagaatccaggtggcgctagcgcatcggcccgagtgtcaagttgggactcccagagctatgatatcgagcagatctgtttgggcgcatctaacccaccctgggcctctacactgttcgaaatcgatgaattcgtgaaaatttacgatcttcctggcgaagacgacacgtcctctctcaaccaatacctgtttcccgtgtgcctcgagtacgaccagctccagtcgtctgtctag

SEQ ID NO: 30958 - DNA, 549 bp, Artificial Sequence
  Description of Artificial Sequence: Synthetic coding sequence
taggcccatggcttccagcctcacgcaagtgtcgaacccgcatgccaggccggcacatggaatttgaaacagctatctcaggaggggccacggaggtaccgccggccacgtacacgctttctcagcaaacagctcacggcccttcgcgaactgctggagaaaaccatgcacccaagcctagccacaatggggaaactggcatccaagctgcagctcgacctcagcgtagtgaagatttggtttaagaatcagagggccaaatggaaacgtcagcagagacagcagatgcagactagaccaagtctcggaccagcgaaccagacaacgagtgtcaaaaaagaggagaccccatccgcaataacaacagctaacatccgacctgtgtccccaggcatcagcgacgccaacgaccacgatctgagagaaccttctggtatcaagaacccaggcggggctagcgcatctgctcgggtgtcctcttgggactcacagtcctacgacatagaacagatttgcctgggcgcatccaaccctccctgggcgtcttag

SEQ ID NO: 30959 - DNA, 573 bp, Artificial Sequence
  Description of Artificial Sequence: Synthetic coding sequence
atggcgtcacggggaaagactgagacttccaagttgaaacagaacttggaggaacaactggatcgattgatgcaacagctccaggatctggaagaatgtagagaggagctggatactgatgaatatgaagaaaccaaaaaagagacactcgaacaattgtcggagtttaatgactctctcaaaaaaattatgtccggcaacatgacccttgtggatgagctcagcggaatgcagctggctatccaggcagcaatcagtcaggccttcaaaaccccagaagtgatccgtttgttcgctaagaaacagccagggcagttgagaacccggttagctgaaatggacagggatttgatggttggtaagctggagagggacttgtacacacaacaaaaggtggagatcctgaccgctctcagaaagctgggtgaaaaacttactgcggatgatgaggctttcctgtcggctaatgcaggtgccattctgagccaatttgagaaagtgagcacagacctcggatctggggacaagatcctcgctctcgcttctttcgaagtagagaagactaaaaagtag

SEQ ID NO: 30960 - DNA, 573 bp, Artificial Sequence
  Description of Artificial Sequence: Synthetic coding sequence
atggcaagtcggggtaagaccgaaacatcgaaacttaaacagaatttggaggagcaattggacaggctgatgcagcagctgcaggacctcgaggaatgtagagaggagctcgatacggatgagtatgaagaaacgaaaaaggaaactctcgagcagctgagcgaattcaatgattcacttaaaaaaatcatgagtgggaacatgacccttgtcgatgaactctcaggcatgcaattggcaatccaagctgcaatcagtcaggcatttaaaactcccgaggtaattaggttatttgctaagaagcagcccgggcagcttagaacgcgcctcgctgagatggaccgggacctgatggtcggcaagctggagcgggacctctatactcagcagaaggtggagattctcaccgccttgcggaagctgggagaaaagctgaccgccgacgatgaagctttcctgtcggcaaatgctggggccatcctttcacagttcgaaaaagtttcaacggatctgggcagcggggacaaaatccttgctctggcctcatttgaagttgaaaagacgaagaagtag

SEQ ID NO: 30961 - DNA, 573 bp, Artificial Sequence
  Description of Artificial Sequence: Synthetic coding sequence
atggcatcacgtgggaagacggaaaccagcaaattaaagcagaatctggaagagcaactggacagacttatgcagcagctgcaggatcttgaagagtgcagagaggagttggacacggatgaatacgaagagacgaaaaaagagactcttgaacaactgagcgagttcaacgatagtttgaagaagatcatgtcaggcaacatgacactggtcgacgagctttccggcatgcagctcgcgatccaggccgctatatcacaagcctttaaaacacccgaagtgatacgcctgttcgcaaaaaaacagccaggccagctgcggacacggctggccgaaatggaccgcgatcttatggtggggaaattagaaagggatctgtatacacagcagaaagtggagatactgacagcccttagaaagctcggggaaaagttaaccgccgacgacgaagcatttctgagcgcaaatgccggcgcaatcctcagtcaatttgagaaggtgagcaccgatctgggatccggcgacaaaattttagccttagcttcctttgaggtggagaagacaaagaagtag

SEQ ID NO: 30962 - DNA, 636 bp, Artificial Sequence
  Description of Artificial Sequence: Synthetic coding sequence
atgaacaactttatatttctgaaatttatgaccctgggaacatctcgcacaggagaaatcaaaatggcctccagaggcaagaccgaaacttctaaactgaagcaaaacctagaggagcagttggatcgcctcatgcaacaactccaggacctggaggagtgcagagaggaattggacacggacgaatacgaggagactaagaaagagacactggaacaactttcagagtttaatgacagtctcaaaaagatcatgtctggcaatatgacgctggtggacgaactctccggaatgcaacttgcaatccaggctgctattagccaggccttcaaaacccctgaagtgattagattatttgctaagaaacagccgggtcagctccgcacccggctggccgaaatggaccgtgacttgatggtaggtaaactggagcgggacctgtatacacagcaaaaagttgagatccttaccgctctcaggaaacttggcgagaaactgaccgcagatgacgaagcttttctgtccgcaaacgccggagccatactcagccagttcgagaaagtgagtactgacctcggcagtggagataaaatcctggcacttgccagttttgaggtcgagaaaacgaaaaagtag

SEQ ID NO: 30963 - DNA, 720 bp, Artificial Sequence
  Description of Artificial Sequence: Synthetic coding sequence
atggttcaaccccagacatccaaggcagagtcccctgcgttagctgcgagtccgaacgcccagatggacgatgtgatagacacattgacaagtttgcggttgaccaactctgccctgcgtcgggaagccagcaccctccgtgccgagaaggccaacttgaccaatatgctcgaaagcgtaatggctgaactgacactgcttcgcactagggcacgaatccccggagcactacagattaccccccccattagcagcatcacctccaatggcacacggcccatgacaactcctcctacctctctaccagaacccttctcgggcgatcctggccggctggctgggttcctgatgcagatggaccgtttcatgatattccaggcttccaggttccctggcgaggccgagagggtggcattcttagtcagccgtttgactggggaagcagagaagtgggctatcccccatatgcagcccgactctccccttagaaataattatcagggcttcctggccgaattgcggcgcacttataagagccctctgaggcacgcaagaagggcacagattcgcaagacatccgcatcaaatagagctgtccgcgagagacaaatgctttgtaggcagctcgcttcagcagggactggaccgtgccctgtccaccccgcctctaatggaaccagtcctgcccccgcccttcccgcccgcgcgaggaatctctag

SEQ ID NO: 30964 - DNA, 2079 bp, Artificial Sequence
  Description of Artificial Sequence: Synthetic coding sequence
atggaccaccacatcccaatgcatgccctgcccgaagaaatccagaagatgttacccgaggaaaaagtgtgcaaatactgcggagtttcctatttaatcttacacgagtttaaagctatggaggagaaggtgaaggctatggagaaggaaatgaagttctaccagggctcggtcgaccgagagaaaagactgcaggagaaactccacagcctgtctcaagagctagaacagtacaaaattgataacaagtctaaaactgagcgcatatatgatgtcggtatgcagctcaagtcccagcagaatgagttccagaaagtgaaaaagcagctgtcccatctgcaggacgagttgaaaattaaatatcgtcaatcctatatcttttcccaaagattgtcagaatataaatatttctggaataaaaccctgtcactgttgaccttcacgaaaagggaacttacatccattaaaaatgaagtgtacgataactatcagaactggacttcactcaagggggctgtctttctccagattaagtccatttccgagacagcactcaccgaaattgatatcctgaataagagccttacagtgtcccaaagaaataaagtgtgcctagagaaggagatgaagaacctgaaactcctttcagatgccgccattctgcgtagccagcagatcagaacctcacggcagcaggaagttaatttacaaacaagatgttatgatctgcagaaagaggtcctagacctgcagtgcctggtcgaggcactagggctgaagctgcagaaggctgtcaccgaaatggacaactataaggaaatgttgatgaataaatcaaacgaggccgacgactgtcagcgcgagctgaaaaagttaaaattcgagagtatcatctccgagtctcagcacaccatgttgcttaaggaaaaggaggattccctcatgacctgtcagcagatttacaaggctttgcaagaggaactaactgtgaaagaaaagcaggaagaagacatcaagaggaggatcaatctcgccgaaaatgaacttgagatcacgaaaacgcttttaaaccaaacgagggaggaagtgctgacattaaagaacgagcgggagctaatgttaatttctcatcagaaatcaatcgagcaactacaagagaccctacggcaaaagctcctgagtgatgataactggaaggaaaagattgaagctgaactcgccaaagagcgggcccagcacctggtcgaattcgaggagcaggcactgctgttcaaagaagaaaccaagctacagctggatatcgaaaaggagaagcaccaagacgtcatccagaaatataagaaggagcaggaagaattgcagatgaagatttctgacttgattaccggggctacacgagaccttaggcaggaggttacaacactcaaagaaaaactgcacaagagtcacatcaggtatacagaggagagtaatagtaaagaaaaggagatagagaatctgaagaatctcgtcgcggaatttgagagcagactgaaaaaagaaatcgattccaatgatagtgtgtctgagaatctgcgcaaagaaatggaacaaaagagcgacgagttaaagcgagtgatgctcgcgcagacacagctgattgagcagttcaaccaatcccaggaagaaaacaccttcctccaagaaactgtgcgccgggaatgtgaggaaagatttgaactgaccgaggcccttagccaggcaagggagcagttgctggagctgtctaaattgcgcggttccttgcctttcagcccctgttctctttccaaaggaagcctgacatctcccgcggcggcggtgagtaatcacggcgaacgtagcttggcccgtttgaattccgaaaaagggatacaaatcccgaacctgaggggagtttctaagcctaccactttccctacgagcgacaaacccaaaagggtacgctcgggcgtccccattttgccccagcctcatccccctcggggaggcgccagcagcgccaatgagacacggcaacggctcgctgcgatcctgaggaggcggagatctcagcagtag

SEQ ID NO: 30965 - DNA, 1167 bp, Artificial Sequence
  Description of Artificial Sequence: Synthetic coding sequence
atgttgctaaaagaaaaggaggattctctaatgacgtgccagcagatttataaagcgttgcaggaggagctgaccgtcaaagagaaacaggaagaagatatcaagcggaggattaatctggctgaaaacgaactcgagatcacaaagacccttctgaaccagacgagagaggaggttctcactctgaagaatgaacgcgagctaatgctgatatcccatcagaaaagcatcgaacagctccaggaaacactgcgacagaaattgttatcagatgataattggaaagaaaagattgaggcagaattggctaaggaacgtgcacagcatctggtggaattcgaggaacaagccctgttgttcaaggaggagacaaaactgcagcttgacattgagaaggaaaaacatcaagacgtgatacaaaagtacaagaaggagcaagaggaattgcaaatgaagatctcagatctcattacaggcgctaccagagacctgcgtcaggaagtcaccacgctgaaggaaaaactacacaaaagtcacattcgctacactgaagagagcaacagcaaagagaaggaaatagaaaacttaaagaacctcgttgcagagttcgagagtcgtctgaaaaaagagattgacagcaacgattccgtaagcgaaaatcttcgcaaagagatggagcagaagtcagacgagctgaagcgcgtgatgttggctcagacccaattaatcgagcagttcaatcagagtcaggaagaaaatacctttctccaagagaccgtgaggcgcgaatgcgaagaaaggtttgagcttaccgaagcactttcacaggcccgagagcagttactggaactttctaagctgcgggggtccctccctttctcaccttgctccttatctaaagggtcactcacttcacccgccgcagctgtcagcaatcacggggaaaggtctctcgcacggcttaactccgagaaaggcatccaaatccctaatctgcggggagtgagcaaaccgacaaccttccccacgtcagataagccgaagcgcgtccgctctggtgtaccaatccttccccaacctcacccaccccgcgggggagcgtcctcagctaacgaaacacgccagcggttggctgccatcttacgcaggcgacgctcccaacagtag

SEQ ID NO: 30966 - DNA, 1653 bp, Artificial Sequence
  Description of Artificial Sequence: Synthetic coding sequence
atggcctcagtatttcattatttcctcttggttctggtctttcttgacacacacgccgctcaacctttttgcctccctggctgcacttgcagtgaagaaagtttcggtaggaccctgcaatgcaccagcgttagcctggggaaaatccccggcaatctttctgaggagttcaagcaggtgcgaatagagaactcaccattgtttgagatgccacagggttctttcattaatatgagcacactggagtatttgtggctcaacttcaataatatttccgtgattcaccttggggcattggagcacctccccgagctgagagagctaaggctggagggcaataaactgtgcagtgtgccatggacggccttcagagctactccgttgctccgggtactcgatttaaaacgcaataaaatcgacgcactacctgaactggccctgcagtttctagtaagtcttacatatctggacctaagctctaatcggctgaccgtggtaagtaagagcgtcttccttaactggcctgcgtatcaaaaatgtaggcagcccgattgcggagccgaaatcctgtccagcctggtggttgcactgcatgataatccttgggtgtgcgattgcaggcttcgcgggctggtccaattcgtgaaatccatcactctacctgttatcctcgtaaactcctacctgatctgtcaaggtcccctatctaaagccggacagctgttccatgagaccgaactctctgcctgcatgaaacctcagatttctacaccttcagcaaatatcactatcagggccggccagaatgtcacgcttcgctgtctggctcaggcctcaccatcccctagtatagcctggacttacccgctttcaatgtggcgggagttcgatgttctcacttcgagcacgggagaggacacagctctaagcgaattagcaatccccgcagcccacctggtggattctggtaattacacttgtatggccagtaatagcatagggaagtccaatctggtcatctcactgcatgttcaacccgctcaagccctccatgccccagattcgctctcaatccctagcgagggcaacgcatacatcgacctcagggttgtgaagcagaccgtgcacggcatactgttggagtggcttgccgtggcagacaccagcaaagaagagtggtttaccctttatatcgcatctgacgaggcttttcgcaaggaagtcgtccatatcggtcccgggataaatacttacgccgtggatgatctgttacctggcacaaagtatgaggcatgcttatctctcgagggacagccacctcaccaaggtcagtgtgttgcatttgtaacagggcgcgatgctggaggactggaggccagggagcacttactgcatgtgaccgtggtgctgtgtgtggtcctgctggcagtacctgtgggcgcatacgcttgggcagcccaagggccttgtagttgcagcaaatgggtgcttagagggtgcctgcacaggcggaaagccccttcttgtacacctgccgcaccccaatccaaagatgggtcatttagggagcatcccgctgtctgcgacgacggtgaagggcacatcgataccgagggcgacaaggagaaggggggtaccgaggacaactcctag

SEQ ID NO: 30967 - DNA, 1683 bp, Artificial Sequence
  Description of Artificial Sequence: Synthetic coding sequence
atggccagtgtgttccactactttctgttagtcctagtcttcctggatacccacgccgcccagcccttctgtcttcccgggtgcacatgcagcgaagagtcgttcgggagaaccttgcaatgcacgagcgtatcactggggaagatacctggcaacttgtcggaggagttcaaacaggtgagaatcgaaaattccccactgttcgagatgccgcagggcagcttcattaacatgtcgacgctcgaatacttgtggctgaattttaacaacatatccgtgatccacctgggggcccttgaacacctgcccgagctcagagaactgcgactagaggggaataaactgtgcagtgtcccctggaccgcattccgggccacccctttgttgagagtgctggaccttaaaaggaataaaatagatgccctaccggagttagctctgcagttcctggtgtccctcacctacctcgacctgtcaagtaaccgcttgaccgtggtatcaaagtctgtgtttcttaactggccggcttaccagaagtgccgacagccggactgcggcgccgaaatcctgtcatcattggtcgtggcgctccatgacaatccctgggtgtgcgattgcagactcagggggctggtacagtttgtgaagagcatcaccctaccagttattcttgtcaattcgtatttgatttgccaggggcccctgtcgaaggccggtcagctgttccacgagactgaactgtcggcctgtatgaagccacagatatccaccccctctgcgaacataaccatcagagcaggacaaaatgttactcttagatgcctggcccaggccagcccctctccttctatcgcttggacctaccccctgagcatgtggagagaattcgatggactcttaggcggcaagcatcttacccccgtgctcactagtagtacaggcgaggacaccgccctgtccgagctggcgatccccgctgcacatctcgttgactcagggaattatacttgtatggcctccaactccattggaaagtcaaacttggtaatcagcctccacgtccagcccgcgcaggcacttcatgctcccgattccctctcaataccctccgagggcaacgcatatattgacttgagggttgtcaaacagaccgtgcacggcattcttttggaatggctcgccgtcgctgacacttcaaaggaggagtggtttactctgtacattgcatcagatgaggcctttcgaaaggaagtggtgcacatcgggcctgggattaatacttatgcggtcgatgacctgttacccgggacaaagtacgaagcctgtcttagcctagagggccaaccgccacatcagggccagtgcgtggccttcgttacaggccgtgatgctggcggtctggaagcccgagagcatctgctgcacgtaaccgtagtgctttgcgtggttttgcttgccgtgcccgttggagcttatgcatgggccgcccagggaccttgcagttgtagcaaatgggttctgcgaggatgtctgcaccgtcgcaaggcaccctcctgtacacccgccgctccccagtccaaagacggtagctttagggagcatcccgccgtttgtgatgatggcgagggccacatagatactgagggcgacaaggagaaggggggaaccgaggacaatagttag

SEQ ID NO: 30968 - DNA, 1176 bp, Artificial Sequence
  Description of Artificial Sequence: Synthetic coding sequence
atgcgggggagttgtgagcgaagcggagaagatgaagagcagaaggaggaagccatggtcgcctgcggccgcctttccggtgtgcccgaggctgagcagggaccagaagcgaactgggactctgatcttgaaaccgagggcacagatggactgggggagttagtacgggatactctgtacctaaggtcttgtagggcgcacagcgtggttccaatctcctgttttcttcgacaggggagcgcccaggagctaaacctgcgccaccgtggactagggcctcagggagcgcgggccctggcctcatcgctgagcagtaacccatatgtgaaacgactggatttacgagacaacggcctctgtggagccggagctgaggccctggctggcgccttgtcgaaatctagcagcatacacgacgtggacttgtctgagaaccagctcggcgtggcgggagcccaagccctgtgcgccgctctaacagtgaatcaggctatgaggaaaatgcagctgtccggaaacggattggaagagcaggctgcccagcacctggcagagctgctgcttgcacatacagatcttaaaagcctggatctttcttataatcagctgaatgaccaggctggggaaacactagggcctgctttggccgaaaacacaggactcacagagctgaatgtgagttggaatcaccttcgcgggcctggtgcagtggcctttgcccgcggactggaggcgaacatattcctgaaagttcttgacatttcttacaacgggtttggtgacccaggggcatccgccgttggggaagcactcaaggcgaataacgtgctggaggaactgaacatgtctaataaccggattagcgctatgggagcactttctctgggtcttggcctccgagttaatcagacactgaggatcctagttagtagaaaccctatgcgctccgagggatgcttcggtctgctaaagagcgtacaggacaatccagcctccgccctggaacttttggacttcagcgatatccaagtaaatgcagaatttgacggtttggctagcagtgtccgcggaatcttgcccgagctgtgcatcaagactggggcgtgtagagtggagtacaagaaagagttactcccggtttttcgcagcgccctgcccgctagcgttcctaaatag

SEQ ID NO: 30969 - DNA, 486 bp, Artificial Sequence
  Description of Artificial Sequence: Synthetic coding sequence
atgcgagggtcttgtgagcgcagcggcgaggatgaagaacaaaaggaggaagccatggtggcttgcggcaggctgagcggagttccagaagccgagcagggtcctgaggcaaactgggattccgacctcgaaactgaaggcacagacggcctcggggagctagtcagagataccttgtatctcagaagctgtagagcccattctgtggtgcctattagttgcttccttcgacagggctccgctcaagagctgaatctgcggcaccggggattgggtccacagggcgctcgagccttggccagctctctgtcatccaatccttacgtcaaaagactggatctccgcgacaacggcttgtgcggcgctggagcggaggcactggcaggtgccttgtctaaatcctcttccattcacggtagatgctgggtttgggggcgctgggcgggggtttcatcgttctcgtctggaatgtgcctgcaccgatag

SEQ ID NO: 30970 - DNA, 2298 bp, Artificial Sequence
  Description of Artificial Sequence: Synthetic coding sequence
atggctgcctcacagggcggcgggggcaattctggaggcggaggatgcggcgggggggggtcttcgggcgggtgtgggacggcgggaggaggaggaggcggtgcgggtggcggagggggcggcggcggcggcacactggtggtgcccattccagtcccaaccctttttggtcagccctttcccaatggcccaccatggaatcccggatctctgcagccccaacacactgttcgatccttggatcgagcactggaggaggcgggaagcagtggcatcctctctctctctggcagaaagttacgcgactttcccgggtctggatatgatctgaccgacacaacccaggctgatctgtccagaaaccgcttcacagagatccctagcgacgtttggctcttcgccccactggaaacactcaatttgtatcacaactgcattaaaaccattccagaggctatcaaaaacctgcaaatgctcacctatctgaacatctccaggaacctgttgagcacccttccaaaataccttttcgatctgcctcttaaagtcctggtggtgtccaacaataagctcgtgtcaatcccggaagagattggtaaactcaaagatctgatggagttagacattagttgcaacgagattcaggtgctcccccagcagatgggcaaactccattcactgcgcgaactcaatattagacgcaacaaccttcatgttctgcctgatgaacttggggatctgccgctcgtgaaactggattttagctgcaacaaggttaccgagattcccgtgtgttacaggaaactgcaccacctccaggttatcattctggacaacaatcctctccaggtacctccagcacagatatgcctaaaaggcaaagtgcacattttcaagtatctcaatatccaagcttgctgcagaatggacaagaaaccagactcactggatctcccatcactgagtaaaaggatgccctcgcagccattgaccgattctatggaggatttttacccaaacaagaatcacgggcctgacagtggaataggatccgacaacggggaaaagaggctgagtactacggaaccgagcgatgacgacaccgtgtcattgcactcccaggtttcagaatccaatcgggaacaaacgagtcgtaacgattcccacataatcggcagcaagaccgactcccagaaggatcaggaagtgtacgactttgtggacccaaatacagaggatgtagctgtccctgaacaggggaatgcccatattggatcttttgtttcattctttaaggggaaagaaaaatgtagcgaaaagtcacggaagaacgaggagctgggcgatgaaaaacggttggagaaggagcagctcttggccgaagaggaagatgacgatctcaaagaagtcactgatctgagaaaaatagcggcacagttattgcagcaagagcaaaagaacagaatcctgaatcacagtaccagcgtgatgcggaacaagcctaagcagactgtagagtgtgaaaagtccgtgtccgcagatgaggtaaactcccctcttagcccgctaacctggcagccattggaaaaccaaaaggaccagatcgatgagcaaccttggcccgagagccaccccattatctggcaatcagaggagcgccggaggtccaaacagatacgcaaggagtatttcaagtacaaaagcatgcgcaaatcgagctccggtaatgagaacgatgaacaggattcagataacgccaatatgtctacgcagagccctgtgtcatctgaagagtacgacagaacagatggattctcacatagtccatttggactcaagcctagatcggccttctcccgcagctctcgccaagagtacggagctgcggatcccggcttcaccatgagacgcaaaatggaacatctccgggaagaacgcgagcaaatccgacagctcaggaacaatctggaatctaggctcaaggtcatcctccccgatgacatcggcgcagcgttgatggatggcgttgtcctgtgtcacctcgcgaatcacatacgaccgcgcagcgtggcgtccattcatgtgccctccccagccgtcccaaaactgagcatggcaaaatgtcgccggaacgttgaaaatttcctggatgcgtgcaaaaagctgggtgtctcacaggaaaggctgtgtctgcctcatcatatactggaggagagggggctcgtgaaggtgggagtgaccgtgcaagctctgctggaactcccgactactaaggccagccagctgtccgtcgcctag

SEQ ID NO: 30971 - DNA, 735 bp, Artificial Sequence
  Description of Artificial Sequence: Synthetic coding sequence
ggtctttttagtctgccaggtacatggaggagagtccgggaggaagctgtcactgtgggcgaatctcacccgataatttggcagtctgaagaacgccggagatcgaaacagatcaggaaagaatatttcaagtacaaaagtatgaggaaatcctccagcggcaacgagaacgatgagcaggatagtgataatgctaacatgagcactcagtcccctgtctcatccgaagagtatgatagaactgacggattttcacattcccccttcggccttaagcctaggtctgcctttagcaggtcatctagacaagaatatggcgcagcggatcccggctttaccatgagaagaaagatggagcacctgcgggaagagagagagcagattaggcagctccgtaacaatctagaatcccggctgaaagtcatacttcctgatgacatcggggctgctctgatggacggggttgtcctctgtcatttagctaatcatatccggccacggtccgtcgcctcgatacacgtgccttcgcctgccgtgccgaaactgagtatggccaaatgtcgcaggaacgtcgagaattttcttgacgcttgcaagaaactgggcgtgtctcaggagcggctttgtcttccccaccacattctggaggaaaggggcctcgttaaggtgggagttacagtgcaggctctccttgaacttccaaccaccaaggcatctcagctctccgtggcatag

SEQ ID NO: 30972 - DNA, 2247 bp, Artificial Sequence
  Description of Artificial Sequence: Synthetic coding sequence
atggcagccagccagggtgggggggggaattcaggagggggaggatgcggagggggaggatcctctggtgggtgcggaacagccggagggggggggggaggggcaggcgggggaggtggcggaggtggtggtacactggtggtacccatcccagtacccacactgtttggccagccgttcccgaatgggccaccctggaaccctggcagtctccagccccagcacactgtccgcagcctcgatagggctcttgaggaggcaggcagcagtggaatactaagtctgagcggacggaaattacgggatttccctggttctggctacgacctgaccgatacaacacaagctgacctcagtcggaatcgcttcactgaaatcccgtctgacgtgtggttgttcgcccccctggaaacactaaatttataccacaactgcatcaaaactatccccgaagcaatcaagaatttgcagatgctgacctacctgaatataagcaggaacttgctatctacattgcctaaatatctgtttgatctgcctctgaaggtcctggtggtttcgaacaacaagcttgtgagcatccctgaggagatcggcaagctgaaggatctgatggagttggacatttcttgcaacgagattcaggtgttaccccagcagatggggaagttgcattccctgcgggaactgaacatcagaagaaataacctgcacgtgctgcccgatgagcttggcgacctccccctggtgaagctcgattttagctgcaataaggttaccgagattccagtgtgttatcgcaagttgcaccatctgcaggtgatcatcctggacaataatccactacaagtgccacccgcccagatctgtttgaagggtaaagtgcacatcttcaagtatttaaatattcaggcttgttgtcgtatggataaaaagcctgactccttggacttgccctctctgagcaagaggatgccaagccagccgttgacagacagcatggaggatttttatccgaataaaaaccacggccccgattcagggatcggtagtgacaacggggagaaacgcctgtcaactaccgaaccctcagacgacgatacagtgagtttgcactcacaggtgtccgaaagtaaccgagaacagaccagccgcaatgactctcacatcattgggtcaaaaaccgactcacagaaggatcaggaggtctacgacttcgtcgacccaaatacagaggacgtcgccgtgccagagcaaggcaatgcacacatcgggagctttgtatcattttttaaaggaaaggagaaatgtagcgaaaagtcaaggaaaaatgaagaattgggcgatgaaaagagactggagaaagagcagttgctcgcggaagaggaagacgatgatttaaaggaggtaaccgatctgaggaagattgcagcacaactcctgcagcaggagcagaagaatagaatcctgaaccactccacttctgttatgcgtaacaaacccaaacagacagtggaatgtgaaaagtcagtctccgccgatgaagtcaatagtcctctttctcccctgacgtggcagccactcgaaaaccagaaggaccagatagacgagcaaccatggcctgagagtcatcccatcatttggcaaagtgaagaacgtcgcagatctaaacagattcggaaagaatattttaagtataagtccatgaggaagtcaagtagtggcaatgaaaatgacgaggagtatgaccggactgacggcttttcacacagtccatttggactgaaaccacggtccgcctttagccggagttctcggcaggagtatggcgctgccgaccccggctttacaatgcgccgtaaaatggagcacctgcgtgaggagagagagcagatccgccagctgaggaataatctggaatctcgcctgaaagttattctgccagatgatatcggagctgcgctgatggacggggtggtcttgtgtcacctagctaatcacattcgccccaggagcgtcgcatccatacacgtcccttcccccgctgtacctaaactgtccatggccaagtgtcgaaggaacgtggagaacttcctggacgcctgtaagaaactcggggtttctcaggaaaggttgtgcctgccccaccatatattggaagaaagggggctcgtcaaggttggcgtcactgttcaggctttgctggaactgcccactactaaggcgagtcagttaagtgtggcgtag

SEQ ID NO: 30973 - DNA, 2247 bp, Artificial Sequence
  Description of Artificial Sequence: Synthetic coding sequence
atggcagcctcccagggcgggggcggcaattccggcggcggagggtgtggcggggggggatcttcaggagggtgcggaacggcaggcgggggaggcggaggcgctgggggaggcgggggcggcggcggcggtactcttgtcgtgcccatccctgtccctaccctgttcgggcagccatttcctaatggacccccatggaaccctggtagcctgcagccacagcatacagttcggtcactggacagagccttggaggaagccgggtccagcggaatcctgtcactgtcgggccggaagctccgtgacttcccgggcagtgggtacgacttaacagatactacacaagctgatttgagtcggaaccggttcaccgagataccatcagatgtatggctttttgcaccactggaaaccctgaatctctaccacaattgtatcaagactattcccgaagcaatcaaaaaccttcagatgctaacctacctaaatatttctcggaatctcctgagcacactgcctaagtacctctttgatttacctctgaaggttctggtggtgagtaataataagctagtgtcgatccctgaagaaattgggaagctgaaagacttaatggagctggacatttcctgtaacgaaattcaggtgctgccacagcagatggggaagctccatagtctgcgtgaactaaacattcgtcgaaataatcttcatgtcttacccgacgaattgggagatcttcctctcgtcaaattggatttttcgtgcaacaaggtgaccgagatcccggtctgctatagaaaactgcaccacttgcaagtcatcattctagataataatccgctgcaggttccgccggctcagatatgtcttaaggggaaggtacacatattcaagtatttgaacatccaagcatgctgtaggatggataaaaaaccggacagcttggacttgcctagcctcagcaagaggatgccaagtcagccactcaccgactcaatggaggacttctatcctaataaaaatcatggccctgactccggcatagggtctgacaacggtgagaaacgcttaagtactactgaaccgtctgatgacgacactgtaagcctccatagccaggtgagcgaaagcaaccgagagcagacatcacgaaacgattcccacattatcggcagcaagacagactcccagaaagatcaggaggtctacgactttgtggatcccaacactgaagacgtcgcggtgccggagcagggtaatgctcacattggttcgtttgtgagcttctttaagggcaaagagaagtgtagtgaaaagagtaggaagaatgaggaattaggagatgaaaagcggttggagaaagaacagttactggccgaagaagaggatgacgacctgaaggaggtcacggatctaagaaagatcgctgcccaattgctacagcaggaacagaaaaaccgtatcctgaaccacagtacctcagtgatgaggaacaagcccaagcaaaccgtggaatgtgaaaagtcagtgagtgcagacgaggttaattctccactttcaccattgacttggcaaccattggaaaaccagaaggatcagatcgatgagcaaccatggccggaatcccaccccataatttggcagtcggaggagcgccgaaggtctaagcagataagaaaagagtatttcaagtacaagtcaatgcgcaagtcttctagcgggaatgagaatgacgaagagtacgacagaacagacggattcagccactcaccattcgggcttaagccaaggagtgccttcagcaggtcttcaaggcaagaatacggggctgcagatcctggatttacgatgcgaaggaaaatggagcacttgcgggaggagagggagcaaatccgccaactgagaaacaatctggaatccagactcaaggtgatactcccagacgatataggcgccgcattgatggacggagttgtgctgtgtcaccttgctaaccacatccggccccgttccgtcgcttcaatccacgttccgtcgcctgccgtccctaaactgtcaatggcgaagtgtcggcgaaatgtggagaattttctggacgcatgcaagaaactcggggtttcccaagaacggttgtgtctccctcatcacatcttagaggagcgcggtttagtcaaagttggagtaaccgtgcaggccctgcttgagctgcccacgacgaaggccagccagctgtctgtcgcttag

SEQ ID NO: 30974 - DNA, 351 bp, Artificial Sequence
  Description of Artificial Sequence: Synthetic coding sequence
atgacccagcttaaggagctggatatctcaaataacgccatcagggagataccacggaatattggagaactccggaatcttgtaagtctgcatgcttataacaaccagatatcctatttaccccctagcttgctgagcctcaatgacttgcaacagttgaacctcagcggtaacaatcttacagccctgccatctgccatttacaatattttctctctaaaagagattaattttgatgataatccactgctccggccccctgtcgaaatctgtaaagggaagcaactttacactattgcccggtacctgcagagagctgatgagcgtgacggactccagttgcactcctag

SEQ ID NO: 30975 - DNA, 2583 bp, Artificial Sequence
  Description of Artificial Sequence: Synthetic coding sequence
atgtcggagaaggagggaatgtctgaggtgcttgaagacacaatctcccagtttaggaaggaatctagatcccagagcatgaaagagccaggttttatcaaagagactagtaacctgatcaacgaggcatcagattacctcgagggcaagtcatccaaccaaatttacgagacccatcctaggcagaacaccttggagtcaacatcctccagtgggaggaagtctaagcgcaatgaagagcagaaaaagaatcttcagttttccgagacatctacgcggacaggaacctcccagtctctttcaagcctcaccggcaggacagccgagtaccaagctcttgtgaacttcctaagtcacgagaccgtgggtgaagtttctcctcaggtctcggaagagaaccagaaacagctgggcctgggcgccgacaattttactgtgaacttggaagccaaaggtttgcaggagttccccaaagacatcttaaagatcaaatatgtaaagtacctttacttagataaaaaccagattaagacttttcaaggggctgattcaggtgatcttttaggcctcgagatcctatctctgcaggaaaacggactctcctccctcccgagcgaaatccaactgttgcataatctgcggatcctgaacgtgtcacataatcacattagtcatatcccgaaggaaataagtcagttagggaatattcggcagcttttcttttacaataattatattgaaaatttccccagtgatctggagtgcctgggcaacctggaaatactctctctggggaagaacaaactgcggcatatccccgacacactcccctctttaaagacactcagggttctgaacttagaatacaaccaacttacgacattccctaaggctctttgttttttaccaaagttaatcagccttgatctgaccgggaacctgatctccagcctgccaaaggagattagggaactgaagaatcttgagacgctcctcatggatcataacaaactgacctttttagccgtggagatctttcaattactcaaaattaaggaattacagctggccgataataagctggaggtcatctctcacaaaatcgagaattttagggaactccgcatactgatacttgataagaatttactgaagaatatacccgagaaaatctcttgctgtgctatgctggaatgtctgtcactgtccgataataaactgacagagcttccaaaatacatacacaagctgaataatttacgcaagctgcatgtgaatagaaataacatggtcaagattacagactgtatcagtcacctaaacaacatttgttccttagagttctccggcaacattattaccgacgttcccatcgagattaagaattgccaaaaaatcattaaaattgaactgtcatataataaaatcatgtacttccccctaggcctatgtgcattggacagtctgtactaccttagcgtcaacggaaattatatcagcgagattccagtggatatctcgttcagtaaacaattgctgcacttggagctcagtgagaacaagctcttaattttttcagagcacttctgttccctgatcaaccttaaatacctagaccttgggaagaaccaaattaaaaagattcctgccagcatttctaatatgatttcgctccacgtcctgatcctgtgttgtaataaatttgaaacctttccgagggagttatgtacactggaaaatctgcaagtcctggaccttagcgagaatcagcttcagaagatttcttcagacatctgcaatctaaaaggcatacagaaactgaatttctcttcaaatcagttcatccatttcccgatcgagttatgccaattacaatccctggagcaattaaacatctcacagattaaaggccgcaaactgacacgacttcccggggaattatccaatatgacacagctgaaggaactggacatcagtaacaatgcaataagggaaatccccagaaatatcggcgaacttagaaacctggtgagcctgcacgcgtataacaatcagatctcttacctgcccccgtctcttctgtcattaaacgacttacaacagcttaacctaagtggaaacaatctgactgctctgcccagtgcgatctataatattttcagtttgaaagagataaacttcgatgacaatccgctgctgaggcccccagtggagatttgtaagggtaagcagctatacacaattgcccgctatctccagagagcagacgaacgggacgagaaaatcctggaaaagatatttaagatagttgctaacaatatcacagagacaaatttcgaattcttgtgtcagaaactgaatcttgcgaatagtgagaccgatatgccaaccaagtctaccgtgagtctgtccgagagggcacaccaggccctggttatatggaaaactcagtccaacaagctgagcctgacagctgctgccctgagggatcaacttattagggcattgacaatgattggagcttacgagataatggataagattacggccctgaacctcttcacacgggccattaagttctag

SEQ ID NO: 30976 - DNA, 180 bp, Artificial Sequence
  Description of Artificial Sequence: Synthetic coding sequence
atgagtgagaaagagggtatgtcagaggtactggaagacaccatctcccagttcagaaaggaatctaggtcacagtccatgaaggaacccggcttcatcaaagagacttccaatctgatcaacgaggcatctgattacctcgaggggaaaagctccaatcagatatacgagactcattag

SEQ ID NO: 30977 - DNA, 354 bp, Artificial Sequence
  Description of Artificial Sequence: Synthetic coding sequence
atgacacagctgaaggagctggacataagcaacaatgccattagggagattccacgcaatatcggcgagctgaggaatctggtcagcctccacgcctacaacaaccagatttcctacttgccgcccagcctgttgtctctgaacgatctccagcagcttaacctgagtggcaataatctgacggcattgcccagtgccatctacaatatcttcagtttgaaggagatcaacttcgatgacaatccactgctgaggcctcccgtggagatctgcaagggaaagcagctgtacaccattgctcggtaccttcagagggctgatgaacgtgacggccgcttgaaaatacacacctag

SEQ ID NO: 30978 - DNA, 2583 bp, Artificial Sequence
  Description of Artificial Sequence: Synthetic coding sequence
atgtctgaaaaagaggggatgtccgaggtgctggaagacacaatcagtcaattccggaaagaatcccgatcccagtcgatgaaggaacccggctttataaaagagacttccaacctcataaatgaagcctctgattacctagaaggcaaatctagtaatcagatatacgagacccacccccgccagaatacacttgagagtacctcctcaagcggaaggaagtccaagcgcaatgaagagcagaaaaagaacctgcagttctccgaaacaagcacccggactgggactagccagtcactgagttcacttactgggcgtactgcagagtaccaggcgctggtcaacttcttgtctcatgagaccgtcggggaggtcagccctcaagtttcggaggaaaaccaaaagcagcttggacttggcgccgataacttcacggtcaacctagaagctaaagggctccaggagttcccaaaagacattctgaagattaagtacgttaaatacctgtatctggacaagaatcaaatcaagacatttcaaggcgccgactccggggatctgttgggtttagaaatcctgtccctccaggaaaatggcctctccagtctgccttcagaaattcagctgcttcacaatttgcggatcttgaacgtgagtcacaatcacatttcgcacattcctaaggagatctcccagctgggaaatatccgccagctgttcttttataacaactacattgaaaattttccaagtgacctggagtgtctggggaacctggaaatacttagtctcgggaaaaataagctcagacacattcctgacacactgcccagtctgaagacccttcgcgtccttaatctggagtataaccagctgacgacgttccctaaggccctgtgctttcttcctaaactcatctccttggatttgacagggaacttgatcagctccctgcctaaagagattagagagctaaagaacctggaaaccctactgatggatcacaacaaactgacattcctggccgtcgaaatctttcagctgcttaaaataaaggaactccaactcgcagacaataagttggaagtaatttcgcataaaatcgagaatttccgggaactgcgaatcctgatattggacaaaaacctgcttaaaaatattcctgaaaagatctcctgttgcgccatgcttgaatgtttatcattatctgacaacaagctcaccgagctgcctaaatatatccataagttaaacaaccttcgcaagttacacgtcaatagaaataatatggtgaagattactgattgtatcagccacttgaacaatatttgtagcctggaattcagtggcaatatcattaccgatgtgcctatagaaatcaaaaactgtcaaaagattataaagatcgaactgtcatacaataagatcatgtactttcccttgggcctgtgtgccctggattcgctgtattacctgagcgtcaatggcaattatatctcagaaataccggtggatatctccttttccaagcaactcctgcacctcgagctgtctgaaaataagctgctgatttttagcgaacatttttgcagtctgattaatctgaaatatctggacctggggaaaaaccagattaaaaaaatcccggccagcatctccaacatgatttcccttcacgtactgatcttgtgctgcaacaagttcgaaacttttcctagggagctctgtacattagagaacctccaagttctggatctctcagagaaccaacttcaaaaaattagttctgacatctgcaatctcaaggggatccaaaaactgaacttctctagcaaccaattcatccatttccccatcgagctctgccagctccagagtctcgagcagttgaatatcagccagattaagggaaggaagctcactcgattaccgggagagctgtccaatatgactcagttgaaggaattggacatttcgaataatgccattcgcgagatccccagaaacatcggagagttgcgcaatttggtttcgctgcacgcatataataaccagatttcttaccttccaccctcactgctctcccttaatgacctgcaacaactcaatttaagcgggaataacctcacagccctccctagtgcaatctacaacatcttctcactcaaagagatcaacttcgacgataatccgctgctgagacccccagttgagatttgcaagggtaaacagctgtacaccattgcgcgctatttgcaacgtgccgatgagagagatgaaaaaatccttgagaaaatcttcaaaatcgtggcgaacaacattacggagactaactttgagttcctgtgccagaaacttaacctcgccaactctgagacagatatgcctactaaaagtactgtgagcctctccgaacgtgcccaccaggcactggtgatttggaaaacgcagtccaacaagttgtccttgacggctgcagccctgagggaccagcttattcgagccctgaccatgatcggcgcctacgaaattatggataagataaccgcactgaacctgttcacaagagctattaagttctag

SEQ ID NO: 30979 - DNA, 2478 bp, Artificial Sequence
  Description of Artificial Sequence: Synthetic coding sequence
atggccacaagcgagagggcactgctgagaacacgggcagcctccttgctgagaggtctaggccgttctcgtacgggggcccggtcattacaatttagggcggaaaaggagcgccagccttgctggagctttcctatgggacaaaagaccaaaggctcctcaaatatcgccagctcttacctgctgcagcagctcatgcaccgttatcaggagctggacagcgatggcgacgaggatcagggtgagggggaggcgggatcagaggaaagctcagaatcagagatgctgaatctggaagaggagtttgatggggttctgcgcgaggaggctgtggccaaagcactacatcatctgggccggtctggctcggggacggaacaggtgtatttaaatttgactctgagtggttgcaacttgatcgatgtcagtatcctgtgtgggtatgtgcacttgcagaaacttgatctctctgccaacaaaatagaggatctttcatgtgtcagctgcatgccttacctccttgagctgaatgcgtcccaaaacaacctcactaccttcttcaacttcaaacctccaaaaaacctcaagaaagcggatttctctcataaccagatatccgaaatctgtgacctctcagcgtatcacgcactcactaagcttatccttgatgggaatgagattgaggagatctctggcctggagatgtgcaacaatctcatccacctctctctagcaaataacaagatcactacgattaacggactgaacaagctcccaattaagatactttgtctctctaataaccagattgaaatgattactggcctggaggacctgaaggcccttcaaaatctcgatttgtcccacaatcagatctcgtcattgcagggcctggagaatcatgacctactcgaggtaatcaatttagaagataataaaatcgccgaacttcgggagattgaatacatcaagaatctccctatcttgcgtgttctgaacctcttagagaacccaattcaggaaaagtccgagtattggtttttcgtcatcttcatgctactcaggctcaccgaactagatcagaagaagatcaaagtggaagagaaagtgtctgccgtaaacaaatacgaccctcccccagaagtagtggctgcccaggatcatctaacccatgtggtgaactctgtgatgcaaccccagagaatttttgattcaacactgcccagcctcgatgccccctatcccatgctgattctggctggacctgaggcctgcggcaaacgcgaacttgcccaccgcctgtgtcgccagttctcaacatattttagatacggcgcctgtcatacaactcggcctccatatttcggggaaggagacagagtagattatcatttcattagccaggacgtgtttgatgaaatggtgaatatggggaagttcattcttaccttcagctacggtaaccataagtatggcttgaaccgcgacactgtggaaggcattgccagagacggtctggcatcctgcatacatatggagatcgagggggtgcgcagcctgaagtatagctattttgagcccaggtatatactggttgtgcccatgaataaggagaagtacgaagggtacctgcggagaaaagggttgttctctcgcgctgagattgagttcgccgtgtctcgggtggacctgtacatcaaaatcaaccaaaactttccagggtattttgatgaggtgatcaatgcggacgacttagacgttgcctatcagaaactgagtcagctgatccgagagtacctcgggctcactgaggaacctgccaagtctctggctacgaccgcagacgtgaaaaccagccatctgaagcctgaggcccaccctacgaagtacataagcagcaacatgggtgattttctgcattccaccgataggaactacctgatcaaattctgggccaagctgtctgccaagaaaactcccgctgagcgagactcaatacataggcaacatgaggccgccagacaggccctgatgggccgcatacgccctgatcacacgctactcttccagagaggccctgtgccagcacctctcacatctggattgcactactacaccacgctggaggaactctggaagagcttcgatttatgtgaggactatttcaagccgcccttcgggccatatccagagaagagtggaaaggattcactcgtttccatgaaatgctccttgttccggttctgtccatggagtaaagagcttccctttcagcccccagagggcagcatttcatctcacctgggaagtggtgcctcggatagcgaaactgaggaaacacggaaggctctgcctattcagagcttctctcatgaaaaagagtcacatcagcatcgccagcactcagtgcccgtgatttctcggcctggatccaatgtcaagcccacactgcctcccatccctcagggacgtcggtag

SEQ ID NO: 30980 - DNA, 3933 bp, Artificial Sequence
  Description of Artificial Sequence: Synthetic coding sequence
atggatgacgacgatgctaagctcaaagccgagatcgaagcggaactggacaaactcagcatttcatccctggaaaaggaagacatcgaaagtgacgcgaagtccgagactcagtccgatgactcggacaccgatagcgttgagctgccagaaagcgtactgcactgtattaacataatcaagaaccggagtaaagccgtggaagaactcatcctgcaagacttagaggataccgacatcctgtcttgcagttatggcgccgttagtaacaatcatatgcacctgcggactgggctatcaactgaatacgaggagagcagcgagcagttaattaagatactgtctgagattgaaaaggaggagttcatgagaagcaaaaccgactgtgcaaccccggattttgttccggaacccagtccccacgatttgccgatggacgagcatgttctaccggacgacgccgatatcaattttggatactgcgaagtggaggaaaaatgcaggcaaagttttgaggcatggcaggaaaaacagaaagaattggaagacaaggagaaacaaacgctcaaggcccaaagagatagggaagaaaaacagtttcaagaggaggaagaaaagagacattgttggatgaagcagtttaaggtcgaaaagaaaaagctggagaacattcagaaggagtacatccgtaacctgcacctgcagatggaggaagagaggacgcgctttaaagatcaacaagaaaaagaaaagaactccctgttaaaacagcagaacaacgccgcagtgaaaatccaggcgaaatataaagcatttgttgcataccagaagtacggccctatcatcaaggaacagatcgagagtaagaagcggaaagcacaagagtggaaagaaaaagaggcaaagattcgccaaaaggaagaggagaaccgcaagcggctagaggaggagcagagaattaaagaagagcgaaaaaaacagaaggaagaggaacgtaagcgccgagaaaaagagtatgaagagaaaaaaaacatcgtgaagcaagagcgagagcagctaattagtaaagagaaaattatcctgagggaggatgcctctcagcaattgataataagctctgcattaaaaaagagcggctacaataacaaacacttgtctctcgaagatatctccaatgataaaggagatatcgctaaaaacctggtggacgagaatagcaaaaagcaggaagacgtattactctggctggtagaagagagcaacatgaaagagaatgtggaccgccagaccatcctgaaagagagcatacaggttaagctaaaggagtctatttctagccagacaatattggcggattttaagatggaagagaaaaatgagaatctcgctaagaagcggtgtagcgaagagttggtgaagcaggagcgaaagtacgaaaacactgacaataagactgagctagggaatagcgatctcaaaggcaatctgaaggagcagttcccattacaggaactcaaatccgacgcccagaaggaagaaaaaataatgaaacacgtcataaatgaaaataccgggcagaaaacgcagattatcctcggtcacaatcaggaaataagcgaggtgaaaaccaacgaagagcagaagatcattaaagacaaccagcaaaagaaaatccaaaaagtagaaaaggaggaaatccaggaacagaacggactcctgtacaaagacaaggatacactggttatctctgtgaagcagagatctctgtccctgacaagtgagaatagcaaggatgtcagagagaacgtcatactgcaggagaaggagatctattctaaatcaaaggagattgaagaaaatccaaaggataatgcgtggaatagcggcatcgtcatttttaacacaaccgacacaatgattaacatcgaaggtaagcggaatgaccaggactatgtgctggggagacacgccccatgcgagggcctgagcaactataacgctgaatctagcatggtgtccaaggaggtgaatagtctcaagtccgaaatccgtaacatctccgaaaagtgccatgagaatgcacccgaacctgactccatgacctgctgcgttagtgaaagtacactgctttacagcatcgaagaacgaagactcgcatggatcaaaagtttcaagccttggttagaaatattcaaacaaaaccaacagaagaaaatcgtacgacggaagcggccagttaaatgtcctgctaacatgacccctgctttagacaagctagagatccttagatgtggaccttgggacaccttgcagcaagtcacgactgtgactttccaggacttgcccggttgtgttctatctaccttagctgagtgtactaatcttcaatttttgtcattgcgccgttgcggattaacaagcctgcactccctctctaattgtaagaaactaaagtacatagacgctcaggagaatcacatcgaggccattgaatgcgagaacttggagaatttgtgcgttgtgcttcttaacaagaatcagcttacctctctccatgggctggatggttgtacaaatatccagtgtctggaactgagctataataaaatcacaagaattgggtacagctttttcttagaagagaagttggtggacaatgcgggcttttgccaccacctcggaaccagtacatcttacctgtccctcgcgcaggtatggatacctacaggattgtgttggtcttggatcccaatcacatctctgaccaaaaatagcgactgtaacttcctcattagtcatctgtattggaattgtggcctagagagcttgaagaacctccaacagctcatactggaccacaatcagttgatcaacacgaaaggcctttgcgacacccccactattgtgtacctggattgcagccataatcatttaacggatgtcgagggcgtggagaactgtgggctgttacaaattctcaagctgcagggaaattacctgagcgaacttccctctctcgaaaatctagtgctcttacgtgagctccacctagacgataattcgatttcaacagttgaagcatttagctcctattggctccctctgttgcagaacattaccatcagtcagaattcgctcactaagatcgtgccgctgttccacttcgtctccctcgagaagctggatgtctctcacaattgtttatccgacctgaaaagcgccatcaaatggttcgatgcctgctactccctgcacgagctgagcctaactggcaaccccctgctgcaggaaaccaactggagggactcactgttaaaggtacttcctgccctgcgaatcctgaacggaaacattctgaattccaacagcgaaagtagaactgaggaacacaatcagctgggctccgccggtttcctagccctctgccaaagccagatcagagaattcaaccttctgatcgagaactacatcaccgggaagggtgatgttttcacactagatacagctgagaatctgtgtcactactttaagaagttgatgattctgtcaacagagtatcgacatgcgcacgaaagaggggatgtgacgatcaccaagaaggacgagtctgaagcccagaaaaatcatctggctcctacaaactctgacagcactcttcagaacggcgttttctattcctgcgctagggagggtgagcctgatagccccgatatccccgagaagtggatggacagtgtgagctcgcattcaccgttgagcaaatctgccacatgcgaaaatatggaagggcggcatcaagagattctcgtgtgtcagaagcgcgaggattccaaggccagtagcattcccacgatccggatccctttcaaagaagtcgtcatgacaaactctcttttaaggaatcatcagaatatagagccatcggagaagtag

SEQ ID NO: 30981 - DNA, 495 bp, Artificial Sequence
  Description of Artificial Sequence: Synthetic coding sequence
atggacgatgacgacgcgaaactcaaagccgagatcgaggccgagctggataaactcagcattagcagcctggagaaggaagatattgagtcagatgcaaagtctgagacgcaatctgatgacagcgacactgactccgtggagctgccagaatccgtgctgcattgcatcaacatcatcaagaatagatccaaagcggtggaagaactgatcctgcaagatctcgaagataccgatatcctgtcatgtagctacggagccgtgtctaataatcacatgcacttacgtactggactctccacagagtatgaggagagttctgagcagttaattaagattttatctgaaattgagaaagaggagttcatgcgctccaaaacagattgcgctacacctgactttgttccagagccttcgccccatgatctccccatggatgagcatgtgctgccagatgacgccgatatcaatttcggatactgcgaggtcgaatag

SEQ ID NO: 30982 - DNA, 5169 bp, Artificial Sequence
  Description of Artificial Sequence: Synthetic coding sequence
atggatgatgatgatgctaaactgaaggcagaaattgaggcggagctggacaaactgtccatctcatcccttgaaaaagaggatatcgagagtgacgcaaaatccgagacacagtcggacgacagtgataccgactccgtggaactgccagaatcggtacttcattgtattaatattatcaagaatcgtagtaaggccgtggaagagctcatcctgcaagacttagaagatacggatatcctgagttgctcttatggagccgtgtctaataaccacatgcacctgcgtaccgggctgtccaccgaatatgaggagagctcggagcagctgatcaagattctatccgagatcgaaaaagaagagttcatgagatcaaaaactgattgcgccaccccagactttgtccccgagccgtctccccacgaccttcctatggacgagcacgtgcttcccgatgatgcagacattaactttggatactgcgaagtcgaggagaaatgcagacaatcttttgaagcatggcaggagaagcagaaagagctcgaagataaagagaaacagacactgaaagctcagcgcgatagggaagagaagcaatttcaggaggaagaagaaaaaagacactgctggatgaagcagtttaaagtggaaaagaagaaactagagaatatccagaagcaggagcaggacaaaatgaacgatgagctctacaaggaggaaaaaatctggaaggagaaattcaaacagcacgaggaatacattcgtaacctgcatctacagatggaggaagagagaactcgtttcaaagatcaacaggagaaagagaaaaattctctgctgaagcaacagaataacgccgctgtcaaaatccaggcgaagtacaaagcctttgtggcataccagaagtatgggcctattattaaagagcagatagaaagtaagaagaggaaggcccaggagtggaaagaaaaagaggcgaagatccggcagaaagaggaagaaaatcgaaaacgccttgaagaggagcagaggattaaagaagaaaggaagaagcagaaggaggaagaacgcaaaaggcgagagaaggagtatgaagagaagaaaaatatcgtgaaacaggaaagggagcagcttatctcgaaggagaagattatcttaagagaagacgcctcccaacagctgatcatctcttcagctctcaaaaagtctggatacaataacaaacacctgtcactggaagacataagcaacgataaaggagacatagctaaaaacctagtggatgaaaattctaagaaacaggaggacgtcctattgtggctcgtggaggaaagcaatatgaaggaaaacgtggacagacagaccatcctcaaggagagcattcaagtgaaattaaaagagagtatctcgtcccagaccatattggctgactttaaaatggaagaaaaaaacgagaacctggccaagaagaggtgctccgaggagttggtcaaacaggagcgcaagtatgagaacaccgataataagactgagctgggaaatagtgacttaaaagggaacctgaaggagcagttccctttacaggagctcaaatccgacgcccaaaaagaagagaagatcatgaaacatgtgattaacgagaacacagggcaaaagacccagattatccttgggcataaccaagaaatctcggaagttaagaccaacgaagaacaaaagatcatcaaggacaaccagcagaaaaagatccagaaggtggagaaggaggaaattcaggaacagaatggactcttatataaggataaggataccttggttatctctgtcaaacagcgcagcctctcactgacttcagagaacagcaaggatgttcgggaaaacgtcatccttcaggaaaaggagatatactccaagagcaaagaaatcgaggaaaatccaaaggataatgcgtggaattccgggattgtcattttcaacacaaccgatactatgataaatatcgaaggcaagcggaacgaccaagactatgtgctcggtaggcatgcgccttgtgagggactttctaactacaacgctgaatcttcaatggtaagcaaggaggtgaattcactcaagagtgaaataagaaacatcagtgagaagtgccatgagaacgctcctgagccagatagcatgacctgctgcgtgagcgaaagcaccctgttgtactctatcgaagagagaagactggcttggatcaagagtttcaaaccctggctagagatcttcaagcaaaatcagcagaagaagattgtccgccggaaaaggcccgttaaatgccccgccaacatgacccctgctctcgacaaactagagattctccgttgcgggccatgggacactcttcagcaggtcacaacggttactttccaggacttgccgggatgtgtcctttctacgctcgccgagtgtactaaccttcagtttctctccctgcggaggtgcggtctgacaagcctgcattctctgagtaactgtaagaaacttaaatatatcgacgctcaggaaaatcatatcgaggctattgaatgtgagaacctcgagaacctctgcgtcgtgctcctgaataagaaccagctcactagtctccatggcctagacggctgtaccaacatccagtgtttggaactgtcctacaataagattacccgcatcggatattcattctttcttgaagagaaactagtggataatgctgggttttgtcatcatctgggtacatctacaagttacttaagccttgcccaggtctggatacccacgggactgtgttggtcctggatcccgatcacaagcttgactaaaaactctgattgcaatttcctgatttcgcacctctactggaactgcggactagaatctctgaaaaatctgcagcagctgatcctggatcacaaccaattgatcaatacgaagggactttgcgatacccctactattgtctacttggactgcagccacaaccatctcaccgatgtcgagggcgtggagaactgcggtctgctacagattttaaaactgcaaggcaactacctcagcgagctgcccagcctcgagaacctcgtattactgcgagaattacacttagacgataactcaatctcgacagtcgaagcattctctagttattggctccccctcctgcagaatattactatcagccagaactccctgacaaagatcgtgcctttattccattttgtctctctcgagaagcttgacgtatcccacaattgtctgagcgatcttaaaagcgccataaaatggtttgatgcttgttactctctgcatgagctgtcattgacagggaaccctcttctccaagagacgaattggcgggactctctcctcaaggtattgcctgctctaaggatcctgaacggaaatatcctgaactccaattctgagagtcgcaccgaagaacacaaccagttgggcagtgctgggttcctagccctatgccagtcacagatccgagaattcaatcttctaatcgagaattatataacgggtaagggagatgtgttcactctggacacagccgagaacctgtgccactatttcaagaaactgatgatcctgtcaaccgaatacaggcacgcacacgagcgcggcgatgtgaccatcactaagaaagatgagtccgaggcacaaaagaatcacctggcaccaaccaactccgacagtaccctccagaacggagtcttttattcctgcgcaagagaaggcgagccggatagccccgacatccccgagaaatggatggatagcgtctcctcccactcgccactgtctaaaagcgccacatgtgaaaatatggaaggcaggcaccaagagatactggtctgccagaagagagaggattccaaggccagttctatacctacaatccgaatcccatttaaggaagttgtgatgacgaatagtctgctgagaaatcaccaaaatatcgaaccttcagaaaagattatggccgcagtcgtcatacagagttactggaggggctatctcatgaggcggcagactcacttttctacacgcttacacactgccgccacagagggcctcccaaatagctctattaagaatcagactatcttgaagaaaggcaaacgcgaaaatatcgtcaatatcagaaaacagcgggaaaaggccgccatactgatccaggccgtttggaaagggttcatcttgcgcaagaagctaacaacagcgttggaggccattaagaacgaagagtctgatgaggagtaccgggagatcgacctcgaagacttcattttcgatgaagcagcgttggaggaagagtggctggcccttgatagcactagatttccgagccagaccctgctgctgtcaaaccagctgcattggccaaaaatccccggtaacctcaagtgggacgatacaagcttcaatctgccaagtaaccctgctcaagcctggctgtgtaacgataaggagaaccttagcagttctgagcatacgcagttcaactccagaagtgagaataagacaagctcatggacacctgaatcgaagaccagcaggaagtcactcctgaagtccgaaaaggaaaagaagatttctgaggagtggggtttcaaggacatttctactgcacagcagatgctgaagcgggcccagaaaatgaaaagtaagaagcttaagaagaagattgatagcacagtgcgtcttgctctcttcaaaaataacgaaaacaaggtgtctctccctaaatctcctaagatggtgcaacctcgaagagacggctactttgaggggattgaggaggacccaatacacaaagataccacagctaatgagaaactggaacgcaatagggagtatacctaccagtggctccatacacaagttggcgttcatgagactacttccagtcgaaacatgaaatgtaatcattttttgcctgaacttgaccctgatgtcctcaatggcggacgcgtgcagctggtcgcccgactggtctcccgcgaggacactgatttagaccttttctctatgacaaatggcagtgccctgagcgtcaatagagagaagaaaaaccaggctcacagacattctgccgggagcagttcaaagctgtggttcccaagtaaattaatatag

SEQ ID NO: 30983 - DNA, 1875 bp, Artificial Sequence
  Description of Artificial Sequence: Synthetic coding sequence
atgtttcacgggactgtgactgaagagctgacctcccatgaagaatggagccattacaatgaaaatattagagaaggccagaaagattttgtgtttgtgaagttcaacgggctgcacctgaagtcgatggagaatcttcagtcttgtatctctcttcgcgtgtgtatcttcagcaacaattttattaccgatatacaccccttgcagtcctgcattaagctcatcaagttagacctccatggaaatcagataaaatcacttcccaacacaaaattttggaatggtctgaagaacctgaagctcctgtatctgcacgataacggttttgccaagctgaaaaacatctgcgtgctgtccgcatgtccaaccctaatcgctctcacaatgttcgactgtcccgtaagcctgaaaaaaggctacaggcatgtgctagtgaattctatctggcctcttaaagcccttgaccatcacgttatctcagacgaagagatcatccaaaactggcacctgccagagcggtttaaagcttgcaatcatcgactgtttttcaacttctgccctgcactgcgcaaaggcactacctacgaagaagagatcaacaacataaaacatatcacctcaaagattaatgccattctcgcccacaatagccctgtgttgatagtccagcgatggatcagaggattcctggtgcgcaagaatctctctcctgtgttcttccataagaaaaagcagcaggaaaaaatcatcaggggatatgaggccaagtggatctatatcaccaagggatacgaggacaagcttctcaaagatctgttctttaagcccgagactaatattaaaggaaaactcgcctactggaagcacaacatctattatccggtggatctcaaaaactcctcagagcacaggaagcacgtgtccagcatcctgtgcgagctgaaaccaaaagacctgggcatgaaatccaaaacgtcaaggcacttgattcagaagggccaggagagcgaagatgagatagtcgatgaaaagctcgacacctcctttagaatatccgtgttcaaattacctatctacacttctggcagcctgaagaataatgccgtgctccgtgagaagaaacagcactttttcccggcttatccccagccgatatacaccacacatcccaagcctatcattaagaaggacattcggctggagagaagcatgaaagaattttttgctcctcagagggccgggatgaaactgagaacgtttagcgacatagacaagtactacaccgaacaaaaaaagcaagagtaccacaaggagaaggtgcgtgtggtcgccatggcccaagtggctcgggagcgggttcgtgtggctgttaacgagcacctgaatcagaaaaaatatgctacacagaagttgatcgaggagaataaggagaccatccagaattctcttcgccaggtgtggcaaaacagatttaattacctcgaaaaagcacgtgaaagaaaggccctttttttgaaggagaagtcccaaaaagctagcgaacgactgctagtgcaaaatttaaataacgagcgcacactcttaacaaggggtttactcaagatagacaggctggaaaagaatgaggctgttctgaaagagaagagtctaattgtgaaacagaagttaaaggcagaaaaataccgcaagaacctactgaaagaaatgaaaaaggtgcggtctcaggaaatttacaagcggcactgcgaagagaaattcgtcatggacatgatcgcatttgagaaggcttgcgagagactccaagatgctaaaactaaggttgctattgtgaagaccaacttagatttcaaagtcccgaacggcctgatcaaatag

SEQ ID NO: 30984 - DNA, 900 bp, Artificial Sequence
  Description of Artificial Sequence: Synthetic coding sequence
atgttccacggaaccgtgaccgaagagcttacaagccacgaagagtggtcacattacaacgagaacattcgggagggccaaaaagatttcgtctttgtgaagtttaacggcctccatctcaaatccatggagaatttgcagagctgtatatctctgagagtgtgtatattttctaacaacttcatcaccgatatccaccctctgcaatcatgtatcaaattaattaagttggacctccatggcaaccagataaagagcttaccaaatactaagttctggaatgggcttaagaatctcaaactgctgtatttgcacgataacgggtttgcaaagctgaagaacatttgtgtcctatccgcttgtcccaccctaattgctctgactatgttcgattgcccagtgagtctaaagaaaggatatcgtcatgtgctcgttaacagcatatggccgctcaaggcacttgatcatcacgtgatcagcgatgaggagatcatccaaaattggcatttgccggagcgtttcaaagcctgcaatcacaggctgttttttaatttctgcccggccctgagaaagggaactacctatgaggaagagattaataatatcaagcatattactagcaagatcaacgctattctcgcacataattctcctgtgctgatcgtgcaaaggtggatccgcggattcctggttcggaaaaatctctccccggtgtttttccataagaagaaacagcaggagaaaatcatccgaggctacgaggccaaatggatttatatcaccaaaggttacgaagataaactgttgaaagacctgtttttcaagcctgagacaaatatcaaagggaagctcgcttattggaaacatgacatcaagaagctgtacagcaatcaccactag

SEQ ID NO: 30985 - DNA, 1683 bp, Artificial Sequence
  Description of Artificial Sequence: Synthetic coding sequence
atgtctaaggatattaagtcggtggagcacagtcccaagattcaccagagaaatgacccacagcacgtgaacgatcgtaccttttttatcgatgcttctaaccaatctcttactgctatcccactggagatcttcacctttactgagctcgaagaagtgcacctggaaaataaccagatcgaggaaatcccacaagagatccaacgccttaaaaacattagagttctctatttggataagaacaacctccggtctctgtgtcccgccctgggactgctgagctctctagagtccttagatctttcctacaatcctatcttctcttcgagtttggtggtggtctcttttctgcacgctctccgtgagctgaggctgtaccaaaccgacttgaaagagatccccgtggtgatttttaagaacctccaccacctcgagctgctgggtctaactggtaatcacctgaagtgtctgccaaaggaaatcgtcaatcagactaagcttagagaaatatacctcaaaaggaatcaattcgaggttttcccccaggagctgtgcgtgctatatactctggagattatcgatctcgacgaaaacaaaataggcgcgatacctgaggagatcggtcaccttacgggcttacaaaagttctatatggcatcaaataaccttccggtactgcctgcttccctttgccaatgctctcagctctccgtcctggacttgtctcacaacttgcttcattccattccaaaatcgtttgccgagctgcggaagatgaccgaaatcggactgtctggcaataggctggaaaaggttcctagacttatctgccgatggacgagtctccacctgttatacttggggaatacggggctccaccgactgaggggctccttccgttgtcttgtcaatcttcggttcctggacctctcccagaatcatctgcaccattgtcccctacaaatctgcgccctgaagaatttggaggtcctggggctggatgacaacaagattgggcagctccccagcgaacttggaagcctgtctaagctcaaaattctgggcttaacagggaacgaatttctctctttcccagaggaggtgttaagcctcgctagtctggagaagttatatatcggacaggatcagggcttcaagctcacttacgtcccagaacatattagaaagctgcagagcctaaaagaactatacattgaaaataatcacttagagtacctgcctgtgagcttgggaagcatgcctaatctggaagtactggattgtaggcataatcttctaaaacagttgcctgatgcaatctgtcaggcacaagcgctgaaagaactcagactggaagataatctactaactcacctcccagagaatctagactcactcgttaaccttaaggtgctaacactgatggataatcctatggaggaaccccctaaggaagtctgcgctgagggcaacgaggcaatttggaagtacttgaaagaaaataggaaccgcaacattatggccacgaagatccaggcttggtggcgaggtaccatggtgcaaagggggttcgggaagtttggggaactgctgaagcctcagaaaaaaggaaagactagtcccaaagataaaaaaggcaagaaagacgtgaagggaaaacccggtaagggaaagaaaaaatag

SEQ ID NO: 30986 - DNA, 537 bp, Artificial Sequence
  Description of Artificial Sequence: Synthetic coding sequence
atggaacataaggacgacgacgatgacgatgtttctttcgctaagtggatgtcctctttctggggtcacagttggcgcgaagaagaccagagaggactgcgcgaacgtcatcgcctgcaagctacatctcacaggaaaacatcgctgccttgcccactccctgtgttaccccggataccgtcatccgactgccatcctcgacgacacagtcacgaggaccaggagttccgatgtagaagtcatgttcgcgattataggaagtattccgaggatggcagttttaaggaaccactggaatctaagggcaggtcgcactcaaaaatcgaaaagttctccgaatcgttcgagcggcagttatgtttccgaacaaagcggagcgcctcattgggtcccgaatctaggaaagagaggaacgagagggagtgcctgcggatggaaatcaaatcaagaaagaaggttgaggaagaacgctcatctcggaaagaggagcatggtgaggctcatatggcccccctgttcgagaagggacccgagtag

SEQ ID NO: 30987 - DNA, 1446 bp, Artificial Sequence
  Description of Artificial Sequence: Synthetic coding sequence
atgacccctgcactgaccgcattgctctgtctcggactctcattgggccccaggaccagggtccaggccggaccttttcccaagcccaccctttgggcagagcccggctccgtgatctcctggggcagccccgtcactatatggtgtcagggctccttagaagcgcaagagtaccaacttgataaagagggcagccctgaacctctcgacaggaataaccctttggagcctaaaaataaggcgcggtttagcatacctagtatgactcagcatcacgccggaagatatcgttgtcactactattccagcgcaggttggtccgaaccttctgacccgctggagttagtgatgactggcttttataataaaccgacattatcagctctgccatcccctgtggttgcaagcggtgggaacatgaccctgcgatgtggctcccagaagggataccatcattttgttctgatgaaagaaggcgagcaccagctcccgcgcaccttggatagccagcagctgcactcgggtggcttccaggctttatttcccgttggcccggtgacccctagtcaccgttggagatttacctgctattactactacaccaatacgccacgcgtgtggagccatcctagcgatcctctggagattctgccaagtggcgtgtcccggaagccttccctcctgaccctccaggggccagttctggccccagggcagtccctaacactgcagtgtggatcagatgtcggatacgacagattcgtgttgtacaaggagggagaaagggacttcctccagaggcccggtcagcagcctcaggccggcctaagccaagctaacttcacgctgggacccgtgtctccctcgcacggaggccagtatcgctgttatggcgcccacaacctgagctcagagtggtctgctccatctgatcctctgaacatcctaatggcaggccaaatttacgacacggtgtctttatccgctcagcctggacctacggtcgccagcggagagaatgtcaccctgctgtgccagagtcgagggtacttcgatactttcctgctgaccaaagagggagcagctcaccctccattaagattgcgtagtatgtacggtgcacacaagtaccaagcagaatttcccatgtcgcctgtcacaagcgcccatgctggcacttaccggtgctatggcagctattcctctaacccgcatcttctgagctttccctcggagccactggaactgatggtgagcggtcattctggcggtagcagtctccctcccaccggaccaccctccaccccagcctcacacgctaaagattacacagtggagaacctgattcggatgggcatggccggtctggtattggtctttctggggattctattatttgaagcacaacacagtcagcgaaacccccaggatgcagccggacgttag

SEQ ID NO: 30988 - DNA, 1395 bp, Artificial Sequence
  Description of Artificial Sequence: Synthetic coding sequence
atgacccccgcactcaccgcacttctctgtctgggcctctctctcggtccacgaacgcgcgtgcaggcgggacctttccctaaacctacattatgggccgagcctgggagtgttatatcttggggctcacccgtcactatatggtgtcagggtagcctcgaggcccaagaatatcagctggataaggaaggctctccagagcctttagacaggaacaatcctctcgagccaaaaaataaggcgagatttagcattccttccatgacccagcaccatgccgggaggtacagatgtcactactactcatcggccggatggtccgaacccagcgatcccctcgagctcgtgatgaccggcttctacaacaagcctacactttcggccttaccaagccctgtggtggcctctggcggtaatatgaccctccggtgtgggtcccaaaaggggtaccatcactttgtgctcatgaaggagggcgaacatcagttgcctagaacgttagattcacaacaactccatagcggtggatttcaggctcttttccccgtaggtcctgttactccgagtcacaggtggcgttttacatgttattattattacaccaatacacccagggtttggtctcaccccagcgacccactggagatactccctagtggggtctcgcggaaaccttccctgctgaccttacaggggcccgttctcgctcccggccagtccctgaccctccaatgcgggagcgatgtgggttacgaccggttcgttctttataaggagggtgagagggactttctgcagcgccctgggcaacagccccaggcagggctgtctcaagcaaattttaccttgggcccggtgagcccctcccatggcggtcagtatagatgttatggcgcccacaacctctcgtctgagtggagcgcaccgtcagaccctttaaatattctcatggcaggtcagatttacgacacagtgagcctgtcggcacagcctggccccaccgttgctagcggcgagaacgtcacattactatgtcaatctcgcggctactttgataccttcctgcttactaaagaaggtgccgctcacccgccgttacgcctacgaagtatgtacggggcccacaaataccaggccgagtttccaatgagcccagtcacctctgctcacgcagggacatatcggtgttacgggtcctatagttctaacccacacctgctgtctttcccctctgagcctctggagttgatggtctctgcttcacacgcgaaagattacactgtcgagaacctcattaggatgggcatggccggcttggtgctcgtctttctgggcatacttttgtttgaggcccagcactcccaacgcaacccccaggatgctgccggcaggtag

SEQ ID NO: 30989 - DNA, 1899 bp, Artificial Sequence
  Description of Artificial Sequence: Synthetic coding sequence
atgacacccgctttaactgctctcctgtgcctgggactgtctcttgggcctcgtactagggtgcaggcagggccctttcccaaaccgacgttgtgggctgaaccgggatcggtcattagttggggcagccctgtcactatctggtgccaggggtccctcgaagcccaggagtatcagctagataaagagggcagccccgagccactggaccgaaataaccctctggaacctaaaaataaggctaggtttagtatcccctctatgacccagcaccacgccggcaggtatcggtgtcactattactcttcagctgggtggtccgaacctagtgacccccttgagctggtgatgactgggttttacaacaaacccacactgtccgctctgccctcaccagtcgtggcttctggaggtaatatgaccctgcgctgtggcagtcagaaggggtatcaccatttcgttctgatgaaggaaggggaacatcaactgccaagaactctggattcacagcagctacattcaggaggatttcaggcactgtttcctgtggggccagtgactccgtcccaccgatggcggttcacctgctactattattacacaaacacacctagagtgtggagtcatccgagcgatccactggaaattctgccttctggggtgagccgaaaaccaagtcttttgaccctgcagggaccggtacttgcccctgggcagagcctgacactgcagtgcggatcagacgtgggttacaaccggttcgttctctataaggagggagaacgggactttcttcagagaccaggccagcaaccgcaggccggtctgagccaggccaactttacattgggccccgtgtctccgagcaatggaggacaataccggtgctatggagcccacaatttgagctcggagtggtcagccccaagcgaccctctcaatattcttatggcaggccaaatatatgacaccgtctctttatcagctcagcctggacctacggttgcctccggtgagaacgtaacacttctgtgtcagagttggtggcaatttgatactttcctgttaaccaaggaaggggccgcacaccctccactgcggttacggagtatgtatggggcccataaatatcaggcggaatttcctatgtcccctgttacatcagcccatgcgggcacatatcggtgttatggctcgtactcttcaaacccgcatcttctttcccacccctccgagccgctcgagctagtcgtcagcggtcactcaggtggttccagcttacccccaacaggaccccccagcactcctgggctgggaaggtatctggaggttttgatcggcgtttctgtcgcatttgttctgctcctgtttcttcttctgttcttgctgttgagacgtcagaggcattccaagcaccgtacgtcagatcagaggaaaacggattttcagagacctgccggggctgcagagaccgaaccaaaagacaggggactgttgaggcgatcatcccccgcggccgatgtgcaggaggagaatctctatgcagcggtgaaggatacccaatctgaggaccgagtggagctagacagccagcagagcccacacgacgaggatccccaggcagtgacatatgctcctgtgaagcacagcagccccaggcgtgagatggcaagtcctccaagcagtttgtccggagagtttttagatacaaaggaccgacaggtagaagaagaccgtcagatggatactgaggccgccgcctctgaggcctcacaggatgtgacctacgctcagctgcacagtctgaccttgagaaggaaagcaaccgagcctcctccttctcaagagggggagcccccagcagaacccagtatctacgctaccctcgccatacattag

SEQ ID NO: 30990 - DNA, 582 bp, Artificial Sequence
  Description of Artificial Sequence: Synthetic coding sequence
atgacaccagccctgacggctctgctgtgcctgggtttaagcctggggcctcggacgcgtgtacaggctggccctttcccaaaacccacgctctgggccgaaccggggtccgtgatctcttggggttctcccgtcaccatttggtgtcaagggagtctcgaagctcaggagtatcagctggacaaggagggctctccggaacctcttgatcgaaataatccgctggagcccaaaaacaaggccaggttctctatcccatctatgacccagcatcatgcgggacgttacaggtgtcattactatagctccgccgggtggtccgagccctcagaccctttagaactggtaatgactggattctacaacaagccaacactttccgccctgccttccccagtagtcgcatccggtggtaatatgaccctacggtgtggatctcagaaaggataccatcactttgtcttgatgaaagagggcgaacaccaactgccccggactctggattcccagcagctccacagcggcggattccaggccctgtttccagtgggccccgttactccttcacacaggcgggtgtag

SEQ ID NO: 30991 - DNA, 1899 bp, Artificial Sequence
  Description of Artificial Sequence: Synthetic coding sequence
atgacccccgccttaactgcactgctttgtctgggcctatctctcggccctcgaacacgggtgcaggccgggcccttccctaaaccgacactgtgggctgagccagggagcgtcatttcttgggggtcccccgtgaccatctggtgtcaggggagcttagaagcccaagagtaccagctggataaagagggtagccctgaacctttagacaggaacaatcccctcgaacctaagaataaggcccggttctcaatccccagtatgacccagcatcatgctggccggtatcgctgtcattactactctagcgcggggtggagcgaacccagtgatccattggagctggtgatgactggtttttataataaacccaccctaagcgccctgcctagtccagtggtggcatccggaggaaacatgactctcagatgtggaagccaaaaaggataccaccacttcgtgctgatgaaagaaggggagcaccagctgccacgcaccctagactcccagcaactgcactctggtggctttcaggcactgttccctgtggggcccgttactccgagccatcggtggagatttacttgttattactattataccaatacaccacgcgtgtggagccatccgtcagatcctctagagatcctaccaagcggagtctctcggaaaccatcactcctgactctgcagggtccagtcttggcaccagggcagagtcttaccctccaatgtggatctgacgtgggctacgaccggtttgtgctttacaaggagggcgagcgggacttcctgcagagacctggccaacagccccaagccggcctgagtcaggctaacttcactctcggtcctgtgagccccagccacggcggccagtaccgatgctatggtgctcataatttaagctccgaatggagtgccccctctgatccgttgaacatcttgatggcgggccaaatctatgatactgtttcccttagtgcacagcccggtcccaccgtggccagcggggagaacgtgacgctgctttgtcagtctcgcgggtatttcgataccttccttctaaccaaggagggggctgcccaccctccactgcgcctccgtagtatgtacggtgctcacaagtaccaggctgaattccccatgagccccgtgacttccgcccatgcaggaacatacaggtgttacgggagctatagctcaaacccacacctgttatcttttccgtccgaacctttggagctgatggtttccggtcacagcgggggctcctctctgccccccactggtccacctagtactcccggcctgggacgctacctggaagtcttgattggcgtgagcgtcgctttcgttctgctgttgtttctgctcctgtttctacttctccggaggcagcgacacagcaaacacagaactagtgaccagcgcaaaactgacttccaacgacccgccggtgcagcagagacagagcctaaggatagggggctattgaggaggtcctcaccggccgccgacgtgcaggaggaaaatttgtatgctgcagttaaagacactcagagcgaggacagagttgagcttgatagtcagcaaagtccacacgacgaggacccacaagccgtgacgtacgcccctgtcaagcattcatcccccaggagggagatggcttcgccaccatctagcctttccggcgaatttctagacacaaaagatcgccaagtcgaagaagatagacagatggataccgaggctgccgcatccgaagcgtcacaagacgtgacatatgcacaattgcactcactaactctacgccggaaggccaccgagccccctccttctcaggagggtgaacctcccgcagaaccaagcatctatgcgacgctggccatccactag

SEQ ID NO: 30992 - DNA, 1368 bp, Artificial Sequence
  Description of Artificial Sequence: Synthetic coding sequence
atgacacctgcactgactgctctcctctgtcttggactgtctctcggaccgcggactcgtgtgcaggcaggtccctttcccaagccgaccctgtgggctgagcctggcagcgtcatctcctggggctctcccgtgacaatttggtgccagggctctcttgaggcccaagaataccaactcgacaaggaaggctcccctgagccccttgaccggaataatcctctagagcccaagaataaggctcgattttcgattcctagtatgactcagcatcacgccggccggtataggtgccactactacagcagcgcgggctggtctgaaccttcagatccactggaactggtaatgacagggttttacaataagccaaccctttccgccttgcccagccctgtagtcgcttcgggcggcaacatgacacttcggtgtggatcccagaagggataccaccacttcgtgctgatgaaggagggagaacaccagcttccgagaacactcgactctcagcagcttcattcaggggggttccaggctctgttccccgttgggcccgtcacaccttctcacagatggcgctttacatgctactattactacacaaacacccctcgcgtctggagtcacccttctgacccccttgaaatcctgccctccggagtgagccggaagcctagcctgctcacgttgcagggcccggttctcgccccaggtcaatccctcactctgcagtgtggctcggacgtggggtacgacaggtttgtgctatacaaggaaggtgagagagactttctgcaacggcctggtcagcagccacaggcaggcctctcccaggcaaattttacgctgggccccgtgtctccatctcacggaggccagtaccgatgctatggcgcacataatttatcttctgagtggtcagcccccagtgatcccttgaacatactcatggccggccagatctacgacactgtgagcctctctgcccaacccggcccaaccgtggctagtggggagaatgtaactctcttatgccagagtcgcggctattttgacaccttcctactgacaaaggagggtgcggctcaccctcctctgcgtcttaggtcaatgtacggcgcgcacaaataccaggcggaatttccaatgtctccggtgacctcagcgcacgcagggacttatcggtgctatggcagctactcgtcaaaccctcatcttctgagctttcccagtgaaccactggagcttatggtgagcggtgaaggtgcagatccagtcctatccgagcttaaaggcagcgctcaggcccaggcccccaggcgggccctgggctgggacgggcccagggaagccgttagagaggcctag

SEQ ID NO: 30993 - DNA, 1896 bp, Artificial Sequence
  Description of Artificial Sequence: Synthetic coding sequence
atgacccctgctctcactgctctgctatgcctaggccttagcctgggcccgcggacacgcgtgcaggctggcccttttcctaaacctacgctctgggccgagcccggctccgtaataagctggggctcaccagtgacaatttggtgccagggatcgctggaggcccaagagtatcagctggataaagaggggagcccagagccactggacagaaacaacccactggaacctaaaaacaaggctcgattcagcatcccgtctatgacacagcaccatgcaggacggtacagatgtcattattacagcagcgccggatggtctgagcctagcgacccgctggaactcgtgatgactggcttctataacaagccgactctttccgcccttccttctccggtcgtggcttcgggcggaaacatgaccctgcgttgcggctctcaaaagggataccatcacttcgttctgatgaaggaaggagagcaccaactcccaagaacattggacagccagcaactgcattccggcggcttccaagctttgttccccgtgggacccgtgacgccctctcatcgttggcgctttacctgttactattattacacaaataccccgagagtgtggagtcacccaagcgacccacttgagattctaccctctggggtctcgcggaaaccgagtctcctgaccctgcagggacctgtactcgctcctggacaatccctcacactacaatgtggttctgacgtcgggtacgatagattcgttttgtataaggagggggaacgcgattttctccagaggcccggtcagcagccgcaggcaggcctgtcacaggcaaacttcacgcttggacctgtgtctccttcgcatggcgggcagtaccgatgctatggagcacacaatctttcttctgagtggtccgctccgagtgatcctctcaatattttaatggctggacagatctacgataccgtgtccttgagcgcacagcctgggcccacggttgcctcaggagaaaacgtgacgctcttgtgtcagagttggtggcaatttgacacatttctactcacaaaagagggcgcagcacacccaccgcttcggctgcgcagcatgtacggagcccataagtatcaggccgagtttcccatgtcacctgttacctcagctcacgccggcacttatcgatgctacggaagctattccagcaacccccatctgttatcccacccgagcgagcctttggagctagttgtgagcggccattccggagggagcagcttgccccctactggaccgccctcaacccccggccttggccggtatttggaggtcctgatcggcgtgtccgtggcctttgttctccttctgtttctgcttctcttcctccttctcagaagacaaagacactccaaacaccgcacttccgaccagcgtaaaactgactttcagcgccctgctggggccgcggagactgagcccaaagatcgtggtttgctgagacgtagttcgcccgctgctgacgtgcaggaggagaacctgtacgccgcagtgaaggatacgcaatccgaggacagggtggagctggattctcaatcaccgcatgatgaggacccccaggctgtcacctacgcgccggtgaagcactcctccccccggagggagatggcttctcctccgtcctctctgtctggcgagttcttagatactaaagacaggcaggtggaggaggatagacagatggatacagaagctgccgcttcagaagcctcacaggatgtcacctacgctcagctccattctttaacattgcggcggaaggccacggagcccccccccagccaggagggtgagccccccgccgaaccgtctatctatgccactctggcaattcactag

SEQ ID NO: 30994 - DNA, 1083 bp, Artificial Sequence
  Description of Artificial Sequence: Synthetic coding sequence
atgattccactcctgctggcagcattattatgtgttcccgcaggtgccctgacgtgctacggtgatagcggacaacccgtggattggtttgtggtctacaagctgccagcgcttcgcgggtcgggcgaagccgcgcaaagaggactgcagtataagtacttggatgaatcctcgggcggctggcgagatggccgcgcgcttataaactctcccgagggcgctgtaggtaggtccctgcagccactgtatcggtctaacacttcgcagttggcatttctgttatacaatgaccagccaccccagccctcaaaggctcaagactcttccatgagaggacatacaaaaggcgtgctgctgctggaccacgacggcgggttctggctggtgcattccgtgccaaattttcctccacctgctagcagtgcagcctattcgtggccgcacagtgcctgtacatatgggcagaccctgttgtgcgtcagtttcccttttgcccaattttctaaaatgggcaagcagctcacatatacatacccttgggtttataattatcagctggaaggtatcttcgcacaagaatttcctgatctggagaatgtcgttaagggacaccatgtgtcacaggaaccctggaacagctcaatcaccttgaccagccaggccggagcagtcttccagtcgttcgcaaaattttccaaattcggggatgacctgtactctggatggttagcagcagcactgggaacgaacctgcaggtccagttttggcacaagactgtaggcatcttgccttcaaactgctcagatatatggcaagtgctaaacgtgaaccagattgccttccccggccctgcaggcccatcttttaactcaactgaagaccatagtaaatggtgcgtcagtccaaagggtccctggacctgtgtgggtgatatgaacagaaaccagggcgaggaacagaggggcggcgggacgttatgtgcacaactcccagctctctggaaggccttccagccacttgtgaaaaattatcagccctgtaacgggatggccaggaaaccctcgcgcgcctataaaatatag

SEQ ID NO: 30995 - DNA, 2346 bp, Artificial Sequence
  Description of Artificial Sequence: Synthetic coding sequence
atggctgccaacgttggcgaccaacggagcacagactggtctagccagtatagtatggtggcgggtgctgggagggagaatggaatggagacccctatgcatgagaatcctgaatgggaaaaggcacgccaggcgctggcaagcatttccaagtccggggccgctggtggctccgcaaagagttctagcaacggaccagtagcctcggctcaatacgttagtcaggccgaagcttcagctctgcaacagcagcagtactaccagtggtatcaacagtacaattacgcctacccgtactcctattactacccaatgccgccagtgccaggcatggacgaatccatgtcctaccaggctcccccccaacagttgccatcagcacaacctccacagccttccaaccctccccacggcgcacacacattgaattctgggccacaaccgggcacagctcccgcgacccagcactcacaggctggacccgccaccgggcaggcatatggtccccacacttacactgaacctgcaaagccaaagaaaggtcagcagctgtggaaccggatgaaaccggcccctggcacagggggtctgaagttcaatatccagaagcggccctttgctgtgacaacacagtccttcggctctaatgccgaaggccagcatagtgggtttggacctcagccgaatccagaaaaagtccagaatcactcgggatcaagcgccaggggcaatctcagtggaaaaccagacgattggccgcaggatatgaaggagtatgtcgaaaggtgctttacagcctgcgagagcgaggaggacaaggacaggaccgagaaactgctgaaggaagtgctgcaggcacgcctacaggatggctctgcctacaccatagattggagtcgagagcccttgcctgggctgacccgagagcctgtggccgagtcaccgaagaagaagagatgggaggcggcttcttcccttcacccacccagaggcgctggatctgcaacaagaggtggaggagccccgtcccagcgcgggactccaggtgccggaggtgctggcagagccaggggcaactctttcactaagttcggcaatcggaacgtgttcatgaaggataacagctcttctagcagtacagacagccgtagcaggtcttctagccgcagcccaactcgtcattttagacgcagcgattctcatagcgactcagattcatcctactccggtaacgagtgccatccagtcggaaggcgcaaccctcccccaaagggacgcgggggccggggcgctcacatggatcgcggacgaggtcgcgcacaacgcggaaaaagacatgaccttgcgcccaccaagaggtccagaaaaaaaatggccgctttagagtgcgaggatcctgagagggaactgaaaaagcagaaaagagccgcccgattccagcacgggcactcacgccggttgagactggaaccactggtgctgcagatgtcaagcctcgagtcctctggggccgatcctgactggcaggagttgcagattgtggggacctgccccgatataacgaagcattacctgaggctgacgtgcgctccggacccatccacagtgcgcccagtcgcagtgctgaaaaaatccctctgtatggtaaagtgtcattggaaggagaagcaagattacgcctttgcgtgtgaacagatgaaaagcatccggcaggatctgaccgtccaggggatccggaccgagtttacagtcgaggtttacgagacacacgcccgcatcgccctggaaaaaggagaccatgaagaattcaaccagtgtcagacccagcttaagtctctctatgccgagaacctgcctggaaatgtgggggagtttacagcatataggatactgtattacatcttcaccaagaattccggagacattacgactgagctggcctatctaaccagagagttaaaggcggacccgtgcgtcgcgcatgccctggccctgagaactgcgtgggctttgggcaactaccatcggttttttcgcctgtactgtcacgcgccttgtatgtcaggatacctggtggataaatttgccgaccgagagaggaaggtggcactcaaagctatgattaaaacatatgttgtgccctcatctcttcttcctctgctattcccctcttttcggctcgttagttcatgcatcaaattatccccctgtccactcctgccccttccgcccgttttcctgcttattttttttagtccttttccaccaagtctgtcagccttttttccctggttttccaccggaaaaacggtcccaccttccctgccaccgtcttcagcaatgtag

SEQ ID NO: 30996 - DNA, 2403 bp, Artificial Sequence
  Description of Artificial Sequence: Synthetic coding sequence
atggctgccaacgttggggaccaacggagcactgattggagcagtcagtactcaatggtggccggcgcaggaagagagaacggtatggaaacgcctatgcacgaaaatccagaatgggagaaagcacggcaagccctagcatccatcagcaaatctggcgccgcagggggctcagccaagtccagcagcaacggtcccgtcgcatccgctcagtatgtgagtcaggctgaggcttctgcactccagcagcagcagtactaccaatggtaccagcagtacaattacgcttacccttatagctactactaccctatgtccatgtatcagtcttatggctcaccatcacaatatggaatggcgggctcctatgggtctgcaacacctcagcaaccatccgcacctcagcaccagggcacacttaatcagcccccagttccaggaatggacgaaagcatgagctatcaagcacccccccaacagctcccgagtgctcagcccccccagccctctaacccacctcacggcgctcacactctcaacagtggaccgcagccgggcaccgcacccgccacacagcattctcaggctggcccagctaccgggcaggcttatggtccgcatacttacactgaaccagctaagccaaagaagggtcagcagctttggaaccgtatgaagccggcccccggcaccgggggtttaaagtttaatattcaaaagaggccattcgcggtgactacacagtcctttggctccaacgccgagggccagcacagcgggttcggcccccagcccaaccctgaaaaggttcagaaccatagcggcagttccgctcgcggcaacctgtccgggaagcccgacgactggcctcaagacatgaaggagtacgtggagagatgtttcaccgcctgcgaatccgaagaagataaagaccgtaccgagaaactgcttaaggaagttctgcaagcccgattgcaagatgggagcgcatacacgatcgattggtcaagggagcccctgccaggccttactcgggagcccgttgcagagagcccaaagaagaagcgctgggaggctgcctcttcgctgcatccgccaagaggggccggctccgcaactagagggggaggggctccatctcagcggggaacgccgggcgctggcggcgccgggagagcaaggggaaatagctttacaaaatttggcaatagaaatgtattcatgaaagacaacagctcctctagcagcaccgattcacgctcgcgaagcagtagcagatctcccacccgtcactttcggcgaagcgactcgcacagcgattctgattcatcgtacagcggaaatgagtgccatcctgtgggccggcggaatccacctccgaagggccgcggtggccgcggtgcccatatggacagaggccgcgggagagcacagcggggcaaacgacacgacctcgccccaacaaagcgctctcgtaagaaaatggccgcgctcgaatgcgaggaccccgagcgcgaactgaagaagcagaagcgggcagcaagattccagcacgggcactctagaagactgcgtctcgaaccactagtgcttcagatgtcaagtttggaaagcagtggcgccgatccagattggcaggagctccagattgtggggacatgccccgacatcactaagcactacctgagactgacgtgtgcccccgacccaagtaccgtgaggcccgtggctgtgctgaaaaagtccctttgcatggtaaaatgccactggaaggagaaacaggattatgcatttgcatgtgaacagatgaaatcaattcggcaggacctgaccgtccaaggtattaggaccgaattcactgtggaggtctatgaaacgcatgctagaatcgccctggagaaaggagatcacgaggaatttaaccagtgccagactcaactgaaaagtctgtatgctgagaacctgcccggaaatgtcggggaattcacagcatatagaatcctttattacatctttacgaagaacagtggcgacataaccacagaactggcttacctgactagggagttgaaggctgatccctgtgtggcccatgctctcgcactcaggaccgcctgggccctcggcaactaccaccgattcttcaggttgtattgccacgccccttgtatgtcggggtatctggttgacaagtttgcagatcgggagcgcaaggtggcattaaaggcaatgattaagaccttcaggccggctctccctgtaagttatctgcaagccgagcttgctttcgagggggaggcagcctgcagagcatttctggagcccctgggtcttgcatacaccgggccagacaactctagtatcgactgtcgcctctccttagcacagctgtcagcattctag

SEQ ID NO: 30997 - DNA, 165 bp, Artificial Sequence
  Description of Artificial Sequence: Synthetic coding sequence
atggctgcgaatgtgggcgaccagcgcagcactgactggtctagccaatactccatggttgccggagccggcagagagaatgggatggaaacccctatgcacgaaaaccccgatcggtctggcattgactgtagactgtccctggcgcaactctctgctttttag

SEQ ID NO: 30998 - DNA, 903 bp, Artificial Sequence
  Description of Artificial Sequence: Synthetic coding sequence
atggcagcaaatgtgggcgaccaaaggtcgacagattggagcagccagtattccatggtggcgggggcaggtcgcgagaacgggatggagacaccaatgcatgagaacccagaatgggagaaggcaaggcaagcactcgcgagtatatctaagtccggggcggctggtggctccgctaagtcatcttccaatggccctgtcgcttccgcacagtacgtcagccaagcagaagcctcggcgttacagcagcagcagtattaccaatggtaccaacagtataactatgcttacccttactcgtattactatccaatgtcgatgtaccaatcatacggaagtccatcccagtatgggatggcaggcagttacggatcagctactccccagcagccaagcgccccccagcatcagggcaccctgaatcagccccccgtccctggcatggacgaaagcatgtcttaccaggcgccacctcagcagctgccctcagcccagcctcctcagcctagcaatcctcctcacggtgcccatacactgaacagcggcccccagcccggaaccgccccggccacacagcacagtcaggcagggcctgctactgggcaggcatacgggcctcatacctacaccgaacccgctaagcctaaaaaggggcagcaactgtggaataggatgaagcccgcccccgggacaggaggcctgaaattcaatatacagaaacgcccatttgccgtgacaacccaatcctttggttccaacgccgaggggcagcacagtggattcgggcctcaacctaatccagaaaaagtgcagaaccattccggttccagtgcacgcggaaatctctcaggtaaaccagatgattggccgcaggatatgaaagaatacgtcgaacgatgttag

SEQ ID NO: 30999 - DNA, 276 bp, Artificial Sequence
  Description of Artificial Sequence: Synthetic coding sequence
atggccgcaaacgtgggagaccagcggagcaccgattggtccagccagtacagcatggtcgcaggagcaggacgcgaaaatgggatggaaacccccatgcatgaaaaccccgagtgggagaaggcgagacaggcattagcaagcatttctaagtctggggctgcgggcggctccgcaaaaagctctagtaatggccccgtcgcaagtgcacaatacgtttcccaggccgaggcttcagcactgcagcagcagcagtactaccagtggtaccagtag

SEQ ID NO: 31000 - DNA, 591 bp, Artificial Sequence
  Description of Artificial Sequence: Synthetic coding sequence
atggtgtgtcggctcatttgtgtgttccacagtacaaacgcggtctcagtcttcagtctttcactgtttagggcatgtaccccggtcccggaccccgcaccctggcctattccatgtagaggggccagcggcaagaaaacagggcgccctgcacgtgcccggttaaggcgcgggcatcctgccagtcctccaacagctagatgcctcacctgctttgctactgactcctgttcccagccacttggagcaagcgtgtttggcgtgggggaactgctgagggattgtgcaaggccaagacctcccacattgaagtgccagcaccatcaacaccagattcttcgtagacataccgcactgcggacaagaaggcctggccggcttgtgagcagctgtatcaagctcagcccctgtccacttctaccactgcctcctgtgtttttgctgatttttttcagcccttttcccccatcactcagcgccttttttccatggttttccacaggcaagaccgtgcccctgcccccttgcttgcatggatctcctgcccacgttatgcttccaagtctctttttcgtgtgtgttttcatttag

SEQ ID NO: 31001 - DNA, 1506 bp, Artificial Sequence
  Description of Artificial Sequence: Synthetic coding sequence
atgggtagcaggcccccatgtggcgctacaagttcagcacggcgggcatgccagtttcccgcgcccatggcggcagctcgagagcccgagctgccgcaggaagcccctgccaccgaaccagccccaccacctgcctgccgcttcttcctggagggacgatgtcgattcggcgcaagatgtcggcaaccccaccctggagcaccagccccccccggaagggaggcgcagccagaggccggtgctaaaaagccacccctgcgaacagctgccgacgtgattcaaagaatccgttgggaccctcgtcttgaccctgcggatttttctgttggttatgtcgataggtttctcggcgttcgggaagaacccttttctgctttctgttgggatcagcccctcgctgcgttgggaccaggtgtccttgccgtgccccagcacagggttaggttcttcagattccacggccgcttggtttgggaccgcgcttcacgtaccgacctcgtgttcggtagcggctccgccgctgggcgtggccctaccatcttagacgcccctaatactgagggcgcccacggggccgagggtgctgagtggactctggccggcacgggccaagaagcgcaggccgcccctaaaagaggctccactaggcctctctgcaccggccatcaggaaccaggagttgaggagcccggcgagttggaagccgcacaagaacgggccctcggaactgcagctgaccttggtacattagccccccggggccgcttggccggcgtgaccgaagaggctctgaagcccaccgctgccaccaggacaaccttactgggtgggaaggaagcgcaggcccttggggtccctggtggctcggctgaaactactgaagccgaatggggaccggctgcctggccagaagataaaagggcaaggttatctgtggccgctccctgtcagcccagaccaacacattttgtcgcactgatggtgactgaaccaggactgcaggcagaagtcactaaggcgcaagagtaccttgtgcacgtcgcccctcactgcgcgaacttcctcgtgccttctcaaaacctgcatctgaccttggccctgcttcggctggcaggcgccggcgaagaggccgcagcaattggagcactacggagggcccttttggccccgggtctcaatgcaccccctcgcctgtcttttcgcaaattagtgctgctgggaccacacgtgttatgcgcgccaccaagccccacactggaaagcatggcccaggtgctgagtcagcgactggaggcagaaggtttgagtactttacagtcccctggacagctccacccgcacctgaccgtggccaaggtcccacatggctctcaggttcaccttcccaagttagagttcacgctcagtcaggaagtaggttgccaacctctccagactctctggctgtgcaggataggacgcactggcggacctttccagcccctggctgaaattaggctagaatag

SEQ ID NO: 31002 - DNA, 3252 bp, Artificial Sequence
  Description of Artificial Sequence: Synthetic coding sequence
atggcatgccccgcactgggcctggaggcgctccagccgctccagccagagcccccacctgagcccgctttcagcgaggcccagaaatggattgaacaagttaccgggcgctcattcggtgataaagactttaggactggtctggagaacggaatcctgctgtgtgagttactgaatgccattaaaccaggactggtaaagaagattaaccgcctgcccacaccaatcgcgggcctagacaatattatcctcttcctccgcggctgcaaggaacttggactgaaggaatcgcagctgttcgacccatctgatctgcaagatacatccaacagggtgactgtgaaaagcctcgattattctcgaaaactgaagaacgtgctggtcaccatttactggctgggaaaggcggcaaactcttgtacgagctattccgggaccactctgaacctgaaggagtttgagggactgctggctcagatgaggaaggataccgatgacatagagagccccaagcgatccatacgcgacagtggatatatcgattgttgggattcagagcggtctgacagtctaagtcccccgagacacggccgggacgacagcttcgactctctcgatagttttggctcacggtctagacaaacgccctcccctgacgtggttctccggggcagcagtgatggaagaggctccgacagtgagtctgacctcccacaccgaaaattaccagacgtaaaaaaggacgatatgagcgcccggcggacctcccatggggagcccaagagtgccgtccctttcaaccagtatctcccgaataaaagtaatcaaacagcctatgtgccggctcccttaagaaagaaaaaggcagaaagggaggagtaccgtaaatcttggtctaccgccacgtcaccgctgggcggagagcgcccctttaggtacggacctagaacacctgttagcgacgatgcagaaagcacttccatgtttgatatgcgatgtgaagaggaggccgctgtccagccccacagccgagcaaggcaggagcagctgcagttaatcaataaccagttgcgagaggaagacgataagtggcaggacgacctcgcccgatggaaaagccgtcgcagatccgtgagccaggatctgataaagaaggaagaagagcgaaaaaagatggaaaagctgctggccggagaggacgggacgtccgagcggcgcaagtccatcaagacctacagggagattgtccaggaaaaagaacgccgggaaagagagctacacgaagcctacaagaatgccaggagtcaggaagaggcagaagggattcttcaacagtacattgaaaggtttacaatctcagaggcagtgctggaacgccttgagatgccaaagatactggagcgctctcacagtaccgagccgaatctgagctcttttcttaacgaccctaatcctatgaaatacttaaggcagcagtccctgccacccccaaagttcactgcaacagtggaaacaacaatcgcccgcgccagtgtattagacacatcaatgtccgcgggctccggtagcccaagcaaaactgtgactcccaaagcggtgccaatgctgacccccaagccctacagtcagcctaagaactcgcaggatgtgctgaaaacattcaaagtggacggtaaggtctccgttaacggagaaaccgtacacagagaggaagagaaagagcgagagtgtcccaccgttgcaccagcgcattcattaacaaagagtcagatgtttgagggtgtggccagagtgcacggaagccctctggagctgaagcaggacaatgggagcatcgaaatcaatatcaagaaaccaaacagcgtgcctcaggaactagcagcaaccactgaaaagaccgagccgaattcccaggaggataagaacgacgggggcaagtctcgcaaggggaatatcgagttggcatcttcagagccacaacactttactacaaccgtaaccagatgttcacccacagtggccttcgtcgaatttcccagcagtcctcaactgaaaaacgacgttagcgaggagaaagatcagaaaaagcctgagaatgagatgtccggcaaagtcgagctcgttctcagccaaaaagtggtaaagcccaagtccccagagcctgaagctacgctcacatttccttttctggacaaaatgccggaagccaatcaactgcacttaccaaatctcaattcccaggtggattcaccttcctcagagaaatcgcccgttatgaccccgcagttcaaattttgggcatgggacccagaggaggaacgtcgcaggcaggagaagtggcagcaggaacaggagaggttgctgcaagaacggtaccagaaggagcaggataagctgaaggaagaatgggaaaaagcccagaaagaagtcgaggaggaagaacggcggtattatgaggaagagagaaaaatcatcgaagatactgtggttcctttcaccgttagctcctcatctgcagatcagctgtctacgagcagttccatgactgaggggagcggtacaatgaataagatagatttgggtaactgtcaggatgaaaaacaggacagacggtggaaaaagtcgtttcagggggatgattcagacctactgcttaaaactagagagagcgaccggcttgaggagaaagggtctttgacagaaggagcgctggcgcactcaggcaatcctgtgagtaagggagttcacgaagaccaccaactggataccgaggccggcgcccctcactgtggaactaacccccagctggctcaagacccatcccagaatcagcaaactagtaatccaacgcatagcagtgaggacgtcaaacccaaaactcttcctcttgataagtcgattaaccatcagattgaatctccctccgaacgaaggaagaagagccctagagagcacttccaggctggccccttcagcccctgttcacccactccccccggccaatccccaaatcgatccattagtggaaagaaattgtgttcttcctgtggactgccattagggaaaggagcagcaatgatcatagaaaccctgaatctctacttccatattcagtgttttagatgcgggatctgcaaaggccagctgggggatgccgtgagcggcaccgatgtgcgtattcggaatggacttctgaactgcaatgactgttacatgagaagccggtccgccggtcagcctacaacattgtag

SEQ ID NO: 31003 - DNA, 4401 bp, Artificial Sequence
  Description of Artificial Sequence: Synthetic coding sequence
aggaaggatacagatgatattgagagccctaaacgatctatcagagatagcgggtacattgattgctgggactcagagcgctcagacagcctgagcccaccacgccatggcagagatgacagcttcgactcactggactcttttggctcgcggtcgagacagaccccaagcccagatgtggtgctccggggctccagtgatggacgtgggtcagactctgaatccgacctgccccatcggaagttacccgacgtgaaaaaagatgacatgagcgccaggcggacttcccacggggagcctaaaagcgcagtgccttttaatcagtacttgcctaacaaaagcaaccagacagcatatgtgccagccccactgcgaaagaaaaaagcagaacgggaagagtatagaaaatcctggtcaacagctacttctcctctgggcggagagagacctttttccttcccagaaacgattgaggaagagggaagcgaggttggaagcgctggtgaggacaacccagcgggacagatgaaccctgggtggaagcctagtgatggaggctgcgaactgcccgatggatctggcaaagagcaccctagcagcgacggggccgtcgtggcgcccgcaccaaagtctgaggaaaaggatgctgcggagatccagaagcggaaaaggcttgagcaggccgggattaaagtcatgccagccgcccagcgcttcgctagtcaaaagcagctctccgaagaaaaagaggccattcgggatatcgttctgaggaaggaaaacagctttctcactcaccagcatggcaacgactcagaagcagaaggggaggtggtatgcaggctgcccgaccttgagaaggatgacttcgccgcccgccgggcacgtatgaaccagaccaaacctatggtaccacttaatcagctgttgtatgggccttacccgaagaagggggctgaaaaatccgatggctctaaacagctgtccaagggaatttccaagaaaaggagcctggagtataagcggaatcaaggccatactgaagaagttaaactgatcgtcacctgtaacatgagagctcaggagtccgagcctgtcgaagggggcttgcgaaaagtcccagaccttcacaaggacgacctggctcagcagaggattcaagggagccttgctcctcaccgagaaccccccagttttatcactcttagcaacattaccgaggccgacctcgagacctgggagagacttaaggtttcggaaaaggcccgcgatggggacgtgcagcacatttgcgcatccgagccatctccagaaatcaaggcagaaaccgccatacgtgacgatttcgccaaccgcaaagcaagagcctccaagaaagctagcagccctagacagaaatttgtacactttgggcccgtgaccgaactcgatcagcagaaatggaaaagacttagtataggtaaagccggtccccgggaggatgaggaggaggttatttgccatggatccaaaatccaaatggatagcgtaagccccgtttctgcagcaacttctagcctgaagggtcaccagatcttcaatcggcagaatgactgcagaacaatgaactgcggtagaggcgactattgtcgccgggcaagctggttagccccggttccagagtcccaggaggagtgggtttgtagcctaggcgaatgtcccaggggtaccgaagaggtgactagcaagcagctcccccaagatggaaaggaggagacagagagcgcaccccgggactcagaaaggctttccaaagcggagcggagcgaagactccagccagccactggtgtgccccctggcttctgaatgcgaagcttccgggacagaggagaaactggagaagatgaccgccccagcctggagcggaagtggattaaaaggccagcggaagctggacgactctcggaaggacgatatgatggcccgcaggaccggaatgtcgcttaggcacactggcagtaacccgaatcaatttctccccgtgccctttgccaaacagcaggatgtcgaggagtcctccaagggccttcccatgaaagaccagcgctatggccctcggactccagtctctgacgacgctgagagcacttctatgtttgatatgcggtgcgaagaagaagcagcagtgcagccccacagtcgggcacgccaggaacagttgcagctgatcaataatcagctccgggaggaagacgacaagtggcaagatgacttagctaggtggaagtcacgacgccgctccgtcagtcaggacctgattaaaaaggaggaggagagaaagaagatggagaagctgctcgccggagaagacggcactagcgagaggcgaaaatccattaaaacatatagagagatcgtgcaggagaaggagcggagagaacgagagcttcacgaggcatataaaaatgccagatcccaggaggaggccgaaggaattctgcagcagtatatcgaaaggttcacgatttctgaggctgtgctggagcgacttgaaatgcctaaaatcctggaacgcagccactcgactgaaccaaacctgtccagcttcctcaatgatcccaatcccatgaagtatttacgccagcagtctctgccaccgccaaaattcaccgctacagtcgagacgacaattgctagggcctccgttctcgatacatccatgtccgccggaagcgggagcccgtcaaagacagttactccaaaggcggtgcctatgctgaccccaaaaccttacagccagccaaagaattctcaggacgttctgaaaacttttaaggtagacggaaaggtgagcgtgaacggagagacggtgcatcgggaggaggagaaagaaagggagtgccctaccgtcgcccctgcacacagcctcaccaagtctcagatgtttgaaggagtggccagggttcacggttccccccttgagctgaagcaggacaacggatctattgaaatcaatatcaagaaacctaacagcgttccacaggagctggcagctactaccgagaaaacagagcccaattcacaagaagataagaatgacggagggaagagtagaaaaggcaatattgagcttgcatccagtgagccccagcatttcactacaaccgtgacgcggtgttcacctaccgtcgctttcgtggagttcccctcctcaccccagcttaaaaacgacgtctccgaggaaaaggatcaaaagaagccggagaacgaaatgtcaggcaaggtggaacttgttctttcacagaaagtagtcaagcctaaaagtcctgagccagaagcgactctaacattcccctttttggataagatgcctgaggccaaccagctacacctccctaatctcaacagccaagtggacagtccttcgagcgaaaagagcccagttatgacgcccttcaagttctgggcgtgggatcctgaggaggagagacgtcggcaagaaaagtggcagcaggaacaggaaaggctacttcaggaacgctaccaaaaggaacaggataagttaaaagaggagtgggagaaggcacagaaggaggtggaggaagaggaaaggcggtactacgaggaagagagaaaaatcatcgaagacaccgtggtcccctttacggtgagctcaagttccgctgaccagttgtcgacatcatctagtatgactgaaggatcgggaacaatgaacaagatcgacctagggaactgccaggatgagaaacaggataggcgttggaagaagtcctttcagggcgatgactccgatttgctgctaaagacacgagaaagcgatcggctagaagaaaagggttctcttaccgagggggccctagcccacagcggaaacccagtatccaaaggcgtgcacgaggaccatcagcttgacaccgaagcaggggcaccgcattgcggaactaaccctcagctcgctcaagatccctcacagaaccagcagacatctaatcctacacatagctctgaagacgtcaaacctaaaacactgccattagataaatcaattaatcaccagatcgagtcgccatcagagaggcgcaaaaagtccccaagggagcacttccaggctggccctttttccccctgcagtcctacaccacccggccagtcgccgaaccgctccatttccggcaaaaaattatgctctagttgcgggttgccactgggcaagggggcagcgatgatcatcgagaccttgaacctctactttcatattcagtgctttcgctgcggcatttgcaagggccaactgggggacgccgtttctggcaccgatgtcaggatacggaatggcctccttaattgtaatgattgctatatgaggagccggagtgcgggacagcccactaccctgtag

SEQ ID NO: 31004 - DNA, 2673 bp, Artificial Sequence
  Description of Artificial Sequence: Synthetic coding sequence
atggactcggaacggcaggtcaaagatactgatgacatcgaatcccccaaacgctcaattcgggattcagggtacatagactgctgggatagcgaacgctctgattcactgtccccacctaggcatggacgagatgactccttcgattcccttgattctttcggatcacgcagcaggcagactcctagtcccgatgtcgtgctgaggggatcttcagatgggagaggctccgattctgagtctgacctcccgcaccggaaactgcccgatgttaaaaaggacgacatgagcgctcgacggacatcacacggggagccgaaatcagctgtgcccttcaaccagtatctgcctaataagtcaaatcagacggcctatgtgccagcaccccttcggaagaagaaggcggaacgcgaagagtatagaaagtcctggtccaccgctaccagccccttggggggtgagaggcccttcagaagcacctcaatgtttgatatgagatgcgaagaggaggcagccgtccagccacactccagggcaaggcaggagcagctgcagctgattaataatcaactacgggaagaagacgacaaatggcaggatgatttagcgcggtggaagtcgcgccgtagaagcgttagtcaggatctgattaaaaaggaggaagagagaaaaaaaatggagaagctcctggcaggcgaggatgggacttcagagcggagaaagagcatcaagacatacagggaaattgtacaagaaaaggagcggagagagcgggaactgcacgaagcatataaaaacgccagaagccaggaggaagctgaaggaattctccaacagtatatcgaacggtttacaatcagcgaggccgttttggaacggctggagatgcctaagatcctggaaaggagccatagcacagaacctaacctttcctcctttcttaatgatcctaaccccatgaagtaccttcgccaacaaagtcttcctccccccaagttcaccgcaaccgtggaaaccaccatcgcaagagcatcagtgctcgacacttcgatgagcgccgggtcaggatcgccttctaagactgttacaccaaaagccgtaccaatgctaactcctaagccgtattcccaaccgaagaacagccaagatgttttgaaaactttcaaagtggatggaaaggttagcgtgaatggagaaactgttcatcgtgaagaagagaaggaacgggagtgccccaccgtggcgcccgctcacagcctgacgaagtcgcagatgtttgaaggcgtggcccgggtacacggatcccctttagagctgaaacaggataatggtagcatcgagattaacatcaagaaaccaaatagtgttccccaggagctagccgccaccacagagaaaacagagccgaattcccaagaggataaaaacgatgggggaaaatctcgcaaagggaacattgagcttgccagctcggagccccagcacttcaccactaccgttacccggtgtagccccacagtagctttcgtggagttcccctcatccccacagctcaagaatgacgtaagtgaagagaaggatcagaagaaaccagagaatgaaatgtccgggaaagtggagctggtcttatcgcagaaggtcgtgaaacccaaatcccccgaaccggaggcgacgttgacattccctttcttggataagatgcctgaggctaaccagctgcatctgccaaacctgaatagccaagtagactcacccagctctgaaaaatccccagtcatgaccccattcaagttttgggcttgggacccggaagaggagcgcagaaggcaggagaagtggcaacaggagcaagagagacttctccaggaacgatatcagaaggaacaagataagctaaaggaagagtgggaaaaagcccagaaagaggtggaggaggaggaaaggagatattatgaggaggagaggaagattatcgaggataccgtggtgccctttactgtatcctcatcctctgcagaccagttgagcaccagttcttctatgactgaaggctcagggaccatgaacaagattgacctcggcaattgtcaggacgaaaaacaagatcgacgctggaaaaaatcattccagggggatgacagtgatctgcttctgaaaacgcgggagagcgaccgtttagaggaaaaggggtcattgaccgagggcgcactggctcactctggcaatccagtttccaagggcgtgcacgaggaccaccagctggatacagaggctggcgctccccattgtgggaccaacccacagctggctcaagaccccagtcagaatcagcagacatctaatccaactcactctagcgaggacgtgaaaccgaagaccctgcctctcgacaagtctatcaaccatcagattgaatccccaagcgagcgccgcaaaagcatctctgggaagaaattatgctcttcttgtggactgccattggggaaaggcgcagctatgattattgagacactgaatctctacttccacatccaatgttttcgttgcgggatctgcaagggacaattgggtgacgccgtttctggtactgatgtaaggatcaggaacggactgctgaattgcaatgactgttacatgcgctctcggagcgccggccagccaaccactctatag

SEQ ID NO: 31005 - DNA, 2709 bp, Artificial Sequence
  Description of Artificial Sequence: Synthetic coding sequence
atggattccgaacgccaggtaaaagatactgatgacattgagtcccccaaacgatccataagagatagtgggtacatcgattgttgggactctgagcgttccgatagcctcagcccccccaggcacggcagagatgacagcttcgattccttagactccttcggttcccgatctaggcaaacaccttcaccagacgtcgtactcagaggctcatcagacggacgaggctctgactcagagtccgacttaccacaccggaagcttcccgacgttaagaaggacgatatgtcggctcgccggacgtcacatggtgagccaaagagtgccgtgccatttaatcagtatctccctaacaaatctaatcagaccgcatacgtccctgccccattgaggaagaaaaaagccgagcgcgaagagtaccgcaagtcatggagcaccgccacttcacctttaggtggcgaacgacctttccgatatggccctcgcacacctgtgtctgacgacgcagagtctactagcatgtttgatatgagatgtgaagaggaggccgctgtgcagcctcactcgcgggcacgacaggagcagctgcaattgatcaacaatcagctccgggaggaagacgacaaatggcaagatgatcttgccaggtggaaatcacggcggagaagcgtcagtcaagacctgatcaagaaagaagaagaacgaaaaaaaatggagaaactcctggcaggagaggacggcacaagcgaaaggcggaagagcatcaagacctacagagagatcgtgcaggagaaagaaaggagagaacgtgagcttcacgaagcctacaaaaatgcccggtctcaggaagaagcagaagggatcctccaacaatatattgaaagatttaccatctctgaggcagttctggaaagactggagatgccaaaaatacttgaacggtcacactcaactgagcccaacctcagctccttcctcaacgacccaaacccaatgaaatacttgcggcagcaatctctgcctcctcctaagttcaccgccactgttgagacaacaattgctcgcgctagcgtgctcgacacctcaatgagcgcaggctcaggtagtccctccaaaaccgtaacacccaaggccgtgcccatgctgacgcccaagccttatagccagccaaagaactcccaagatgtcctaaagacattcaaagttgatgggaaagtgagcgttaatggggaaaccgtgcatagagaagaggagaaggaacgtgagtgccccaccgtcgctcctgcccactctctgacaaagtcccaaatgtttgagggtgtggcccgggtgcatgggtccccattagaattgaaacaggacaatggatctatagagatcaacattaagaagcccaacagcgttccgcaggagctggcagccaccaccgagaaaacagagccgaacagtcaggaagacaagaatgacggcggcaagtctaggaagggaaacatcgagctggcctcgagtgagccacagcacttcacgaccactgtcacacgatgtagccccactgttgcttttgtagagttcccttccagtccgcaattaaagaatgacgttagtgaagagaaagaccagaaaaagcccgagaacgaaatgtcaggtaaggtggagctggtgctttcccagaaggtcgtcaaacccaaatctcctgaacctgaagccacgctgacgtttccgtttttggacaagatgcctgaagccaaccagctgcacctgcccaacctcaatagccaagtggatagtccaagctccgagaaatcccccgtaatgaccccattcaagttctgggcttgggatccagaggaagagcgacggcggcaggagaagtggcagcaagagcaagagaggttgctgcaggagcggtatcagaaagaacaggataagcttaaagaagagtgggaaaaggctcaaaaagaggtagaagaggaagagcgccgctactacgaggaagagcgaaaaattattgaggacacagtggttccattcacagtcagctcatcaagcgccgatcagctgtccacatcatcatctatgactgaagggtcagggacgatgaataagatagaccttgggaactgccaggacgagaagcaagacaggcgctggaagaagtcttttcagggagatgacagtgatttgctcttgaaaactcgggaaagtgataggttggaggagaaggggtccctgaccgagggcgccctggcgcattccgggaatccagttagcaagggagtgcacgaggaccaccaactagacacagaggcaggggctcctcactgtggcacaaacccccaactggctcaggatccctcccagaaccagcagaccagcaaccctacgcacagcagcgaggacgtgaaacctaaaaccctgcctctggataagagcatcaaccaccagattgagtccccatctgagcgccgaaaatccataagtggaaagaagctgtgttcatcatgcggtctgcccctggggaagggtgctgcaatgattatagagactctgaacctgtacttccacatccagtgctttcggtgtggaatttgcaaagggcaacttggggatgctgtgtccggcactgacgtccgcatcagaaacggccttctcaattgcaatgactgctacatgcgaagccgatcagctggccaacctaccacactgtag

SEQ ID NO: 31006 - DNA, 4404 bp, Artificial Sequence
  Description of Artificial Sequence: Synthetic coding sequence
atgagaaaggacactgacgatattgaatcaccgaaacgatctatccgcgatagtggatatatcgattgctgggattcggagcgctcagactccttgagtccaccacgacatggacgagacgacagctttgactccctggactcattcgggtcccgctcgcggcagactccctcccccgacgtggtactgagaggatctagtgacgggagaggttccgactcagagagcgacctgcctcaccgaaagttgcctgacgtgaaaaaggacgatatgtccgccaggcgcacgagtcatggagagcccaagtcagcagtcccctttaaccaatatctccccaataaatctaaccagacagcttatgtaccagcccccctccggaaaaaaaaagccgagagggaagagtaccggaagtcctggagcactgcaacatcgcctctgggaggggaacggccattctcatttccagaaaccattgaggaggaggggagtgaggttggttccgccggcgaggataacccggctggtcaaatgaaccctgggtggaaaccatccgatggaggttgtgaactgcccgatggctcgggcaaggaacaccccagttccgacggagctgtcgtggctcccgccccgaaatctgaagaaaaagacgcggctgagatccaaaaacgcaaaagactagagcaggcaggcataaaagtaatgcctgccgctcaacgcttcgcttcacagaaacagttgagtgaagagaaggaggctataagggacatcgtgttgcggaaggagaattcctttctgacccatcaacatggaaatgactcagaagccgaaggagaagtggtctgtagactgccagacttagagaaggacgacttcgcagccagacgggcccggatgaaccaaaccaagccgatggtacccctgaaccagctcctctatggcccctatccaaagaaaggcgctgaaaaatctgatggcagcaaacagcttagcaaaggcattagcaaaaaacgctccctcgagtacaaacgaaaccagggtcataccgaggaagtgaagctcatcgtaacctgtaacatgcgagcccaggaatccgagcctgttgagggcggtttgaggaaggtacccgatctacataaagacgacctcgctcagcagcgcatccagggaagcctggccccacacagagaacccccctctttcattactttgtctaatattaccgaggcagatttagaaacatgggagagactgaaagtgagcgaaaaggcgcgagacggtgacgtgcagcacatctgcgcatccgagccctcacctgaaatcaaggcggagactgcaataagggatgatttcgcgaataggaaggcgagggcctcgaaaaaagcttcaagtccgaggcagaaattcgtgcattttggaccagtaaccgagctggaccaacagaagtggaagcggctctcgattgggaaagcgggccccagagaggatgaggaggaggttatttgtcatggttctaaaatccagatggacagcgttagtccagtctccgcagcaacctcatccttgaaagggcaccaaatcttcaatagacagaatgactgccgaaccatgaattgcggcaggggcgactattgtcgtagggcttcctggctcgccccagtgccagaatcgcaagaggagtgggtctgcagtctgggggaatgccctcgaggtacagaggaagttacatccaagcagctgccccaggatggcaaggaagagactgaatccgcccctcgggactccgagcgcctgagtaaggcagaacgatccgaagacagctcccaacccttggtctgccctctggcctccgaatgtgaggcttcaggcacagaagaaaaactggagaagatgaccgcccccgcttggagcggctccgggctcaaaggacagcgaaaactggatgactcaagaaaggatgatatgatggcgcgtagaacaggcatgtctttgcgccataccgggtcaaacccaaatcagtttctccctgtgccgttcgctaaacaacaagacgtagaagaaagctcgaaagggctcccgatgaaagaccagagatacggcccccgcacacctgtgtcagatgacgcagagtcaacatccatgtttgacatgagatgtgaggaagaagccgctgtacagcctcattctagagctcgccaggagcagcttcaactgattaataaccagctgcgggaagaggatgataagtggcaggatgatttggctagatggaaatcccgccgcagatcggtcagccaagacttaatcaaaaaagaggaggaacgcaagaagatggaaaagctgttagccggggaagacggcacgagcgagaggcgcaagtcaatcaagacttacagggagattgtccaggagaaagagaggcgagagagagagctccatgaagcctataagaatgctcgcagtcaggaagaggcagaggggatcctgcaacagtacattgaaaggttcacgattagcgaagccgtccttgaaaggctggaaatgcctaagatcctggagcgttcacattctactgaaccaaacctttcttcattcctgaacgacccaaatcccatgaagtacctgcgccaacagagcctaccaccaccaaaattcaccgccactgtggagactacgattgcaagggcctccgtgttggacacttccatgtcggctggaagtggatcaccatcaaagactgtgaccccaaaggctgtgcccatgctgacccccaaaccctattcgcagccgaaaaatagccaggatgtgctgaagacgtttaaggtcgatggcaaggtgtctgttaatggagagactgtgcatagagaggaagagaaggagagggagtgccccacagtggcccccgcccactcccttaccaagagccaaatgttcgagggagtggcacgcgtgcacggttcgcctttagagttgaagcaggacaatggaagcatcgaaatcaatatcaaaaagcccaactcagtcccccaagagttggccgcaaccacagagaagaccgaacccaattctcaggaggacaaaaacgacggaggaaagagccggaaaggaaacatcgagcttgccagctctgagcctcagcattttaccacaactgtaacacgctgcagcccaaccgtggccttcgtggaatttccatcgtctccccagcttaaaaatgatgtgtcagaggaaaaggatcaaaaaaagcccgagaatgagatgtctgggaaggtggagctggtgctgagtcagaaagtggttaagccaaaaagcccagagcccgaggccacactaacatttcctttcctcgacaaaatgcctgaagccaatcagctccacctgcccaacctcaattcccaggttgactctccatcctcagaaaagtccccagtgatgacaccctttaagttttgggcatgggatcctgaagaagaacgcaggagacaggaaaagtggcaacaagagcaagaacgcctcctgcaggagcgctaccagaaagagcaggataagctgaaagaggagtgggaaaaagcccagaaagaagtagaggaggaggaaagacgatattatgaggaggaacgcaagataattgaagatacggtcgttcctttcacagtttcctctagcagtgccgaccagctctctacatcaagctccatgacagagggcagtggcacgatgaacaagatagatttgggaaactgtcaggatgagaaacaagatagaagatggaagaaatcattccagggcgacgatagcgacttactcttaaaaacacgcgagagcgaccgcttggaggaaaaagggagtctgaccgagggtgccctggcacactcgggcaatccagtctctaagggcgtccacgaagaccatcagctagacaccgaggcaggggcaccccactgcggaaccaaccctcagctggcccaggatccaagccagaatcaacagacctctaaccccacccactcgtccgaggatgtgaaaccgaaaaccctgcccctcgataaaagtataaatcaccaaatcgaaagccctagcgagaggcggaagaaatctccaagggagcatttccaggccggtccattcagcccttgcagccctaccccccctggccagtccccaaatagaagtatcagcgggaaaaagttgtgttcatcttgtggccttcctctgggcaaaggcgccgctatgatcattgagacattgaatctatattttcacattcaatgctttagatgtggtatatgcaaagggcagttgggagatgccgtgtctggcaccgacgtgcgaatcaggaacgggctcctgaactgtaatgactgttatatgcgctcgagaagtgcggggcagcccacgaccctatag

SEQ ID NO: 31007 - DNA, 2694 bp, Artificial Sequence
  Description of Artificial Sequence: Synthetic coding sequence
atgcggaaggacaccgatgatattgagtctcctaaacgttcgatacgggactccggctacattgattgctgggatagcgaacggagcgactccctatcaccaccacgtcatggccgtgacgactcctttgactctttggacagctttggaagcaggagtcgccagacccccagccccgatgtggtcctgagaggtagttctgatggacgaggatccgattctgagagcgatctcccccatcgtaagctgcccgatgtgaaaaaggatgatatgagcgctagaagaacgagtcatggtgagccaaaatcagcggttccattcaaccagtacctacccaataaatctaaccagaccgcatacgttccggctccactgagaaagaagaaagccgagagggaggagtatagaaagtcgtggtctaccgctacctcaccgctgggcggcgaaagacctttcagatacggccctagaaccccagtttcagatgatgccgaatctacctcaatgtttgatatgcggtgcgaagaggaggcagcagtgcagccccactctcgtgccaggcaggagcaattgcagttgatcaacaaccagttacgggaagaagacgacaagtggcaggacgatttggctcggtggaagagcaggagacgctcagtatcacaagacttgatcaaaaaagaagaggagcgtaagaaaatggagaagctgctcgctggcgaggacggaacctccgagagacgaaaatcaatcaaaacttatcgtgagatcgttcaagagaaggaaaggagagaacgcgagctgcacgaggcttataagaatgcccgatctcaggaggaggccgaagggatccttcaacagtacattgaacgctttaccatctctgaggccgttctcgagaggctagagatgcctaaaatcttggagcggagccacagcactgaaccaaatctcagttcgtttctcaatgacccaaatcccatgaaatatttgcggcagcagtcactgccccctccgaaattcacggctactgtagaaaccaccatcgcccgggcctcagtgttggacacaagcatgtcagcgggtagcggctcgccaagtaagacggtgactccaaaggcggtccccatgcttacgccaaaaccttactcccagcccaagaatagccaggacgtcctgaaaacattcaaagtagacggtaaggtgtctgtgaatggagaaactgtccatagagaagaagagaaagagcgtgaatgtccaaccgtggcgcctgcccacagcttaaccaagagtcagatgttcgagggcgtagcccgcgtccatggctcacccctcgaattgaagcaggacaacgggtcaatcgagataaacattaaaaaacctaattccgtgccacaagagctagcagcaaccacggaaaaaactgagcccaattcccaggaggacaaaaatgacggagggaagtcccgtaagggcaacatcgagctcgccagctccgagccccagcacttcaccacaacagttacccgatgcagtcctacggtggcattcgtcgaattcccatcttccccacaactgaagaacgacgtctctgaggagaaagaccagaaaaagcccgagaatgagatgagcggcaaagtggaactcgtgctgagtcagaaagttgtcaagccgaagagcccagaaccggaggcaacactgaccttcccttttctggacaaaatgcctgaagccaatcagctccatctgcccaatctgaattctcaggtggacagcccatcgtcagaaaagagtccagtgatgacccccttcaagttctgggcctgggatcccgaagaagaaagacgcagacaggaaaaatggcagcaagagcaggaacgcctgcttcaggagcggtaccaaaaagagcaggacaaactgaaagaagagtgggagaaggcccaaaaggaggtggaagaggaggagagacgatactacgaagaagagaggaaaataatcgaggacacagtcgtcccattcactgtctcaagttctagcgcggaccaactcagtacctcatcttcaatgacagagggctccgggacaatgaacaaaatagaccttggaaattgtcaggacgaaaagcaggataggagatggaagaaatcatttcagggcgatgatagcgacctactgctgaagacccgggagtcagatcgcctggaagaaaaagggtccctcactgaaggagcgctcgctcactctggcaaccctgtgtctaagggagttcacgaggaccaccagctcgacacggaagccggagccccacattgtggaacaaaccctcaactagcccaggatccttcccagaaccaacaaacgtccaaccccactcattcctcagaagacgtcaagcctaagaccctgcctctcgacaagagcataaaccatcaaatagaatctccctctgagagaagaaagtctatctccggaaagaagctgtgcagcagctgcggtctcccactcggtaagggagcagccatgataatcgagaccctaaacttgtacttccacattcagtgcttcagatgtggcatttgtaagggacagctgggcgacgcggtgtctggcaccgacgtacggattaggaatggtcttttgaattgcaacgattgttacatgaggtcacgaagtgccggtcagcccaccactttatag

SEQ ID NO: 31008 - DNA, 3210 bp, Artificial Sequence
  Description of Artificial Sequence: Synthetic coding sequence
atggcatgccctgccctggggctggaggccctacagccactgcaaccggagccgccgccagaacctgccttttccgaggctcagaaatggatagaacaagtgacaggacgcagtttcggcgataaggacttccgcactggcctggagaacgggatactcctttgtgagctcctgaatgcaatcaaaccaggcttggtgaaaaaaataaaccgacttcccactccgatcgccgggctggataacattatcttgttcctgagagggtgtaaagagctgggactgaaagaatcccagctttttgacccttccgacctgcaggacacctccaaccgcgttaccgtcaaaagtttggattattcccggaagctgaagaacgtgctcgtgaccatctattggctgggaaaggcagccaacagctgcacgagttattcaggcaccactctaaatctgaaggagtttgaagggctcttggctcagatgcgcaaggacactgacgatatcgaatctccaaaacggagcattagggatagcggatacatcgactgctgggactcggagcggagcgattccttatctcccccgagacacggcagagatgatagcttcgacagcctggatagcttcgggtccaggtcacgtcaaaccccatcgccagatgttgtgctaagagggagttctgacggaagaggatccgattcagagtcggatctgccacatcgcaagttacccgacgtcaaaaaggatgacatgtccgcacggcgcacctctcacggtgaaccaaaaagcgctgtcccattcaatcagtacctacccaacaaatcaaatcagaccgcctatgtgcccgctccccttaggaagaaaaaagccgaaagagaggaatacaggaaatcttggtctaccgccaccagcccattgggaggggaaagaccatttcgctctacttctatgttcgacatgaggtgcgaagaagaggcggccgtccaaccccacagcagggcccgccaagagcagttgcagctcatcaacaaccagctgcgggaagaagacgacaagtggcaggatgatctggcccgctggaagtcaagaagacgttctgtgagtcaggaccttattaaaaaagaagaggagcgcaagaaaatggaaaaactcctagctggcgaggacggcaccagcgaacggcgcaaatcgattaaaacctatagagagattgtgcaagaaaaggagaggcgggagcgcgagctacacgaggcctacaagaatgcgcgtagccaggaagaagcagagggcatactccagcagtacattgagcgattcaccatctcagaagccgtcttggaacggttggaaatgcctaagatcttggaaagatctcacagtacggagcctaacctcagcagcttcctgaatgacccaaatcccatgaagtatctgagacagcaatccctcccaccacctaaattcaccgccaccgtggagacaaccatcgcacgggcttcagttcttgacacttccatgagtgctggctcagggagtcctagcaaaacagtgacaccgaaggcagtacccatgctgacccctaagccgtattctcaacctaaaaacagccaggatgtcttgaagactttcaaggtggatgggaaggttagtgtgaatggcgaaacagtgcatcgcgaagaggaaaaggagcgcgagtgcccaacagtggcgcccgcccactctctgacaaagagtcaaatgttcgaaggggttgcacgcgtccatggaagcccgctggaactcaagcaggacaacggatctatagagattaatatcaaaaaacctaattcggtgccccaggaactcgcggcgactaccgaaaagaccgaaccaaactcccaggaggacaagaacgatggtgggaagtcaagaaaaggcaatattgaactggcctcgtctgagcctcagcactttacaacaaccgtgacacgatgctccccaacagtcgcttttgtggagtttcctagctccccgcagctgaagaacgatgtgtcagaggaaaaggaccaaaagaagcccgagaatgaaatgtcaggcaaagtggaattggtgctttcccagaaggtcgttaagcccaagagcccggagccagaggccacgctcacattcccatttcttgacaaaatgcccgaagctaatcaacttcacctacctaatctcaactcccaggagagccctggtactgcatcagtacctctgagggttcagaacagctggcggaggtcgcagtttttttcgcagtctgtggactcaccatctagcgagaaatcacccgtcatgaccccatttaaattttgggcgtgggaccctgaggaggaacgtaggcgacaggagaagtggcagcaggaacaagaaaggctgctgcaggaacggtaccagaaagaacaggacaagttgaaggaagagtgggaaaaggctcagaaagaggttgaggaggaggagcgacgctattatgaggaagagagaaaaatcatcgaggacaccgttgttcctttcactgtgagctcttcatcagcagatcagctttccacgtccagcagcatgacagaagggtctggcacaatgaacaagatcgatcttgggaactgccaggatgaaaagcaggaccgccgctggaaaaaatctttccagggcgatgactccgacttactgctgaagacacgagagtcagacaggctggaagagaagggcagcttgacagaaggagctctggcccactcagggaatcccgtgtccaaaggagtccatgaggatcaccagctggataccgaggccggagccccccactgcggtaccaatcctcaactcgctcaggaccctagccagaatcagcaaacgagtaaccctacccactcttctgaggacgtcaaacccaaaacgttgcccctggacaagtctattaaccaccaaattgaatccccttccgagagacgaaagagcattagcggaaagaaactgtgcagcagttgtggcctacccctgggaaaaggcgctgccatgataatagaaactctgaacctctattttcacatccagtgctttaggtgtggtatatgtaaaggacagctaggagacgccgtatccggcacagacgtacggatcagaaatggactgttgaattgcaacgactgttatatgcggtctaggtcagccggacagcctactacactgtag

SEQ ID NO: 31009 - DNA, 3174 bp, Artificial Sequence
  Description of Artificial Sequence: Synthetic coding sequence
atggcttgtccagccctggggctggaggccctgcaaccattgcaacccgagccgccccccgagccggctttctccgaggcccagaagtggattgaacaagtcaccggacggagtttcggagacaaagactttagaacggggctggaaaatgggatcttgttgtgtgaactcctgaatgccataaagcctggactggtgaagaaaattaaccgactcccaactcctatcgcagggttggacaacattatcctattcctcaggggctgtaaagagctgggcctaaaagaaagtcagctgtttgacccctcagatctgcaagacacatctaacagagtgacagttaagtccctggattactctcgcaagctgaagaatgtgttggtaactatttattggctcggaaaggcggctaacagctgtacctcttattctggcacgaccctcaacttaaaagagtttgagggtttactggctcaaatgcgaaaagatactgatgacatcgaaagcccaaagcgatcgataagagactcaggttacattgactgctgggacagcgagcgcagcgactccttgtctccgcctaggcatggaagagatgatagttttgattcactagactccttcggctctagatcaaggcaaacacctagtcccgacgtggtcctccgcgggagctccgatgggagaggaagcgattccgaatccgatctaccacaccgcaaactgcctgatgtgaagaaggatgatatgtccgcccgccggacctcacacggagagccgaagtccgcagtgccattcaaccaatacctcccaaacaaatctaaccagacagcatacgtgcctgccccccttaggaagaagaaggccgaacgcgaggaatatcggaagtcttggtccaccgcgaccagccctctcggaggcgaacggccttttcgatacggacctagaaccccagttagcgacgatgccgagtctacaagtatgtttgatatgcgctgtgaggaggaggccgccgtgcagccgcactctcgggcccgtcaggaacagctgcagcttattaataaccagctcagagaggaggacgataaatggcaagacgacttagcccgctggaagtctaggaggcggtcagtgtctcaggatctcataaaaaaagaggaagaacgcaagaaaatggaaaaattacttgccggcgaggacggcacttcagaaaggagaaaatctattaagacgtatagagagatcgtgcaagagaaagagcgaagagaacgggagcttcacgaagcctataaaaatgcccgctcccaggaagaggccgagggaattctacagcagtatattgaacgcttcacgatcagtgaagcggttctggaacgactcgaaatgccgaagattctggaacgcagccatagcactgaaccaaacctttcctccttccttaacgaccctaatcctatgaagtacctgcgccagcagtccctgcccccgcctaagttcacagccacggtggaaaccacgatcgccagagctagtgtgttggatacgtccatgagcgccggctcaggcagtcctagtaaaacagtcacgccaaaagccgtccctatgctcacccctaaaccatactcacagccaaaaaacagtcaggatgtcctgaaaacctttaaggttgacgggaaggtaagcgttaacggcgagacagtgcaccgagaagaagagaaggaacgggaatgtcccaccgttgccccagcccattccctgactaaaagccaaatgtttgagggggtggcgcgcgtccacggttctccactggagctgaagcaggataatggttcgatagagatcaacatcaagaagccgaacagcgtgccacaggagctggctgctacaaccgaaaagacggaaccgaactctcaggaggacaagaatgatggaggaaagagccggaaggggaatatcgaactcgcctcgtctgaaccccagcattttacaacaacagtgacccggtgttcccctaccgtcgcatttgtggaattcccatcatctccccagcttaagaatgacgtgagcgaggaaaaagatcagaagaagccagagaacgagatgtcaggtaaggttgaacttgtgctcagccagaaggtagtgaaacctaagtcaccagagccagaggcaactttgacatttccttttctagataaaatgcctgaagccaatcagcttcatctccctaatcttaatagtcaggtggatagccccagctcagaaaaatctcccgttatgactcctcagtttaagttttgggcttgggatcctgaagaggaacgtaggcggcaagagaagtggcagcaggaacaggaacggcttctgcaagagaggtatcagaaggaacaggataagctcaaagaagaatgggaaaaggctcaaaaagaggttgaggaagaggagcgccgttactacgaggaagaacgaaagattatcgaagataccgtggtgcctttcaccgtgtcctcctcgtctgctgaccagttgagcacatcctcttccatgacagagggctccggcacaatgaataagatcgatctcgggaactgtcaggatgagaagcaagaccgaaggtggaagaaatccttccagggggacgacagcgatctgctgctgaagactcgtgagagtgataggctggaagaaaagggctctctgacggaaggggctctggcccactcaggtaaccccgtcagcaagggcgtgcacgaggatcatcagttagacaccgaagccggagctccgcattgcggaacaaatcctcagctcgcccaagatcccagccagaaccaacagacaagcaaccccactcatagcagcgaggatgtcaagccaaagaccctgcccctggacaagtctataaatcaccaaatcgagagtccaagcgaaagacgcaagtctattagtggaaaaaaactctgttcaagctgtggtctgcccctgggaaagggagccgcgatgattattgaaacactgaacttgtactttcatatacagtgtttcagatgcggcatttgcaagggccaacttggcgacgctgtcagcggcaccgatgtgcgaatccgaaatggtcttctcaactgtaatgactgttacatgcgttccagatccgctggtcagccgaccacactctag

SEQ ID NO: 31010 - DNA, 1230 bp, Artificial Sequence
  Description of Artificial Sequence: Synthetic coding sequence
atgaacttagaccgttgtaactcgatcgctgagccacaacacttcacaaccaccgttactcggtgttcccccaccgttgcatttgttgagttccccagttccccgcagctcaagaatgatgtaagcgaagagaaggatcagaagaaacccgagaacgagatgagtggcaaagttgaactcgtgctcagccaaaaagtcgtgaaacctaaatcccccgaaccagaagccaccctgacgttcccgttcctcgacaagatgcctgaggcgaatcagctgcacttacctaacctaaattcccaggtggactctccatcctctgagaaaagccccgtgatgacccccttcaagttttgggcctgggacccggaagaagagcggagaagacaggagaagtggcagcaggaacaggaaaggttactgcaggagagataccagaaggagcaggataaactgaaagaagagtgggagaaggcgcagaaagaggtcgaggaagaggagcgccgatattacgaagaagaaagaaagataatagaagacaccgtggtcccgttcaccgtgtcctctagctccgccgatcaattgagcactagctcttcaatgactgagggctctgggacgatgaacaaaatagacttggggaattgtcaggatgagaagcaggatcggcgctggaagaagtcatttcagggggacgatagtgatctgctgttgaagactcgtgagagtgaccgcttggaagagaaaggaagcctgactgaaggcgctctcgctcacagcggaaaccccgtcagcaaaggagtgcacgaagatcaccaactagataccgaggcgggtgctcctcattgtgggacaaacccgcagctggcccaagaccccagtcagaaccagcaaaccagtaacccaacccattcctctgaggacgttaagcccaagacactgcccctggacaagtcaattaatcaccagatcgaaagtccaagtgaaagacgaaaatctatttctgggaaaaaactctgctccagctgcggcctgcccttaggaaagggtgcggcgatgataatagagaccctgaacctgtatttccatatccaatgtttcagatgcgggatttgtaaaggccagctgggagacgccgttagtgggacggacgtgcgaattcggaatggcctcctgaattgtaacgattgttacatgcgctcacgatcagccggacaaccaactacactgtag

SEQ ID NO: 31011 - DNA, 3171 bp, Artificial Sequence
  Description of Artificial Sequence: Synthetic coding sequence
atggcttgccctgctctgggtctggaggcattgcagccccttcaaccggagcccccgcccgaaccagccttctcagaggcccagaaatggatagagcaggtgactggacgatcttttggagataaggactttaggaccggacttgaaaatggtatcctcctctgcgagttgcttaatgctattaagcccgggctagttaagaagatcaatagattaccaactcccattgccgggctagataatataatcctctttctgaggggctgtaaagagttaggactgaaagagagtcagctgttcgacccttccgaccttcaggacactagtaatcgggtcaccgtcaaatcactggattacagccggaagcttaaaaacgtcttggtgactatctactggttggggaaggctgcaaactcatgtacctcctattctggcaccacactgaatctcaaggaatttgagggacttctggcacagatgagaaaggataccgatgatattgagtccccaaagagatcaatccgggattcaggctatatcgattgctgggatagcgagaggtcggactcactatccccccctcggcacggcagagatgacagcttcgacagcctggattcctttggctctcggtctaggcaaacaccaagtcctgatgtggtgctgagaggcagctcagacggtcgcggaagcgacagcgagagcgatctgccgcaccgcaagttgccagacgtaaaaaaagacgacatgtccgcgcggcgaacatctcatggggaacccaaatcagctgtccccttcaaccaatatctccctaacaagtctaaccagacagcctacgtgcccgcacccctgcggaaaaagaaggccgagcgggaagaataccgcaaatcctggtctaccgctacatctccactcggaggcgaaagaccattccgatatggcccacggacacctgtgagtgacgacgcagagtctaccagcatgtttgacatgagatgtgaagaagaggcagcagtgcagccccattctagagcccggcaggagcagcttcagctgataaataatcagttgcgggaagaggacgacaagtggcaagacgacttagcacggtggaaatcaaggcgtcgtagcgtttcgcaggatctcattaagaaagaggaggaaaggaagaagatggaaaaactactcgctggcgaggatggcacctccgagcgccggaaatcaattaaaacatatcgggaaattgtgcaggagaaagagcggagagagagggaactgcacgaggcctacaaaaatgcaaggtctcaggaagaagccgaaggtatccttcagcagtacattgaacgatttaccataagtgaggcagttctggagcggctcgagatgcccaagattcttgaaagatcccactctaccgagccaaacctttctagcttccttaatgaccctaacccaatgaagtacctgcgtcagcagtctttgcctcccccaaaattcacagcaaccgtggagaccacaattgcccgggcgtccgtgctggacacgtcgatgtcggcgggatccggcagcccatcgaagacagtgacacctaaagcagtgcccatgctcaccccaaaaccgtattcacagcctaagaacagccaggatgtcctgaaaacctttaaagtagacgggaaagtgtctgtcaacggggaaacagtccacagggaagaagagaaggaacgcgagtgtcccactgtggcccccgcccacagcctaacaaagtcccagatgttcgaaggcgttgccagagttcacggaagccctctggagctcaagcaagataatggctctatcgaaattaacattaagaagccaaacagcgtgccccaagagctcgccgccacaaccgaaaaaaccgagcctaactctcaggaggacaagaacgatgggggcaagagtagaaagggcaatatagaactcgcatctagtgaaccacagcattttacgaccaccgtgacccgctgctccccaaccgtggcctttgtggaattcccctcgtccccccagctgaaaaatgacgtatcggaggagaaggaccaaaagaaacctgagaacgaaatgagcgggaaggtcgaactagtcttgagtcagaaggtggttaagccaaagtcccctgagcctgaagcaacattgacatttcccttccttgataaaatgcccgaggccaatcagctccacctccctaacctcaatagtcaggtggacagcccatcatcagaaaagagtcctgtgatgacacccttcaagttttgggcatgggaccccgaggaggaacggagacggcaagagaagtggcaacaggaacaggagcgccttctgcaagagaggtaccagaaagagcaagacaaactcaaggaggaatgggagaaggcacaaaaggaagtggaagaggaagagagaaggtactacgaagaggagagaaaaattattgaggatacagtggtgcctttcactgtgtcctcttcatcggcagatcagttgagcacctcaagcagcatgacagagggatcagggaccatgaataagatcgacttggggaattgtcaggacgagaagcaagatcgacgctggaagaaaagcttccagggcgatgattctgatctccttctgaaaactagggaatctgatcgcctggaagagaagggcagcctcacagaaggggcgctggcgcacagtggaaatccagtgtcgaaaggagttcacgaggatcaccagcttgatactgaagccggcgctccccactgcgggaccaacccacaactggctcaggaccccagccagaaccagcagacctcaaaccccacgcatagcagcgaagacgtgaagcctaaaaccttacctctggacaaatccatcaatcatcaaatagaaagcccatcggagcgccggaagtcaatatctggcaagaaattatgcagtagctgtggcctgcctctcgggaagggcgcagccatgatcatcgaaacattgaacctgtatttccatatacaatgtttccggtgcgggatctgtaagggccagctgggggacgcagtctccggcaccgatgtgaggattcggaatggcctcctcaactgcaatgattgctatatgcgttccagaagtgcggggcagccgaccactttgtag

SEQ ID NO: 31012 - DNA, 384 bp, Artificial Sequence
  Description of Artificial Sequence: Synthetic coding sequence
atgtttcaagcagctggcgctgcacaggctacccctagccatgacgcaaagggcggcggctcctccacagtccagcgctccaaaagtttttccttacgcgcgcaggtgaaggagacatgtgccgcatgccagaagaccgtctatcctatggagagactggtagccgataagctcatctttcataactcttgcttctgttgtaagcactgccacactaagctgagcttaggatcttacgccgccttacatggcgaattctactgcaagccgcacttccagcaactgtttaaatcaaagggaaactatgatgaagggttcgggaggaaacagcacaaggaactctgggcacataaggaggtggatcctggtacaaagactgcctag

SEQ ID NO: 31013 - DNA, 1944 bp, Artificial Sequence
  Description of Artificial Sequence: Synthetic coding sequence
atgcgcctgacacttctgtgttgcacttggagggaggagcggatgggagaagagggctccgagctaccagtctgcgcttcctgcggacaacgaatatatgacgggcagtacctgcaagctctgaatgccgactggcacgcggactgctttcgctgctgtgactgttcagcctctctgagccatcagtattatgagaaagacggccagctgttctgcaagaaagactattgggctcgctatggggagagctgccacggctgttcagaacagatcaccaagggcctggtaatggtagcaggcgaacttaagtaccatcctgaatgctttatttgcctgacgtgtggcaccttcattggtgacggcgatacgtatacactagtggagcactcaaagctgtattgtggacactgctactaccagaccgtcgttaccccagttatcgagcagatcttacccgactctcccgggtcacatctacctcacacagtgacccttgtctctatccccgccagcagccacggcaaacggggtctgtcagtatccatagatcccccgcatggaccgcccggatgcggaactgagcattcccatacagtgcgcgtgcagggcgttgatcccggatgtatgagccctgatgtcaagaatagcatccacgtcggggacaggatccttgaaattaacggcacccccataaggaacgttcctctggacgagattgacctactcattcaggaaactagtaggctgctccaactgacactggagcatgatccccatgacacgctggggcatgggttaggccccgaaacgagccccctctcttcccctgcctacaccccctccggtgaagcagggtcaagcgcccggcagaagcccgtgctgagatcttgttccattgaccgatcacctggggccggatccctaggctctcccgctagccaacgaaaggacctgggacgaagcgagtcccttcgcgtggtctgtagacctcaccgcatatttaggccttccgacctcatccacggagaggtactcggcaaaggctgcttcggtcaggctattaaagtgacgcatcgagaaactggtgaggtgatggttatgaaagaattgatcaggttcgacgaggagacgcagaggacattcctcaaggaagtgaaagtgatgcgttgccttgaacaccccaatgtgctgaaatttatcggcgtgctgtataaagataaacggctcaactttattacggaatatatcaaaggtggcactctgcggggaataattaaatccatggactctcagtacccttggtcccagagggtgagcttcgccaaggacattgcttctggaatggcctaccttcactcaatgaatataattcaccgggacctgaacagtcacaattgccttgtaagagaaaacaaaaatgtagtggtggccgacttcgggctagcgcgcctgatggttgacgagaagactcagcctgagggtctgcggtctttaaagaaacccgaccgcaagaaacgttataccgtggtgggaaatccctactggatggccccagagatgatcaatggtaggagctacgacgaaaaagtggacgtattcagctttggcattgtactctgcgagattatcggccgcgtgaatgcagatccagactacttgcctcgcacaatggacttcggcttgaatgtgcggggattcctggatcgctattgccctcccaactgcccaccttcattcttcccaattaccgttagatgctgcgatttggatccagagaaacgaccatctttcgtgaagctggagcattggctggaaacacttcggatgcacctggcaggccacctgcctcttggcccccagttagagcagcttgacagaggcttctgggagacttaccgaaggggcgaatctggccttcctgctcaccctgaagtgcccgactag

SEQ ID NO: 31014 - DNA, 741 bp, Artificial Sequence
  Description of Artificial Sequence: Synthetic coding sequence
atgttccccgtgaaagtgaaggtcgaaaaatccgaactggaaatggttaaggccagaaatcaattagacgccgtactccagtgccttttagagaaatcccacatggatagagaaaggctggacgaggaggctggtaagaccccctctgacactcacaataaagattgctccatcgctgcaaccgggaagcgccccagtgcacgctttcctcaccagagacggaagaaaaggcgcgaaatggatgatggactggcagaaggtggaccacagcgaagcaacacctacgtcataaagctgttcgacaggagcgttgatttggcacagttctcggaaaatacccctctttatcccatatgccgcgcttggatgagaaattctccgtctgttcgagaacgggaatgctcaccaagttccccccttcctccccttcctgaagacgaggaggggtcagaagtaaccaattcaaaatcccgtgacgtgtataagctgccaccacccactccccctggaccaccaggagatgcttgccgaagccggatcccctcccccctgcagccagagatgcaggggactcccgacgatgagccttccgaacctgagccctctccttccacgctaatttaccggaacatgcagcgatggaagcgaatacgtcagagatggaaggaagcttctcataggaaccaattgagatacagtgagtctatgaagatcttgcgcgagatgtacgagaggcagtag

SEQ ID NO: 31015 - DNA, 351 bp, Artificial Sequence
  Description of Artificial Sequence: Synthetic coding sequence
atggggtggaagatggcctcccctaccgatggcactgatctggaagcctctctgctttcctttgaaaagctagaccgcgcatcaccagatctatggccagagcaattgcccggggttgcagagttcgctgcctcatttaaaagtccaataacctcaagcccccccaagtggatggccgaaattgaacgggatgatatagatatgttaaaggagctgggatcattgaccacggcaaacctgatggaaaaagtcagaggactacagaatctggcctaccagttaggcttggacgagtcccgcgaaatgacccgcgggaagttcctgaatatactggaaaagcccaagaagtag

SEQ ID NO: 31016 - DNA, 447 bp, Artificial Sequence
  Description of Artificial Sequence: Synthetic coding sequence
atgagattgggatgcgaacttggcatcgggttcttattcggaggcgtggcttacggcacaagcttctcccgccggcgcctcgccacaagtagagatatgggatggaagatggcaagtcctactgacggtaccgatttagaagccagcttactgtccttcgagaagcttgatagggcgagtccagacttatggcccgagcaactgccaggcgtcgcggaattcgctgcctcgttcaaatcccccatcacttcctcaccacccaagtggatggccgaaattgagcgggacgacattgacatgcttaaggagcttggatctctgacgaccgccaacctgatggaaaaagtccgggggttgcagaatctggcataccaactgggtcttgacgagtcccgtgaaatgacccgagggaagttccttaacatactggaaaagccaaagaaatag

SEQ ID NO: 31017 - DNA, 2598 bp, Artificial Sequence
  Description of Artificial Sequence: Synthetic coding sequence
atgtctgatgttagcacatccgtgcagtcaaagtttgctaggctggcaaagaagaaggaaaatataacttacatgaaaagagagcagctgacagaaactgataaagatattgcccctgtcttggatctgaagtgtaaagacgtatccgccatcatgaataagtttaaagtgttgatggaaatccaggatcttatgttcgaggagatgagggaaacgctgaaaaatgacctgaaagccgtgctcgggggcaaagctacaattccagaggtgaaaaacagcgagaatagctcctcccggacagagttccagcaaataataaatctggccctgcagaaaacaggaatggtggggaagatcgaaggcgaaaactcaaaaatcggcgacgataatgagaacctgacgttcaagcttgaggttaacgagctgtccggcaaattagataacactaatgagtacaacagcaatgatgggaagaagctgccccagggggagtcacggtcgtatgaagtgatgggcagtatggaagagacactatgcaacatagacgatcgggacggcaaccgcaacgtccacctggaatttacagaacgggagtcaagaaaagacggggaagacgagttcgtaaaggaaatgcgtgaagagaggaaattccagaaattaaagaataaggaggaggtcctcaaagcctctcgtgaggagaaggtccttatggacgaaggggcggtcctgacactggtggccgatcttagtagcgccaccctcgacatcagcaaacagtggtccaacgtgtttaacatactgagagagaacgatttcgagcccaagttcctgtgcgaagtcaaacttgcgttcaagtgtgacggtgagataaagacgttctctgatctgcagtccctgcgtaagttcgcttctcagaaatcaagcgtcaaggagctcctcaaggacgttctccctcagaaggaagaaatcaaccaagggggtaggaaatacgggattcaggagaaaagagataaaaccctcatcgattctaagcatcgcgccggggagattacctctgacgggctctccttcctgtttttaaaggaggtgaaagtcgcaaaacctgaggaaatgaaaaatcttgagacccaggaggaggaatttagcgaactggaagaactggatgaggaagcctctgggatggaggacgatgaagatacatccggcctggaagaagaggaggaagagccttcagggctggaggaggaagaagaggaggaggcctcaggacttgaagaggacgaagcatcgggccttgaggaagaagaggagcagacgtctgagcaggattccacgttccagggccacaccttagttgatgctaagcacgaggtggagattacctcggacggcatggaaaccacgttcatagattcggtggaagattccgagagtgaggaggaggaggaaggaaagagtagcgagacgggaaaggttaagaccacctcactgaccgagaaaaaggcctctcgcagacaaaaggagatacctttcagttacttggtgggggactctggcaagaaaaaattagtgaagcaccaggtagtccacaagacccaggaagaggaggagaccgctgtcccaaccagtcagggcaccggtacaccctgcctgaccttatgcctcgcttcacctagcaaaagcctcgaaatgtcacacgatgaacacaagaagcactcacatacaaatctatcgatttctaccggagtgaccaaattgaagaaaacagaggaaaaaaaacaccggactctccacaccgaagagctgacctcaaaggaagcggacttgaccgaggaaacagaggaaaaccttcgctcttcagttataaactctattcgggagattaaagaagaaatcggaaacctgaagagtagtcacagcggtgttcttgaaatcgagaactctgttgacgacctgtcttctagaatggacatcttggaggagagaatcgattctttggaggatcagatagaagaattcagtaaggacaccatgcaaatgacaaaacagataatcagcaaggaacggcaaagggatattgaagagagaagcagatcctgtaatatccggttgattggcattccagagaaggagagctatgagaatagagcagaagatataataaaggagatcattgatgaaaatttcgccgaactgaagaagggctcatctctggagattgtctcagcgtgccgggtcccctcaaagattgacgaaaaaagactgacaccacggcacatccttgtgaaattttggaactccagtgacaaggaaaaaatcatcagagcttcacgagaacgtcgggaaatcacctaccaggggactagaattcggctgaccgccgatctgtccttagacacactggatgcgaggtcaaagtggtctaatgtgtttaaagtattgttagaaaaaggcttcaatcctcgaattctgtaccctgccaaaatggcctttgacttccgtgggaaaacaaaggtgtttctgagcattgaggagtttcgagattatgtgttgcacatgcccaccctccgtgaattgctgggaaataatataccatag

SEQ ID NO: 31018 - DNA, 2274 bp, Artificial Sequence
  Description of Artificial Sequence: Synthetic coding sequence
atgaaggtgttttgcgaagtgctggaagaactctacaagaaagtccttcttggtgccacccttgaaaacgactcccacgactacatcttctacctgaacccagctgtgagcgaccaggactgttccacggccaccagccttgaatgggccaacacctgcggaatccagggtcggcatcaacccatctccgtgggggtcgcacccatcgccgttgcccctgtgtgtctgaagacaaattcccagatgagtggttcccgagaggtcatgctccttcagttaactgtgattaaggtgatgacaactaggatactgagtgtcaagacagagtttcatgcgaaagagcagtaccgagatgtcattaaaattctcctggaatccgccaaagtggactctaaactcatctgcatgttccagaactcagataagctgctatcgcacatggctgcccagtgtctggccctgttactgtatttccagctcagggagaaaatcacactctccaattcctggattgccttttgtcaaaagaatctatcagaatacagtgaatccaacaaagccatttactgcctgtggacattaaccgccattatcaaggagatcttcaaggatagctgtagccagaagaccgagatattgaagcagtttttgacccactttgacacaatctttgaagtgttctataatagcctgtttagccagcatttcgagaactgcagagacaccagcaaaatagtgaacatccttatgtgcttcctggacctgttggagctgttgattgcgtctcgcattcatcttaagttgcactttacttgtcagcgaattcttttcctgaagcccagctgcatgctggaggttattacctggcctatacaggcttttgtcaagaggaaggtcataatcttcctgaagaagtgcctcctgtgtaaggtgggcgaagatctctgccgcggcagcgtaccggcccttatgcctccggatcaccatgtggccgttgatatgctggccctggccaatgccgttcttcaggccgttaatagcggcctcctcaaaactctgtctgtatatgaaaagcatagcttcttcgggggcgacgaggtgcagcctgagtgtgaactcatcacatctcccgaccacgttatcctgagggcggcctctttggtgatcatgaagagtctggaaatcaagttccaaaattattccagcgcctccgaagtgaaggtggaccttcaacggttcatgtcagaactgctcacattcctgaagccacacctgcaaccttctctccagctgcataacccttgtaagtggctgtccagagtattcatcgaacaggacgatgacatgctcgaggccgcaaaggcttctcttggcatttatcttaccctcacacggggctgtgaggctacagagtccctaacacaggggaaggagatgtgggatcatcatacccatgagaatggttacaatccccactgcatttttcttttttttctcaagaacatagggtttgacagtactgtactcttggactttttaatctcatctgagacttgctttcttgagtactttgtgagatacttgaaattgctgcagaaagactgggataatttctttactatatgtaacaacttcgatgctactgagtctaagtacgatatctcaatctgcggctgcgtgcccagcctggtgcaggaccaaagttctaatcagacaataccccataggttgacagctccgcacagccatagggatgtctgcgcaaggcactcctgggccagcgacgctccatcagaacctctgaaagccgttatgagcaaaggcgcccatactatgtgcgccagttctcttagttctccacgggcttcacaatctctagtagactatgactcttctgacgattctgacgtggagtccactgagcagtgtctcgccaactctaaacaaaccagtttgcatcagcaggctacaaaagaaatccaggacgccgcaggcacctccagagataagaaggaattctccctggagccaccgtcccgcccattagtgttgaaagaattcgatacagctttttcttttgattgcgaagttgcgccgaatgacgtagtgagtgaggtcgggattttctacagaattgtgaagtgttttcaggagctgcaagatgcaatatgtagactgcagaagaaaaatttgttcccctataatccgacagcacttctaaaacttctgaaatacatcgaggtcattagtaataaaaccatgaatacgctctag

SEQ ID NO: 31019 - DNA, 576 bp, Artificial Sequence
  Description of Artificial Sequence: Synthetic coding sequence
atgaaggtgttttgcgaagttctagaagagctctacaagaaagtcttgctaggcgccaccctggagaacgatagtcatgactatatcttttaccttaatccggcagttagtgatcaagactgtagtactgcaactagcttagagtgggcaaacacatgcggaattcagggcaggcaccagccaatcagtgttggggtagcccccatagccgtggcaccagtgtgcctgaaaactaattcccagatgtctggctcgcgggaagtgatgctgctccaacttaccgtcattaaggttatgacgacacgcatcctgagtgtgaagacggaattccacgccaaggagcaatacagagacgtgatcaaaatactgctcgaaagcgctaaggttgattctaaattgatatgcatgtttcaaaatagtgataagcttctcagccatatggccgctcagtgccttgccctgcttttatattttcagctccgggaaaagataaccctgtccaactcttggatagctttttgccagaagaatctatccgagtattcggaaagcaacaaagctatctactgtctctag

SEQ ID NO: 31020 - DNA, 597 bp, Artificial Sequence
  Description of Artificial Sequence: Synthetic coding sequence
atgaaggtgttttgcgaagtgctggaggaactttacaagaaggtactgcttggggccacacttgagaatgatagccacgactatatcttctatttaaatccggcagtctcggatcaagactgctcaacggctactagcctggagtgggccaacacctgtggaatccagggtcgccatcaaccaatctccgtgggggtcgcaccgatcgcagtggcaccagtctgcttgaagactaactcgcagatgtccggctcccgcgaggttatgctcctgcagctgacagtcatcaaggtgatgacgactaggattctgagtgtcaagactgagtttcatgccaaagagcaatacagagacgtgattaaaatcttactagagtccgccaaggtggacagcaagctgatctgcatgttccaaaatagcgataagctgctgtcccacatggccgcgcaatgcctcgccctcctgctgtatttccagttgagggaaaagatcacattaagcaacagttggattgcattctgtcagaaaaatctgtcagaatatagtgagtcaaacaaagcgatctactgtttgtggaccctgaccgcaatcatttag

SEQ ID NO: 31021 - DNA, 390 bp, Artificial Sequence
  Description of Artificial Sequence: Synthetic coding sequence
atgaaagtgttttgtgaagtcttggaggagttgtataaaaaagtgctactgggggctactcttgaaaatgacagtcacgattacatcttttacttgaaccccgctgtgagtgaccaggactgctctacggcgacttccttggaatgggcaaatacatgcgggatacaagggaggcatcagccaatctccgtcggcgtagccccaatagccgtggctcctgtgtgcctcaaaacgaactcacagatgagcggctctcgggaggtgatgctgctccagctgaccgtaatcaaggtaatgaccaccaggatattgagcgttaaaacagagttccacgccaaggaacaatatcgggatgtgattaagatcctgctggagtccgctaaggtctag

SEQ ID NO: 31022 - DNA, 435 bp, Artificial Sequence
  Description of Artificial Sequence: Synthetic coding sequence
atgaaagtcttctgcgaagtgctggaggaactctacaagaaagtgctgcttggggccacgctggagaatgattctcacgactacatcttctacttgaacccagccgtgtcagaccaggattgttccactgccacaagtctggagtgggccaatacttgtggcatccaagggcggcaccagcctatctcagtcggggttgcacccattgcagtggcgccagtatgtttaaaaaccaactcccagatgtctggctccagagaagtaatgctgcttcagctgacagtcataaaggtaatgaccacacggatcctttctgtcaagacagaattccatgccaaggagcagtatagagacgttatcaaaatcttgctcgagagtgcaaaggtggattctaagctcatctgtatgtttcaaaactctgacaagcttttatag

SEQ ID NO: 31023 - DNA, 1311 bp, Artificial Sequence
  Description of Artificial Sequence: Synthetic coding sequence
atgaaagtgttttgtgaagtgctggaggagctgtacaaaaaggtgctgctaggggcaaccttggagaacgacagccacgattacattttctatctgaaccccgctgttagcgaccaggattgctctacagcaaccagcttggaatgggcaaacacttgcggcattcaggggaggcaccagccaatcagcgtgggggtggcaccaatagcagtggcacccgtgtgtctgaagactaacagccaaatgtcgggctcccgcgaggtgatgttgctgcagcttaccgttataaaggttatgacaactaggatccttagtgtcaaaactgagttccatgccaaagagcagtaccgggatgttatcaagattctcctggaatccgccaaagtggactctaaacttatctgcatgttccagaatagtgacaagctactgtcacacatggctgctcagtgcttggcccttctcctgtactttcagcttagagaaaaaatcacgctatccaattcatggatcgcattctgtcagaaaaacctgtctgaatattcggagtcaaacaaggcaatatactgcttgtggacacttacggctatcataaaggaaatttttaaggatagctgtagtcagaaaaccgagattctgaaacaattcctgacgcactttgatacaatctttgaggtgttctacaactcactcttctctcagcattttgagaattgtagggacacctcaaagattgtgaatattctgatgtgttttctggacctgcttgagctgcttatagcctcccgcatccatcttaagttacactttacgtgccaacggattctattcttgaagccgtcctgcatgctagaggtgattacttggcccatacaggcctttgttaagaggaaggtgattatctttttaaagaagtgtctgctttgcaaagttggcgaagacctttgcaggggaagtgttcctgcactgatgccaccagatcaccatgtggccgtcgacatgttggccctagctaacgcagtgctccaagcagtcaatagcggcctgttaaagacactgagcgtttacgagaaacattctttctttggcggggacgaggtccaacccgagtgtgagctcattaccagccccgatcacgtaattctgcgtgcggcctcactagtgataatgaaaagtctcgagatcaagtttcaaaactacagcagcgccagtgaagtgaagggtaatagtccgaactccttttgcatgcagtgtgtgattatttatctctccactgtcattcacaactatcagatcagcggcctggtgtag

SEQ ID NO: 31024 - DNA, 732 bp, Artificial Sequence
  Description of Artificial Sequence: Synthetic coding sequence
atgtctagcggaaccgaattgttatggcctggggccgccctgctcgtgctacttggggtggcagcttctctgtgcgtgagatgttcaaggccgggtgctaaacggagtgagaaaatttaccagcaacggagtctccgagaggaccagcagtcatttactggttcaaggacctactcactggtgggacaagcctggccaggccctcttgcggacatggcacccaccagaaaagacaaattgcttcagttctacccttccctggaggatccggctagctccaggtaccagaatttttcaaaaggtagcaggcacggttctgaggaagcttacatcgacccaatcgccatggaatactataattggggtaggttttctaagccacctgaggatgatgatgccaactcctacgagaatgtcctgatttgcaaacagaaaacaacggaaaccggcgcgcagcaggagggaatagggggattgtgtcggggtgatctgagcctaagcttggccctaaaaacagggccaacatccgggctgtgcccttctgcctcccctgaagaagatgaggaatctgaggactaccagaactccgccagtatccaccagtggcgcgagtcccgaaaggttatgggtcagcttcagcgagaagcctcccctggtccagtgggcagccccgatgaagaggacggcgagccggattatgttaatggtgaggttgctgcaaccgaggcctag

SEQ ID NO: 31025 - DNA, 732 bp, Artificial Sequence
  Description of Artificial Sequence: Synthetic coding sequence
atgtcaagtggtaccgagctgctgtggccgggtgccgctctgctcgtactgcttggagttgccgccagcttgtgcgtccgatgttcaagacctggcgcgaagaggagtgagaagatataccagcagaggagcctgagggaggaccagcagagctttactgggagcaggacctattctctagtcggacaggcatggcccggccctctcgcagacatggctccaacacggaaggataagcttctccagttctatccaagtctggaagatcccgcgagctccagataccagaatttcagtaaggggtcgcggcatggcagcgaggaggcgtatatcgatcctatcgcaatggaatactacaattggggtcggttcagtaagcccccagaagacgatgatgccaatagttacgaaaatgtgctcatctgcaagcagaagaccactgagaccggcgcacagcaggagggtatcggtggactgtgcagaggggatcttagtctaagcttggctcttaaaactgggcccacctcaggcctgtgtccttctgcttcccctgaggaggatgaggaatccgaagactaccagaactctgcgtccattcatcaatggagggagagccgaaaggtgatgggacagctccagagggaagcctcaccaggcccggttggcagccccgacgaagaggacggggagcctgactatgtgaacggtgaagtggccgctaccgaggcctag

SEQ ID NO: 31026 - DNA, 732 bp, Artificial Sequence
  Description of Artificial Sequence: Synthetic coding sequence
atgtccagcggtaccgagctcctttggccaggggcagctctactagtactcttaggcgtggccgccagcctatgtgtacgatgttctagaccaggggccaaacgcagcgagaagatctaccagcagaggagtttaagagaagatcagcaaagcttcacgggatctagaacctatagtttggtaggacaggcgtggcctggaccattggcagatatggccccgactaggaaagacaagctcctgcaattctaccccagcctggaggatccagccagcagtagatatcagaatttcagtaaaggcagcagacacggctccgaggaagcgtatatcgacccgatcgccatggagtattataactggggtcggttcagtaaacctcccgaagacgacgacgccaattcctacgagaatgtcttaatttgtaagcagaaaactaccgagacaggtgcgcagcaagaaggcatcggtgggttgtgccgaggcgacctgtctctctcactagccctgaagaccggcccaacctctggactgtgtccaagtgccagtccagaagaggacgaggaatccgaagactaccaaaactctgccagcatccaccagtggcgggagagccgaaaggtcatgggacagctgcaaagggaggcatctccaggtcctgtgggtagtcccgacgaagaagatggcgagcctgattacgttaacggagaagttgctgctactgaagcgtag

SEQ ID NO: 31027 - DNA, 495 bp, Artificial Sequence
  Description of Artificial Sequence: Synthetic coding sequence
atggtcggggtggtcagcgatgaccaggattttctagattccaaggatactatgaaaatggcagttgttttagtcacgccattaggtaacggggacctggcacttaaatttggatatcctacccctcatggcgggtgccagaaaatggatacaacgttcaccgagggagccgtgcccgggcagttttcaaatcccgccatggcactgagcgacattcgagtggccttttccgactatcagcacttcgctctgctgtacctggagatgcgcaagggggggttacggaaccaatggctgcagctgtacgggggccgagctgccggcagacgtcctaggcacccccgatttggttccggcatgagcccactgtgtttacatcagccattccttcacgctgagggaggaacagccggtagttggtgcctgtggccgagggtgcctgcacctccgtgcccaagtctccccctgtttgctccacctgccccgtcactgtag

SEQ ID NO: 31028 - DNA, 696 bp, Artificial Sequence
  Description of Artificial Sequence: Synthetic coding sequence
atgagacagcccgcggtgagactggtgaggcttgggagggttccatatgccgagctcctgggactgcaagaccggtggctgcggaggttacaggcggagcctgggattgaagctccatctggaacggaagccggagctttacttctgtgcgaaccagccggccctgtttacaccgcaggcttgaggggtggcctgacaccggaggagactgcccgtcttagagcacttggggccgaagtgagagttaccggacgtggcggcctcgccacatttcacggtcctggccaactgctgtgccatcccgtcctggacctgcgaaggttagggctgcggctccgtatgcatgtcgcaagtctggaagcttgcgcagtgagactgtgtgaactgcagggcctgcaggacgctagggcccgaccacctccatacaccggcgtttggctggacgaccgcaagatctgcgctataggagtgcgctgcggcagacatataaccagccatggacttgcactgaactgcagcaccgatctgacttggttcgagcacatagtaccatgcggcttggtcggcaccggggtcacatctctatccaaagaacttcagaggcacgtaactgttgaggaggtgatgccacccttcctggtcgcattcaaggagatttacaaatgtactctgatttccgaggacagtcctaattag

SEQ ID NO: 31029 - DNA, 849 bp, Artificial Sequence
  Description of Artificial Sequence: Synthetic coding sequence
atggaccgtactcttgagagcttgagacatataatcgcacaggtcctcccgcatagagaccccgcccttgtatttaaagatcttaatgtggtgagcatgcttcaggaattctgggagagcaagcagcaacagaaagcagctttcccgtctgagggtgtggtggtctacgaatccctgcccgcccccggaccccccttcgtctcctacgtgaccctgcccggggggagctgcttcggaaattttcaatgttgcttaagtcgcgcagaggctagacgcgatgccgctaaagtggccctgatcaactccctatttaatgagctgccttcacggaggatcaccaaggagttcatcatggaaagcgtgcaggaggccgtcgcgtcaacttccgggaccctggacgacgctgatgatccttccactagcgtgggtgcgtaccactacatgcttgagtccaacatgggaaaaactatgctggaattccaggaactcatgaccatattccaactacttcactggaatgggtctctcaaggccctgagagaaaccaagtgtagcagacaagaagtgatctcctactacagccaatattccctggatgagaaaatgcgttcacacatggcactggattggatcatgaaagaaagagattcacctggaatcgtgagccaggagctgaggatggccctcagacaactggaggaggcccgtaaagcagggcaggagttaaggttttacaaagagaaaaaggagatcttgagcctcgcccttacacagatctgttctgaccccgacacgagttccccaagcgacgaccagctttccctcactgcactgtgtgggtaccactag

SEQ ID NO: 31030 - DNA, 1014 bp, Artificial Sequence
  Description of Artificial Sequence: Synthetic coding sequence
atggaaaccatgcgcgcacagcggctgcagcccggtgtcggcacaagcggtagggggactttgcgggcgctgcgaccgggtgtcaccggagctgccgcagctaccgcaacgccacccgctggaccacctcccgctccacccccccccgcaccaccacctccacccctgcttttgagcggggcaccgggcctgcctttgcctcccggtgccgcggggtctccagctgtgctgcgggaggccgtagaggccgttgtgaggtcttttgccaagcatacccaggggtatggaagagtgaatgttgtggaggccctccaggaattttggcaaatgaaacagtcgcgtggtgccgacctgaagaatggcgctttggtggtctacgaaatggttccgagtaattcacctccttatgtctgttacgtgaccctgccaggcggcagctgtttcggttcgtttcaattctgcccaaccaaagcagaagccaggagaagcgcagccaaaatcgctctgatgaattcggtgttcaatgaacacccgagccgacgcataacggacgagttcatcgagaagtccgtatctgaggcactcgcctcctttaacgggaatcgggaagaggccgacaaccctaatactggcatcggcgcattccgatttatgctagagtctaacaaagggaaaagcatgctcgagtttcaagagcttatgaccgtcttccagctgctccattggaatggcagtctgaaggctatgcgcgaaaggcagtgctcgagacaggaagtcctcgcacactactcccacagagccctagacgacgacattaggcaccagatggctctggattgggttagccgggagcagtctgtgcctggcgctctatctcgcgaactggcctcaacggagagggaactggacgaggcaaggctcgccggaaaggagctacgatttcacaaggaaaaaaaggatatcctagtgctcgccgccggccagctgggaaacatgcatagcagtaactgctag

SEQ ID NO: 31031 - DNA, 855 bp, Artificial Sequence
  Description of Artificial Sequence: Synthetic coding sequence
atggagaccatgcgagcacagcggctgcagccaggggtggggaccagtgggcgaggtacattgcgtgccctgcggcctggcgtcaccggcgctgctgccgccacagctacccatactcagggttacggtagggttaatgtcgtggaagcgctgcaggaattctggcagatgaagcaatcacgtggggcagatctgaaaaatggcgccttggtcgtgtatgaaatggtcccttcaaattcccccccctacgtgtgttatgtgacactgcccggggggtcctgtttcggatctttccaattttgcccaacaaaggcagaagcacggcgcagcgccgcgaagatagctctcatgaactccgtgtttaatgagcatccctctaggcggataactgacgagtttatcgagaagtccgtgagtgaagcccttgcttcgtttaacgggaatagagaagaggcagataacccgaatacgggcattggggccttccgatttatgctggagagtaataagggcaagagtatgcttgagttccaggagctgatgacagtgtttcagcttttgcactggaatgggtctctgaaggccatgagggaaagacagtgctcccggcaggaggttcttgcacactattctcaccgggcactggatgacgatattagacatcagatggctctcgactgggtgtcaagggagcagtctgtgccaggtgcgctgtcacgggagctcgcttccaccgagagggaactggatgaggcacgcctggccgggaaggaacttagattccacaaggagaaaaaagatatcctggtactcgcagcagggcagctggggaatatgcactcatcaaattgctag

SEQ ID NO: 31032 - DNA, 390 bp, Artificial Sequence
  Description of Artificial Sequence: Synthetic coding sequence
atggcgaagtcactcagaagtaagtggaagcgcaaaatgcgcgctgagaagagaaagaagaacgcccccaaagaggcaagcaggctgaaatctatacttaaattggatggcgatgtgctgatgaaagacgtgcaggaaattgccacagtcgtcgtgcctaagccaaagcactgccaggagaagatgcagtgcgaggtcaaagatgaaaaagatgacatgaagatggaaacggatatcaagaggaataagaaaaccctgctcgatcagcatggccaatacccaatttggatgaaccaaaggcagcgaaaacggcttaaggccaagcgcgaaaagcggaaaggcaagtcaaaggcaaaagccgtaaaagtggccaaaggcttggcatggtag

SEQ ID NO: 31033 - DNA, 390 bp, Artificial Sequence
  Description of Artificial Sequence: Synthetic coding sequence
atggcaaagagcctgcgctctaagtggaaaaggaagatgagggcagagaagcgaaagaaaaatgctcccaaagaggcttctcggctcaagtcaattcttaagctggatggtgatgtgctcatgaaggacgtccaggagattgccaccgttgttgtgcctaaacccaaacattgccaggagaagatgcagtgcgaggttaaagatgagaaagacgatatgaagatggagacagacattaagaggaacaaaaagaccttactcgatcagcatgggcagtatccgatctggatgaaccagagacagcggaagagactaaaagcaaagcgggaaaaaaggaaagggaagtctaaggcaaaagccgtcaaggtagccaaagggctggcctggtag

SEQ ID NO: 31034 - DNA, 414 bp, Artificial Sequence
  Description of Artificial Sequence: Synthetic coding sequence
atgtcacagttccagggcaagggcccccggtggaccgtgctcatcatgtccaaggtcgggcttcgaggagggctctccgatcagatggcaatgaaagtgttggacccgctaaggcaagcgctcgactcaagtatgcagagcaataacctgtgtcagcatccacagcctttggctcttcacgtctccgccgcggtggcttctgccggagctcaagcgtctagcctgcttgggccactgccacatttgtccagtttcgcctttcagccagctcactccctgctgagtctcctggggagccatggcgctgaggtcagtaaaaagatggcgctgctggctagggaaagatcccccgcgcatctcgtcgcctttccaggccgtcttacagccacaccgccaggtctgcccactttttag

SEQ ID NO: 31035 - DNA, 198 bp, Artificial Sequence
  Description of Artificial Sequence: Synthetic coding sequence
atgaagaaggacagccagggcgcattctctggcttttgccatggcggagatgcccttcatgagggccgagtgcgccgaccgttgtggttgaaggatatgtataaacctctgagcgcgacaagagtgaacaaccatgcttggaaactgcacaaaaagagcagcaatgaggatgagattctgaacagggacccaggttag

SEQ ID NO: 31036 - DNA, 1818 bp, Artificial Sequence
  Description of Artificial Sequence: Synthetic coding sequence
atgagtagtgtctcgccaattcaaatccctagtagactgcctttgctgctgacacatgagggggtactcctgcctggtagcaccatgagaacatctgtcgattcggcccgaaatctgcagttggtgaggtccaggctcctcaaaggcacatctctgcagtccacgatcttaggagtcattcccaacacccctgacccagcatccgatgcccaagatctgccccccttgcatagaatcggaaccgctgctttagccgtccaggtggtgggctccaactggccgaaacctcactataccttgctgataactggactgtgtaggttccagatcgtgcaagtcctgaaggagaaaccttacccgatcgccgaagtggaacagctggataggctggaagaattcccaaacacatgtaagatgcgagaagagctgggggaactctcagaacagttctataagtatgcggtccaaattcttgacgccgtgagcctggaggagagatttaagatgacaatacctttgctcgtcagacagattgaaggcctgaagctgctccagaagacgcgcaaacccaaacaggatgatgacaaaagggtgatagcaatccgccccatccggcggatcacgcacatctcaggcaccttagaggatgaggacgaagatgaggacaacgatgatattgtcatgctggagaaaaagatccggactagcagcatgccagagcaggctcataaagtgtgcgttaaggagatcaagagacttaaaaaaatgccacagtccatgcccgagtacgctctgacaagaaattacttggagttgatggttgaactcccctggaataaatcaaccaccgaccgtttagatatcagggctgcccggattctcctcgacaatgatcactacgccatggaaaaactgaaaaaacgagtgctggaatatcttgcagtacgacagctgaagaacaacttaaagggcccgattctctgctttgtgggaccaccaggagttggcaaaacttccgtgggccgcagcgtcgctaagactttaggtcgggaattccaccggatcgctctgggaggagtgtgcgaccaaagcgacatcagaggccaccggcgcacctacgtaggaagtatgcccggccgtattatcaacggcctcaaaactgtcggagtaaataatcccgtgttcctgcttgacgaggtcgataaactcggcaagagcctgcagggggatcccgctgccgctctgttggaagtgctggacccagaacagaaccacaatttcactgatcactatcttaacgtagcatttgacctaagtcaggtgctattcattgctacggccaatacaaccgcaacaataccggctgcattactggacagaatggagattatccaggttccaggctatacccaggaggaaaaaattgagatagcccatagacatcttattccgaaacagttggagcagcacggcctgacaccgcagcaaatacagatcccacaggtaacaacgctggatatcattacaagatatacccgagaagcaggtgtgagatctctggacaggaaactgggagccatctgcagagccgtggccgtgaaggttgctgaagggcagcacaaggaggccaagttggatagatcagatgtaaccgagagagaaggttgtagagagcacatcctggaagacgagaaaccagagtcaatctcagacacaaccgatcttgcactccctcccgaaatgcccatcttgatcgactttcacgctttgaaagatattctaggtccacctatgtatgaaatggaaattgcttcctag

SEQ ID NO: 31037 - DNA, 2427 bp, Artificial Sequence
  Description of Artificial Sequence: Synthetic coding sequence
atgagcagcgtgtcccctattcagataccatctaggctccctctgctattaacacatgagggcgtgctgctcccgggcagcaccatgaggacaagcgtggactcggcaagaaacctacagctggtgcgcagccggctgctgaaaggtacctcactgcagtcaactattctgggcgttatcccgaatacgcccgacccagcttcagacgcacaggatcttccgcccctgcaccgcatcggtactgctgcactagccgtgcaggttgtggggagtaattggcccaagccccactataccctgctgattacaggtttatgccgattccagatcgtgcaagttctcaaggaaaaaccatatcccatcgccgaagtagagcagctggataggctcgaagagttccccaacacatgcaagatgcgtgaagagctcggggagctgtctgagcagttttacaagtatgccgtccaaatcctcgatgcagtgtccctcgaggaaagattcaaaatgacaatacctcttctggtgcgccagatcgagggtctaaagctgctgcagaagaccagaaagccaaagcaagatgacgataagcgcgttattgcgattcgtcctatcagaagaatcactcacatcagcggaacactggaagatgaagacgaggacgaagacaatgacgatattgtcatgttggagaaaaagatcaggacaagctcaatgcctgagcaggcccataaagtctgcgtgaaggagattaaacgcctcaaaaagatgccacagagcatgccggagtatgccctgacacgaaactacctggagctcatggtcgaactcccctggaacaagtccactactgaccgtctggacatccgcgccgccaggatcttgctggataacgatcactacgccatggagaagctcaagaaacgggtcctggaatacctcgccgtccgacaactcaagaataatctgaaaggacccatcctgtgctttgtgggccccccaggagtgggtaaaacctctgtcgggaggtctgtcgcgaaaaccctaggacgggagttccaccgtattgccctagggggtgtgtgtgaccagagcgacataagaggacaccgcaggacgtacgttgggagcatgcccgggcggatcataaacgggctcaagactgttggggtcaataacccagtttttctgctcgacgaagtagacaagttgggaaaatctttacagggagacccggccgcggcacttctggaggtactcgatcccgagcagaaccacaactttactgaccattaccttaacgtcgcgtttgatctgtcgcaggtgctgtttattgctactgccaacactacagctacgatacctgcggccctgctcgatcgtatggagatcatacaggttcccggatacacacaagaggagaagatcgagattgcacaccggcaccttatcccaaaacagctggaacaacacggccttacaccccagcagatccagattccccaggtcacaaccctagacatcataacaagatataccagagaggctggggtgcggagtctcgatcgcaaacttggagccatttgcagagctgtggcagtgaaggtagccgaaggacagcacaaggaggcgaaactggacaggagcgacgtgactgaacgcgagggctgcagagagcacatcctggaggatgaaaaacctgagtccatcagcgatacaacagacctggccctcccaccagaaatgcctatccttatcgattttcacgccctgaaagacatcttggggccccctatgtacgaaatggaggtaagccagcggctgtcgcagccaggtgtggccattggtcttgcgtggacccccctggggggagaaattatgttcgtagaggcttctaggatggacggcgaaggtcagcttactctcaccggtcaacttggggacgtaatgaaggagtcagcccacctcgcgatatcctggttaaggtcaaacgccaagaaataccagctcaccaacgctttcggctcgttcgacctgctagacaacactgacattcacctgcacttcccagcaggcgcggttacaaaggacgggccatctgctggcgtgaccatcgttacatgtcttgccagtctgttttccggccgtttagttaggtctgacgtcgcaatgactggtgagataactctgcgtggattggttttacccgtcggtggtatcaaggacaaagttctcgccgctcaccgcgccgggctaaaacaggtgatcattcctaggcggaacgaaaaggacctggaggggatccccgggaacgtccgacaagatcttagctttgtcacagcgagctgcctggatgaggtactaaacgctgcctttgacggaggcttcactgtgaagacaaggcctggactgctgaatagtaaactatag

SEQ ID NO: 31038 - DNA, 1746 bp, Artificial Sequence
  Description of Artificial Sequence: Synthetic coding sequence
atgcttgagaagaagatcaggaccagcagcatgcccgaacaggcccataaagtgtgcgtcaaggagatcaagagactgaaaaaaatgccccagagcatgccagagtatgccctgacaagaaattatctagagctgatggtggaactcccttggaacaagagcaccacggacagattagacatccgtgcagcccggatcctcctcgataacgatcactacgcaatggagaaattgaagaaacgagtcctggaatatctggcagttagacagctgaaaaataacctgaaaggtccgattttgtgtttcgtgggccctcctggcgtagggaagacctctgtgggtcgttccgtggcaaagaccctcggccgggaatttcatagaatcgcccttggcggcgtatgcgatcagagtgacatacggggacatcgcaggacatacgtcggcagcatgcctggccgaataatcaatggtctaaagaccgtgggtgtgaacaacccggtctttttattagatgaggtggataagcttggaaagtctctccagggtgacccggctgccgccctcttggaggtactcgatcctgagcagaaccacaatttcacagatcattatctcaacgtggccttcgatctgtctcaggttctcttcatagctactgctaataccaccgccactatccccgcagctctgttggataggatggaaatcatccaggtgcctggctatactcaggaagaaaagatcgagatagcacatcgccacctgatccccaaacagctggagcaacatggattaactcctcagcaaatccagatcccccaggtcactactctagatattattactagatatacaagggaggccggagtaaggtccctcgaccgcaaactgggcgccatatgccgagccgtggctgtgaaagtggctgaggggcagcataaggaagcgaagctagaccgaagcgatgttaccgagcgtgagggatgccgagagcatatcctggaagacgagaagcctgaatccatctcagacactacagatttggctctgccgcccgaaatgccaatcttgatcgatttccacgccctgaaggacatcttaggccctccgatgtatgagatggaagttagtcagcgactctctcaacctggggtggctattggcctcgcctggactccattggggggtgagattatgtttgtggaggcctctagaatggacggagaggggcagttaacgctcactggtcagctgggcgatgtgatgaaggagtctgcgcacctggctatcagctggttgaggagcaacgcgaaaaaatatcaacttaccaacgccttcgggtccttcgacttacttgacaataccgatattcatctgcattttcctgccggtgccgtcaccaaagacggcccaagcgcaggagttactatcgtcacttgccttgcatcgctgttcagcggtcgcctggtgagatccgacgttgccatgactggcgagattaccttacggggcttagtgctgccagtcggcggtatcaaagacaaggtgctagcagcccatcgagctgggctgaagcaggtgatcattcccaggagaaacgagaaagatctcgaaggtatcccagggaatgtacgccaggatttgagttttgttaccgccagctgcctggatgaagtactgaatgccgctttcgatggcgggtttacagtcaagacccggccaggcctcttaaatagcaagctgtag

SEQ ID NO: 31039 - DNA, 2322 bp, Artificial Sequence
  Description of Artificial Sequence: Synthetic coding sequence
atgtctagccccgcagtggccagaacctcccctggtggcagcagagagatggcccctgccccccagggccgggggagattctgggaagtgggtggagggtctggacacaggttggaacgcgccgccgccgaatccgagaggtgggagcttctcctgagaaggggggaactcttagccctcggcggccatctaaagggtgctcttgaggccttcgccgctgcattaaggagaggcgccccggccagacccgaatgcttgggcgcactggtggattgtctcgtgttcaattaccgccttaggcatggattaggttggagtgccgctccagtggccggcgcagacggcggcgcaggtggtctcttgaggtgtctagggtgccgagggtttcttagtgagcctgtgaccgtgccctgcggtcactcatactgccgacgctgtctgaggagggagctcagagcgcgctgcagactgtgccgggatagactgccacccgcaaccgcctccgccaccgatgccgaaggcactgccccgcggccaccacctctggccgccgccatagcagcatccgactttcgcacgtcggttgtcttgaaccacctggctgagaaatggtttcctggccaacgtgagcgagcacgggctgcgggccggcttggcgagctactgcaccagggtaggtacagagaagctctcgccgccgcgtgtgaagccctgcgcgcagagcctagcgatctgatagttaagatttaccgtgccgaaagttacgcaggtctacaggagtttaaggcggcgatcgaagatttaaacgccgtacttttccagcttcccgactggccagaggtctatttccgcaaggggaaggtcctgtgcgatgcgggctttctgggagatgcattgcagttgttcctccaatgcctcgccttggacgaagattttgcgccggctaagctgcaggtgcaaaagatcttgtgtgacctgctgctgcccgaaaacctcaaggagggactcaaagaaagtagttggtccagtcttccctgcacaaaaaatagaccctttgactttcactcggtcatggaagagtctcaatccctgaatgaacccagccctaaacaatcagaagagattcctgaggtcacttcggaacccgtaaagggcagtctgaatcgtgcgcaaagtgctcaatccattaactcgacagaaatgcccgctcgcgaagattgtctgaagcgggtgtcttctgagcctgttttgtcggtccaggaaaaaggggttctgttgaagcgtaaactctcgctcttagagcaggatgtgatcgtaaacgaagatggcagaaacaaacttaagaagcagggagagacgccaaacgaggtttgcatgttcagcttagcctacggggatatacccgaagagctgatcgatgtatctgattttgagtgtagtctttgcatgcggttgttttttgagcccgtgaccacgccctgcggccactcattctgcaagaactgcctggagaggtgtctggaccacgctccttactgccctctgtgcaaggagagcctcaaagagtatctagccgacaggcgatactgtgtgactcagcttctcgaggagctgattgtgaagtacctacccgatgagctttccgaaaggaaaaaaatttacgatgaagaaactgccgaattgtcccacctaaccaaaaacgtgcccatcttcgtctgcactatggcctacccaacagtgccttgtcccctacacgtcttcgagccccgatacagactgatgatcaggaggtctatccagactggcactaaacaatttggaatgtgcgtgtctgacacgcagaattcttttgcggattatggctgcatgctgcaaataagaaatgtacacttcctgcctgacggcaggtcggtcgtagacacagtgggcggcaagcggtttcgcgtcttaaagcgtggaatgaaggatggttactgcaccgctgatattgagtatctagaagacgttaaagtggaaaatgaggacgaaattaagaacttgcgcgagctccatgatctcgtgtactcgcaggcgtgctcttggtttcagaatctgagagatcgattccggtcccagattctccagcacttcggaagtatgcccgagagggaagagaatctgcaagccgctcctaatggccccgcctggtgctggtggctcctggcggtcctccccgtggatccccggtaccagctgagcgttttaagcatgaaaagcctgaaagaacggctgacgaaaatacagcacattctgacatatttttctagggatcagagtaaatag

SEQ ID NO: 31040 - DNA, 2265 bp, Artificial Sequence
  Description of Artificial Sequence: Synthetic coding sequence
atgagccccgaaccagtaccaccaccccccccccctcagtgccctgggtgtgacagagctgaaccgattgctcagaggcttgaagaaggagacgaggctttccgcgctggggattacgaaatggcggcagagctcttccggtctatgttggccggtctggcgcagcctgaccggggactctgcttgcgactaggggacgccctcgccagggccgggcgactcccagaagccttgggagctttccgaggggccgctaggcttggagcattgcggcctgaggaactcgaggaactggcgggtgggctcgtgcgagccgtaggcctgcgggacaggccacttagcgcggagaatcccggtggggagccagaagcgccaggcgagggcggacccgcgcccgagccgcgcgccccccgtgaccttctggggtgccctagatgccgaagacttctccacaaacccgtgactctgccctgtggccttacggtatgcaaacggtgcgtggaacccgggcctgcaagacctcaggtgcgccgagtgaatgtggtgctgagcggcctgctggaaaaatgctttccagctgaatgtcgcttgcgcaggctggcaggccaagctcgctctctacagcgccagcagcagcccgaagctgcgttgttaagatgcgatcaggccctagaattggcgccagacgataactcactgctgctcctacgggcagaattatacctgaccatgaagaactatgagcaggccctgcaggacgcctctgcagcctgtcagaatgaacctctattgatcaaaggtcaccaggttaaggcccaggccttgtctggcttaggtcgcagtaaagaggtcctaaaagagttcctctattgtcttgctctgaacccagagtgtaacagcgttaagaaggaggcccagaaggttatgtgtgaggtactcttctctgccactgccaatgttcacgagaatttgactagtagtatacaatctaggcttaaggcacaggggcactcccacatgaacgctcaagccctcctggaagaaggggatgcaggatcctctgagaacagcagcgagaaatcagatatgttaggcaacacaaattcatctgtgctttactttatactggggctgcattttgaagaggataaaaaggcactggagagtattctgccgactgccccctcggcggggctcaagcgacagttccctgatgatgttgaagacgcacctgacctcaatgcccctggtaaaatcccaaagaaagacctgtccttgcagaggagtcccaatagcgaaacggaggaatcccagggattgagtctggatgtcaccgacttcgaatgtgccctttgcatgcgcctgctattcgagcctgttacgacaccatgtgggcacacattctgcctgaagtgcctggaacgatgtctggatcatgcgccccattgtcctctgtgtaaggacaaactgtccgaactgctggccagcaggaattttaatatcactgtgttagctgaagagctgatttttcgatacctccccgacgagctgtcagatcggaagagaatttatgacgaggaaatgagcgagttgtctaatctgactagggacgtgccaattttcgtttgtgccatggcattccccacagtgccatgtccattgcatgtgtttgagcccaggtaccgactgatgattcggcgatgtatggagacaggcaccaagcggtttgggatgtgcctctctgcagaacatgccgggctgagcgaatacggctgtatgctggaaattaaggacgtcagaacgtttcctgacgggtccagcgttgtggacgctatcggcatttctcggttccgcgtcctgagtcaccgccacagggatgggtacaatactgctgatattgagtacctggaggacgaaaaagtggaggggccagaatatgaagaactggctgccctgcatgattccgttcaccagcaatccgtatcctggttcgcgtcattgcaagaccgaatgaaagagcaaatcctgtcccattttggcgttatgcccgaccgagaacccgagcctcagtctaaccccagcggtcccgcttggagctggtggatcctggcggttcttcccctggagaggaaagctcagcttgcaatcttggggatgacatccttaaaggagcgactgttggccattcgtcgaatccttgtcatcattactcgtaaaatgaactcaaggcaggaactagcaaatgcgcgggagagaaacaattag

SEQ ID NO: 31041 - DNA, 1536 bp, Artificial Sequence
  Description of Artificial Sequence: Synthetic coding sequence
atgaagaactacgagcaagccctccaggatgcatccgccgcctgccagaacgagccactcctgatcaaggggcatcaggtcaaagctcaggccctgtcgggtttaggtcgatctaaggaagttttgaaggagtttctatattgcctggccttgaaccctgagtgcaatagcgtgaaaaaagaggcccagaaagtgatgtgcgaagtacttttttcagccacagccaacgttcacgaaaacctcacctcatctatccagtcacggctaaaggctcaaggtcactcccatatgaatgcccaagccctcctggaggagggcgacgctggctcatccgaaaactccagcgaaaaatcggacatgctggggaacaccaactcctccgtcctgtatttcattctcggcctgcatttcgaggaggataagaaggctctggagtccatacttccgacggcccccagcgccggactgaaaaggcaatttcctgacgacgtggaagatgcccctgacctcaacgctcctggcaaaatacccaagaaagatctctcactccaacggagccctaattccgagaccgaggagtctcaggggctgagcctggacgtgaccgacttcgagtgcgcgttgtgtatgcggcttctgttcgagcccgttaccaccccatgtggacacacattctgcctgaagtgtctggagaggtgcctggaccacgctccccattgtcccttgtgcaaagataagctgtccgagcttctggcctcccgaaacttcaacattaccgtacttgctgaggagctgatttttcgttatcttccagatgagctttccgacaggaagcgtatctacgacgaggagatgtctgagctgagcaacctgacaagggacgtaccaatctttgtctgcgctatggccttccccactgtgccttgccccctgcacgtttttgagcccaggtatagattgatgatacgcagatgcatggagactggcactaaacggttcggcatgtgtcttagcgccgagcacgcaggcctctcagaatacgggtgcatgctggagatcaaggacgtgcggacttttcccgacggttctagcgtcgtggatgctatcggcatcagtcgctttcgagtcctttcccaccggcaccgggatgggtataacacggctgatatcgagtatttagaggacgagaaggtcgagggtcctgagtacgaggagctggcagctctgcatgattctgtgcaccagcagtcggtgagttggtttgcctccctgcaagaccgaatgaaagagcagatccttagtcactttggtgttatgcccgaccgcgagccagaacctcaatctaacccctccggccctgcttggtcctggtggattcttgccgtgctccctctcgaacggaaggcacaactggcaattttaggaatgaccagtttaaaggaacggctgctggctatcaggaggattttggtaatcatcacaagaaagatgaactctcgccaggaattagcaaacgcgagggaacgcaataactag

SEQ ID NO: 31042 - DNA, 2157 bp, Artificial Sequence
  Description of Artificial Sequence: Synthetic coding sequence
atggaatctgtcaggattgagcagatgctgtctctgccagcagaggtgtcatcagataatctcgaatctgccgagaggggcgcatccgcagctcaggtggacatgggcccccaccctaaagtggcagcggaaggcccggctcccctccccaccagggagcctgagcaggagcaatcccccgggacatccactcccgagagcaaggtgcttctgactcaggcggatgctctggcgagcagaggcagaattagagaggccctggaggtctatagacagctaagtgaaagacagcagcttgtggcggaacagttggaacagctagtgcgctgcctggcggaaaaggtgcctcagggagaagcactggcacctgctccccctgatgagggtagtaccgcaagtgggaccgtcgcggctgaagaaacgggtgctgccgccgccgcggcagccacagaagtgtgggacggcttcaagtgcagaaagtgtcacggcttcctgtcagaccccgtgtctctctcctgcgggcataccttctgcaagctgtgcctggaacggggaagagccgctgacaggaggtgcgccctttgcggcgttaaactcagcgccctgatggtggcgaccggcagagccagaggcgccaggcgcgctggccaacagcctccgccaccccttcgcgtgaacgtggtcctgtcaggactcttaggtaagctgttccctggtcctgcgcgggcatcccagcttagacatgagggaaacagactgtacagagaacgccaggtggaagcagccctgctaaagtacaatgaggctgtgaagctcgctcctaacgaccatttgctttactccaatcgatcgcagatttacttcacccttgaaagccacgagaacgctctgcacgatgcagaaattgcctgtaaactaagacccatggggttcaaagacaacctggagctgcctcactgtagttctcaagaggaagcagccgctaggggagatgggtcgagtctcatggacccagccaaggttaagggcgatgggcaacagcaccacatgaaagaccaagaagaggaagaggagaagtgggatgccaccagcccaaaggctgcctctagcaagacaggcaaatgccaggagaaaaaacgcaaacattgtcagatcgaatctcaggaggagacgggtatgcccaataaggcctccaagcaggatcctccaacagaccagggagacaagccggcgctctctctgcccctcgcttctttcgatgcctctgaccttgaatgtgcgttatgtatgcggttgttctacgagccagtaaccactccttgcggacatactttttgcctaaagtgcctggaacgctgcctcgaccataacgccaagtgccccctctgtaaggacggcctctctcagtgtctcgcctctaggaaatattcaaaaaacgtcattatggaagagttgatcgctaagttcctcccggaagagctgaaagaacgcaggaagctctacgaggaagaaatggaagagctcagcaatctaaacaagaatgttccaatctttgtatgtacaatggcctaccctacagtgccatgtcccctgcacattttcgagccctgctacaggctgatgatccgaaggtgtattgagacgggcaccaggcagtttggaatgtgtctcggagaccccgtgaaagggttcgctgagtacggttgtattttggagatacgaaatgtccagttcttcgcagacgggagatcagtggtcgattccataggaaagaggcgatttcgagtgttacatcagtcccagagggacggatataacaccgccgacattgaatacatcgaggaccagaaagtgcagggtgaagactgcgcagaactcatgggactgcacaactgcgtgtatcaacaggcatccctgtggttccactctctgaaactctccctcaaaaacaggatcctgaaccacttcgggccaatgcccgaaaaagatgcagatcctcagatgaacccaaacggtccggcctggtgctggtggatgctcgcagtgttgccactcgaatctcgggcacagctcccctttctggctatgagatcactgaaagatcgactgaacggcatacggagggtgttggcctttatctcacgcaaccagaactag

SEQ ID NO: 31043 - DNA, 2157 bp, Artificial Sequence
  Description of Artificial Sequence: Synthetic coding sequence
atggaatctgtgcggatagagcaaatgttgtctttgcccgcagaagtatcaagtgacaacctggagagcgctgagcggggcgcatcagccgcccaggtggacatggggccacatcccaaggtggcggcagaaggacccgcacctctgccgactcgggaacctgaacaggagcagagccctgggacttctactcctgagtctaaggtactgcttacacaagcggacgctcttgctagcagaggacgaatccgggaagcacttgaggtgtatcgccagttaagtgagagacagcagctggttgccgaacagctggaacaactcgtcaggtgcctggcggagaaagtaccccaaggagaagccctggcgcccgcgccccccgatgaaggatccacagctagcggaaccgtggccgcggaggagaccggagcagccgccgccgcagccgccaccgaggtttgggacggattcaaatgcagaaagtgccatggcttcctttctgacccggttagcctgtcgtgcggacacacattttgcaaactgtgtctcgaacgcggcagagcagctgatcgacggtgcgcactctgtggggttaaactgtcagcgctaatggttgctacaggccgcgccaggggcgctaggagggcggggcagcagccccccccacctttgcgcgtgaacgtcgtactgtccgggctgcttggcaagctttttccaggacctgcacgggcaagccagttacggcacgagggaaatagactctaccgagagagacaagtcgaggcggccctgctgaagtacaacgaggccgttaagctcgcaccaaatgatcacctactgtactccaaccggtcccagatctatttcacccttgaatcccacgaaaacgcactccacgacgctgaaatcgcctgcaaactgcgtcctatggggtttaaggacaatctcgagttgccccactgcagtagccaggaggaggccgccgcacggggcgacggtagctcattaatggaccccgcaaaggtgaagggcgatggccagcaacaccatatgaaagatcaggaggaggaggaggaaaagtgggacgccacctccccaaaagccgcatcttccaagacaggaaagtgccaggaaaaaaagcgcaaacattgccaaatcgaatcccaggaggaaactgggatgcccaacaaggcctcgaagcaggatccaccaacagatcagggcgacaaacctgccctctccctgcccctagctagctttgacgccagcgacctggagtgtgccctttgcatgagactgttctacgagccagtgacaacgccatgcgggcacaccttttgcctgaaatgtctggagcgatgtcttgatcataatgccaaatgccccctctgcaaggacggcctatcccagtgcctggccagtaggaaatattccaagaatgtgatcatggaagaactgatcgccaagttcctgcctgaggaactgaaagagcggaggaaactgtatgaggaggagatggaagagttatccaacctgaacaaaaatgtgccaatcttcgtctgtaccatggcctatccgactgtgccgtgtccgctgcacatctttgaaccgtgctaccgcctgatgatccgccgctgcattgagacaggaaccagacaatttggcatgtgtctcggggatcctgtgaaagggtttgctgagtacgggtgcatactggaaattaggaatgtccaattcttcgcagatgggcgatcggtggtggatagcatcggcaaaagaaggtttcgggttctccaccagtcgcagcgagacggttacaacaccgccgatatagaatacatcgaagaccagaaggtgcaaggtgaggattgcgcggaactgatgggccttcataactgcgtgtaccagcaggccagtctctggttccacagcctcaagctctcactgaagaacagaattctaaatcactttgggcctatgccagaaaaggacgcagatccccagatgaaccctaacggaccagcttggtgttggtggatgctcgccgtgctcccgctggagagccgagcccagttacctttccttgcgatgcgctctctcaaggatagactcaatggaattagaagggtgcttgcttttatttctaggaatcagaattag

SEQ ID NO: 31044 - DNA, 2280 bp, Artificial Sequence
  Description of Artificial Sequence: Synthetic coding sequence
atggagagtgttagaattgagcagatgctctccctgcccgctgaagtgtcgagcgacaatttggaatctgctgaacgtggtgcctcagccgcacaggtggacatgggtcctcaccccaaggtggcagccgaaggacccgcccctttgccgacacgcgagcccgagcaagaacagtcccccggaacctccactcctgagtctaaggtcctccttacacaggccgacgctctggcaagccgtggtaggatccgagaggctcttgaggtctacaggcagttatctgagcgtcaacaactggtcgccgaacagcttgagcagctcgtgcgttgtttagctgagaaagtgcctcagggcgaggcactggctccagcacctccggacgagggatccacggcatctgggacggtagccgcagaggagaccggtgcggccgccgctgcagccgccaccgaggtgtgggatggattcaaatgtcgaaaatgtcacggcttccttagtgatccggtatccctatcttgtggccatactttctgcaagctctgcctcgagagagggagagcggccgataggaggtgcgccctgtgtggtgtgaaactgtctgccttgatggtcgccaccggtagagcccgtggagctcgtagagccggccagcaacccccgccacccttgagagttaatgtagttctgagtgggctcctcggaaagctcttccctggaccagcaagggcctctcaactccggcacgaagggaacagactctacagggagcgtcaagtggaggcagccctgctgaagtacaatgaagcagtaaaactggcacccaatgaccaccttctctattctaatcgaagccagatttatttcacccttgaatcccacgagaatgcccttcacgacgcggagattgcttgtaagctcaggcctatgggatttaaagcacacttccggaaggctcaggctcttgctacacttggaaaggtagaagaggcgctgagagaattcttgtattgcgtgagtctcgatggtaaaaataagcgggccaggtgcgaagcccagcgggacaatctcgagctcccgcactgctcatcacaggaagaggctgccgcccggggggacggcagttctctgatggatcccgcaaaggtcaagggcgacggacagcagcatcacatgaaggaccaggaggaggaagaagaaaaatgggacgccacaagccccaaggctgcaagcagtaagactggcaaatgtcaggagaagaagcgtaagcactgccagatcgaatcacaagaggagacaggcatgcccaataaggcctccaaacaggaccctcccaccgatcagggggacaagccagccctttctcttcctttggctagctttgacgcctcagatctggaatgtgctctgtgcatgcgcctattttatgagcctgttacaaccccctgtgggcacacgttctgtctcaaatgtctggaacgatgtctggaccataacgccaagtgtcccctgtgtaaggatggcttgagccagtgtctcgccagccgcaagtactccaaaaatgtgatcatggaggaactgattgccaagttcttacccgaagagcttaaagaacgtaggaagctttatgaagaggagatggaggaattatcgaatctgaacaagaatgtgccgatatttgtttgcacaatggcttatccaaccgttccctgccctctgcatatcttcgaaccctgctatagacttatgattcgacgctgtatcgaaacggggacaagacagttcggtatgtgcctgggggacccagtcaagggctttgcagaatatggttgcattctcgaaatacgcaatgtccagttctttgcggatggtcgaagcgtggtcgactccatcggcaagcgccgtttccgggtactccaccaatctcaaagggatgggtacaacaccgctgatatcgagtacatcgaggaccaaaaggtccaaggggaggactgcgctgagttgatgggcctccataattgtgtctaccagcaagccagcctttggttccactctcttaagctgtccctcaaaaaccgcatactgaatcatttcggacccatgccggagaaggacgctgatccacagatgaaccccaacggccccgcatggtgctggtggatgctggctgtgttacccttggagagtagggcacagctacccttccttgccatgaggagcctgaaggacagattaaacggcatacgcagagtgttggccttcattagcaggaaccagaattag

SEQ ID NO: 31045 - DNA, 1512 bp, Artificial Sequence
  Description of Artificial Sequence: Synthetic coding sequence
atggggtttaaagctcatttccgaaaggcccaggcactggccaccctcgggaaagtggaggaagcgctgagagagttcctgtattgtgtgtccttagacggtaaaaataagcgggctcgatgtgaagcccagcggctactgctttccttcttttctccttctgtgccgggcgatagtcaggagcactctcctgatatcctcaagctgctcgcacctcacccccggttgaaagagaatgtcgagagcatgacgacagaggtcacctcacataatctgccgcggctgctgcaggataatctggagctgcctcattgctcctcccaggaagaggccgcagctaggggcgatggctccagtctgatggacccagccaaagtgaagggggatggtcagcaacatcacatgaaagatcaggaagaagaggaagagaagtgggatgctacaagtcctaaggctgcgtcaagcaagactggaaaatgccaagagaagaaacgcaaacactgtcagatagaatcgcaggaggaaacaggaatgcctaacaaggctagtaaacaggatccacccaccgaccagggcgataagccagccttgtctcttcccctggctagtttcgatgctagcgatctcgagtgtgcactttgcatgcgtctgttttatgagcccgtcactaccccctgcgggcatacattctgccttaaatgcctcgagcgatgcctggatcacaatgccaaatgcccattgtgcaaagatggcttgagccagtgcctggctagccggaaatactctaagaacgttatcatggaagagctaatcgcaaagtttctgcctgaggagctgaaggaacgcaggaaactttacgaagaagagatggaggagctatccaacctcaacaagaacgtgcctatcttcgtatgcactatggcatatcccaccgttccttgccctctgcatatcttcgagccatgctatcgcctgatgatcaggcgctgtatagagaccggcacacggcaatttggaatgtgtttgggagatcctgtgaagggctttgccgagtacggttgtatcttagagattagaaacgtacagttctttgcagacggaagatctgtggtggacagcatcgggaagcgcaggtttagagtactgcatcagagccaacgagatgggtataacactgccgacatcgagtatattgaagatcagaaggtgcagggggaagactgcgcggagcttatggggttacacaactgcgtctaccagcaggcctctctgtggtttcacagcctgaaactcagtcttaaaaacagaatcctaaaccatttcggccccatgccagagaaggacgccgacccacagatgaatccaaacggtcctgcttggtgctggtggatgctggcagtattgccgttggaatcccgcgcccaactcccatttttggccatgagatctttgaaggatcggttaaacgggatcaggcgagtactggcctttatctcaagaaatcaaaattag

SEQ ID NO: 31046 - DNA, 1578 bp, Artificial Sequence
  Description of Artificial Sequence: Synthetic coding sequence
tagtgcggcgtaaagctaagcgctcttatggtggcaactggcagggctcgcggcgctaggcgggcaggacaacagcccccacctccactgcgcgtgaatgttgttctgtctggtctgctcgggaaactgtttcccggaccagcgcgggcgagccagctgagacatgagggcaacaggctgtatagagagcggcaggtggaagcagcactgctgaaatacaacgaggccgtcaaactggcccccaatgaccacctcctgtacagcaacagaagccagatctacttcaccctggagagccacgagaacgccttgcatgacgccgagatcgcttgcaagctgagacctatgggctttaaagacaatctggagttgccccattgttcaagccaagaagaggcggcagcacgcggagatggctcctctctgatggacccagccaaggtgaagggagacggacaacagcaccacatgaaagaccaagaggaagaagaagaaaagtgggacgccacatctcctaaggccgcttcaagcaagactggaaagtgtcaagaaaaaaaacgtaagcattgccagatcgaaagtcaggaagagaccgggatgccaaacaaagcgtctaaacaggaccctcccactgatcagggggacaagccggctctgtcacttccactggccagcttcgacgctagcgacctggaatgtgccctctgtatgcgcctcttttatgagcctgtgaccaccccttgcggacacacgttctgtctcaagtgcctggaacggtgcctggaccacaatgccaaatgccccctgtgtaaagacggtttaagtcagtgtctggccagcagaaaatactcaaaaaacgttatcatggaggagttgatcgccaagtttctcccggaagagttaaaagagcgacgcaagctgtacgaagaggaaatggaggagctgtccaacctgaacaagaacgtacccatctttgtgtgtactatggcttacccgacagtaccctgccccctgcacatattcgagccatgctaccgtctgatgattcggcggtgcatcgaaaccgggactagacagttcgggatgtgtcttggagacccggtgaaggggtttgccgaatacgggtgcatcctcgagatccggaatgtccagttttttgctgacggacgctcagtcgtcgactcaattggaaaacgcaggttccgcgtgctgcatcagagccagagggatggatacaatactgccgatattgagtatattgaagaccaaaaagtgcaaggggaagattgcgcagagctgatgggcctgcacaattgtgtgtatcagcaggctagcctctggttccactccctgaagctttccctgaaaaaccgaatcctgaatcacttcggccctatgcccgaaaaggatgcagaccctcaaatgaatccgaacggtccagcttggtgttggtggatgctcgccgtacttccactcgagagtagggctcagctgccctttctggccatgcgctctctgaaggaccggcttaacggaatccgtcgggtgttggcattcatttcgcgtaaccagaactag

SEQ ID NO: 31047 - DNA, 1389 bp, Artificial Sequence
  Description of Artificial Sequence: Synthetic coding sequence
atgggtgcggctgggagggcaacccgtctggtgggtggccgcgaacagaggggagccgttgggggcggctggtgggggggagaacccgacattccctacacacatactaccgagcaccctccaatgggttctcctttgcctaacctccgagctcatgtgcgcaccggcagaccaccggacccgtgtaccgctgccgccagggacaggagaccactcggaagaggagggagaggagcggcgcaaactttcggacagcgcactcgtggaggtccccgttgcccaggctcgcacagacagcgtcccccttctatgaaagctgcccccaggctgccacatagattgcgtcaccgggggcaaccccccgagccatcatcactccgagccctccacgcagatcctatcccatctggcctgtctcctggaccttgtggtgctcctcctacatggagcggtagaagggcccccggagatcgggacaatcggccaactagcgggccatggcagagacacacacggcgatctagagtatggtcacagcgggggcctccccagcctaaactggtgtctcgttcgggtcgggaggatactcgggccggccgaggagcccagaccggcaaggccagagatcgtaagggaaaaggaacccgggaaccggcagagggacgccttggtaagaaaccacaggcgaaacctgggcaccaggagaatacagccactggctcacataggcaccgctacgagggcgggcccgctgctcccaggctgggctctcgcaccgctccagggacgcacagagatccgccgcacgagccaggatctcggcatcgggatcctgaagctacatccgccaccaacccaacacccgggcccagatgttggttccttgtgcacccacctactctgtcttccagcggcagacctgcacggccgccactcggcatgttgccaatggctcgtcaccccaatcccgttccacgcaagcggggttgtaggcaccggtcactgctgcttcggggtgctggaggggagcccgccagaagcggagcgggccatgcacccgatgggaccccgggaaccgccacagcacgtgccgcttcacagccgctgggcagaaggcccggcccagccgggtctagccctgacagtgaaggaggcggagccggccacacagtgggcgatgaacccccgtctgtacctacagctgaggatagtctcaaaagggaatcagtgagagacagctcattctccccagagagtagcgaggtagacggcggtctgtgcagcgagttattgtggttccagctagctgcacggcggagagaaatctcaaacgtgtcccgagaggcgcgggccactgtcatcgagccacggaaatggaggcttcagtag

SEQ ID NO: 31048 - DNA, 495 bp, Artificial Sequence
  Description of Artificial Sequence: Synthetic coding sequence
atgcggcctcagcctagggggggctctggaaggaaggagaacaccggcgaagaacgagaaggaagagccgagcggtaccacgcgattagtgccgatggcgagaggcggctacaaccgggtacggccgttctgacgagacatgtgagcttcctgttcggaggacgggaggctgaagagcacgtgatggagaccgaccgcgtggagggagctagggatggcgacaagcgtaaggaagtctgctttgtgccaattcagggcagcttttgcttcatgcggctgacatgtgcacgcctcgttgccgctctggacatccacggactctcattctctttgagattttgtggctcaagagacaccaagcacgaagatataaccggcagggaagggcaggtgaccccgctcccccgcggtactccacaactatgtactgcgcgggttgggctgtctagccctagaacacgggggcagggcgttcctatatcttgcaaaacttag

SEQ ID NO: 31049 - DNA, 261 bp, Artificial Sequence
  Description of Artificial Sequence: Synthetic coding sequence
atggtaagacacccctactcagtgcagacccagctgtctacggaagccaaagccatctggagatcaatgcaacagcaggagaccaaccttctggctaatctgacgaccaatgacgctagagacaactcaaaagacttccagaactccaaggtgggcgcggccgcaacatctcgggatgagggctgcaactgcccaatcattggtgagatcgtgattagctgttactggcttttcgagatcccaccactgatcagtaggtag

SEQ ID NO: 31050 - DNA, 192 bp, Artificial Sequence
  Description of Artificial Sequence: Synthetic coding sequence
cagcagcaggagaccaacttgctggccaacctgactacaaatgacgcaagagacaatagcaaggatttccagaatagtaaggtgggggccgccgctactagcagggacgaaggttgtaattgccccattatcggagaaattgtgatctcttgttactggctgtttgagatccctccattgatcagtgaatag

SEQ ID NO: 31051 - DNA, 249 bp, Artificial Sequence
  Description of Artificial Sequence: Synthetic coding sequence
atgcagtgtctgtatttcattctgatcttaaaaggctactttcatcagcagcaccatacgttactgatcaccatcgccctctgcttccttcaacaacagcaggagacaaacctgctggcaaatctgacaacgaatgatgctcgtgataatagcaaagatttccaaaatagcaaggttggagcggccgccacttcccgagatgagggcgaaactcagaaatgcattcagaaacccctgcacgaaaagtag

SEQ ID NO: 31052 - DNA, 795 bp, Artificial Sequence
  Description of Artificial Sequence: Synthetic coding sequence
atgccgcgaagcctgaaacgcgcccagctacggagtctcctgcctcggcccccagcagtgtcgcacacgcaaccctggtatcgagcggcccaccccacgacttcccccactgcagcatctcgagatgttcaccccgcatctggcgccgtgcctggaccttggctggtagagggcactgctgtacgtgagggtccgcagcttcaagacgcagtaccccagcgccctacccgcccctccaaagcgctgtggcccgcccagatgtctgctgcacccgcaatcagacttggccagatggtgccaggtgatactcggggcctgtgggggccccagggtacactgctgacttggacataccggggcggccaaggcggacggtggaccagaagagcagagggacccagggaagggacatttgctgaacagcggcctcacttccagtcctctggagcgcagcaggaatcacggctcgcgatggggccccccccactcggtctcggcgacgctgcgggcgatggccgagggcagaccgggcaggagaaggggcgagccgaaggtcgtcaggcccgtaaaagcgcgtgcaaatgtcctcgcaaaggtcctaatcccggcccatggacacgcgccgccgcctggtggggacgactagagggggccaaggcatctgcaaaaggagaacaggtcagagaccctggcggtcacctttgggaacagggacacgtttctccatgcgcgaggttcaaccaaggccatagctgtggcagtcccaaggtttcccatacaacctgggtgtcctag

SEQ ID NO: 31053 - DNA, 447 bp, Artificial Sequence
  Description of Artificial Sequence: Synthetic coding sequence
atgggctcagagcagtcgtcagaggctgaatctcgccccaatgatctaaattcatctgggctgctgagcggacagactagtcctacaaatgctaaattggaaaagctggatagccagcaggtgctgcagctgtgtctgaggtaccaggaccatctccaccagtgcgccgaggctgttgcctttgaccagaatgcactggtgaagaggattaaggagatggatctgagtgtcgagaccctgttctcttttatgcaggaacgacagaagaggtatgccaagtatgccgaacagattcagaaggtgaatgaaatgtccgccatcttgcgccgtatccaaatgggtatcgatcaaacagtcccattgcttgatcggctgaatagcatgctgccagagggcgaaaggcttgagcctttctctatgaagcctgatcgcgagcttagactgtag

SEQ ID NO: 31054 - DNA, 591 bp, Artificial Sequence
  Description of Artificial Sequence: Synthetic coding sequence
atgggtagcgagcaatcctctgaagctgagtccaggccgaatgatctcaactcctcagtgacaccatctccagctaaacaccgcgcaaagatggatgatatagtcgtggtggcccagggctcacaggcatcccgaaacgtgtccaacgatccagacgttatcaaactgcaggagatcccaacttttcagccgctgctcaagggtctcctgagcggacagacaagccctactaacgcaaagcttgaaaagttggattctcagcaggtgttacagttatgcctgaggtatcaggatcaccttcaccagtgcgctgaagcagtggccttcgatcagaatgcactggtgaaacgaatcaaggagatggacctctcagttgagaccctgttctcatttatgcaagaaagacagaagcgctacgcgaaatacgcagagcaaatccagaaggtcaatgagatgagcgcgattctgcgaagaattcagatgggtatcgatcagacagttcccctgttggacagactaaacagcatgctgccggaaggcgagaggcttgaacccttctccatgaagcctgacagagagctgcggctttag

SEQ ID NO: 31055 - DNA, 501 bp, Artificial Sequence
  Description of Artificial Sequence: Synthetic coding sequence
atgcagggcacaagagccgaattaagcgcacatagcccaagcagagcagccgggaacagacggcatgagcaaggattgcctcccggtgcacaggcctgcatcacattgacaaatagaaccggatttctatgtcacgaccagagaagttgtatacccgcatcaggagtgtgcgatggagttaggacatgtacccacggagaagacgaggacgaatcgttgtgcagggatgtacctcagtcgctcccacattttttagtcgcgcattgtggtgatcccgcctcttggatttactctgaccagaagtgtgacggtactaacaactgcggcgattgttctgacgaactgtcccccgtgactgtgtgccccccctgtggtcctggctggtggaggtgtccgtctacattctttaaatactgcgactgcatcccacgacatttgtgccgggaccacgtgcaacattgcagtgactggagcgacgagtacgcgtgcccagggccttag

SEQ ID NO: 31056 - DNA, 489 bp, Artificial Sequence
  Description of Artificial Sequence: Synthetic coding sequence
atgaataaagtgttcccccagggggagaacggctacaccgccgcggagtccaaagcccatccaggcggggagggcgcccaggcttgcattaccctgaccaacagaactggcttcttgtgccacgatcagagatcctgcatccctgctagcggtgtctgtgacggcgtgcgcacctgtacgcatggagaagacgaggacgagagtttgtgtcgcgatgtgccccagtctctgccacacttcttagtggcccactgtggcgaccctgcctcttggatctattctgatcagaaatgcgacggtacaaataattgcggagattgctcggacgaactgtcacctgttactgtatgtccaccctgtggccccgggtggtggaggtgtcctagtaccttcttcaagtattgtgattgcatcccacgccacctttgtcgcgatcacgtgcaacactgctccgactggagcgatgagtatgcatgccccggaccatag

SEQ ID NO: 31057 - DNA, 759 bp, Artificial Sequence
  Description of Artificial Sequence: Synthetic coding sequence
atggagggccacgtctactggacagatgatgaagtttgggctatcaggagggcatacctggacggttctggagcgcagaccctcatcaataccaaaattaatgatcccgatgacatcgctgtgaactgggtggcgcgatctttgtactggacccatacaggtacggagcacatcgaggtaacctgcttaaatagcacgagtcataaaatactcgtgtccgaggatatggatgagccgcgcgctatcgccctgcaccctgagatggggcttacctactggatcgactggggggaaaatcccgaaataaaaagagccaatttggatcgccaggaactcagggtactggtcaacgcctccttgggctggcccaacggcctggccctggacttgcaggaaggaaaactgtactggggtgatgccaagactgataaaattgaggcaattagtgtggacgagaccaaaagacagactttgctgaaggataaactcccccacatcttcaggttcaccctgcttggagactttatctactggaccgcttggcaacatcatagtataaaacgcgtacataaagttaaagcaaaccgagatgtgataatcgatcaactgcctgaccttatgggactgaaggcagtgaatgtggacaaggtggttggcactaatcctcatgcagaccgaaacggaggagcggccacctgcgcatcttcacgcccaactcagcccgggctcgctgcaccaagtagagcctggaattgttag

SEQ ID NO: 31058 - DNA, 759 bp, Artificial Sequence
  Description of Artificial Sequence: Synthetic coding sequence
atggagggccatgtgtattggaccgacgatgaggtttgggcgatccgccgagcatacctggacgggagcggcgcccagaccctgattaatactaagataaacgatcccgacgacattgcagttaactgggttgctagaagtctgtactggacccatacaggcactgagcacattgaggtgacctgcctcaattccaccagtcacaaaatcctggtgtctgaggatatggatgagccacgagccatcgctctccatcctgagatgggccttacttactggatcgattggggagaaaaccccgaaatcaaacgggccaatctagatcgacaggagctgagggtgctggtgaatgcatcactcggctggcccaatgggctggccctggatctgcaggagggaaaattgtactggggagacgccaagacagataaaatagaagcgataagcgtagacgagaccaagagacaaaccctgctgaaagacaagctcccgcacatctttaggtttactctactgggagactttatttattggactgcttggcaacaccactctataaagagggtgcacaaagttaaggcgaacagagacgtgatcattgaccagcttccggatctcatggggctgaaagcagtgaacgtagataaggtggttgggacaaatccccatgccgataggaacggaggtgctgccacatgcgccagcagcagaccaactcagccgggacttgcggccccctctagagcctggaactgctag

SEQ ID NO: 31059 - DNA, 675 bp, Artificial Sequence
  Description of Artificial Sequence: Synthetic coding sequence
atggagggccatgtttattggactgacgacgaggtctgggcaatcaggcgcgcgtacctggatgggtcaggtgctcaaaccctcatcaacaccaaaatcaatgaccccgatgacatcgccgtgaattgggttgctagaagtctgtattggactcataccgggacagaacacattgaagtgacatgcctaaattccacctcccataaaatcctggtttctgaggacatggatgaacccagagctattgccctgcaccccgagatgggattaacctactggattgactggggggagaatcccgagatcaagcgggctaatctggataggcaggaactgcgagtactcgtaaacgcatctcttggctggccaaacggactcgccctggacctccaggaggggaagctgtactggggcgatgccaagactgataaaatcgaagctatcagtgtcgacgagaccaagcggcagacacttctgaaagacaaattaccccacatctttagatttactctacttggggatttcatctattggaccgcttggcagcaccactccattaagagggttcataaagtgaaggctaaccgcgatgtgattatcgaccagctgccagacctcatggggctcaaagctgtaaacgtggataaggtggtgggcccaggcaccgccgagtag

SEQ ID NO: 31060 - DNA, 12 bp, Artificial Sequence
  Description of Artificial Sequence: Synthetic coding sequence
atggaaggatag

SEQ ID NO: 31061 - DNA, 1158 bp, Artificial Sequence
  Description of Artificial Sequence: Synthetic coding sequence
atgagcggatcatctggtacaccttatctggggagtaagatatcacttatcagtaaggcccagatccggtacgagggcatcctgtacactattgacaccgacaattccacagtcgctctcgctaaggtgcgctcgtttggaactgaggatcggcccaccgaccgtccagctcccccccgtgaggaaatctatgaatatattattttcagaggctctgacattaaggacataacagtttgcgagcccccaaaggctcaacacacactccctcaggatcctgccatcgttcaaagcagcctcggatccgcctccgcttccccttttcagccacacgtcccctatagccccttcaggggaatggccccttacggacccctagccgcatcttccctgttatctcagcaatatgcggcttctctagggctagagaaacttgtctcgccaccagcctccgctgcggcatccagcccaagctcgtctccgtcccctcagcccgtgtctgaactggatctatcctcagagcctcagcagctgactgctaagggcaactcctctctgggagaactgcatgccgtgctgcaaacgattctgcgcgctcgtggtaaagccgcggaccgcatgaccgtagccgtggcagatcacctccccagtccttgcagtagacgaaggagcggtaacaggagaacccggaacagatccagagggcaaaatcggccaacaaatgttaaagagaatactatcaaattcgagggagacttcgattttgaatccgctaacgcacagttcaacagggaagagctggataaggagttcaagaagaaactaaatttcaaggatgataaagctgaaaagggagaggagaaagacctagctgtcgtcacgcagagtgctgaggctcccgccgaagaggacctgctgggaccgaactgttattacgacaagagcaagtctttcttcgacaatatatcttcggaactcaagacttctagcagaagaaccacttgggcggaagaaagaaagctcaacacagaaacctttggcgtgagcgggaggttcttaaggggaaggtcctccagagggggtttccgaggcggtaggggcaatggaaccacacgccgcaaccctacctctcatagggcgggcaccggcagggtgtag

SEQ ID NO: 31062 - DNA, 1158 bp, Artificial Sequence
  Description of Artificial Sequence: Synthetic coding sequence
atgtcgggttctagcggaaccccatatttagggagtaagataagtttgatttcaaaagcacagatccggtacgagggcatactgtataccattgacacagacaactcaacagtggccctggcaaaggttcggtcattcggcaccgaggatcgccccaccgatagaccagcaccgcctagagaggagatctatgagtacataatctttaggggctccgatattaaagacataaccgtgtgcgagcctcctaaggcccagcacacactgccacaggatcccgccatcgtccagtcttccttagggtctgcaagcgcgtcccctttccagccacacgtcccctactcacccttccgtggaatggctccttacggcccgctggccgcctcttcattgctctcccaacagtacgctgcaagcttaggcctgggggcaggcttcccgtcaatccccgtggggaagagccctatggtcgagcaagcagtccagacaggatccgcggataacttgaacgctaaaaagctgctgcccggtaaaggaactacaggcacacagctcaatggacgacaggcccaaccctcatccaaaactgcgagcgacgttgtccagccggccgccgtacaggcccagggccaagttaacgatgagaacaggagaccacagagaaggcgatctggaaataggcgtacccgcaacagatctcgaggccagaatcgccctacgaacgtgaaggagaacactatcaaatttgagggggatttcgatttcgaatccgcaaacgcccaatttaacagagaggagctggataaagagtttaaaaaaaagcttaactttaaagacgacaaagctgaaaaaggggaagaaaaggatcttgccgttgttacccagtcagccgaagccccagctgaggaggatctcctgggacctaattgttactacgacaagtcgaagagtttcttcgacaatatctcatcagagctcaagacgtccagtcgccgaactacatgggcggaagaaaggaaacttaataccgaaacttttggcgtatctggccgcttcctgcgaggtcggagcagtagaggcggatttaggggagggagaggaaacggaaccacccggcgaaacccgacctcacaccgggcaggcacaggccgcgtgtag

SEQ ID NO: 31063 - DNA, 672 bp, Artificial Sequence
  Description of Artificial Sequence: Synthetic coding sequence
atgagtgggagttcaggtaccccttacctgggatctaaaatatccctgatctccaaggctcagatccggtacgaaggaatcctctacacgatagacaccgataactctaccgtagcgctagccaaagtgagatcattcgggacagaggaccggcccacagatcgccccgcccccccgagagaggaaatttacgagtacattatttttcggggcagcgatatcaaggacatcactgtctgcgaacctcccaaggcccaacatactttaccacaagatccggccattgtccagtcgtccctaggttctgcttccgcaagcccattccaaccccacgtaccttatagcccattcagggggatggcaccctatgggcccttggccgcctcaagcctcctgtctcagcagtacgctgcctccctaggactcggcgccggctttcctagcatccccgttggaaaatcacccatggtagaacaggcagtccaaaccggaagcgcggataatttgaacgccaagaagctgctgcctggcaaagggacgaccggcacccaactcaacgggcggcaggcccagccttcgagcaagactgcatctggcaacaggcgcacccgcaaccgcagccgcggccaaaaccgaccaaccaatgtcaaagaaaatactatcaagttctag

SEQ ID NO: 31064 - DNA, 747 bp, Artificial Sequence
  Description of Artificial Sequence: Synthetic coding sequence
atggccccctacggaccccttgctgcctcttccttgctctcccagcagtacgcagcctctctagggctcgagaaacttgtgtcaccccccgcttctgcagcagcctcttcaccctcttctagcccctcaccgcagcccgtgtccgagctggacctctcaagcgaaccacagcagttgacggccaagggcgccggtttccccagcatccccgttggaaagagtccaatggtcgaacaagcggtccagaccggctctgctgacaacctgaatgcaaagaagttgttgccagggaaagggaccacaggaacccaactgaatggaagacaggctcaaccaagctctaagactgcatccgacgtcgtgcagcctgctgccgttcaggcacagggacaggttaacgatgaaaaccgccgcccacagaggcgccgcagtggcaaccgccgcactaggaacaggagcagaggccagaatagacctaccaacgtgaaggagaacactatcaaatttgagggggactttgatttcgaaagcgctaatgcccagtttaatagagaggagctggacaaggagtttaagaaaaagttaaattttaaggatgacaaggcagaaaaaggagaggagaaggacctcgccgtggtgactcagagcgccgaagcccctgctgaggaggatctgcttggaccgaactgctattatgataaatcaaagtcctttttcgacaacatatcgtctgagttaaaaacgtag

SEQ ID NO: 31065 - DNA, 720 bp, Artificial Sequence
  Description of Artificial Sequence: Synthetic coding sequence
atggccccctacggcccactcgcagccagctctctcttgtctcagcaatatgctgcaagcctggggctggaaaaattagtgtcgcctccggctagtgctgctgcctcgtcaccgagcagtagcccttcaccccagccggtcagcgagctggatttatccagcgagcctcagcagctaaccgccaaaggatgcctgttctgtttccgctcactctttacttatacccaatctcatatagttctgtttcgggtacctacggggcccgggaccctagaacgtgaggagatggagcgtggggcggggttcccaagcatccccgtcgggaagagccccatggtcgagcaggccgtgcagacagggtcggccgataacctgaatgcaaagaaattgctgcctggcaagggaaccaccggcacccagctgaatggccggcaggctcaaccctcctccaaaaccgcctccgacgttgtacaacctgctgctgtgcaagcacaaggccaagtgaatgatgagaatcgtcgaccgcagcgccgccgaagcggcaaccggaggaccagaaacagatctaggggccaaaacagaccaaccaacgttaaagagaatacaattaagttcgaaggggatttcgactttgagagcgccaacgcacaattcaaccgggaggaactcgataaagaattcaagaaaaggcctatattactcctggtgttctggacctag

SEQ ID NO: 31066 - DNA, 666 bp, Artificial Sequence
  Description of Artificial Sequence: Synthetic coding sequence
atgagtggaagttcagggaccccctacctgggcagcaaaattagcctgatctcaaaagcccaaattagatatgagggcattctgtacaccatagataccgacaattcaaccgtggctctcgcgaaggttcgctccttcggcacagaggatcgtcctacagatcggccagccccccctcgcgaggagatatacgaatacattatctttagggggtctgatattaaagacatcacagtctgcgagccacccaaagcccagcacaccctgccacaggatccggccattgtgcagtcgtccctcggttctgcctctgccagtccttttcagccgcacgtcccatactctccattccgaggaatggctccgtacggccccctcgccgcatcttccctgttgtcacagcagtatgctgctagtctgggactggaaaaactggtctcccccccagctagtgctgctgcgagctctcccagctccagtccctctccgcagccagtgtcagaacttgacttgagcagcgaaccacagcagcttacagcaaagggaaacagctctctcggcgaattgcacgcggttctgcagacaatcctcagagccagagggaaagctgccgaccggatgactgtggctgtagctgatcacctcccatccccttgctcaaggtag

SEQ ID NO: 31067 - DNA, 891 bp, Artificial Sequence
  Description of Artificial Sequence: Synthetic coding sequence
atgtcaggctccagcgggacaccttacttaggctccaaaattagtctgatttctaaagcccaaatacgatatgaggggatcttatacaccattgacaccgacaacagcacggttgccttggctaaagtgcgatcattcggcaccgaggataggcctaccgacagaccagccccccctcgcgaagagatatatgagtatattattttcaggggttctgatatcaaggacataaccgtatgtgaacctcccaaggcgcagcacactctgccgcaggatcctgccatcgtgcagctgaacaaacggccagacgagggcgtccgaggcgacggcatggctttcgcagtcctgacaaggtgccttgttgtccaatcctccctgggttccgcctctgcctcaccttttcagcctcacgttccatactcccctttcagaggtatggccccatacggcccgctggccgcttcttctctcctgtcccagcaatacgctgcttctctaggcctgggtgcgggcttcccgagcatacctgttggcaagagccccatggtggaacaggcagtccagactggctctgccgataacttaaacgcaaagaaactcctacctggaaaaggaaccactggtacacaactgaacgggcggcaggcgcaaccctctagcaagacagcttccgatgtggtgcagccagccgccgtgcaggcccagggacaggtgaacgacgaaaaccgcaggccacaacgtcgcagatccggtaatcggaggacgcgtaacagatcccggggccagaataggccgactaatgtaaaggaaaacaccataaagtttgaaggcgacttcgatttcgagtccgccaatgctcaattcaatagggaggaattggacaaggagtag

SEQ ID NO: 31068 - DNA, 693 bp, Artificial Sequence
  Description of Artificial Sequence: Synthetic coding sequence
atggccccttacgggccccttgctgcgtctagtctgctctctcaacagtacgccgcctccttaggcctggaaaaactggtctctccccctgcaagcgctgcggcgagctcgccgtcctccagtccgtcaccccaacccgtgtcagagttggatctaagctcagagccccaacagctgactgccaaaggatgcttgttctgcttcagaagtctattcacttatacacagtctcacatcgtcctgtttcgggtgccaaccggtcctggcacccttgagagagaggagatggagcgcggcgccggattcccttccatccccgtgggcaagagtcccatggtcgagcaagccgtacaaacaggcagtgcagataaccttaatgctaaaaaactactgcccgggaaaggcaccaccggaacccagctcaacggcaggcaggcccagccttcatccaaaaccgcctcagatgtcgtccagccagcagctgtccaggcccaagggcaggtgaacgacgagaacaggcggccgcaaaggagacgctccggtaaccggaggacacgaaaccgctcccgcggccagaataggccgacaaatgtcaaagaaaacaccatcaaatttgagggagatttcgatttcgaatcagcgaacgctcagttcaacagggaagagcttgacaaggagttcaaaaagaaatag

SEQ ID NO: 31069 - DNA, 1158 bp, Artificial Sequence
  Description of Artificial Sequence: Synthetic coding sequence
atgtctggctcctctggcaccccgtacttgggttcaaaaatttcactgatttcaaaagctcagatacggtacgaggggatactgtacaccatcgataccgataattctaccgtagcactcgcaaaggttaggtctttcggaaccgaggatcgccctacagaccggccagccccacctcgcgaagaaatctacgaatatataatctttcgcgggagcgatattaaagacattactgtttgtgaacctcccaaggcccagcataccctgccccaggaccccgctatcgtgcagagttcgctcggctcagcttctgctagccctttccagcctcacgttccctactctcccttcagggggatggcaccctacggccccttagccgcctcgtcgctgctgtcacagcagtatgcagcatcactgggactgggagctggtttcccttccattcccgtgggtaagtcacctatggtcgagcaggctgtccagaccgggtcagctgataacttaaatgctaagaaattgttgcccggcaaaggtactacaggaacccagttaaacgggcgtcaagcacagccaagttctaagactgcttcagacgtcgtgcagccagcagccgtgcaggcgcagggacaggtgaatgacgagaatcgaaggccacagagaagaagatccggcaaccgccggacccgtaatcgctctcgcggtcaaaaccggccaactaacgtgaaagaaaacaccatcaaatttgaaggtgacttcgacttcgagtccgctaatgcccagtttaaccgggaagagctcgacaaggaattcaagaagaagttgaactttaaagacgacaaggctgaaaaaggtgaagagaaagacttggccgtagtcacacagagcgcggaggctcctgccgaagaagacctgctgggacctaactgctactacgataagtcaaaaagtttcttcgataatatcagttctgagctgaagacttcctcgcgccgcacaacttgggccgaggagcgcaaacttaataccgagacttttggcgtgtccggtcggtttctcagggggcgaagctcccgaggcgggtttcggggcggcaggggaaatggcacaactagacgcaatccaacaagccaccgggcaggcacagggagagtgtag

SEQ ID NO: 31070 - DNA, 1428 bp, Artificial Sequence
  Description of Artificial Sequence: Synthetic coding sequence
atgccgcacagaaaaaaaaagcccttcatcgaaaagaaaaaggctgtctcttttcacctggttcaccgtagccagcgagatcctctagcagccgacgaatcagctcctcaaagagttctactgcccacccagaaaatagataacgaggagaggcgagccgaacaacggaagtatggagtctttttcgatgacgactatgactacctgcaacatttgaaagagcccagtggaccatccgagctcatcccctcatccacttttagcgctcacaatcggcgcgaggaaaaggaggaaactctcgtcataccctctaccggcatcaaattaccaagctcagtttttgccagcgagtttgaggaggacgtggggcttttgaataaagccgctccagtgtcaggcccacggctagactttgaccccgatattgtggcagctctggatgatgactttgactttgatgaccctgataacctgctggaggatgatttcattttgcaggccaataaagcaacgggcgaagaagagggcatggatatacagaagtctgaaaacgaggatgactcagagtgggaagacgtagatgacgagaaaggagacagcaacgatgactacgattccgccggactgctttctgacgaggattgcatgagcgtccctggcaaaacacacagggcgatcgctgatcacctcttttggtctgaagagaccaagtccaggtttacggaatactccatgaccagttcagttatgaggcggaacgaacagctgacattacacgatgagcggtttgagaaattctacgagcagtacgacgacgatgagatcggcgcactcgacaacgccgagctcgagggctcaatacaagtggacagcaatagactccaggaggtgctgaacgactattacaaggagaaggctgagaattgcgtcaagctcaatacattggagccattggaggaccaggatctcccaatgaacgagctagatgaatccgaggaggaagagatgattacagttgtcctggaggaggccaaagagaaatgggactgcgagtcaatttgcagtacctattccaatctgtataatcatcctcagctgattaagtaccagccaaagcccaaacagatccgtatcagcagcaagacgggtattccactgaacgtactacctaagaaaggtttaacagccaagcagacagaacgaattcagatgattaacggctcagatttgcctaaggtgagtacccagccaagatccaagaacgagagcaaggaggataaacgggctcgtaagcaggcaattaaggaggagaggaaggagagacgggtggaaaagaaggcgaacaagctggcctttaagctggaaaaacggaggcaggaaaaggaacttcttaacctgaagaaaaacgtcgagggattgaagctgtag

SEQ ID NO: 31071 - DNA, 714 bp, Artificial Sequence
  Description of Artificial Sequence: Synthetic coding sequence
atgaaaggcattttggtcgccggcattacagctgtactcgtggcagcggttgagagcctcagctgcgtgcaatgcaacagttgggagaagagctgcgtcaacagtatcgcctctgagtgtccatctcacgctaacacctcttgtatatcgagctcagcaagttcctctctggagaccccggtcaggttgtaccagaatatgttctgctctgctgagaattgctctgaggagactcacattactgcttttacggtccatgtgtctgccgaggagcactttcacttcgtgagccagtgctgccaggggaaagaatgttcgaacacctctgatgcactggatcctccacttaaaaacgtctcaagcaatgccgaatgtccagcctgttatgagtccaacggcacctcatgccatggcaaaccatggaaatgctacgaggaagagcagtgtgttttcctggttgcagagctcaaaaatgacatcgagtctaaaagcttagtgttaaagggttgcagtaatgtgagcaatgctacctgccagtttctttcgggagagaacaagaccctaggtggggtcatattcagaaagtttgagtgcgccaatgtgaactcactgaccccaacttctgccccaactaccagccacaacgtagggtctaaagctagcttgtatcttctggcacttgcgtcactgctgttgagggggttgctcccttag

SEQ ID NO: 31072 - DNA, 5622 bp, Artificial Sequence
  Description of Artificial Sequence: Synthetic coding sequence
atgagaaccggctgggctactccacgccggccagcaggcttgctcatgctgctcttttggtttttcgatctggcagagcccagcggcagggccgccaacgacccattcacaatcgtccacgggaatacggggaaatgtatcaagcccgtctacggatggatcgtggcggacgactgtgatgaaacggaagacaaactgtggaagtgggtgtctcaacacagactgttccacctgcattcgcagaagtgcttggggttagatataacgaagagcgtgaacgagcttaggatgttttcttgcgactcgagtgcgatgctatggtggaaatgcgagcatcatagcttatacggcgcagcgagatatcgtttggcactcaaggatggtcacggcacagcaattagcaacgctagcgatgtgtggaagaaaggcggtagcgaggaatcgctgtgtgatcagccctaccatgagatctatacaagagatggcaacagctacgggaggccttgtgaatttcctttcctcatcgacggaacctggcaccatgactgtattctggacgaagatcattccgggccttggtgtgccaccaccctgaattacgagtatgaccggaagtggggtatttgccttaagccagagaatggttgtgaggataattgggagaaaaacgagcagttcggtagttgttaccagttcaacacccaaactgccttgagttggaaggaagcgtacgtaagctgtcagaatcagggcgccgaccttctgtccattaactctgctgctgagctcacctacctgaaagaaaaggaaggaatcgcaaaaattttctggatcggcctcaaccagctctacagtgctaggggctgggagtggtccgatcacaaacctttgaacttcctgaactgggaccctgaccggcctagtgccccaactataggggggtcgtcatgtgccagaatggacgccgagagcggactctggcagagcttttcctgcgaggcccagctcccttacgtctgccgaaaaccgctaaacaacaccgtcgaactgacagacgtgtggacttattccgacacacgctgcgatgctggatggctgcccaacaatgggttttgttatctgctggtcaacgagagcaactcatgggacaaggctcatgctaaatgcaaagccttctccagtgacctcatcagcatacattcactggcggatgtagaagtggtagtgaccaaactgcataatgaggacattaaagaggaagtctggatcgggctgaaaaatattaatatacccacgctgttccagtggtccgatggcaccgaggtgactttaacctactgggatgagaatgaacccaatgtcccttacaacaagactcctaactgtgtgtcttaccttggtgaattggggcagtggaaggtgcagagctgtgaagagaagttaaagtatgtgtgtaaaaggaagggcgagaaactgaatgacgcatcatccgacaagatgtgcccccccgacgaagggtggaaacggcacggggaaacctgttacaagatctacgaggacgaagtacctttcggcactaactgcaatcttaccattacttcaaggttcgaacaggaatacctgaatgacctgatgaagaaatatgataagagcctgaggaaatatttctggacggggctgcgggatgtggattcctgcggggagtataactgggctaccgtgggtggacggcgccgggctgttactttctccaactggaacttcctcgagcctgcaagccctggtggctgcgtagcaatgtctacaggcaagtctgtaggcaaatgggaggtgaaagattgcagatccttcaaagcactcagtatatgcaagaaaatgtctgggcccctagggcccgaagaggcatccccaaaaccagatgacccatgtcctgaaggctggcagagtttccctgcctccttgagctgttacaaagtctttcacgctgaaaggattgtccggaagagaaactgggaggaggctgagcgtttctgccaagccttaggcgcccacttatcatctttcagccatgtggatgaaatcaaagaattcctgcacttcttaaccgaccagttcagtgggcagcactggttgtggatcggtctgaacaaacgctcccccgatctccagggttcctggcagtggtcagaccgcacccccgtttccactataatcatgcctaacgagtttcagcaagattatgatatcagagactgtgctgccgttaaagtattccataggccttggcgcaggggatggcacttttatgacgatcgggaatttatatacttaagacctttcgcttgcgacacaaagttggagtgggtgtgccagatcccaaagggccgaacacccaagacacccgattggtataacccggacagggccggtatccatggaccaccgcttattattgagggttccgagtattggttcgtggcagacctccacctgaactatgaggaggccgtgctatactgtgcaagcaaccactcctttttggcgacaattacttctttcgtgggacttaaggccataaaaaacaaaattgcaaatatctcgggagacggacagaaatggtggattcgcattagtgagtggcccatagacgatcactttacctactcccgctatccatggcacaggttccccgtcacattcggcgaagagtgtctgtatatgtccgcgaagacatggctcatcgaccttgggaaaccaaccgactgctccacaaagctgccgtttatctgcgagaaatacaatgtctcttccctcgagaaatacagccccgattctgctgcgaaagttcaatgttctgagcagtggattccgttccagaacaaatgttttctaaagattaagcccgtcagtctgacctttagtcaggccagcgatacgtgtcactcctacggaggcaccctgcctagtgtgctttcccagattgagcaggatttcattacgagcctactgccagatatggaagctacactctggatcgggcttaggtggaccgcctatgagaaaatcaacaaatggacagacaacagagagcttacctactccaatttccatccattactggtgagcggcaggctcaggatccctgagaattttttcgaggaagagagtcgctaccattgcgccttgatcctcaatctccagaagagtccctttaccggcacatggaatttcacctcatgttcggaacgtcattttgtttctttatgtcaaaagtacagcgaagtgaaatccagacagaccctccagaacgccagcgagacggtgaaatatctcaacaatctgtataagatcattcctaagacacttacatggcattccgcaaagcgagagtgcctcaagagtaatatgcagctggtgagcatcacggacccataccaacaggccttcctgtctgtgcaggcattgctgcataatagctctctttggataggcttgttctcccaagacgatgagctcaactttggctggagcgacggcaaacgcctgcatttcagcaggtgggctgagactaacgggcagctggaagactgcgtcgtcttggatacagacggattctggaagaccgtcgattgtaatgataatcagcctggggctatatgctactactctggcaacgagactgagaaagaggtgaagccagtagattccgtcaaatgcccatcaccagttctgaatacgccttggatcccctttcaaaactgctgttataatttcatcatcaccaaaaacaggcacatggccaccacgcaggatgaagtgcacaccaagtgtcaaaagctgaatccgaaaagccacatcctgtcaattagagacgaaaaggaaaataattttgttctcgaacagcttctttacttcaattacatggcttcgtgggttatgctgggcatcacctatcggaataaatctctgatgtggtttgataaaacgccattatcctatactcattggagagctgggcgcccaactattaaaaatgagaaattcctagccggactgagtacagacggattttgggatattcagacctttaaggttatcgaagaagcagtttatttccatcagcattcgattctggcctgcaagatcgagatggtcgattacaaggaggagtacaataccactctgccccagttcatgccttacgaggatggcatctactccgtgatccagaaaaaagtaacatggtacgaagctcttaacatgtgctcccagagcgggggccacctggctagtgttcacaaccagaacgggcaactgttcctggaggatatagtgaagcgagacggcttccctttgtgggtgggactgtcgagtcacgatggctccgagagtagtttcgagtggagcgacgggagtaccttcgactacatcccctggaagggtcagaccagtcctggcaattgtgtgcttttggacccaaagggcacttggaaacacgaaaagtgcaattcagtcaaagacggcgccatttgctacaagcctacaaaatcaaagaagctgtcacgactaacttattctagccggtgccccgccgccaaggagaacggatcaaggtggattcagtacaaggggcactgctataagtctgatcaggcactgcactctttctctgaagccaaaaagctgtgctcgaaacacgaccactctgccactatcgtgtcgatcaaagatgaggatgaaaacaaattcgtaagccgcttaatgcgcgagaataataacatcacaatgagggtgtggttgggactttcacaacattccgtggatcagagctggtcttggctggacgggagtgaggtgactttcgtgaagtgggaaaacaagtctaaaagcggtgtgggacgctgtagcatgcttatcgcgagtaatgaaacatggaaaaaggtggaatgcgaacacggatttgggcgagtggtctgcaaggtccccctggactgccccagctcaacatggattcagtttcaggacagttgctacattttcttgcaagaggccataaaagtggagtctatagaggacgtgcggaaccaatgtaccgatcatggtgccgatatgattagtattcacaacgaggaagagaacgcctttattctagataccctgaagaagcagtggaagggtcctgacgacattctcctcggaatgttttatgacactgacgacgcaagctttaagtggttcgataactccaacatgaccttcgacaagtggacagatcaggacgacgacgaagatcttgtggacacttgcgcctttctgcatattaaaacaggagagtggaaaaaaggcaattgcgaggtcagctctgtggagggcacattatgcaagacagctattccgtacaagagaaagtatctctctgataaccatattctcattagtgccctagtgatcgcctctactgtaatcttgaccgtacttggcgccatcatctggtttctgtataagaagcactccgatagccggttcaccaccgtatttagcaccgccccacagtcaccctacaacgaagactgtgtgctggtagtcggagaggagaacgaataccctgtgcagttcgactag

SEQ ID NO: 31073 - DNA, 5454 bp, Artificial Sequence
  Description of Artificial Sequence: Synthetic coding sequence
atgagaactggatgggctactcctaggaggccagctggactgctgatgttacttttctggttttttgacttggcagaacccagtggacgggctgcaaacgaccccttcaccatcgtacacggcaacacaggtaagtgcataaagcctgtgtacgggtggattgtggccgatgactgcgacgaaacagaagacaagctgtggaaatgggtaagccagcaccgtctcttccacctgcacagtcaaaaatgtcttggactggatatcacaaagtctgtgaatgagcttaggatgttctcttgcgacagtagcgcaatgttgtggtggaagtgcgagcatcattcgttatacggagccgcccggtatcggctggcgcttaaagacgggcacggtactgctatcagcaacgccagcgacgtctggaaaaagggcgggagtgaggaatctctgtgtgaccaaccgtatcacgaaatctacactagggacgggaacagttacgggcgtccttgcgagtttcctttcctgatcgacgggacctggcaccatgactgcatcctggacgaagaccatagcggaccatggtgcgctactacattaaattacgagtacgaccgaaagtggggcatctgcttgaaacctgagaatggctgcgaagataattgggaaaagaatgaacagtttgggtcgtgttaccagttcaacacacagactgcgttatcatggaaagaagcttatgtgtcttgccaaaaccagggcgctgacctcttgtccattaactccgcggcagaattaacatacttaaaggagaaggagggaatcgctaaaatcttctggatcggcttgaaccagctatactccgctagaggctgggaatggtctgaccataagccattaaactttctcaactgggatccggacagaccttccgccccaacaatcggtggcagttcttgcgccagaatggacgcagagtccggactgtggcagagcttcagttgtgaggcccagctcccttacgtgtgtaggaagcccctcaataatactgtggaacttaccgacgtgtggacttattccgacacaagatgtgatgcgggctggctgccaaataacggtttttgctacctgcttgtgaatgaaagcaatagttgggataaagcccatgcaaagtgcaaggcgttctcctccgatctgatcagcatccattctttagccgacgtggaggtagtagtgaccaaattgcataatgaggacatcaaagaggaagtgtggattgggctgaagaatatcaacatccccaccctcttccaatggtcagacgggacggaggtcacactcacctactgggacgaaaatgaaccaaacgtgccttacaataagaccccaaactgcgtgagctacctgggcgagcttgggcagtggaaggtccagagttgcgaagagaagctgaaatacgtgtgcaaacggaaaggagaaaaactcaatgacgctagctccgataaaatgtgccctcctgatgagggttggaaacgccatggagagacttgctataagatctacgaagacgaagtcccattcgggaccaattgtaatttgaccataacatcacgattcgagcaggagtacctaaatgatttgatgaagaaatacgacaagagcttgaggaaatacttctggacagggttaagggatgtagattcatgtggagaatataactgggccacagtcggtggtagacggcgcgctgtgacctttagcaattggaacttcctcgagccagcatctcctggtggatgtgtcgcaatgtctactggaaagtcagtgggcaaatgggaagttaaggattgtaggtccttcaaggccctgtccatctgcaagaaaatgagcggaccgcttgggccagaggaagccagcccgaagccagacgatccatgtcccgagggctggcagtcattccctgcctcacttagctgttacaaggtgtttcacgccgagcgcattgttagaaagagaaattgggaggaggcagaaaggttctgccaggccctgggagcccatctgagttccttctctcacgtggacgagataaaagagttcctccattttctgaccgaccaattctcaggtcagcattggttgtggattggattgaacaagaggagtcccgacctccagggcagctggcaatggagcgatcgtacgccggtctcgacaatcattatgcccaacgagttccaacaggactacgacatcagagattgcgccgcagtcaaggtgttccatcgcccatggagacggggctggcatttttacgatgatcgagaatttatctatctcagaccattcgcctgtgataccaagctggaatgggtttgtcagatccctaaagggaggacacccaaaactcccgattggtacaatcctgacagggcaggtattcatggtcctcccctgattattgaaggatctgagtattggtttgtagcagacctccacctaaactatgaggaggcggtgctgtactgcgccagcaaccattcctttctcgccacgatcacctctttcgtggggttgaaagctatcaagaacaaaattgcaaatattagtggagacggacagaaatggtggatccggatctcagaatggcccatcgatgatcacttcacttactcccggtacccttggcatagattccccgtcaccttcggcgaagaatgcttatatatgagtgccaagacctggctgatagacttgggcaagcccaccgactgttccactaagctgcctttcatttgcgagaagtacaatgtgagctcattggagaaatactcgccagattccgcagccaaagtgcaatgtagcgaacaatggattccatttcagaacaagtgcttcttgaaaattaagcccgtgtctctcacgttctcacaggcctcggacacatgtcacagctacgggggaacactgccttcagtcctgagtcagattgaacaggatttcatcacatctctactgccagatatggaggccaccctatggatcggactgcgttggactgcctacgagaaaataaacaaatggactgataacagagaactgacctatagcaattttcatcccctgctggtctcaggtagacttaggatccccgagaatttcttcgaagaagagagcaggtaccactgtgccctgattctgaacctgcagaaaagtccctttaccggaacctggaatttcacatcatgtagcgagcgacatttcgttagcctgtgccagaagtatagcgaggtgaagtctaggcagacactgcagaatgcgtctgagacggtcaaatacctgaacaacttgtataagatcatcccgaaaaccttgacctggcactccgcaaagagggaatgtctgaagtctaacatgcagctcgtatccatcacggacccttaccagcaggcatttttatccgtccaggccctgctgcacaatagtagcctgtggattgggctgttttcccaggacgacgagctgaactttgggtggtccgacggaaagcggcttcacttttcaaggtgggccgagactaatgggcagctcgaggattgcgttgtgctcgatacagacgggttttggaagaccgtcgattgtaatgataaccagcccggcgccatctgttactatagtggcaacgagaccgaaaaagaggtgaaacctgtggatagcgtcaaatgcccctcacctgtgcttaataccccctggatcccctttcaaaactgctgctataacttcatcatcacaaagaacagacatatggccacaacacaagatgaggtgcatacaaagtgccagaagttgaatccaaaatcccacatcttatctatccgagacgaaaaggagaataactttgtgctggaacagctgctttactttaactacatggctagttgggtgatgctgggcataacttaccgcaataaaagcctgatgtggttcgacaagacccctttaagctacacccattggcgtgcgggacgaccaacaattaaaaacgagaaatttctggccggcctatcaacagacggcttctgggacattcagaccttcaaggtcattgaagaggccgtctattttcaccagcattcaattctggcctgcaaaatcgagatggtggactacaaggaagaatataataccacactgccacaatttatgccctacgaggacggcatttatagcgtcatacagaagaaggtgacttggtacgaagccttaaacatgtgcagccagagcggaggccatctggcatctgttcataaccagaatggccaactgtttctagaggacatcgtgaagcgcgacggctttcccttatgggttggtctcagcagtcacgacggctcagaatccagctttgagtggtctgacggctctacttttgattacataccatggaagggtcagactagtcccgggaattgcgtccttttggacccaaaagggacatggaaacacgaaaaatgtaacagcgttaaagacggcgctatctgctataaaccaacaaagtcaaaaaagttaagtaggctgacatacagtagccggtgccccgccgccaaggagaacggctcacgctggatacagtacaaaggacattgctacaagtcggaccaagctttgcactctttctccgaggccaagaagctgtgctcaaaacatgatcacagcgccacgattgtgagcatcaaggatgaggatgagaacaagttcgtttctcgtctcatgagagagaataacaatatcacaatgagggtatggctgggattgtctcagcattccgtggactgcccatcatccacttggatccagttccaggactcctgctatattttcctgcaggaggccatcaaggtggagtccattgaggatgtcagaaaccagtgcacagaccacggagctgacatgatttcaatacacaacgaggaagagaatgccttcattctggacaccttaaaaaaacagtggaagggccctgacgatatactgctgggtatgttttacgacaccgatgacgcctctttcaagtggtttgacaattccaatatgactttcgacaaatggactgatcaggatgatgacgaggatcttgtggatacctgtgcattccttcatattaaaactggggaatggaaaaaaggtaattgcgaggtttcttctgtagagggcacattatgcaagacagcaattccttacaaaagaaagtatctctcagataatcatatcctcatcagcgcgttagttatcgctagcaccgttattctcaccgttctaggcgctatcatttggttcctttataagaaacattccgattctagattcacaaccgtgttcagtaccgctccccaatctccctataacgaagactgcgttttggtcgtgggagaagagaatgaatatcccgtgcagtttgactag

SEQ ID NO: 31074 - DNA, 498 bp, Artificial Sequence
  Description of Artificial Sequence: Synthetic coding sequence
atggcactcctggctctgctcctagtggtcgctctgccacgggtctggactgatgctaatctcaccgcaaggcagcgagaccctgaagacagtcaacggacggatgagggtgacaatcgcgtgtggtgtcacgtttgcgagagggaaaacacctttgagtgtcagaatcctaggcgctgcaaatggacagaaccctactgtgtgattgccgccgtgaagattttcccacggtttttcatggtcgctaaacaatgctctgccggatgcgccgcaatggagcgtcccaaaccggaagagaagagattcttactggaagaaccaatgcccttcttttatcttaaatgctgcaagatcagatattgtaatctggaaggcccgccaatcaatagctccgtattcaaggaatacgctggaagtatgggcgaaagttgtggaggactctggctggctatcctgctgctgctcgcttctattgctgctggtctctcgctttcgtag

SEQ ID NO: 31075 - DNA, 639 bp, Artificial Sequence
  Description of Artificial Sequence: Synthetic coding sequence
gacttcgggtactgtccacgggtatattgcgagaaccagcccatgcttccgataggtgtgttggttatggtgggcttcacggttggcaaagtccctgtgcctgacattcgaacttgtcatttttgtctcgttgaggatccctcagtgggttgcatctctggatctgaaaaatgtaccatatcgtccagttctttgtgtatggttattacaatctactatgatgtgaaggtccgatttatcgtcaggggatgcggccagtacatctcttataggtgtcaggaaaaacgaaacacctatttcgccgaatactggtatcaagctcagtgttgccagtatgattactgcaacagctggtcttcaccccagcttcaaagcagcctccccgagcctcacgatcgtccactggctctccccctgtcagatagtcagatccagtggttctatcaggcacttaacctgtcactcccactgcccaacttccacgcagggacagagcctgatggtcttgaccctatggttaccctttcgctaaacctggggctttccttcgccgaactgtgccgcatgtacctctttctaaattcctccggcctgctggtgctcccccaggctggtctgctcaccccacacccctcatag

SEQ ID NO: 31076 - DNA, 639 bp, Artificial Sequence
  Description of Artificial Sequence: Synthetic coding sequence
gattttgggtattgtcctagagtgtactgtgagaaccagcccatgctgcccattggcgtgcttgtgatggtggggtttaccgtgggcaaggtgccggtccccgacatccgtacctgtcatttttgtcttgtggaggacccaagcgtgggctgcatttctggatcggagaagtgcaccatctcgagctcctcactctgtatggtgataactatttactacgacgtgaaagttagatttatcgtaagaggctgtgggcagtacatctcatacagatgtcaagagaaacggaacacctattttgcggagtactggtatcaagcccagtgttgtcaatacgactattgcaacagctggagctcaccacagctgcagtctagtctccccgagcctcatgaccggcctctcgcacttcctctgagcgatagccagattcagtggttttatcaagctctcaacctctcactccctcttcctaatttccacgcaggcactgagccagatggcctcgaccctatggtgaccctgtctctgaatctcggtctctctttcgccgagctacgacgcatgtacttattcctgaacagcagcggcttgctggttctaccgcaggctggtttacttactccacatccctcctag

SEQ ID NO: 31077 - DNA, 687 bp, Artificial Sequence
  Description of Artificial Sequence: Synthetic coding sequence
atgagtagtagtgaagaagtgtcttggattagctggttttgtggacttcggggtaacgagtttttttgtgaggtggacgaggattacatccaagataaattcaatctgacggggttgaatgaacaggtgccccattaccgccaagccttagatatgattcttgatctggaacctgacgaggagttggaggataatcccaaccaatccgaccttatcgagcaggctgcggagatgctttacggactgatccatgctagatatatcctcacaaatagaggtatcgcccagatgctggagaaatatcagcaaggcgacttcggttactgtcctcgagtgtactgtgaaaatcagcctatgctgcctattggactaagcgacattcccggggaggctatggtgaaactgtattgtccaaagtgtatggacgtctatacgccgaaaagctccagacaccatcatactgacggagcatacttcggaaccggctttcctcacatgctctttatggtccacccagaatatcgccccaaaaggccagccaaccagttcgtcccatctagctgttcgcgacaccccgatgtcccactgcttccaagacgccgccccttctgtaggatgcattttaggctgcgcgaagtatatcaccagcagctcattccagtccacggtgaccaccatttactgtag

SEQ ID NO: 31078 - DNA, 639 bp, Artificial Sequence
  Description of Artificial Sequence: Synthetic coding sequence
gactttgggtattgcccccgagtgtattgcgagaaccaacccatgctgcccatcggggttctggtaatggtggggttcacggtggggaaggtcccggtgccagatataagaacctgccacttctgtctcgtggaggacccaagcgtgggctgcatcagtggcagcgaaaaatgcacgatttcgtcctcttctttatgcatggtgataactatatattacgatgtgaaagttaggtttattgtgcggggatgcggccagtatattagctacagatgtcaagagaagcgcaatacgtactttgccgagtactggtatcaggctcaatgctgccaatacgattattgcaatagctggagttccccccagcttcaatcctcccttcccgagccacacgaccgccccctagcgctgcctctgagcgacagccagatccagtggttctaccaggctctgaacttaagcctgccactgccgaactttcacgccggaacagagccggacggcctcgatcccatggtgacactgagtctaaacctcggtctgtcatttgcagaactgagaagaatgtatctctttctgaactctagcgggctcctagtccttccccaagctggactgttgacgccccacccctcatag

SEQ ID NO: 31079 - DNA, 639 bp, Artificial Sequence
  Description of Artificial Sequence: Synthetic coding sequence
gactttggctattgtcctagggtttactgcgagaatcagcctatgctacctattggggtgctggtgatggtgggcttcactgtcgggaaagtcccagtacccgacattcgcacatgccatttctgtctcgtggaagatccatccgttggatgtattagcggttccgagaaatgcactatctctagtagtagtttgtgcatggtcattacgatctactatgacgtgaaggtgcgcttcatcgtgagagggtgcggacagtacatttcttatcgctgtcaagaaaagcggaatacatacttcgctgaatactggtatcaggcgcagtgctgtcagtacgattactgcaacagttggagcagcccgcaacttcagagctccctgcccgagcctcacgatcggccgttggctctacctctttctgattcccagatacagtggttctatcaggcactcaacctctctctgccactgcctaactttcacgccggcacggagcccgacgggttggatcccatggtgactctctcattaaacttggggctcagttttgcagagttgtgtagaatgtacctcttcctcaactcaagcggacttctagtgctgccacaggcaggcctgctgactcctcatccctcatag

SEQ ID NO: 31080 - DNA, 687 bp, Artificial Sequence
  Description of Artificial Sequence: Synthetic coding sequence
atgagttcctccgaggaagtgagctggataagttggttctgtgggttgaggggcaatgagtttttttgcgaagtcgatgaggactatattcaagataaattcaacctgacggggcttaacgagcaggtaccacactaccgacaggctctcgatatgattctcgatctggaacctgacgaggagttagaggataacccaaaccagtccgacctgatagaacaagctgcagaaatgttgtacggcttgatacatgcaaggtacattctgactaatcgaggcattgctcagatgctggaaaagtatcagcaaggggacttcggatactgccccagagtgtactgtgaaaatcagcctatgctgccaattgggctaagtgacatcccaggagaggctatggttaaactgtattgccctaaatgtatggacgtgtacaccccaaaatccagtcgccatcaccacactgatggtgcgtatttcgggactggcttcccccacatgttgttcatggtgcaccccgagtaccggcccaaaagacccgcgaaccagtttgttccctcatcctgcagtaggcatccagacgtgcccctcctgcctcggcgccggccattttgtcgtatgcacttcagactgagagaggtgtatcatcaacaacttatacccgtgcatggagatcaccacttgctctag

SEQ ID NO: 31081 - DNA, 606 bp, Artificial Sequence
  Description of Artificial Sequence: Synthetic coding sequence
atgaaggtccacatgctggtgggcgtgctggtcatggttggcttcaccgttggcaaagtcccagtccctgatatccggacatgccacttttgcctcgtggaggatccttcggtgggctgcatttctgggtccgaaaagtgcacaatttcaagttcttcgctttgcatggtgattactatttactacgatgttaaggtgcgctttattgtacgaggttgtgggcagtatatttcctaccgttgccaggaaaaaagaaacacctacttcgcagaatattggtatcaggctcagtgttgtcagtacgattattgcaatagctggagttcacctcagcttcaatcctctctgccagagccccacgaccggcctttagcactgcccctctccgatagccaaatccaatggttctatcaggccctgaatctatctctgcctttgccaaacttccatgcgggcacagagccagacggattggaccccatggtgactctatccctaaatcttgggctttcattcgcagagctgtgcaggatgtacctttttctaaacagcagcggactcctggtgctacctcaggccggcctcctgactccacatccttcatag

SEQ ID NO: 31082 - DNA, 606 bp, Artificial Sequence
  Description of Artificial Sequence: Synthetic coding sequence
atgaaggtgcatatgcttgtcggagtattagtgatggtgggttttactgtcggaaaagtgccagttcctgacattaggacctgtcatttttgtcttgtggaggacccgagtgtgggatgtatatccgggagcgagaaatgtactatttctagcagctccttgtgcatggtgatcactatctattacgatgtcaaggtgaggttcatagtacgtggctgtggtcagtatatatcctaccgctgccaagagaaaaggaacacctatttcgcagaatattggtaccaagctcaatgttgccaatatgactattgtaattcctggtcgagcccccagttgcagagttctctgccagaaccacatgacagaccacttgcgctgcccctttcagacagccagatccagtggttttaccaggcgctgaacctgagtctgcccctgcccaattttcatgctggaaccgagcccgacggcctcgacccaatggttaccctgtcactgaacctggggctaagctttgcggagctctgccgcatgtacctcttcctgaactcatccggtctcctggttttaccccaggcagggctcttgaccccgcatccaagctag

SEQ ID NO: 31083 - DNA, 303 bp, Artificial Sequence
  Description of Artificial Sequence: Synthetic coding sequence
atggggacatctagtattttcctatgcgtcttattcctgtgcggtgctctcggtctgaccatgtctcctgctcgcggtagactgcgctgttacatctgtggattcactaagccatgccatcccgtgcctactgagtgcagagacgatgaagcatgtgggatttcgatcggcacatcaggacgcacgctcgtgcagtggcctttttctcgacgattgcccaccagtatccaccctgcttttcctgtggctcccgccagtgcctgcctctttcatccaacggaccagagcgagatcactgagtag

SEQ ID NO: 31084 - DNA, 378 bp, Artificial Sequence
  Description of Artificial Sequence: Synthetic coding sequence
atggggacgtccagcatcttcttgtgcgtgctctttctttgcggcgccctgggcttaacaatgtctccagccaggggaaggcttcgatgctatatctgtggattcactaaaccctgtcacccagtgcccacagaatgcagagacgatgaggcctgcggcatttcaatcggtacatctggaaaaagttgtttgagccgcgcacagtgtccccttccggggtacgcaacgtattggttgcactcttataccctgtggcaccactgttgtgagcaggatctctgcaacattgccgcgagcccacaacagctgacatctcttctcgccagcctccccctgtttgtggcgtcatttgctggcagggggcacctgttgcattag

SEQ ID NO: 31085 - DNA, 303 bp, Artificial Sequence
  Description of Artificial Sequence: Synthetic coding sequence
atgggcacatcgtccatttttctgtgtgtactctttctctgcggtgcactgggcctaaccatgagtccagcccgtggaagactgcgttgttacatttgtggctttaccaagccttgccatccagttccaacagagtgtcgggatgatgaggcatgcgggattagcatagggacctcaggccgcaccctagtacagtggccctttagccgtaggctgcctacgagcattcacccagcatttccggtggctcctgccagtgcctgtctcttccaccctactgaccaatccgagattacggagtag

SEQ ID NO: 31086 - DNA, 201 bp, Artificial Sequence
  Description of Artificial Sequence: Synthetic coding sequence
atgggcacctcttccatctttctctgtgtcctgtttttatgtggtgcactcgggctgacgatgagtcctgctcgcggacgattgagatgctacatttgtgggttcacaaagccttgtcatcccgttcctactgagtgtcgcgatgacgaagcttgcgggattagcatcggaacatctgaccagtccgagattactgagtag

SEQ ID NO: 31087 - DNA, 201 bp, Artificial Sequence
  Description of Artificial Sequence: Synthetic coding sequence
atgggtacttcttcaatttttttgtgcgtactgttcctctgcggcgcgctgggcctgaccatgagtccagcgcggggtcgactgagatgctatatttgcggattcactaagccttgtcacccggttccaacagaatgccgggatgacgaggcctgtggcatcagcatcggtactagcgaccagtccgaaatcaccgaatag

SEQ ID NO: 31088 - DNA, 201 bp, Artificial Sequence
  Description of Artificial Sequence: Synthetic coding sequence
atgggaacatccagtatctttctatgtgtgttgttcctttgtggagctctcggtctgacgatgagtcccgctcggggacggctgcgctgttacatttgtgggtttactaaaccctgtcaccctgtgccaacggaatgtcgggatgatgaggcttgtggcatatccattggaacctctgatcaatctgagattacagagtag

SEQ ID NO: 31089 - DNA, 303 bp, Artificial Sequence
  Description of Artificial Sequence: Synthetic coding sequence
atggggacatcttcgatctttctctgcgtgctcttcttgtgtggagcgctcgggcttacaatgagccccgctcgtggtcgtctgcgctgctatatttgcggattcactaagccctgtcacccagtgcccaccgagtgccgcgatgacgaagcttgtgggattagtatcggaacatctggtcgaacactggtgcagtggcctttttcccgcaggttgcccacctctatccatccagcatttcccgtggctcctgcatccgcctgcctgttccaccccacagatcagtcagaaatcacggagtag

SEQ ID NO: 31090 - DNA, 303 bp, Artificial Sequence
  Description of Artificial Sequence: Synthetic coding sequence
atggggacttcatccattttcctctgcgttttgttcctgtgcggtgctctgggtttgacgatgagccctgcccggggaagactgcggtgttacatatgcggtttcactaagccatgtcacccagtccctactgagtgccgtgatgatgaggcttgcggtatctccataggaacttcaggcagaactctggtccagtggccattttcccgccggctaccaacttccatccaccccgcattccctgtggcaccagcctcggcctgtctgttccatccaacagaccagagcgaaattacagagtag

SEQ ID NO: 31091 - DNA, 201 bp, Artificial Sequence
  Description of Artificial Sequence: Synthetic coding sequence
atgggcacttcttctattttcctgtgcgtcctgttcctgtgtggtgctttgggattaaccatgtctccagcgagagggaggttgcgctgctatatttgtggcttcaccaaaccctgccaccccgtgccaaccgaatgtcgcgatgatgaggcctgtggtattagcatcggcacgagcgaccagtccgaaatcactgagtag

SEQ ID NO: 31092 - DNA, 201 bp, Artificial Sequence
  Description of Artificial Sequence: Synthetic coding sequence
atgggaacttcaagtatcttcctttgcgtgctcttcctgtgcggtgccctgggcctgaccatgtccccagccaggggcagactccgttgttacatttgcggcttcactaagccatgtcacccggtccccaccgaatgccgtgatgatgaggcctgtggtatctccattggcacctccgatcaaagtgagattacggaatag

SEQ ID NO: 31093 - DNA, 303 bp, Artificial Sequence
  Description of Artificial Sequence: Synthetic coding sequence
atgggtacatcatcaatctttctgtgtgtgctgtttctctgtggtgcactgggacttaccatgagccctgcccggggaaggctacggtgttatatctgcggcttcaccaagccttgtcaccctgtaccgacggagtgtagagatgacgaggcttgcgggatcagtatagggactagtggcaggaccctggtccaatggccattttctcggcggttgcccactagcattcaccctgcctttccggtggctcccgcatctgcatgtctgttccacccgacggatcagtccgaaataacggaatag

SEQ ID NO: 31094 - DNA, 201 bp, Artificial Sequence
  Description of Artificial Sequence: Synthetic coding sequence
atgggaacctcaagcatcttcctgtgtgtattattcctatgtggagccctcggcctcacaatgtctcctgcgcgcgggagactgagatgttacatctgtggattcaccaaaccctgtcaccctgttccaactgagtgccgggatgacgaagcctgtggcatttctatcgggacttcggatcagtctgagatcaccgagtag

SEQ ID NO: 31095 - DNA, 303 bp, Artificial Sequence
  Description of Artificial Sequence: Synthetic coding sequence
atggggacatccagcatctttctatgcgtgctgttcctctgcggggcactcggacttaccatgtctcctgcaagaggaagacttaggtgttacatatgtgggttcactaaaccttgtcatccagtgcctacggagtgtagggatgacgaagcctgtgggatctccattggaaccagtggcaggaccctggtgcaatggccttttagtcgccgcctgcccaccagtattcaccccgcttttcccgtggcacctgcaagcgcctgtttgttccacccaactgaccagtccgaaatcactgagtag

SEQ ID NO: 31096 - DNA, 387 bp, Artificial Sequence
  Description of Artificial Sequence: Synthetic coding sequence
atgggaacgtcaagtatctttctatgtgtactgttcctatgcggggcactgggactgactatgtcccccgcccgcggaaggttgcgctgttatatttgtgggtttactaaaccatgccaccccgtgcccaccgagtgtagagatgatgaggcatgtggcatatccatcggaaccagcgttaaaaaactgcccttaaaggggcccgtgccttcagcacggttgtgtcacctcctcgctgcattgctgcacagcgtggcaccactgctgagagccggacctgttcaacacagccggtttccaacagccgcccaccagccccctagactgcccgcacccctctgcggacaattgaggtgggagcgtacgccgccgcccctcgcgtcatag

SEQ ID NO: 31097 - DNA, 378 bp, Artificial Sequence
  Description of Artificial Sequence: Synthetic coding sequence
atgggaactagttcaatatttttgtgtgttctgttcctgtgcggggcactgggtctgaccatgtcccctgcaagaggacgattgcggtgctacatttgtgggtttaccaagccttgccaccccgtgcctaccgagtgccgggatgacgaggcttgtggtatttccatcggcacttctggcaaaagctgtctgtcccgagctcagtgtcccttaccgggctatgcgacatattggcttcattcttatacactatggcatcattgctgtgagcaggacttgtgcaatatcgccgcctcgcctcagcaactgacctccctcttagcttctttgcctctgttcgtagcttcgtttgcagggagaggccacctgctgcattag

SEQ ID NO: 31098 - DNA, 378 bp, Artificial Sequence
  Description of Artificial Sequence: Synthetic coding sequence
atgggcacgtcttcgatatttctttgcgttctgttcctatgtggggcccttggtctcactatgtctcccgcaagagggcgactgcgttgttatatctgcggcttcactaagccgtgccatcctgtccctaccgagtgccgggacgacgaggcatgcggtatatcaattggtactagcggtaaaagctgcctcagtcgggcccaatgtccgctaccgggctacgcgacatattggctgcatagttacactctctggcatcactgctgtgagcaggatttgtgcaacattgccgccagcccccagcaactaacaagtctgctcgcatcgctgcccctcttcgtcgcctcttttgctggtagaggccacctgttacactag

SEQ ID NO: 31099 - DNA, 378 bp, Artificial Sequence
  Description of Artificial Sequence: Synthetic coding sequence
atgggtacctcctccatctttctttgtgttttgttcttgtgtggtgccttggggcttacgatgtcaccagccagaggtcgactgcggtgttatatctgcgggttcacgaaaccctgccacccagttcctactgagtgccgcgacgatgaagcctgcggcatctcgattggcacttcaggcaagtcatgcctgtctagagcccaatgccccctgcctgggtacgcaacctattggcttcatagttacaccctgtggcaccattgctgtgaacaggacctgtgcaatatcgccgctagtccccagcaacttaccagcctgttagcctctctgccgctgttcgtggccagcttcgccggacggggacaccttcttcactag

SEQ ID NO: 31100 - DNA, 378 bp, Artificial Sequence
  Description of Artificial Sequence: Synthetic coding sequence
atgggaacgtcttctatttttttatgtgtgctgttcctctgcggggcactaggcctgaccatgtctcctgcaaggggcaggctgcgttgttacatatgcggattcacaaaaccctgccaccccgttccaactgagtgcagggacgacgaggcctgcgggatctcaatcggcacttcaggcaagtcctgtctgtctagagctcagtgcccactacccggctacgcaacatattggttacacagctataccctgtggcaccattgttgcgaacaggatctttgtaacattgcagcttccccccagcagctgacgagtcttttggccagcctgcccctcttcgtagccagctttgccggcagaggccacctgttacattag

SEQ ID NO: 31101 - DNA, 378 bp, Artificial Sequence
  Description of Artificial Sequence: Synthetic coding sequence
atgggtaccagtagtattttcctgtgtgtgctgttcctgtgtggggcgttaggcctcacaatgtcccctgctcgaggtaggctgagatgctatatttgcggcttcaccaagccttgccaccctgtccctactgagtgtcgcgacgatgaagcctgcgggataagtataggaacctccgggaagagttgtttgtcgagagcacaatgccccttgcctggatacgccacttactggctgcactcttatacactgtggcatcactgctgtgagcaggacctgtgcaatatcgcggcttccccccagcagttaacctctctcctggcaagcctacctctgttcgttgccagcttcgcaggaagagggcacttactgcactag

SEQ ID NO: 31102 - DNA, 378 bp, Artificial Sequence
  Description of Artificial Sequence: Synthetic coding sequence
atgggaacttccagtatcttcctttgcgtgctgttcctgtgcggagctttgggcctgaccatgtctcctgcacgaggccgcttacgatgttacatttgcggtttcaccaagccttgccaccctgtacctactgagtgtagggacgacgaagcctgcggaatctctattggcacctcgggaaagtcttgtttgtccagagcccagtgcccattgccagggtacgccacttactggcttcattcgtatactctgtggcatcattgctgtgagcaggacctttgtaacattgccgcgagtccacagcaactcacctcattactggccagcctacccctgttcgtcgccagcttcgccggaagagggcacctgctgcactag

SEQ ID NO: 31103 - DNA, 894 bp, Artificial Sequence
  Description of Artificial Sequence: Synthetic coding sequence
atggccgtgctgtttctgctcctgttcttgtgtggtactccccaggcggctgacaatatgcaggccatatatgtagctttgggtgaagcagtggaattgccctgcccatctccacctacacttcatggcgacgagcatttatcctggttctgctccccggccgcaggatcgtttacaacgttagtagcacaggtacaggtgggccgccccgctcctgaccctggtaagcctgggcgagagtcacggctgaggctacttggaaactactccttatggctcgaggggagcaaggaggaagacgctggcaggtactggtgtacggtgttgggacagcaccacaactatcagaattggagggtctatgatgtattggtcctgaagggttctcagctgtccgctcgggccgcggatgggtcaccttgcaatgtattgctgtgtagcgtcgtgccttcaagacgcatggactcagtgacctggcaggagggcaaaggacccgtgagaggcagagtgcaaagcttctggggctctgaagcggccctgctgctggtctgcccaggagaaggactgtcggaacccagatccagaagacccaggattattcgttgccttatgacccacaataaaggtgtgtcctttagtttggctgccagcatagatgcctcccctgccctttgcgccccatctacgggctgggacatgccttggatcctaatgctgttgctcaccatgggccagggcgtcgtgattttggcccttagcattgtcttgtggcgacaacgagtgcgcggcgcacccggccgggatgccagtattcctcagttcaagcctgaaatacaagtttacgagaacatacacttggcacggttggggccccctgcacataaaccacgatag

SEQ ID NO: 31104 - DNA, 894 bp, Artificial Sequence
  Description of Artificial Sequence: Synthetic coding sequence
atggcagtgctgtttttgctgctgtttctctgcggcacaccgcaggcagcagacaacatgcaggctatctatgtggccttgggcgaagcggtggagctgccctgccccagtcctccaacactacacggagacgagcatttgtcatggttttgctcgcctgccgcgggcagcttcacaacactggtggcacaggtgcaggtggggcgccccgcgcccgaccctggcaaaccaggaagggagtctcggctgcgcctgcttggaaactatagtctgtggctggagggaagcaaagaggaggacgcgggaagatattggtgtactgtactaggccagcaccataattaccaaaactggagagtgtatgacgtactcgtcttaaagggctcacagctctccgctagagccgctgacgggagcccttgtaacgtgctgctgtgctctgttgtccctagccggcggatggacagtgtgacatggcaggagggcaaggggcctgtcagaggccgtgtgcaatccttttggggatcagaggccgcactgctgctggtctgccccggggaggggttaagtgaacccagaagtaggaggcctcggatcataagatgtttaatgacgcacaacaagggcgtgtcattcagtctcgctgcttctatcgatgcgagtccagctctgtgcgccccctccaccggatgggacatgccttggatcttgatgttactgttgacaatgggacaaggtgtggttattctggctctctcgatcgtactgtggcggcaacgggttaggggcgctcccggaagagatgcgagcattccgcagttcaagccggagatccaagtctatgagaatattcatttagctcggctggggcctcctgcccacaagcccagatag

SEQ ID NO: 31105 - DNA, 1149 bp, Artificial Sequence
  Description of Artificial Sequence: Synthetic coding sequence
atggcagtgttgtttctgctcttgttcctctgcggcacccctcaggcagccgataacatgcaggcaatttacgtggcactcggcgaagccgtggagctgccttgtccttcccctcccactttgcacggtgatgaacacctgagttggttctgtagtcccgccgccggctccttcacgactctcgtggcccaggttcaggtgggccggccagcccctgatcctggaaaacccggtcgtgaaagcagactgcgcctgctcggcaattatagtctgtggttggaaggctccaaagaggaagatgcgggtcggtactggtgtacagtcctgggccaacatcacaactaccaaaactggcgggtctacgatgtgctcgttctgaagggatcccagctttccgctagagctgcagacggaagcccttgtaatgttcttctttgctcagtcgttcccagtcgccgtatggatagtgttacatggcaggagggcaagggccctgtgagaggaagagtccagtcattctgggggtctgaagcggccctgctcctggtctgcccaggagaggggctatctgaaccccggtctcgacgtccccggattatccgatgtctaatgacacacaacaaaggtgtgagcttcagcttggcagcgagcatagatgcttctcccgccttatgcgccccctcgaccgggtgggacatgccctggatccttatgctgcttttaacgatgggccagggagtcgtcattctcgccctcagcattgtcctgtggaggcagcgggtccggggggcccctggaagaggaaatcgaatgaggtgctacaactgcggtggtagccccagctcaacttgtaaagaagcagtgacgacgtgcggtgagggccggcctcagccaggcctcgagcagattaaattacctggtaatccccctgtgactctaatacaccagcacccagcctgcgtcgctgcgcaccactgtaaccaagttgagacagagtctgtgggggacgtgacttatcctgcgcaccgtgattgctacctcggcgacctgtgcaatagcgctgtcgcctctcatgtggcaccagccggcatcctggctgctgccgccactgccctcacctgcttgctccccggcctatggtcgggatag

SEQ ID NO: 31106 - DNA, 237 bp, Artificial Sequence
  Description of Artificial Sequence: Synthetic coding sequence
atggcccccttgccaggcgctgagctggtgcggagacccctgcaactgtatcgttacctcctgagatgctgccagcagctgcccaccaaaggcattcaacagcattataaacacgcggttcgtcaatcctttcgcgtccattctgacgaagacaatccggagagaattcagcagatcattaagagagccatcgaggacgcagactggatcatgaataaatacaagaaacagaactag

SEQ ID NO: 31107 - DNA, 1572 bp, Artificial Sequence
  Description of Artificial Sequence: Synthetic coding sequence
atggaaactatgaagtccaaggcaaactgcgcccaaaaccccaattgtaacattatgatcttccacccaacgaaagaggagtttaatgacttcgacaagtacatcgcatacatggaatcccagggagcccatagggccggcctggctaaaatcatcccacccaaagagtggaaggcccgggagacatatgacaacatcagcgaaatcctcatagcaacaccgttacaacaagtcgcctctggtagggccggcgtgttcacccaatatcataagaagaaaaaggcaatgactgtcggcgagtatcgccacctggcgaattcaaagaagtaccagacgcccccccaccagaacttcgaagacctcgaacgtaaatattggaaaaatcgtatctataattctcctatttacggggccgacatttccggatctttatttgacgagaacacgaaacagtggaaccttgggcacctgggtactatccaagatcttctagaaaaagagtgtggtgtggtgattgaaggggtcaatactccctatctttatttcggaatgtggaaaacaacctttgcctggcacaccgaggatatggacctgtattcaataaactacttgcatctgggggagccaaaaacatggtacgtcgtgccacctgagcacggccagaggcttgagcggttggctagagagctctttcccgggagtagccgcgggtgtggagccttcctgagacataaagtagctttgatttccccgactgtacttaaagagaacggtatcccgtttaatcgaatcacccaggaggccggagagtttatggtgacattcccgtatgggtatcatgctgggtttaaccacggatttaactgcgccgaggcaattaacttcgctacaccgcgctggattgattacggaaaaatggccagccaatgcagctgcggagaagctcgtgtcactttttccatggatgccttcgtgcgaatccttcagcccgagcgctacgacttatggaagcgaggacaggaccgagccgtggttgaccacatggaaccaagggttccagcgagccaggaattgagcactcaaaaagaggttcagcttcctagaagagctgccttggggctgaggcaactgccttcccattgggctcgtcactctccctggcccatggcggctaggtcaggtacgagatgtcacactctggtatgctcgagcctaccacggaggtcggccgtcagtggtactgccacccagcctagggctgcagccgtccactcttccaagaaaccatccagtacaccaagttctacccccggtccctccgcacagataatacatccatccaacgggagaagggggcgcgggcgcccgccgcagaagctccgcgctcaggagctcactcttcaaacccccgccaagaggccactgctcgccgggaccacatgtaccgcatcaggtcctgagcctgagcccctacccgaggatggcgccctgatggacaaaccagtgcccctcagccccgggcttcaacacccagttaaggcgtctggctgtagctgggctcccgtgccatag

SEQ ID NO: 31108 - DNA, 780 bp, Artificial Sequence
  Description of Artificial Sequence: Synthetic coding sequence
atgaagcattccaaaaaaacctatgactccttccaggatgagcttgaagattatattaaggtgcagaaagcccgaggactggaaccaaaaacttgtttccggaagatgaagggcgattatcttgagacttgtgggtacaagggggaggtgaatagtagaccgacttaccggatgttcgaccagaggttgccttctgagactatccagacttatcctagatcctgcaatatcccgcagacagtcgagaatagactgccccagtggctgcccgcgcacgatagtcggctccgtctcgattcattgagttattgtcagttcacccgtgactgtttttccgagaagcccgtacctttgaattttaaccaacaggaatacatttgtggaagccacggcgtcgaacaccgggtgtataagcacttttcatccgacaacagtacctccacccatcaggcaagccacaagcaaattcaccagaagaggaaaaggcaccctgaggaggggagggagaagagtgaagaagagcgctctaagcataagcgcaagaagtcatgtgaagagattgacctggataaacacaagagcatccagcgcaagaagacggaagttgagattgagactgtgcatgtcagcaccgaaaagttaaaaaataggaaagagaaaaaaagcagagacgtagtgagcaagaaagaggagcgcaagaggactaaaaaaaagaaagagcagggacaagagcgcacggaggaggagatgctgtgggaccagtcgatactcgggttttag

SEQ ID NO: 31109 - DNA, 684 bp, Artificial Sequence
  Description of Artificial Sequence: Synthetic coding sequence
atggcctcaccttctcgtcagccacctccaggcggctctggcttgctgcaggggtcaagggccagatcttatggaagcctggtgcaaagtgcctgctctcccgtccgggagcgcagactcgagcatcagctcgagcccggcgatacgctggcgggtctggctctgaagtatggggttactatggagcaaattaagcgagcaaatcgattgtatacaaacgactcgattttcctaaaaaaaaccttgtatatccctattctgacagaaccccgggatttgtttaatggcctcgactctgaggaagagaaggacggggaagaaaaggtgcatcctagcaactcagaagtgtggccacatagcacggagaggaagaagcaggagactggtgcgggcagagctaatggggaggtcctcccaacaccaggccaggagacccccacccccatccacgaccttagcgcatccgattttctgaagaagctggatagccagatcagtttgtccaagaaggccgccgcccaaaagcttaagaaaggcgagaatggggtgcccggggaggatgccgggctccacctcagcagcccttggatgcagcagcgggccgtactgggcccggttccgctgaccagaacatctaggacccgtactctgcgcgaccaagaggacgaaatcttcaagctgtag

SEQ ID NO: 31110 - DNA, 540 bp, Artificial Sequence
  Description of Artificial Sequence: Synthetic coding sequence
atgcgtagtggacctctgcggatttctgagtggaaaatggagcagatcaaaagggccaacagactgtataccaatgattctatttttctgaaaaaaaccctttatattcctatcctgaccgagcctagagatctctttaatggtttagattctgaagaggaaaaagacggcgaagagaaagtccacccctcgaatagcgaggtttggccacactccacagagcggaagaagcaggagactggcgccggccgtgcaaacggcgaagtcctgccgacgccaggtcaagagacaccgacccccatacacgacctgagtgctagtgacttcctcaagaagctggatagtcaaatcagtttaagcaagaaggctgccgcccagaagctgaagaaaggcgagaatggagtgcctggtgaagatgcaggactgcacctgtcaagtccctggatgcagcaacgcgccgtgctgggcccagtcccactcactaggactagcaggactcggaccttaagggaccaggaggatgagatctttaaattgtag

SEQ ID NO: 31111 - DNA, 648 bp, Artificial Sequence
  Description of Artificial Sequence: Synthetic coding sequence
atggctgactccagccccgctctgtccctaagggaagggggccccagggcaccccgcccatccgcccctagtccaccaccgcggagtagaagcggcagcgagagcgaagaagccgaactgtctctcagcctggcccgcactaaaaccagaagttatggatccacggcctccgttagagctcccctcggggctggcgtaatcgagcggcacgtggaacacagagtgcgggccggcgatacactgcagggaatcgcactgaagtacggcgtgactatggagcagattaaacgcgctaataagctctttacaaatgactgtatctttctaaagaaaactctcaacatccccgtaatttccgagaaacctctgttgtttaacggcctaaactcaatcgactctcctgagaatgagacggctgataacagtttcagccaggaagaggagcccgttgtcgcaggcgaagacctaccccctcctagccctcaggaaagcgacgtgcagcccgtgcagcctgaggaggtgtcagctcgagattttttgcagcggctggatctgcagatcaagctgtccacccaagcggcaaaaaaattaaaggaggaatccagggatgaagaaagcccatacgccacctcactttatcattcatag

SEQ ID NO: 31112 - DNA, 375 bp, Artificial Sequence
  Description of Artificial Sequence: Synthetic coding sequence
atggagcagatcaagagagcaaacaagctgtttacaaacgattgtatcttcttaaaaaagacacttaatattcctgtgatcagcgaaaaacccctgttgttcaatggcttgaactcaatagacagtcccgagaatgaaacagccgacaatagtttctcccaggaggaagagcctgtggttgccggcgaagacttacctcctccttcccctcaggagagtgacgtgcagcccgtgcaaccagaggaggtgtctgctcgtgactttctgcagcgacttgatctacagattaagctcagcactcaggcagccaaaaagcttaaggaagagagtagagatgaggagtctccttatgctaccagcctctaccattcatag

SEQ ID NO: 31113 - DNA, 375 bp, Artificial Sequence
  Description of Artificial Sequence: Synthetic coding sequence
atggagcagatcaagagggccaataagttatttaccaacgactgtatttttctcaagaaaaccctgaatattcccgtaatttccgaaaaaccccttctgttcaacgggttaaatagtatcgatagtcccgaaaacgagaccgccgataattctttctctcaagaggaagaacccgttgtcgccggcgaggatctcccgcccccatcaccccaggagtccgacgtccaacccgtgcagccagaggaggtgtcagccagagatttcctgcaacgactggatctgcagatcaagctaagtacccaggcagccaagaagctgaaggaggaatcacgcgatgaagagtcaccctacgcaacgtcactgtatcactcgtag

SEQ ID NO: 31114 - DNA, 495 bp, Artificial Sequence
  Description of Artificial Sequence: Synthetic coding sequence
atgaaaatggtgatgccctcttggttcgacctgatgggactttcccccgatgcgcctgaagatgaggccggcatcaaaaaggctgcagaaaatatcaaggctcttattgagcatgagatgaagaacggtattccggcaaatagaattgtgcttggtggttttagtcaggggggagcactgtccctctacactgcactaacgtgccctcacccattagccgggatagtcgctctctcttgctggttgcccttacacagagcatttccgcaggccgctaatggctcggcaaaggatctggccatcctccagtgccacggggaacttgatccgatggtcccagtgcgattcggggccctgaccgcagaaaaactgaggagtgtggttacacccgcgagggtgcagtttaaaacttatcctggggtgatgcattccagttgtccgcaggagatggcagcagtcaaagagttcctggaaaaattgcttcctccagtctag

SEQ ID NO: 31115 - DNA, 543 bp, Artificial Sequence
  Description of Artificial Sequence: Synthetic coding sequence
atgtgtggaaacaccatgagcgtgccactgttgacggacgctgccactgtgagtggggcagagcgggaaacagcggccgtgatcttccttcatggactgggtgatacggggcatagttgggcggacgcgctgtccaccataaggctccctcacgtaaaatacatatgcccccacgcacctcggatacctgtgactctcaacatgaagatggtcatgccgtcatggttcgacctcatggggctgagccccgatgcccctgaagacgaagccggcatcaagaaggccgctgagaatattaaggcccttatcgagcacgagatgaagaacggtatacccgcgaatcgaatcgtgttgggggggttctcccagggaggcgccctttctctttacacagccctaacctgtccacacccactggcagggatcgtggctctttcatgctggctaccgctccatcgcgcgttccctcaggtgaacgtgcctaccgatcccccagccttatgcgtgtgtatccttgtcgcctggggcctactgcagcattag

SEQ ID NO: 31116 - DNA, 549 bp, Artificial Sequence
  Description of Artificial Sequence: Synthetic coding sequence
atgtgcggcaataccatgtccgtgcccctgttgacagatgccgccactgtgtcaggggcagagcgggagacagctgctgtcatctttttgcatggtcttggagacacagggcatagctgggctgacgctttgtcaaccattagactgccccatgtcaaatatatatgtcctcatgcgcctaggatacctgtgacactgaacatgaaaatggtcatgccgagctggttcgacttgatggggctttcccctgatgcacccgaggatgaggcagggattaaaaaagccgccgaaaatatcaaggccctgatcgagcacgagatgaagaacgggatccctgccaacagaatagtcctgggcgggttctcccaggggggggctctgtccctttacaccgctctgacctgtcctcatccccttgccggcatcgtcgcactcagttgttggctgccacttcatagagcttttccccaagggcccgtgcaggatattccagggtgtcatgcccaacttttaagttcgggcgacgggtcctgcgagggcatcagctag

SEQ ID NO: 31117 - DNA, 414 bp, Artificial Sequence
  Description of Artificial Sequence: Synthetic coding sequence
atgtgcgggaatactatgtctgttcctctcctaacggacgccgccaccgtctcaggcgccgaaagagagaccgccgctgtaatctttctgcatggactgggggacaccggacatagttgggccgacgctctgagcactataagactccctcacgtgaaatacatctgcccacatgcacctaggatcccagtgacactgaacatgaaaatggtcatgccctcctggttcgacctgatgggtttgtcccctgacgctcccgaggatgaggcaggaatcaagaaagccgctgaaaaccgacgggggcccgtgcctctccatgggccacacctgccccccccttccggatggcaccgcggggttgaattgctggccgcttctgccccgggacttccccctggagaatgtcctcattag

SEQ ID NO: 31118 - DNA, 627 bp, Artificial Sequence
  Description of Artificial Sequence: Synthetic coding sequence
atgctcccaccgtgtctggaactgtcaggtaaaagacctcggcattcttgggctgacgccttgagtaccattagacttccccacgtgaagtacatctgccctcacgcaccacggatccctgtgacacttaatatgaaaatggtaatgcccagctggtttgaccttatgggattaagcccggatgctcctgaggatgaggctgggatcaaaaaggccgcggagaatataaaagccctgatagaacacgaaatgaaaaatggtattccagcgaaccgcattgtgctgggcggcttttcccaggggggcgctctgtcgctctatactgcccttacatgcccacaccctctggctggaatcgtggccctgtcctgttggttgcctctccaccgagcctttccccaggctgcgaacgggagcgcgaaagatctagctatcctgcagtgtcacggtgaactggatcctatggttccggtcaggttcggcgccttgaccgctgagaagctcaggagcgtcgttacacctgcccgggtgcagtttaagacctatcccggggttatgcactcttcatgcccgcaggagatggccgccgtcaaagagtttctggagaaactgcttccccccgtctag

SEQ ID NO: 31119 - DNA, 696 bp, Artificial Sequence
  Description of Artificial Sequence: Synthetic coding sequence
atgtgcgggaacaccatgagtgttcctctccttactgacgcagctactgtatccggagccgagcgcgaaacagccgcagtgatctttctgcacggactcggtgatacaggccactcgtgggctgacgcactgtcaacgatccggctgccccatgtcaaatacatctgtccacacgcacctcggattcctgtcaccctgaacatgaagatggtcatgccttcttggttcgatctcatgggcctttccccagatgcgcccgaagatgaagcaggcattaaaaaagccgcggagaatatcaaagcactgatagagcacgagatgaaaaacggcatcccagctaaccggatcgttttgggcggattcagccagggaggtgcgctttccctctatactgctttaacttgccctcaccctctggctggcatcgtggcgctgagttgttggcttccacttcatagagcctttcctcaggcagctaacggcagcgccaaggatctggccatcttgcagtgtcatggcgaactggatccaatggtgcccgtgcgcttcggggccctgacagctgagaaactgcgcagcgttgttacaccagcacgggtgcagtttaagacttatccaggagttatgcacagctcctgcccccaggagatggcagccgtgaaagaattcctcgaaaagctattacctcccgtctag

SEQ ID NO: 31120 - DNA, 405 bp, Artificial Sequence
  Description of Artificial Sequence: Synthetic coding sequence
atgtgtggcaacacaatgtctgtccctctgctcaccgatgccgccactgtttccggggccgaaagagaaacagccgccgttatttttcttcatggtctgggcgacaccgggcattcgtgggctgacgctctctccaccatcaggctgccccatgtgaaatacatttgtccacacgctccaaggatccctgttacattaaatatgaagatggtgatgcctagctggttcgacctgatggggctgagcccagacgctccggaggacgaagccggaatcaaaaaggctgcagagaaccggcgcggcccggtgcccctgcacggaccacacctgccccccccaagtggatggcaccgaggcgtcgaactcttggccgcctccgcccctgggcttccgccaggttcatag

SEQ ID NO: 31121 - DNA, 489 bp, Artificial Sequence
  Description of Artificial Sequence: Synthetic coding sequence
atgctcccaccttgtctggaactgtctggaaagcgcccccggcattcttgggccgacgctctctccacgatcaggttgccacacgtgaaatatatctgcccacatgcccctcggatcccggtaaccctgaacatgaagatggtcatgccttcttggtttgacttaatgggattgtcaccagatgccccagaagacgaggcaggaattaagaaggccgccgaaaatattaaagctcttatcgagcacgagatgaagaatgggattcctgcaaatcggattgtgctaggcggattttctcagggaggggcactatcactgtacactgcgttgacctgcccccaccccctagccgggatagttgctctttcctgttggctgccgcttcacagggccttcccgcaggcagccaatgggtcggctaaggatctggctattttgcagtgtcacggcgagctggaccctatggtgccagttagattcggcgcatag

SEQ ID NO: 31122 - DNA, 276 bp, Artificial Sequence
  Description of Artificial Sequence: Synthetic coding sequence
atgtgtggcaacacaatgtccgtgccactgttgactgacgcagccactgtctcaggggccgagcgggaaactgctgcagtcatcttcttacacggcttgggcgacactggacacagctgggccgatgctctgtcgacaattagactgccccatgtgaagtacatctgcccccacgccccacgcatccccgtgacactaaatatgaaaatggtgatgccctcttggttcgacctgatgggtttatctcctgatgccccagaggatgaagctggatag

SEQ ID NO: 31123 - DNA, 1476 bp, Artificial Sequence
  Description of Artificial Sequence: Synthetic coding sequence
atgaaaatggccgctcctacagcaaacaaagcagcctcactcggatgcaacaacaaaccagccttccccgagcttgactttagatcaggggcacgtgtcgaagagttgaacaagctcatccaggaatttaccaaacatgatcaaagagaatatgatgatcagcgtgctctggagatccatactgctaaagactttatcttcagtatgttaggtatggtgcaaaagctggatcagaagttgcccgtcgctaacgagtacctgttgctgagcggcggtgttcgcgaaggcgttgtagatcttgacctcgatgaactgaatgtctacgcacgaggaaccgactacgacatggactttacactgcttgtgccagcgcttaagctgcatgatcgcaatcagcccgtaaccctcgatatgcgccattctgccctctgccatagttggttgtcactgcggttgttcgatgaggggactatctccaaatggaaggattgttgcacaattgtggaccatattaatggtgctacgaactattttttttctcctactaaagtggctgattggttttatgactcgatctcaattgtgcttagtgagatacaaaagaaaccacaacgcggaatgcccaaggtggagaaagtggagaagaacggcacaattatctctatcatccttggggtgggcagctctcggatgctgtacgatattgtcccagttgtgagctttaaggggtggcccgctgtggcccagtcttggcttatggaaaatcacttttgggacggcaagatcaccgaggaagaggtgatttcggggttctatctcgtccccgcttgttcatacaagggaaaaaaggataacgagtggcgactgagtttcgccagatccgaggtacagctgaaaaaatgtatatcttcttctcttatgcaggcatatcaggcgtgtaaagcgattatcataaaacttctcagcaggcctaaggcgattagtccgtaccacttaaggtctatgatgctctgggcctgtgatcggcttcctgccaattacctggcacaggaggattacgcagcccatttcctgctcggtcttattgacgacctacagcattgtttagtcaataagatgtgccccaattattttataccacagtgtaatatgctcgaacaccttagcgaggagaccgtaatgctccatgcacgcaagttgtcttccgtcagaagtgaccccgctgagcaccttcgtactgcaatcgaacatgtgaaagccgccaacaggctaactctcgagttgcagagacggggatcaacgactagcatcccgagcccccagagcgacggtggtgacccaaaccaacccgatgacaggctggccaagaaactgcagcaactcgtcactgaaaatccgggaaagtctatttcagtgttcatcaatccagacgacgtcacaagaccccattttcgcatagacgataaatttttttag

SEQ ID NO: 31124 - DNA, 1089 bp, Artificial Sequence
  Description of Artificial Sequence: Synthetic coding sequence
atgaagtatctcacggtcggggacctggaggactgtctgctgaataaggttgatctgcgtcgacagcagatttctcaggctgtagaggaagtgcagaaggttgttcaccacctaactactaatatttctaaccaggacatccgctttcaggctgtgccctattcggatacttataatgagaacatcaaagtcctggctcctagtcagttcctggttaccgtgcccatcaaggggctggcaggctatcgtgaggcccgcgagcaacactggagatactataccctgcagggcacccgcctcccctgccctctgagagaccccgaggggctgcagcagtggcttgaagtcgagcagttcatgaagtccctctggcaatggcatgagacagatgtgaacattgacggtgatatagtccccgccaaggtcctgcttgtgttcaggaaactggttgagaatgctgtgaggacatgtcacctttccggcaaagtgtccctccttggcaaccggagcgccgtatgggttgctgtcgagacctcagcctatcaggtggagctggagttagttcctgctgtggagattcctacaacatggtcaaagaaagccaggtggcctagatgcttacagcgctggccaagtcaggagagggtcgagtgcattaaaagcttcggtttcaacctgttagcatgttcaaattatcactggcagctgtcctttctgcgcgcggaacaggtgctcctggagcagttggatgaagacggcggatgccgccgcaagtgctttcaggtgatgaggcatctgaaagaggacatttggtgcccaggcaacagacccgtgatcactagtcatcatctgcagactgtgctgttttggacctgcgaaaaatacccccacttcaaagactggcaggtgttctccaaagcctttctgagacttgtgaggaagttacacaagtgtgtgagccagcactttctgaaacattacttcgtgaggaattcaaatctcttccagtgtaccaatcccacagaattagacaccgtggcgcagaaactggctaccttcctcaagaatcctcagatcggcccaccctag

SEQ ID NO: 31125 - DNA, 4371 bp, Artificial Sequence
  Description of Artificial Sequence: Synthetic coding sequence
atgagattgccactgttactcgtgtttgcttcagtcattcctggagccgtgctcctgctggacacacggcaattcctaatttataacgaagaccacaagcggtgtgtggacgctgtgtcccctagcgcggtccagacggccgcttgtaatcaagatgccgagtctcaaaagtttcggtgggtctcagagagtcagattatgagcgtggcattcaaactttgccttggcgtaccctccaagaccgactgggtggctataaccctctacgcatgcgattctaaatccgagtttcagaaatgggagtgcaaaaacgacacactcctgggtataaagggagaggatcttttctttaattacgggaacagacaggagaaaaatatcatgctgtacaaaggatccggcctctggtctcggtggaagatttacggcaccacagacaacttatgcagcaggggatacgaggccatgtatactctcctgggcaacgccaatggagctacttgtgcctttccttttaaattcgagaacaagtggtatgctgactgtacctccgcaggtcggagtgacggatggttatggtgtggtactaccaccgactatgatactgacaagctcttcggatattgccctctgaaatttgagggctccgagtctctctggaataaggaccctctgacctctgttagctaccaaataaacagcaagtccgcactgacttggcaccaggctaggaagagttgccagcagcagaacgctgaattactgagcataacagagattcatgaacagacatacctcacagggctcacctcgagtttgacctctggtctctggatcgggttaaattcactcagtttcaactccgggtggcagtggagtgacaggtcaccttttcggtatcttaactggctgcccgggtccccctccgcggagcctggaaaatcatgtgtgtcgttgaatccgggcaaaaacgccaagtgggagaatctggaatgcgtgcaaaaactcggctacatctgtaagaaaggaaacactaccctcaactctttcgttatcccaagtgaatccgacgtcccaacccactgccccagccaatggtggccgtacgcaggccactgctataaaattcatcgcgatgagaagaaaattcagcgggatgcactcacgacctgccgcaaagaaggttctgaccttgcctcaatacatacaatcgaagagtttgactttatcatcagccaactgggctacgagccaaatgacgagctctggattggcctgaacgacattaaaatccagatgtattttgagtggtctgacggaacacccgtgacttttaccaaatggctgaggggggagccttctcatgagaacaacagacaggaggactgtgtagtgatgaagggcaaagatgggtattgggcagacagaggctgcgagtggccacttggttacatttgcaaaatgaaatcgagatctcaaggacctgaaatcgtagaggtggagaaagggtgccggaaagggtggaagaaacaccacttttactgttacatgattgggcacacactcagcaccttcgcagaggcaaaccagacatgcaacaacgagaacgcttacttgactaccatcgaggatcgttatgaacaggcctttctcacatctttcgtgggtctgcggccagagaaatatttttggaccggcttgagtgatattcagaccaagggaaccttccaatggactatcgaggaagaagtgcgcttcactcattggaactcggatatgccaggaagaaagccagggtgtgtcgctatgcgtaccgggatcgccggaggactctgggatgttctaaaatgcgatgaaaaggctaaatttgtctgcaagcactgggcagagggggtgacacatccccctaagccaacaaccacccctgaacccaagtgccctgaggattggggagcctcgagccgcacctctctgtgcttcaaactttacgctaaaggaaaacacgagaagaagacatggttcgagagccgcgacttctgcagggcgctagggggggatctcgcatcaatcaacaacaaagaggaacaacaaacgatatggcgcttaataaccgcctcaggctcctaccataagctattctggcttgggctgacctacggcagtccctccgagggattcacttggtcggacggatcacccgtgtcctatgaaaattgggcgtatggggaacccaataattatcagaacgttgaatactgcggagagcttaagggggatccgaccatgtcctggaatgatattaactgcgaacatctaaataattggatatgccagatacaaaaaggacagacgcctaagcctgaacccaccccagctccccaggacaaccctcccgtgaccgaggacgggtgggttatctacaaagactatcagtattattttagcaaggaaaaagagaccatggataatgctcgggccttctgtaaacgcaattttggagacctggtaagcatccaatcagagagcgaaaaaaaatttttgtggaagtacgtgaaccggaatgatgcccaaagcgcttattttattggtcttctcatctcactcgataagaaatttgcctggatggacggcagcaaagtggactacgtgagctgggctaccggggagcccaattttgcaaacgaagacgagaattgcgtgaccatgtactcaaatagcggcttctggaacgatatcaattgcggatacccaaatgcttttatttgtcagaggcataactccagtattaacgccaccaccgtgatgccgactatgccatctgtaccttcaggatgtaaggagggctggaacttctattcgaataagtgttttaaaatctttgggtttatggaagaggagcgaaaaaactggcaggaggctcggaaggcatgcatcggctttgggggtaacttggtgtccatccagaatgagaaggagcaggccttcctgacatatcacatgaaagatagcacgttcagcgcgtggaccggtctgaatgacgtcaacagcgagcacacatttctgtggaccgatggcagaggcgtccattacaccaattggggaaagggctatcctggggggaggagatcatctctgtcctacgaggacgcagactgtgtggtgataatcggtggagcgagtaacgaagccggtaaatggatggatgacacttgtgatagcaagagaggttacatctgtcagacaaggagtgatcctagccttactaatcctccagccaccattcaaacggacgggttcgtgaagtatggaaaatcctcctattctttaatgagacagaaattccagtggcacgaagcagagacctactgtaaactgcacaatagcttgatcgcctcgatattggatccttattccaacgcgtttgcatggctgcagatggagacctctaacgaacgcgtctggattgctctgaattctaatttaaccgacaaccagtatacctggaccgataaatggagagtgcggtataccaattgggccgccgatgaaccaaagctgaagtccgcttgcgtatatttggacctggatggctactggaaaaccgcccactgcaatgaaagtttttacttcctctgcaaaagatctgatgaaatccccgccacagaacccccccagctacccgggagatgcccggaatctgaccataccgcctggattccctttcatggacactgttattatatagagagcagctacacacggaactggggacaggcctcattggagtgtctccgtatggggtcatcgctggtcagcatcgagtccgccgccgagagttcattcctgtcctacagagtcgaacctctgaagtccaagaccaatttttggattggcctgttccgcaatgtggagggaacttggctgtggataaacaactccccggtgtccttcgtaaactggaacaccggagatccttcaggtgagaggaacgactgcgtcgccctgcacgcgtcctccggcttctggagtaacatccactgcagtagttacaaaggatacatttgtaagagacccaagattatcgacgccaagcccacgcacgagctcctaactaccaaagcggacaccagaaaaatggatcccagcaaaccgtctagcaatgtagctggagtggtaatcattgtgattctgttgattctgactggggctggcctcgctgcctattttttctataaaaaacgaagggtgcaccttccccaggaaggtgcttttgagaataccctttatttcaacagccagtcaagcccaggcacaagtgacatgaaggatctggtggggaacatagaacagaacgagcatagtgtgatttag

SEQ ID NO: 31126 - DNA, 1497 bp, Artificial Sequence
  Description of Artificial Sequence: Synthetic coding sequence
atgaggctgcccctgttattggtgtttgccagcgttattccaggcgccgtcctcttactcgataccaggcagtttctgatctataatgaagaccataagagatgcgtcgatgctgtaagtccttcagccgttcagaccgcagcttgtaaccaggacgccgaaagccagaagttccgatgggtgagcgagtctcagatcatgtccgtggcctttaaactctgcctgggagtgcccagcaaaactgattgggtggccataaccctttacgcttgcgactctaagagtgaattccaaaagtgggaatgcaaaaacgataccctgctgggcataaaaggcgaggatctgttcttcaattacgggaatcgccaggagaagaacatcatgctgtacaagggttctggactttggtctcgatggaagatttacggcactacagacaatctttgcagtaggggctatgaggctatgtacactttgctgggtaacgcgaacggtgcaacatgcgctttccccttcaaatttgaaaacaaatggtatgccgattgcacaagcgccggtaggagcgatggatggttgtggtgcgggaccaccacagactacgacacagacaagctgttcggttattgccccctgaaattcgagggaagcgagtccctatggaataaggatcccctgacctccgttagttatcagattaactcaaaatccgccctgacctggcaccaggctcgcaaatcttgtcagcagcagaatgctgaactgctgtcaattaccgagattcatgaacagacttacctcacaggactgacctccagcttgacctcgggcttgtggattggactaaattcgctaagcttcaactctggatggcagtggtctgacaggtccccctttcggtatcttaattggctgcctgggtcgccgtccgctgagccaggcaagtcatgtgtgagcttgaatcctgggaaaaatgccaaatgggaaaatctggagtgcgtacagaagctgggctatatctgcaaaaaaggcaacactactctgaacagtttcgtgatcccctctgaatcagatgtaccgacacactgcccatctcagtggtggccttacgccggacattgttacaaaattcatcgcgacgagaagaagatccagagggacgcccttaccacatgcaggaaggaaggcagcgatttggccagcatccacaccatagaggaatttgattttatcatttctcagctgggatacgagccaaacgatgagctgtggatcgggttgaacgatattaaaattcagatgtactttgagtggtctgatggtacccctgtaaccttcactaaatggctgaggggggaaccaagtcacgaaaacaatcgccaggaggactgcgtcgtgatgaaggggaaagcaggagtccagtggcataacttaggcagcatgcagccccttccacgggaattcaagcgcttctcctgcctgtctctgcctagttcttag

SEQ ID NO: 31127 - DNA, 507 bp, Artificial Sequence
  Description of Artificial Sequence: Synthetic coding sequence
acaggacagggaggggtcaggtcagctccagggactgggaggattgcctttccgccaaaagcatcgagaggaagtacaaataccgcccatctttcgattgcaaactcctggcccaggtcagcctccacccccgagacgcgaactaagttcacccaggacaatctttgccatgcacaaagggagagactggactctgcaaatctttgggtgcttgttgattgtattctccgagacacgagcgaggatcttgggctgcagtgtgacgcagtcaacttggcctttggtcggcgctgcgaagagctggaggacgctcgccacaagctgcagcaccacctgcacaaagtaggccatcccgagcctagaaggcgcctccgacgcctccctaccacgttgcccccgctcatcacttggcccggtccctcaacgcccttttccagtgtgccattgattccccgcgacccccggtccaagtgccacctcagcgtaaatctgtgcaagactcggtag

SEQ ID NO: 31128 - DNA, 1941 bp, Artificial Sequence
  Description of Artificial Sequence: Synthetic coding sequence
atggagttccaggaggtgcagcagactcaggccttggcctggcaagcccagaaggcacccactcatatctggcagccattgcctgctcaggaggcccagagacaggcccccccacttgtccagctagagcagccttttcaaggtgcccctccttcccaaaaggcggtgcagattcaattgccgcctcagcaggctcaggccagtgggcctcaggccgaggtgccaaccctccccctacaaccaagttggcaggcacctccagccgttctgcaagctcagcccggcccacccgttgccgctgccaattttccacttggcagtgctaagtccttgatgactcctagcggcgaatgccgtgccagctccatcgataggcgggggtccagcaaagaacgccggacgagcagtaaagaacgtagagcccctagtaaagatcgcatgatctttgcagcaacgttttgtgcgcccaaggcagtgagcgccgcccgtgcacacttacctgcagcctggaagaacctgcctgccacccccgagacatttgccccctctagctcagtgtttcccgctacaagccagtttcagccggcttccctaaacgcttttaaaggcccatcagccgcaagcgagacgcctaaaagcctgccttacgccctacaggaccctttcgcctgcgtggaagctcttcctgctgtcccctgggtgccccagccaaatatgaacgccagtaaagcatctcaagctgttcctacttttctgatggcaactgcagctgcaccacaggcgacagcaacaacacaggaagcttccaagacctctgtcgagcctccgcgccggtctggcaaggcgacacggaagaaaaaacacctggaagcccaagaagattcgagaggccacactcttgcctttcatgactggcaggggcctcggccctgggaaaacctcaatctctccgattgggaggtacagtcacccatccaagtctcaggagattgggaacatccaaacacacctaggggcctcagcggctgggaagggccctcaacctcacgtattctctctggctgggaggggccctctgccagttgggctttgagcgcatgggagggaccatcgacatcacgggctctgggcctcagcgaaagcccaggatctagccttcctgtagtggtgagcgaagtggcatccgtttcacccggttcttcggccacccaggataactcaaaagtagaggcccaaccccttagcccccttgacgagcgtgcaaatgcattagtgcagttcctgctggtcaaagaccaggctaaagttcccgtgcagagaagcgagatggttaaagtgatcttgcgagaatacaaggacgagtgtcttgatattatcaatcgggcaaataacaaactagagtgtgcatttgggtaccagctgaaagagatagacaccaaaaatcatgcttatattatcattaacaagctgggctatcacactggcaaccttgtggccagttatctcgaccggcccaaattcggcttgctcatggtggtgctgagcctcatctttatgaaagggaattgcgtgagagaagacttgattttcaactttctgttcaaactgggccttgatgttcgagaaacaaacggactttttggcaacaccaagaagctcattaccgaagttttcgttagacagaagtaccttgagtacaggcgcatcccttacacggagcctgctgagtacgagttcctctggggcccaagggcttttttggagacaagcaaaatgctggtccttcgtttcttggccaagctccacaaaaaagaccctcagtcctggcccttccactatttggaggccctggccgagtgtgaatgggaagatactgacgaggacgaaccagacactggggacagcgctcacggacctacttcacgtccacccccccggtag

SEQ ID NO: 31129 - DNA, 828 bp, Artificial Sequence
  Description of Artificial Sequence: Synthetic coding sequence
atgccactcttgtggatcaccgggccccgctaccatttgatactgctctcggaggcttcttgtctgagagctaactacgtccacctttgtcctctgtttcagcatcgctggctcgagacctgcaatgctccgccacagctgatccagggcaaggcccattccgccccgaaaccatcgcaggcgtcaggacatttcagtgtcgaactggtgcgcggctacgctgggttcggtctgacactggggggtggtagagacgtggctggagatactccccttgccgtgcgcgggctgctgaaggacggtcccgctcagcgctgtggtcgacttgaggtgggcgatgtcgttctgcatatcaatggggaaagcacgcagggtctcacgcatgcccaggccgtcgaaaggattcgggccggcggacctcagctgcaccttgttatccggagaccactggagactcatcctgggaagccgcggggtgtaggtgaacctcgcaagggcgtcgtgcccagctggccagatcgatctcctgatccagggggaccggaagtcaccggttcacgcagcagcagcaccagtctagtgcaacacccaccaagtcgtaccaccctgaagaagacccgagggtcacccgaaccgagtccggaagccgccgccgacggccccaccgtgtctcctcccgagagaagagctgaggaccccaacgaccaaattccagggagtccaggcccttggcttgttccatccgaagagcggttatccagggccttaggcgtgaggggagcggcccaatttgctcaggaaatggcggctggtagaagacgccactag

SEQ ID NO: 31130 - DNA, 813 bp, Artificial Sequence
  Description of Artificial Sequence: Synthetic coding sequence
atgccccttctttggatcaccggtcctaggtaccatctcattctgttgtctgaagcaagctgcttgcgcgctaattacgtgcacctctgtcccttgttccaacataggtggctggagacttgcaacgctccaccacagctgatccaggggaaggcgcatagcgctcccaaacccagtcaggcgtccggccattttagcgttgaactcgtgcgggggtacgcaggattcgggttaactctcggaggaggtagggacgtagccggggatactcccctggccgtgagggggcttcttaaggatggccccgcacagcggtgtggcagacttgaggtgggggatgtggtcttgcatattaacggagaaagcacacaggggcttactcacgcgcaagcagtcgaaaggattagggctgggggaccccagttacatctcgtgatcaggcgccccttggaaacccacccggggaaacctcgaggggtgggcgaaccgaggaagggtgtcgaccgcagccccgatcctggtggccccgaggtgaccggatctagaagctcttctacgagtctagtgcagcatccacccagcaggaccacgctgaagaagacaagagggtcccccgagccaagccccgaggcggcagccgatggccccacagtctctcctcccgagcgccgcgcagaggatcccaacgaccagatccccggatcacccggcccctggctggtgccctccgaggagcggctctcccgggccctaggtgtgcggggggcagcgcagttcgcacaagagatggcagcgggtcggagaaggcattag

SEQ ID NO: 31131 - DNA, 1005 bp, Artificial Sequence
  Description of Artificial Sequence: Synthetic coding sequence
atggaacctcggaccggcggggctgctaacccgaaaggatctcgcggtagcagaggcccaagccccttagcaggccctagcgcccgacaactcttagcccgcttagatgccaggccattagcggctcgagccgcggttgatgtagcagccttggtaaggcgggctggtgccactctacgcctgagacgcaaggaggccgtaagcgtgctcgattctgcagatattgaggtaaccgactctagacttccccatgctaccattgttgatcacaggccgcagcacagatggcttgagacctgcaatgctcccccccagctgatacaaggtaaggcgcactcagctccaaaaccatcccaggcctcgggacatttcagtgtggagctggtgcgtggctacgcaggttttggtcttactctgggaggaggccgcgacgtggctggggatactccgctcgccgtgcgagggctgctaaaggatggcccagcccagagatgtggcaggttagaggtgggggacgtggttcttcacatcaacggcgaatctacacaaggactgacgcacgcccaggccgtggagcgtatccgcgcgggaggacctcaactgcaccttgttatcagaaggccactagagacccatccagggaaaccacgcggggtgggcgagcctcgcaagggcgtcgtaccttcttggcccgatcggagccctgaccccggaggcccagaggtcactggatcccggagctctagcacgtctctcgtccagcatccgcctagtaggaccaccctgaagaaaacacgtggatctcccgagccctcgccagaggcagcggccgacgggcccacagtgtcaccccccgaaagacgcgcggaagatcccaatgatcagatccctggcagccctggtccatggctggtcccaagcgaagagagactctcccgtgctctgggtgtaagaggagccgcacagtttgcacaagaaatggctgcagggcgaaggcggcactag

SEQ ID NO: 31132 - DNA, 714 bp, Artificial Sequence
  Description of Artificial Sequence: Synthetic coding sequence
tgacggggcccatctccactcgcaggaccgagtgccagacagttgctggcccggctggacgcgcgaccattggctgctagagcggcggttgacgttgctgcccttgtgcgccgggccggtgccacactgcgactgagaagaaaggaagccgtgagcgtgctggatagcgccgacatcgaggtgaccgactcacgtctgccacacgctactatcgtcgaccaccggcctcaaggaaaggcccattctgctcctaaaccgagccaagccagtggtcatttcagcgtggaactggtaaggggttacgccgggttcgggttaacgttagggggcggaagggatgtagctggggacaccccactggctgtgagagggctcctgaaagacggacccgcccagagatgtggtaggcttgaggtgggagacgtggtgctacatatcaatggggagagcactcagggacttacacatgcacaggccgtagagcggattcgggcaggggggcctcaactgcatctcgtcattaggagacctctggagacccatccaggaaaaccaagaggagtgggcgagcctcgcaagggagtcgatcgcagccctgacccaggcggccccgaggtcaccggctcacgttctagctcaacatcattggtgcagcatcctccatcccggacaaccctgaaaaaaacccggggcagtccagagccaagtccttag

SEQ ID NO: 31133 - DNA, 645 bp, Artificial Sequence
  Description of Artificial Sequence: Synthetic coding sequence
gcctggggggtgtcaagctactgtccagtactagcagtgagtgtactcgacagtgctgacattgaggtgactgactctcggctgccacatgccacaattgtcgatcacagaccacaacataggtggcttgagacatgtaatgcccccccccaactgatccaggggaaggctcacagcgccccaaagccctcacaagcttcgggacatttttcagttgagcttgtgagaggttacgctggcttcgggctaactctgggtggaggcagagacgtggctggagatacaccactggcagtcagagggctgctcaaggatgggcccgctcagaggtgcgggcgtctagaggtaggggatgtggtcctgcatattaacggtgagagtactcaggggctgactcatgcacaggccgtggaacgcataagggccggagggccacagctgcatcttgtgatcagaaggcctcttgagactcaccccggcaaacctcgaggcgtgggcgaacccaggaagggtgtcgaccgcagcccagaccccggggggccagaggtcaccggctccagatctagcagcacatccttagttcagcacccaccgtctcgcaccactttaaagaaaacgcggggctcccctgagccatcaccttag

SEQ ID NO: 31134 - DNA, 777 bp, Artificial Sequence
  Description of Artificial Sequence: Synthetic coding sequence
atggagcccaggacgggaggcgcagcgaatcctaaaggatcccgaggtagcagaggaccatctcctctcgcgggcccaagcgcaaggcagctcctggcgcgactggatgcaaggcctctggccgccagagccgccgtcgacgtcgcggctcttgtacggagagcaggggccaccctccgcttgagaagaaaagaagccgtctcagtgttagacagtgcagacatagaggttaccgactcacgcctgcctcacgccactatcgttgaccacaggccgcaggtgggagatgtggtgttgcatattaacggggagtccactcaaggactcacccatgctcaagcggttgaaaggattcgggccggaggccctcagctccacctagtgattagaagacccctcgaaacccatcccgggaagcccagaggtgtcggggagccgcgaaagggtgtggtgcccagctggcctgatcggagtccggacccaggcggcccagaggtgaccggttcacgttcttcttctacttctttggtccagcaccccccttctagaaccaccttgaaaaagacgagaggctcgcctgaaccatcaccagaggcagctgcagatggccctacagtcagtcctcccgaaaggcgggccgaggaccccaacgatcagatcccgggctctccgggaccttggctggttccatctgaagaacggcttagccgggccctaggagttcggggggctgcccagtttgcccaggagatggcggctggtcgcaggagacactag

SEQ ID NO: 31135 - DNA, 432 bp, Artificial Sequence
  Description of Artificial Sequence: Synthetic coding sequence
atgtctccaaactctcctctacactgcttctacctccctgccgtgtcagtgctggattccgcagacatcgaagtgaccgactcgcgacttccccatgcgacaattgtggaccaccggccacaagttggggacgtcgtcctgcatatcaacggtgagtcaacccaaggactgactcacgctcaggccgtggaacggatcagagccggtggccctcagctgcacttagtgatcaggaggcccctggagacccaccccggcaaaccacggggagttggggaaccccggaagggagtggatcgaagtccagatcctggagggcccgaggtgacaggcagtaggtcctccagtacctccctcgtccagcatcccccttctcggactactctaaagaaaaccagggggagtcctgaacctagtccagaagcagcctag

SEQ ID NO: 31136 - DNA, 606 bp, Artificial Sequence
  Description of Artificial Sequence: Synthetic coding sequence
tgagggcggctcttggccatggagccacgcaccggcggagccgcaaatcctaagggcagtcgcgggagccgcggcccaagcccactggccggccccagtgcccggcagctgctggcaaggttggatgcgaggccactcgccgctcgagccgcagtcgacgtcgcagccttagtccgacgagccggcgccaccttacgccttcgcaggaaagaagctgtatcagttctcgattctgccgatatcgaagtaactgatagccgattacctcatgccaccattgtggatcatcgccctcaggtcggagacgtggtcctccacattaacggagagtcaacacaggggctgacccatgcccaggctgtggagaggatccgcgcgggagggccgcaactgcacctggtgattcggcgccctcttgagacccacccgggcaagcctcgaggtgttggcgaaccgagaaagggcgtggatagaagcccagatccaggcggccccgaagtcacgggctcccgcagctcctctacaagtttagtccaacacccgccatcccgtacaaccctgaagaagacgcgcgggagtcccgagccatctccggaggcagcgtag

SEQ ID NO: 31137 - DNA, 531 bp, Artificial Sequence
  Description of Artificial Sequence: Synthetic coding sequence
atggccaggttgccaaagctggccgtgttcgacctggattatactttatggccattttgggtggatacccatgtagatccaccctttcataagtcctccgacggaactgtccgggacaggcgtggccaggacgtgagactgtatcctgaagtcccagaggttctcaaacgtcttcagtctttaggagtgcctggcgcggctgcatctaggacatcagagattgaaggggctaatcaattactggagctctttgatttattccgttattttgttcacagagagatttatcccggatctaagatcacgcattttgagaggctgcagcagaaaacaggcatacccttcagccagatgatcttctttgatgatgaacgccggaatattgtagacgtgtcaaaactgggcgtcacgtgtatccacatacagaacggaatgaatctgcaaacactaagccagggtctggagaccttcgccaaagcccaaacaggtccactgaggtccagcctagaagaatcacctttcgaggcgtag

SEQ ID NO: 31138 - DNA, 369 bp, Artificial Sequence
  Description of Artificial Sequence: Synthetic coding sequence
atggctagattgcctaaactggccgtcttcgatctagactacaccctgtggcctttttgggtggatacccatgtggaccctcctttccacaagtcgagtgacggcacagtgagagacaggaggggacaagacgtgcgcttgtaccctgaggtccccgaggtcctgaagcggttgcagtcgctgggagttcccggagctgcagcatcccgaacatcagaaattgaaggggctaatcagcttctggaactgtttgatctgttccggtgctacctacatagccaccctgaatggaacgaatcaagcaactctaagtccagggtgcgggatatttgcgagggcccaaattgggcgtttgaggtgcagccctag

SEQ ID NO: 31139 - DNA, 1515 bp, Artificial Sequence
  Description of Artificial Sequence: Synthetic coding sequence
atggcggctccccccgctccagccgccaaaggtagtccccagcccgagccacacgcaccagaacccggcccaggttcggccaagcgagggcgcgaagactcaagggccggccggctcagcttctgcactaaggtctgctatgggatagggggagtgccgaaccagatcgctagctctgcgacggcattttacctgcagctctttctcctggatattgcccaaattccagctgcccaggtgtctctggtgttgttcggtggaaaggtgtcgggggctgccgctgaccctgtagctggcttctttatcaaccggagtcagcgaacaggcagcgggagactgatgccgtgggtgctcgggtgcacacccttcatagcactggcctattttttcctgtggttcctgcccccgttcacatcactgcggggcctgtggtacacaactttctactgtctgtttcaggcccttgcaacgttctttcaagttccttatacggccctcactatgctgcttacaccatgccctagggagcgggactcagctaccgcctatcgtatgacagtcgagatggcagggaccttgatgggagcaactgtgcacggcctgatcgtgtctggagctcaccggccccacagatgtgaggcgacagcaacaccaggaccagtaacagtcagcccgaacgcagcccacctgtattgcattgcagcagcagtagttgtcgtcacttacccagtttgtatatccctgctgtgtttaggcgtgaaggagcgccctgacccttctgcacccgcttcaggccccgggctgtcattcttagccgggctgagtctgacaactcggcatccaccctacctgaaacttgtgattagctttctttttatctccgctgcagtgcaagttgaacagtcgtacctggtgttattttgcacacatgccagtcaactgcacgatcatgtgcagggtcttgttctgacagtgctggtatccgctgtcctgtccactccactgtgggaatgggtgctccagaggttcggaaagaaaacaagcgccttcggcatatttgccatggtgccctttgctatcctgctggccgctgtgccaacagcaccagttgcttatgttgtcgccttcgtgtccggagtgagtatcgcggttagcctgctgctaccctggtcaatgcttccagatgtcgtggatgacttccaactccagcaccggcatggacccgggctagaaactattttctactcctcttacgtgttcttcaccaaattaagtggcgcctgcgcgctgggcatatcgaccctatcactggaattcagtgggtataaggctggcgtctgtaaacaggccgaggaggttgttgtaaccctgaaggtccttattggcgcggtgcctacttgtatgatactggccggcctctgtatcctgatggtgggctctacccctaagacgccatctcgggacgcatcttcgcgtttgtccttacggcgccgcacaagttatagtcttgcctag

SEQ ID NO: 31140 - DNA, 1494 bp, Artificial Sequence
  Description of Artificial Sequence: Synthetic coding sequence
atggccgcgccccccgcgcctgcagccaagggatccccccagcctgagccgcacgccccagagccagggccaggcagcgctaaacgaggacgagaggactcaagagccggacgactgtcgttctgcacaaaggtttgctatggaatagggggagtgcccaaccaaatagctagtagtgccacggccttttatctgcaactgtttctattagatatagctcagattcccgccgcgcaggtttctttagtactcttcggcggaaaggtcagcggcgcagctgccgacccagttgccggcttctttatcaacaggtctcaaagaacgggatctggcagacttatgccttgggtactggggtgtaccccgttcattgcactggcatatttctttctgtggtttctccccccattcacatccctccggggtctttggtacaccaccttttactgcctgttccaggcactggcgaccttctttcaggtcccatatacagcactcaccatgttgctgacgccttgtccaagagagcgggactctgcaaccgcttatcgcatgaccgtggagatggcgggtactcttatgggcgcgactgtgcacggcctcattgtcagcggcgcccatcggccacacaggtgtgaagccaccgcaacaccagggcccgtgacagtgtctccgaatgcagcacacctgtactgcatagcagccgcagtggtggtcgtgacatatccggtatgcatctcactgctgtgtctgggcgtcaaggagaggccagatcccagtgcgccagccagtggacctgggctatcattcctggcggggctgagtctgacaactcgtcacccaccctacctgaaactggttattagcttcctgttcatctctgccgccgtacaggtggaacagtcctaccttgtcctgttttgtacacacgcttcgcagctgcacgatcatgtgcagggacttgtgctgactgtgttggtcagcgcagtgcttagtactcctctgtgggaatgggtcctacaacgattcgggaaaaagacgtcagcttttggaatttttgcaatggtccctttcgccatcttgcttgctgcagtccccaccgcccctgtggcttacgtcgttgctttcgtgtccggcgtgtcaatagcagtgagcttactgctcccctggagtatgctgcctgatgtggtcgacgactttcagttgcagcacaggcatggacctgggttggagacaattttctacagtagctacgtcttctttaccaagctgtctggtgcatgcgctttgggcatcagcacactgtctctggagttttccgggtacaaggccggggtgtgtaaacaggccgaggaagtagtagttaccttaaaggtcctgataggagctgtgcccacctgtatgatactggcgggcctatgtatcctcatggttggcagtacacccaaaacacccagccgcgatgcctcgtccagacttagcctgcgccgctag

SEQ ID NO: 31141 - DNA, 1449 bp, Artificial Sequence
  Description of Artificial Sequence: Synthetic coding sequence
atggccgaggctgccactcctggtactaccgctaccacaagtggcgccggcgcagctgcagcaaccgcagcagctgctagtcccacgcctattcctaccgtaactgccccgagcctcggcgctggaggggggggaggcgggagcgacggttccggtggtgggtggaccaagcaggttacgtgccgttacttcatgcatggagtgtgcaaggaaggcgacaattgccgttacagtcacgacctaagtgattcaccctacagtgtggtctgcaagtattttcagaggggttattgtatatacggggatcggtgtcggtacgagcactctaaacccctgaagcaagaggaagcaactgctaccgagctgaccacaaaatctagtctcgccgcatcgagctccctgagtagcattgtcggaccattggtggagatgaacactggtgaggccgagagtaggaatagtaattttgccaccgttggggctggaagcgaagactgggtcaatgcaattgaatttgtccctgggcagccttattgtggtcggacagctccttcttgtactgaggccccactgcagggaagcgtcaccaaggaagaatcagagaaggaacaaacagcagttgaaaccaaaaagcagctgtgtccttacgcagcagtaggcgagtgccggtacggcgaaaattgtgtgtatctgcacggagacagctgtgacatgtgcgggctgcaagtcttacaccctatggatgcagcccagaggagtcagcacatcaagagttgcattgaggcacacgaaaaggacatggagctcagtttcgccgtgcaacgctcaaaagatatggtatgcggtatctgcatggaagtagtctacgaaaaggctaatccttccgagcggagatttggaatacttagtaattgcaaccacacttactgccttaaatgcatccgcaagtggagatctgccaagcagttcgaatccaaaataataaaatcatgccctgagtgccgcatcacgtcaaatttcgtgatcccctcggagtattgggtggaagagaaggaagagaagcagaagctcatcttgaaatataaagaagccatgtctaataaggcatgccgttactttgacgagggacggggctcctgtcccttcggcggtaactgcttttataaacacgcctatcccgatgggaggagagaagagccacagcggcagaaggtcggcactagtagcagataccgagcacaacggaggaatcatttctgggaactgatcgaggagcgcgagaatagtaatcctttcgacaacgatgaagaagaagtggtaacatttgaactgggagaaatgctgctgatgctgcttgcagctggaggtgacgatgagctgaccgattctgaggatgaatgggatctgttccacgatgagcttgaagacttctacgatttagatttgtag

SEQ ID NO: 31142 - DNA, 651 bp, Artificial Sequence
  Description of Artificial Sequence: Synthetic coding sequence
atggaactgtcttttgccgtccagagatcaaaggacatggtgtgcggcatctgtatggaagttgtctacgaaaaagccaatccaagcgaacgaagatttggcatcttgtccaattgcaaccacacgtattgcctgaaatgcattcgcaagtggcgctccgcaaagcaattcgagtccaagatcatcaagtcttgtcctgaatgtcgcatcacctctaatttcgtaattccctcggagtattgggttgaagagaaggaggaaaaacaaaagcttattctgaaatacaaggaggcaatgagtaacaaggcctgtaggtacttcgacgaaggccgggggagttgtccattcgggggcaactgcttctacaaacacgcatatcccgacggcagaagggaagagccccagagacaaaaagtgggcacgagctcccgctaccgcgcccaacgcaggaaccacttctgggagctgatagaggaacgcgagaactctaacccctttgacaatgatgaagaggaagttgtcacatttgaacttggagagatgctgctgatgcttttggccgccggcggggacgacgagctcactgattcagaggacgagtgggatctttttcatgatgaactggaagacttttacgatctagacctgtag

SEQ ID NO: 31143 - DNA, 1257 bp, Artificial Sequence
  Description of Artificial Sequence: Synthetic coding sequence
atgcacggcgtatgtaaggaaggtgataactgcagatattcacatgacttgagtgacagtccatacagcgtcgtctgcaaatatttccaaaggggctattgtatttatggggatagatgtcgatatgaacacagcaagccccttaagcaagaagaggccaccgccactgaactgacaacgaaaagcagcctcgctgcctcctcctcactgtcctctatagtgggccctctggtcgaaatgaataccggcgaagctgaaagcagaaatagtaactttgccaccgtcggggctggaagtgaggattgggtaaatgcgatcgaatttgtaccaggccagccatattgcggcaggacggccccctcatgtactgaggcacctctgcagggctcagttactaaggaggagtcagagaaagaacagacagcggtggaaactaaaaagcagctatgcccctatgccgccgtcggtgagtgcagatacggtgagaattgcgtgtacctgcatggcgactcctgcgatatgtgcggtttgcaggttctgcatccgatggatgcagcccagaggagccagcatataaaatcctgcatagaagcacatgagaaggacatggagctaagttttgcggtgcaaagaagcaaggacatggtctgcggcatctgtatggaggtggtttacgagaaggcaaatccctccgaaagaagattcggcattctcagtaactgtaaccatacatattgcctcaaatgtatccgcaaatggcgatctgccaagcaatttgagtccaagatcatcaagagttgtcccgagtgccggatcacatccaacttcgtgatcccatctgagtattgggtcgaagaaaaagaggaaaagcagaaactgatcctgaagtataaggaagccatgtcgaataaggcctgtcgttattttgacgaggggcgtggaagctgtcctttcggtggaaattgcttctacaagcacgcataccctgatggacgcagggaagagccgcagcgtcagaaggtagggacgagctcccgatacagggcgcaacggcgaaaccacttctgggagttgattgaagagagagaaaatagcaaccccttcgataacgacgaggaagaggtggttacatttgaattaggggagatgctgttgatgctgctggcggcgggaggcgacgatgagttgacagactccgaggacgaatgggacttgtttcacgatgagttggaggatttttacgaccttgacttatag

SEQ ID NO: 31144 - DNA, 990 bp, Artificial Sequence
  Description of Artificial Sequence: Synthetic coding sequence
atggctgaggctgccacaccaggcaccactgccacaacatccggggcaggcgctgctgccgccacagcagctgcagcctctcccacaccaatcccgactgtaacagctcctagtctcggcgctggaggcggaggcggcggcagcgatggatctggcggcggatggactaaacaggtgacctgtcgatactttatgcatggcgtgtgcaaagaaggagataactgcagatacagtcacgacctctcagacagtccttacagtgtggtctgtaagtattttcagcgtggctattgcatctacggagaccgctgtaggtacgagcacagcaagcctctgaagcaggaagaagccaccgcgacagagctgactaccaagagcagtctggcagccagctcttctttgtcttccatcgtcggtcctttggtggagatgaacactggggaagcagaaagccgcaactcaaatttcgcaaccgtaggcgctggctctgaagattgggtgaacgcaattgagttcgtgccaggacagccttactgtgggcgcactgcgccatcttgcactgaggctccattacagggctccgtcaccaaggaagaaagtgagaaggagcagacagctgtagaaaccaagaagcagttgtgcccttatgccgctgtgggagagtgccgctatggtgaaaattgtgtgtacctgcacggcgactcttgtgatatgtgcgggctccaggtcctgcaccccatggacgccgctcagcgctcccagcacattaagagctgtattgaggcacacgagaaagatatggagctgtcctttgccgtgcagcggagtaaagatatggtgtgcggtatctgcatggaggtggtttacgaaaaagccaatcctagtgaacggagatttggaatcttatctaattgtaaccatacttactgcctgaaatgcatccggaagtggcggtcagcgaagcaatttgagtcaaagatcattaaatag

SEQ ID NO: 31145 - DNA, 1557 bp, Artificial Sequence
  Description of Artificial Sequence: Synthetic coding sequence
atggccaagtttgttatcgcaggccgcgccgactgcccatattacgcaaagaccgaattagtggcagactacctgcagaagaacttgccagattttaggatccataaaataactcagcgacctgaggtctgggaggattggctgaaggatgtttgtgaaaagaataagtggtctcataagaactcacccatcatatggcgagaattgctggatcgcggggggaagggactacttctcggtggctataatgagtttctcgagcatgcacagttgtattatgatgtcactagcagcatgacgacagagctaatgatggtgatcgcccaggagaatctgggggcccatattgaaaaggagcaggaggaggaagcactcaaaacatgtattaacccactacaggtgtggatcacgtcagccagtgctcctgcttgttataacctgatccctattcttacttctggtgaggtcttcgggatgcacaccgagatatcaataacgctgttcgacaataaacaggcagaggagcacctaaagtcccttgtagtggaaacccaggacttggcttcaccggtactgagatccgtgagcatttgtaccaaagttgaggaggcctttcgccaggctcacgtgattgtggtgctggatgacagcaccaataaggaagtgtttacactggaggattgtttgaggagccgcgtgcctttatgcagactgtacggctacttgatcgagaagaacgctcacgagtctgtccgcgtcattgtcggcgggcggacgttcgtgaacttaaagacggtgctcctcatgagatacgcaccacggatcgcccataatattatagctgtggcgctcggagtcgaaggtgaagcgaaagctatccttgcaaggaaactgaagacggccccaagttacattaaagacgtgattatctgggggaatatctccgggaacaattatgtggacctgagaaaaacaagagtgtacagatacgagtcggcaatttggggacctctgcattatagcagacccgtgctgaatctgatcttcgacagcgaatgggtgaaacgggagtttgttgcaattctgaagaacctcaccacaactggccggcagttcggaggtatcctcgctgcacacagtatcgcgaccactcttaagtactggtaccatgggagcccaccaggcgagatcgtgagcctgggaatactctctgaagggcagttcggcattccgaagggaattgtattttctatgcccgtgaagtttgagaacggaacttgggtagtgctcaccgacctcaaagacgtggagatctccgaacagatcatgacccgcatgacctccgacctcatccaggagaaactagttgccttgggggataagatacacttccagccataccagtccggacataaagacctggtgcctgatgaggaaaagaatctcgcaatgtccgacgctgctgagtttcccaatcaaataccccaaacgacctttgaaaaaccccagagcctggagttccttaacgagttcgaagggaagaccgtggagagctag

SEQ ID NO: 31146 - DNA, 852 bp, Artificial Sequence
  Description of Artificial Sequence: Synthetic coding sequence
atggctaagttcgtgatcgcggggagggctgattgcccttactatgccaagactgaattggtggcggattatttgcaaaaaaacctcccagattttcgcattcacaaaattacccagcgccccgaggtgtgggaggattggctgaaggatgtgtgcgaaaaaaataagtggagccataagaactcccccatcatctggcgggaactccttgacaggggggggaaagggttactgctgggaggctataatgaattccttgaacatgctcaactgtactacgatgtgacaagctccatgaccaccgaactcatgatggtcatcgcacaggaaaatctgggagcacatatcgagaaagagcaggaagaggaggcactgaagacatgtattaatccactgcaggtatggatcaccagcgagtgggtgaagcgcgagttcgtggcaattctaaaaaaccttactactacagggcggcagttcggaggaatccttgccgcacacagtattgccacaacgttaaaatactggtatcacgggtctcccccaggtgaaatagtatccttgggaatactgtccgagggacagttcgggatccccaaagggattgtcttttctatgccggtgaaatttgagaacggcacatgggttgtgcttactgaccttaaagatgttgagatatcagaacagattatgaccagaatgacaagtgatctgatccaggaaaaactggtggctctgggcgataagatccatttccagccatatcagtccgatacgccacggattaataccctccaccctagtatacagtcttcctggcattctgtactcactatcaccattcgcaaacggtag

SEQ ID NO: 31147 - DNA, 1554 bp, Artificial Sequence
  Description of Artificial Sequence: Synthetic coding sequence
atggctaaatttgtcatcgcgggccgcgccgactgtccctattatgccaagacagagttagtggccgactacttacaaaagaatttgcccgattttagaatccataaaattacacaacgacccgaggtttgggaggactggctcaaagatgtgtgtgaaaaaaacaagtggagtcataaaaactcgcctataatttggcgcgagcttctggaccgaggcggcaagggcttgcttttaggtggttataacgagttcctcgagcacgcccagctttattacgacgtgacgagttccatgactaccgagcttatgatggtgatcgcccaggaaaatctgggcgcacatattgaaaaggagcaagaagaggaggctctcaagacatgtataaacccgctacaagtttggatcacaagtgcctccgctccggcttgctataacttaatcccaattctgacatctggcgaggtgtttggcatgcacaccgagatttcaatcacactgttcgataacaaacaggccgaggagcatctgaagtcactcgtggtcgagactcaggatttggcctccccagtgctccgatctgtgagcatctgcactaaagtagaggaggcatttcgtcaagcacacgtgattgtggtgctcgatgactccactaacaaagaagtgttcaccctggaggattgcctgaggtcccgtgtcccactgtgtagactatacggttaccttatcgagaagaatgcccacgaaagtgtgcgggttatagtgggagggagaactttcgtgaatttaaaaactgttctgctcatgcggtatgcacctcgcattgctcacaatataatcgctgtagcactaggggttgaaggtgaagctaaggcaattttagccagaaaacttaaaactgcaccttcatatattaaggacgtaattatctggggtaacatttccggcaataattatgttgacctgagaaagacaagagtctatcggtatgaaagtgccatttgggggccactacactattctaggccagtgctgaatctcatctttgatagtgaatgggttaagagagagttcgtcgccattctgaagaatcttaccactacaggaagacagtttggcggcatactggcggcacatagcatcgcaactaccttgaagtactggtaccatggatctccccccggggagatagtcagtctaggcattctgtcagagggacagtttggaatacctaaaggcatcgtgttttctatgccagttaagtttgaaaacggcacttgggttgtccttacggatttgaaggatgtggaaatcagcgaacagataatgactcggatgacctctgatctaatacaggaaaagctggtggctcttggggataaaatacattttcagccctaccagtcgggtcacaaagatctggttccagacgaggagaagaacctcgctatgtcagacgccgaattccctaatcagatcccccagaccacctttgaaaaaccgcagtctctggagttcctcaatgagtttgagggtaagactgtggagtcctag

SEQ ID NO: 31148 - DNA, 705 bp, Artificial Sequence
  Description of Artificial Sequence: Synthetic coding sequence
atggaacgtggaggggggggatccggtacggggagcaggcccgagggcactgcacgaggcacctcactcccaggaaaaattgccgagcccggcgccgttaggacgagtcagccgaattaccggccccaggggatggagggcttcctcaagagcgacgagcgacagcggttagccaaggaacgtagggaggaaagagagaagtgcttagctgctagggagcaacagatattagaaaagcagaagagagcgcggcttcagtacgaaaagcagatggaagagaggtggcggaagctggaggaacagaggcaaagagaggaccagaagcgcgccgcagtagaagaaaagaggaagcaaaagctgcgggaggaggaggaacgcttagaggccatgatgagaaggagtctggagagaacacagcagcttgagttaaagaagaagtacagttggggagcacccctagctattggaccaggtggccatgacggggagagcgagaatactccacctcctcctctcggtcttgcggctagtaccctcccaccagatgctggcacgacagccgcagctgcggagagcaccaacgcatgtgataagctgtccacaagtaccatgtccctgcccaagccgactgagcctccaatgaacaagcggctcagctcctcaaccgtggctattagctattcgcccgatcgggacgagaagtag

SEQ ID NO: 31149 - DNA, 2322 bp, Artificial Sequence
  Description of Artificial Sequence: Synthetic coding sequence
atggagcgggggggcggggggtctggtacaggttccagaccggagggcactgctagaggaacaagccttccagggaagatagctgagcctggagccgtaagaacctcacagcccaactacaggcctcagggcatggaagggtttctgaaaagtgacgagcgccagcgcctcgccaaggagcgaagagaagagagggagaagtgcctcgccgcaagggagcaacagatccttgagaaacaaaagcgtgcccgtctacaatatgaaaagcagatggaggagagatggagaaaattagaagagcagcgccagcgcgaagatcagaaacgtgcagcggttgaggagaaacggaagcaaaagctcagagaagaagaggaacggctcgaggccatgatgcgcagaagcttggagcgaacacagcagttagagttgaagaaaaagtattcatggggagccccccttgccattgggccaggtgggcatgacgcatgtgacaagctcagcaccagcacaatgagcctcccaaaaccgactgagcctcctatgaacaaaaggctgagtagttcgactgtggctatcagctactcccccgacagagctcaccacatgcatctttcacccatggaggctatcctggtaagtagacttctgacgcccacccagagctcattagcacggtctcgagcttccgtcatgctttctggccaggccaacgattctgtgttccatgtgtgcccaagactggcacctctcggacccttaaatccctcttataagagttctcctacacggaatatagagaagaaaaaggcgacttccacttctactagcggtgctggcgacgtgggcaaagaagcactaagcggcggtgaggcctctctggtggagaaagtcaaacgcggccagcgaactgccacgagcttgccggttgtcaattttggctcccctctgaggagatgcgaatttagcggaggcatcccaaaaaggcccagcagtcctgttatcagtaagaccgctacaaaggcctatcctcaaagccccaagaccacaaagcctccctacccaggaagcccggtcaagtaccgcctgcctgcactgtctggtcaggatatgcccaaacggaaggctgagaaagaaaagagtaataaggaaagggagggaacactggcccagcaagctgctggaccccagggtgaagaagcccttgagaagcacgttgtggataaacacgcatccgaaaaacacgccgcggcagcagggggcaaagctgagaattccgcagccttgggtaaacctactgccggtacaacagacgctggcgaggcagcgaagatcctggccgagaagcggcgccaggcacgcttgcaaaaggagcaggaggagcaggagcgcctagagaaggaggagcaagataggctcgaacgggaagagctgaagcggaaggccgaggaagagagactccgcctggaggaggaagcgcgcaagcaagaggaggagagaaaaagacaggaggaagaaaagaagaagcaggaaggggaggaaaagcgcaaggccggcgaggaggccaaacggaaagccgaggaggagcttctgctaaaggagaaacaggaacaggagaaacaagaaaaggctatgattgagaagcagaaagaagcagctgagacaaaggcaagggaggttgcagagcagatgaggctcgagcgcgagcagataatgctgcagattgaacaggagaggttggagagaaagaagaggattgatgaaataatgaagcgcacaagaaagtccgatgtatctcctcaggtgaaaaaggaagaccctaaggtgggcgtccagcctgcagtgtgcgttgaaaaaaaaaccaagctcgtggtgccaaataagatggagataaatggcctgaacacctgccaggaagtgaacggggtggatcacgccgctcccgaaacttacccacaggacatcttctccaatgggctcaaacctgccggggggctcatccacctcgatgccttggacgggaaatccaactcgctggacgattctactgaggaggtccagtccatggacgttagcccagtctccaaggaagagttaatttcgatacctgagttctctcccgtgtcagagatgatcccgggcgtgtctctggaccagaatggaacaggaaacgctagagctctgcaggacctgttggacttcacagggccccccacattccctaagcgtagctctgagaacctgtcattagacgattgcaacaagaatcttatcgaagggtttaatagtcctggacaggaaaccccactcaatactttctgctag

SEQ ID NO: 31150 - DNA, 2199 bp, Artificial Sequence
  Description of Artificial Sequence: Synthetic coding sequence
atggaacgtggtggaggtggatccggaactggatcccggcccgaaggaacagcccggggcacgagcctcccaggtaaaatcgccgagcctggcgcagtacggaccagccaaccaaactatcgtcctcaagggatggaaggctttttaaagtccgacgaacggcagagattggccaaagagagaagagaggagcgcgagaaatgccttgccgcacgggaacagcagatccttgaaaagcaaaaacgagcgcgtttgcagtacgaaaagcagatggaggaacgctggcggaaactcgaagaacagcgacagagggaggatcaaaagcgggctgctgttgaggagaaacgcaaacagaagctaagagaggaagaggaacgcttggaggccatgatgcggcgctctttagagagaacccagcagttggaactaaagaagaagtactcctggggcgccccattggcaatcggacctgggggtcatgatgcctgtgataagctgtcgacctccactatgagtctccccaagcccacagagccccctatgaacaagcggctctctagctccaccgttgcaattagctacagcccagatcgagtattccatgtgtgtccacgactggcccctctgggcccattaaacccctcttacaagagcagccccacacgaaacattgaaaaaaagaaagctaccagcacttccactagtggggctggtgatgtgggcaaggaagctctgtcgggcggggaagcatctcttgtggaaaaggtgaaaagggggcaacgtacagctacctccttaccagtcgtcaattttggcagtccgctgaggcgctgcgagttttcaggcgggatcccaaaaaggccttctagtcctgtcatctccaagaccgctactaaagcctaccctcagtctccaaagacaaccaagcccccatacccaggctcacctgtgaagtatagactgcctgctctgtccgggcaagatatgccaaaaagaaaagcggaaaaggagaagtcaaacaaagaacgcgagggcacgcttgcacagcaggcggcaggccctcagggagaggaggctctcgaaaagcacgtggtggacaaacacgcatcagagaaacacgctgccgctgctggtgggaaggccgaaaatagcgcagccctcggaaaaccaactgcgggtaccacagacgcgggtgaggctgccaagattctggctgagaagcgccggcaggcccgcctacaaaaagaacaggaggagcaggaacgcctggagaaagaggaacaggaccggctagagcgcgaggaactgaagcgaaaagcagaagaagagcggcttcggcttgaagaggaagctaggaagcaggaggaggagcgcaagcggcaggaggaggagaagaagaagcaagagggtgaggagaaaaggaaagcaggagaagaggcgaagagaaaagccgaggaagaacttctgcttaaggagaaacaagaacaggaaaagcaagaaaaggctatgatcgagaagcagaaggaagcagccgagaccaaggctagggaagttgccgagcagatgagactggagagagagcagatcatgctacaaatcgagcaggaacgccttgagcgcaaaaaacgtatcgacgagattatgaagcgcactcggaagtcggatgtcagtcctcaggtcaagaaggaggaccctaaagtgggggtccagccagcagtgtgcgtggagaaaaaaaccaagctggtcgtaccaaataagatggaaatcaacggactcaatacatgtcaggaggtaaacggtgttgaccacgcagccccggaaacatatccacaggatattttttctaacgggctgaaaccagcaggcggcctaattcacttagatgcccttgacggcaaaagtaactctctcgacgattctaccgaagaagtacaaagcatggatgtgtcaccagtaagcaaagaagaattgatttccatcccggaattttcaccagtgtccgaaatgatacccggtgtcagccttgaccagaatggaacaggcaatgcacgagccctgcaggacttgctcgatttcaccggccctcctacctttcccaaaagaagcagcgaaaatttaagccttgacgactgtaacaaaaaccttatcgagggttttaattcccctggtcaggagactccgctcaatacattttgctag

SEQ ID NO: 31151 - DNA, 2064 bp, Artificial Sequence
  Description of Artificial Sequence: Synthetic coding sequence
atggaaaggggcgggggcggcagcggtaccgggagcagaccggagggaacggctagagggacgagcttgcccgggaagatcgctgaacccggcgcagtcagaacaagtcaacccaactatcgcccacagggcatggagggttttctaaagtcagatgagcgacaacggctggccaaggaacggcgggaggaacgcgaaaagtgtctggcggcccgcgagcaacaaattctcgaaaagcaaaaacgagccagactacaatacgagaaacaaatggaggagaggtggagaaagctcgaggaacaacgacagagagaagaccagaaacgagccgcagtggaggagaaacggaaacaaaagttacgagaagaagaggagaggctagaggctatgatgcgcaggtctcttgaacgcacccagcagctagagcttaaaaaaaaatatagctggggtgcccccctagccataggtcccggaggacatgatgcaccactcggacccctgaacccatcttacaaaagctctcccacgcggaatatcgagaagaaaaaggccacctcaaccagcacatccggcgctggcgatgtgggtaaagaagctctgtctggaggcgaggcctctctggtcgaaaaagtgaaacggggacagagaactgctaccagcctgccagtggttaatttcggcagtcccctcaggcggtgcgagtttagtggcggtatccccaagcgcccatcgtctccggtgattagcaaaacagccacgaaggcgtatccccagtctcccaaaactacaaaaccgccctacccaggctctcctgtgaaataccgcttgccagcactttccggccaggacatgccaaaaagaaaagcggagaaagagaaaagcaacaaggaacgcgaaggaactctggcacagcaagccgccggaccacagggggaggaagcccttgagaaacacgtggtggacaagcacgcctcagagaaacatgcagctgctgccggtggcaaagctgagaattccgcagcgttgggcaaacccacagccgggaccaccgatgctggggaggcggccaagattctagccgaaaagcgacggcaggcgcgactgcagaaggagcaggaggaacaggaacgtctggaaaaggaggagcaggacagattagagcgagaagaactgaagcggaaagctgaggaagagcgcctgcggctggaggaagaagctaggaagcaggaagaggagcgcaagaggcaggaagaggagaagaagaaacaagaaggcgaggaaaagcggaaggccggcgaggaagccaagcgaaaggccgaggaggagctactgctgaaagagaagcaggagcaagagaaacaggagaaagctatgatcgagaaacagaaggaagctgcggaaactaaagcacgtgaagtagccgagcagatgagattagaaagggaacaaattatgctgcaaattgagcaagagcggctggagcgaaagaagaggattgatgaaatcatgaaacgcacaaggaaatccgacgttagtccacaggttaagaaggaagaccccaaagtgggagtgcagcctgcggtttgcgtcgagaagaagacaaaactcgtcgtcccaaacaagatggaaataaatgggcttaatacctgtcaggaggtgaatggagttgatcacgccgcccctgagacctatccccaggatatattttcaaacgggcttaaacccgccggagggctgattcatctggacgcattagatggcaaaagcaactcactggacgactcgacggaagaggtgcagagcatggacgtttctcctgttagcaaagaagagcttatctcgattccagagtttagtccagtgtccgaaatgattccaggagtctccttggatcagaatggaactggcaatgcgagagcactgcaagaccttctagatttcaccgggcctccaacctttcccaagcggtcttccgaaaacctttccctggatgactgcaataaaaacttaatcgaggggttcaacagtccaggacaggagacaccgctcaatacattttgctag

SEQ ID NO: 31152 - DNA, 2043 bp, Artificial Sequence
  Description of Artificial Sequence: Synthetic coding sequence
atggaaggttttttgaaatcagatgaaagacagagactagctaaggagcgccgtgaggaacgagaaaagtgtttggcagcacgcgaacagcagatcctggagaaacagaagcgggcgcggctacagtatgaaaaacagatggaagaaagatggcgaaagctcgaagaacagcggcaaagagaagatcagaagagggcagccgtagaggagaagcgtaaacagaagttgagagaggaggaagaaaggctcgaggcgatgatgagaaggtctttggaacggactcagcaacttgaactgaaaaaaaagtactcttggggagcgcccttggccattggtccaggggggcacgacgcctgtgataaactctcgacatctaccatgtccctgcctaagccgaccgagccccccatgaacaagcggttaagcagctccactgtagcaatcagctatagcccagatagggcaccactgggacctctgaaccccagctacaaatcttcccctacacgcaacatcgaaaaaaagaaagccacaagtactagcacgtctggggcgggagacgtggggaaagaggctctgagtgggggggaggcgtctctagtcgagaaggtcaaacgaggccagaggactgcgacttcactgcctgtcgtgaactttggttctccgttacggcgttgcgagttcagtgggggcatacctaaaagaccctccagccctgtgatctctaagaccgcaacaaaggcttaccctcagtccccaaaaacaaccaagccaccatacccggggagccccgtcaagtaccggctccccgctctcagtgggcaagatatgccgaaacggaaagccgagaaagagaagagtaacaaggagcgggaggggaccctggcccagcaagctgcagggccgcagggcgaggaagcattagaaaagcacgtggtggacaagcatgcctctgagaagcatgcggcagcggccgggggaaaggccgagaattcagcagccttaggtaagcccactgcaggcacaacggacgcaggtgaagcagcgaagatactagcagagaaaagaaggcaggcacggctacagaaggaacaggaagaacaagaacgcctcgagaaagaggagcaggatcggctggagcgagaagagcttaagaggaaggctgaggaagagcgtctgcggttggaggaggaggccaggaagcaagaggaggaacgcaagaggcaggaggaagaaaaaaaaaaacaggagggagaagaaaagcggaaagcgggggaggaggccaaacgaaaggctgaggaagagctactgcttaaggaaaagcaggaacaggagaaacaggaaaaggccatgatcgagaagcaaaaagaggcagccgaaacaaaggcaagggaggtggccgaacagatgaggctggaaagggaacagattatgctgcaaatcgaacaggagcgccttgagcgtaaaaagcgcatcgatgaaatcatgaagcggacgagaaagagcgacgttagtcctcaggtgaagaaagaggacccaaaggttggcgtgcaaccagccgtgtgcgtggagaaaaaaaccaaactcgtagtgcctaataagatggaaatcaacggactgaatacatgtcaggaggtaaatggggtcgaccacgccgccccggagacatatccccaggatattttcagcaatgggttgaagcctgctgggggcctgatccatctggatgctttagatggaaagagcaattccctggacgatagcactgaagaggtccagagcatggatgtgtctcccgtatccaaggaggagctgatcagcatacctgagtttagccccgtgagtgagatgattccaggggtatctttagatcagaacgggactggtaatgctcgggcattacaggatctcttggattttactggacctcctacctttccaaaacggtcgtctgaaaatctatcgctggatgattgcaataagaaccttatcgaaggatttaacagccctggccaagagacaccgttaaacaccttttgctag

SEQ ID NO: 31153 - DNA, 1854 bp, Artificial Sequence
  Description of Artificial Sequence: Synthetic coding sequence
atgatgagacgatctttagaacgaactcagcaactggaactaaagaaaaaatactcgtggggtgcaccacttgcgataggaccaggaggacacgacggccttgccgcgagcaccctgccccccgacgcggggaccactgctgccgcggctgaaagcacaaatgcttgtgataagttatccacttcaacaatgagccttccgaaacccactgagccacctatgaataagcggctcagttccagcacagtggccatatcttactcaccagatagggcaccacttgggcccctgaatccaagttacaaatctagccccacgcgtaacatagaaaaaaaaaaagcgacgtccacctctacaagcggcgccggcgatgtgggaaaggaggccctctctggtggagaggcgtccctggtggaaaaggttaaacgaggccaaagaaccgcaacaagcctgcccgttgtgaatttcggcagccctttgcgccgctgtgagttttcagggggtattcccaagcgcccatcctccccggtaattagcaagaccgcgaccaaggcttacccacaatctcccaagacgactaagcctccatatcctggctccccagtgaagtaccggttacctgccctctcaggtcaagatatgccaaaaaggaaggctgagaaagaaaagagtaacaaagagcgggagggtacattggcacaacaggccgctggccctcaaggcgaagaggcactcgagaagcacgtcgtggacaaacacgcttcggagaaacatgccgctgcagcaggaggcaaggccgagaattccgctgctctggggaaaccgactgcgggtaccacagacgcaggagaagcagctaagattctggccgagaagcgcaggcaagccaggctgcagaaggagcaggaagagcaagagaggttggaaaaagaggagcaagatcgactggagagagaggagcttaaacggaaggcagaagaagaacggttgagactcgaggaggaagcaagaaagcaggaggaggagaggaagcgtcaggaagaagaaaaaaagaagcaggaaggtgaggagaagcgcaaggctggagaagaggccaagagaaaggcagaggaagagctcctgcttaaggagaagcaagaacaggaaaagcaggagaaagcgatgatcgaaaagcagaaggaggctgccgagacaaaggcccgcgaagttgcagagcagatgagattagaacgtgagcagatcatgttgcaaattgaacaagagcgtctagaaagaaaaaagaggatcgacgagatcatgaagcggacccgcaagagtgacgtctctccccaggtgaagaaagaagatccgaaggtgggagtgcagcccgccgtttgcgtggagaagaaaacgaaactggtcgtgcccaataagatggagataaacggcctgaatacatgccaagaggtgaacggagtggatcacgccgcccctgaaacataccctcaggatatatttagcaacggcctgaaacccgccggcggtctgatccatttggatgcgttggacggtaaaagtaacagcctggatgatagcacagaagaagtccagagtatggacgtgagccccgtatccaaggaggagcttatctctattccagaattcagcccagtgagcgagatgatccctggtgtgtcgctggatcaaaacgggacgggtaacgctcgcgcattacaggatctcttagactttacagggccccctacttttcctaagcgatccagcgagaatttgtcgctcgatgattgtaacaaaaacttgatcgagggcttcaattccccagggcaagaaacgcctctgaataccttctgttag

SEQ ID NO: 31154 - DNA, 1248 bp, Artificial Sequence
  Description of Artificial Sequence: Synthetic coding sequence
atgcgcggacgtgactggccgaagaaggacgagaagaaagaaaagaacgtctggctgcttggtagtaatcgtagctggaggaaccgcaaggaacccggctgttcgactaagagcaaatggaggtctgacggagagaactggaaatctagcggaagcggccgtacgaagagggagctcttgtggaaacgcaagggaaattctgctgcactggggaaacccactgccgggacaactgatgccggtgaggccgctaaaatattggcagagaaaaggagacaagcccggcttcagaaagaacaagaggaacaggaaaggctggagaaagaagagcaagatcgcctggagagagaggagctgaaacgcaaagctgaggaggaaagacttagactggaggaagaggcgcgtaaacaagaggaagaaagaaagagacaggaagaagagaagaagaaacaggagggggaggaaaagagaaaggcgggcgaggaggccaagcggaaggccgaggaggagctactgctgaaggaaaagcaggagcaggagaagcaagagaaagccatgatcgaaaagcagaaagaggccgccgagacaaaggctcgagaagtcgccgaacagatgaggcttgaaagagaacagattatgctgcagatagagcaggagcggttggagcgcaaaaagaggatcgacgagatcatgaagcggacgaggaaatccgacgtgtcaccccaggtaaagaaagaggacccaaaggtgggcgtgcagccagccgtctgcgtggagaaaaagactaagcttgtggttcccaataagatggaaatcaacggtcttaacacctgccaggaagtcaacggcgtcgatcacgctgccccggaaacttatccacaggacatcttctcaaatggtctgaaacccgccgggggcctgattcatcttgatgctctcgatggcaagtccaacagtctcgatgactcgactgaggaagtacagtcaatggatgtgtctcccgtctccaaggaagagcttatctcaatcccagaattcagcccagtatccgagatgatcccgggggtgagtctcgaccagaacggcacaggtaacgcgagggcgctgcaggatctgttggacttcacaggcccacccacattcccaaagcgaagctctgaaaacctcagcctggatgactgcaataaaaacctgatcgaggggtttaacagtcctggccaggagacgccacttaatactttttgctag

SEQ ID NO: 31155 - DNA, 522 bp, Artificial Sequence
  Description of Artificial Sequence: Synthetic coding sequence
atgttgccaccaccccctcgccagccgccaccccaggcccgggccgctcgcggggctgttcggctccaacggcccttcctgcgtagtccccttggtgtcctgcggttgctgcaactgttggcaggcgctgctttctggataacaattgccactagtaaatatcagggtcctgtccatttcgccctcttcgtctccgtacttttctggcttctgacactaggcctttattttctaactttgttgggtaaacacgagcttgtcccggtgctcggttctcgctggctcatggtcaatgtagcccacgacgtgctggcagccgcgctctatggagcagcaacaggaatcatgagtgaccagatgcagcgccattcatattgcaacctcaaggactaccccctgccttgtgcctaccacgctttccttgccgcagccgtgtgcggtggcgtttgccatggactgtatttattgagtgcgctgtatggctgcggccgccggtgtcaaggaaagcaggaggttgcctag

SEQ ID NO: 31156 - DNA, 1158 bp, Artificial Sequence
  Description of Artificial Sequence: Synthetic coding sequence
atgcagacaagttccaaaccctccgattttctgaatctggccaagaaaaagcggaagttctccgagctgctgactaccgtagttttgctttgcctgttaactccctcttggacttcgactgggcgcatgtggtcgcacctcaacaggctcctgttttggtccatattctcctccgtaacctgtcggaaagctgtgctagactgtgaggcgatgaagactaatgagtttccgagtccatgcctcgattcaaaaacgaaggtagtgatgaagggtcagaatgtctcaatgttttgttcacataagaacaaatcactgcagataacgtactccctgtttcgacgcaaaacgcatctgggtacacaggatggcaagggtgaacccgccatttttaatctgtccattacggaggcccacgaaagtggaccctataagtgcaaagcccaggtgacatcatgttctaaatactcacgcgatttttcattcacaatcgtggacccagttactagcccagtcttaaatataatggttattcagaccgagactgatagacatatcaccctgcattgcctgtcagtgaacggctccttgcccataaactatactttctttgagaatcatgtcgccattagcccagcgatttcaaagtacgatcgtgagccagcagagtttaacttaactaaaaaaaaccctggcgaggaggaagaatatcgctgcgaagcgaaaaatcgcctccctaactacgccacatattcacatccagtgaccatgccaagcactggaggcgacagctgcccattttgtctcaagttgctcctgcccggcctgctgctgttgctggtggtgataattctgatcctcgccttttgggtgttgcctaagtacaagactagaaaggctatgcggaacaacgtcccccgagacagaggcgacaccgccatggaggtaggcatatacgcaaacattctcgagaaacaggctaaggaagagtccgtgccagaagtgggctcccggccttgcgtttcaactgcccaagatgaggcaaagcattctcaggaattacagtacgcgactcccgtgttccaggaagttgcacctagggagcaagaggcttgtgactcctataagagcggctatgtctattctgagcttaatttctag

SEQ ID NO: 31157 - DNA, 1413 bp, Artificial Sequence
  Description of Artificial Sequence: Synthetic coding sequence
atgaaatttctactgatcctgcttctgcaagccacagccagcggggcactccccttgaacagctcaacctcgctagaaaaaaacaatgtgcttttcggagagcgctatctcgagaagttttacgggctggagattaacaaactgcctgtgacgaaaatgaagtattccggaaacctcatgaaggaaaaaatccaggaaatgcaacattttctggggctgaaggttaccggtcagctggacactagcaccctagaaatgatgcacgcgcccagatgcggtgttccggatgtgcaccactttcgcgagatgccgggcggtcctgtttggcgcaagcactacatcacatatcgaatcaacaattatacaccggacatgaacagggaagacgtggactacgcaataaggaaagctttccaggtgtggtccaacgtgactcctctgaagttctcaaaaatcaacacaggcatggccgatattctcgtggtgtttgcacgcggagcacacggggactttcacgctttcgatggtaaaggaggcatcctggcacacgctttcggtcctggaagtggaatcggaggcgacgcccatttcgacgaagatgaattctggaccacgcactcaggcggaacaaacttattcttgacagccgtccacgagattggccattctcttggtcttggtcactcatccgacccaaaggctgtgatgttccccacttacaaatatgtggacatcaatacattcaggctgagcgctgatgatatacggggaatacagagcctgtatggtgatccaaaagagaaccagcgtctgcctaaccctgacaactctgagccagctttatgcgaccccaacctgtcgtttgatgcagtgaccactgttggcaacaaaatcttctttttcaaggaccggtttttctggttgaaggtttctgagcggccaaagacttccgtgaatttgatctcatcgctgtggcccactttaccctccgggatcgaagcggcctacgagatcgaggcacggaatcaggtgttcctcttcaaggatgacaaatattggctgatcagtaatcttcggcccgagccaaactaccccaaatccatccattccttcgggttcccaaacttcgtcaagaaaattgacgccgcagttttcaatccccgtttctatcgtacatatttcttcgtggataaccagtactggaggtatgacgagcgccggcagatgatggaccctggataccccaagctgatcactaagaactttcagggtatcgggccaaaaatcgatgcggtattctactccaaaaataaatactattacttcttccagggctctaatcagtttgagtacgatttcctgttgcagagaattaccaaaaccttaaaaagtaattcctggtttggatgttag

SEQ ID NO: 31158 - DNA, 324 bp, Artificial Sequence
  Description of Artificial Sequence: Synthetic coding sequence
atggccggcgaagatgtaggggcccctcctgatcatctgtgggtccaccaggagggcatctacagggacgagtaccaacgcacctgggttgctgtcgtagaagaagaaacctcctttctcagagcgagagtccagcaaattcaggtcccgcttggcgatgctgctcggccttctcatctgctgacgtctcagcttcccctcatgtggcagctgtacccagaggagcggtatatggataataacagcaggctgtggcagattcagcaccacctcatggtgagaggcgtgcaggagttactgctgaaactgttgccagacgattag

SEQ ID NO: 31159 - DNA, 3345 bp, Artificial Sequence
  Description of Artificial Sequence: Synthetic coding sequence
atgctcagctgtctgaaagaagagatgccgccgcaggaacttacccggcgcttagctaccgtcatcacccacgtagacgagataatgcagcaggaggttcggcccctaatggctgtggaaattattgagcagctccacaggcaattcgcaatcctgtccggaggacggggggaggatggcgcaccaatcatcacttttcctgagttcagcggctttaagcacatccccgacgaagattttctcaatgtcatgacttacctgacatccatacccagcgtagaagccgcttccatcggattcattgtggtcatcgatcggagacgcgataaatggagttcggtcaaggcatcactcactaggattgccgtggccttccctggcaacttacagttgatctttattttacgtccgtctagatttatccagagaacatttaccgatattgggattaaatactaccgtaacgaattcaagaccaaggttccgattatcatggtcaatagtgtgagcgatctacacggatacatcgacaagtcccagctgacccgcgaactggggggaactcttgagtaccgacacgggcagtgggtgaaccatcgtacagccatcgaaaacttcgccctcactctgaaaaccactgcgcagatgctgcagactttcggatcttgcctagcaactgcggaactccctaggtctatgctgtcaacagaagacctcctcatgtcacacacaagacagcgcgataaactacaggatgagctgaaacttctgggaaagcaagggactactctgctttcatgcatccaggagcctgcaaccaagtgtccaaactcaaagctcaacttgaatcagctagaaaacgtgacgactatggaaagattactggtacagctggacgaaaccgagaaggcgttttctcatttttggtctgagcatcatctcaagctgaatcagtgtttacagctgcagcattttgagcacgatttctgtaaagcgaaattagccctggacaatctcctagaggaacaggctgaatttaccggaatcggtgactcagttatgcatgttgagcaaatcctgaaggagcacaagaagctggaagaaaagagccaggaacctctggaaaaggcacagttgttggctttggtaggtgaccaactgatacagagtcaccactacgccgcagacgctattcgtcccagatgtgtcgagttgcgccacctctgtgacgactttattaacggaaacaagaaaaaatgggacattctgggtaaatccctggagtttcataggcagctggacaaggtgagtcagtggtgcgaggcaggaatttatttgcttgccagtcaggcggtggacaagtgccaatctcgagagggcgttgacatagctcttaatgacatagcaacatttctcggaactgttaaggaataccccttgctcagcccaaaagagttttataatgagttcgagctgctattgacacttgatgcgaaggccaaagctcagaaagtgcttcagaggcttgatgacgtgcaggagatttttcacaaacgccaggtctcattaatgaagcttgccgcaaagcagactcgacctgtccagccagtcgccccccaccccgagagttcacccaagtgggtctccagtaagacttcgcagccttctacatctgtgccccttgctaggcccctaagaacatccgaggaaccctacacagaaaccgagttaaacagtagggggaaggaggacgacgagacaaagtttgaagtcaaaagcgaggaaattttcgagtcccatcacgaaagaggaaaccccgagctcgaacaacaggcccgtctaggcgatttgtctcctcgacggaggattatcagagatctgctcgagacagaggagatatatattaaagagattaaatccattatagacggttacatcacaccaatggatttcatctggctcaaacacctaatccctgatgtccttcaaaataataaggatttcctgttcggtaacattagagaactctacgaattccataacagaaccttcctcaaggagctggaaaagtgtgcagagaaccctgagcttctggctcactgctttctgaagcgaaaagaagatctgcaaatctattttaagtaccacaaaaacctgcctagggctagggcgatatggcaagagtgccaagactgtgcttactttggagtgtgtcaacgccaacttgaccacaacttgcccctgtttaagtatctgaagggtcccagccagcggctgatcaagtatcagatgctgctgaagggactgcttgactttgagtcaccagaggacatggaaatcgaccccggggaactaggaggtagcgctaaagatggccctaaaagaacaaaagacagtgccttttccacagaactgcagcaggcgttggccgtgattgaagatctgattaaaagttgcgagttggcggtagacctcgcggcggtaaccgagtgccctgatgatattgggaaattggggaaactcctgctgcacggacctttttccgtatggactatccacaaggataggtataagatgaaagatcttatccgcttcaaaccgagccagcgccagatttacctgtttgaaagaggcatcgttttttgcaagatccgcatggagcctggtgaccaaggccttagtccccactattcttttaaaaaaaccatgaagctgatgaccctgagtatcagacagcttggtagaggatctcaccggaagttcgagatcgcaagcagaaacggcttggagaagtacatcttgcaggccgcgagcaaggagattcgggactgttggttctccgagatttccaaactgttgatggaacagcaaaataacatcaaggaccagggcaatccacaatttgagatgagcacttcaaagggttctggggcggggagcggcccatggatcaaaaatatggaacgggccacgacctcaaaagaagaccccgcctccagcactggcggtatcaagggttgttccagccgtgagttcagctcaatggacacattcgaggactgcgaaggtgccgaagacatggagaaagaatccagcgctctttcactcgccggtctgtttcagtcagatgactctcatgaaacctgttcatctaaatcagctttcctggaacgaggagagtcctctcagggagaaaaagaggagcgtgatgaggaagaaaccgccactcgatccaccgaggaggagagggcaggagcaagcaccgggagacttgcccctgcaggagctaccgccggattccaggcccgagctctcaggccgcgaacctcagctcaggagtcttag

SEQ ID NO: 31160 - DNA, 1887 bp, Artificial Sequence
  Description of Artificial Sequence: Synthetic coding sequence
atgctaagctgcctgaaggaagagatgcctcctcaggaactgactcggagactggcgacagtaattacccacgtcgatgaaataatgcagcaagaagtgcggcctctgatggcggtcgagatcatcgagcagctgcataggcaattcgcaattttaagtggcggccggggggaggacggagcccctattataacatttccagaattcagtggatttaagcacataccagacgaggactttctcaatgtgatgacataccttacaagtattccctccgtggaagcggcatctatcggctttatcgtggtgatcgaccgaagacgggataaatggagcagcgtgaaggcatcacttacacggatcgccgtcgcatttcccggtaaccttcagcttatctttatcctgaggccctcaaggtttatccagcgtacatttactgatataggtatcaaatattataggaacgaattcaagactaaggtacctattataatggtgaatagtgtgagtgacctacatgggtacatcgataaatcccaactgacgcgcgagcttggggggaccctcgaatatcggcatgggcagtgggttaaccatcgaacagccatcgagaactttgccttgacactgaaaacaacagcccagatgctacagacatttggctcatgccttgcgactgccgagctccccagaagcatgctgagtacagaagaccttctgatgtcacacacaaggcagcgggacaagctgcaggacgagctgaagctgctgggaaagcaggggactaccctgctgtcatgcatccaggaacccgctactaagtgcccaaacagcaaactcaatctaaatcagctggaaaatgtcactacgatggagcgtctgctcgttcagctggacgaaaccgaaaaagccttctctcacttttggtccgagcatcacctgaagctaaatcaatgtctgcagctccagcatttcgaacatgatttttgcaaggccaaactcgctctcgacaacctgttagaggagcaggcagagtttactggcataggtgatagcgtgatgcacgttgagcagatacttaaagagcataaaaagctggaggagaagtcccaggagcctctggaaaaggcacaattactagctctggttggggatcagctgatccagtcccaccactatgccgccgacgctattaggcccaggtgcgtggaattgcgccacctgtgcgatgacttcattaacggcaataaaaagaagtgggatatactgggtaagtccctcgaattccatcggcagctggacaaggtatcccaatggtgcgaagccggtatatatttgctggcttcccaggctgtcgataaatgccaaagtagggagggagtcgatatagcactcaacgacatcgctacttttctaggcacagtgaaggagtaccctctcctgtctcccaaagagttttataatgagttcgagttgctcctgacgttggatgccaaagcaaaggctcagaaagtgcttcagagactggacgatgtgcaggaaatcttccacaaaaggcaggtctcgcttatgaagctggccgctaagcagacacgacccgttcagcccgtggcgccacaccccgaaagcagtcctaaatgggtgtcatccaagaccagccagccttctaccagtgtgcctctcgctagacccctacggactagtgaagagccctatactgaaactgagttgaatagcagaggtaaagaggatgacgaaaccaaatttgaagttaagtctgaagaaatatttgagtctcaccacgagagaggaaaccctgagctggaacagcaggccaggctgggcgacctgagcccccggaggtattcctctcagtatttcaagtag

SEQ ID NO: 31161 - DNA, 519 bp, Artificial Sequence
  Description of Artificial Sequence: Synthetic coding sequence
atgcacgttgaactccgccacctgtgtgacgacttcattaacggaaataagaaaaagtgggatatcctaggtaaaagtctggaattccacagacagctggacaaggcaaaggcccagaaagtgctgcagagacttgacgatgtccaggagatcttccacaagaggcaagtttccctcatgaagttggccgccaagcagacgagaccggtccagcccgttgccccccatccggagtcttccccaaaatgggtcagctctaagacctctcagcccagtacttcagtgcccctggcgaggccattacggacctctgaggaaccatataccgaaaccgaactgaactcacgcgggaaggaggatgacgagaccaaattcgaggttaaatccgaggaaatcttcgaaagccaccatgaacgcggaaaccccgaactcgagcagcaagctagactgggagatcttagcccacggtcagtcattaccgtatgcgtttgtgagatgctaacccttggagtgcagtag

SEQ ID NO: 31162 - DNA, 2136 bp, Artificial Sequence
  Description of Artificial Sequence: Synthetic coding sequence
atgctgagctgcctgaaagaggagatgcctccccaagaactgactcggagactggctaccgtgattacccatgtcgatgagataatgcagcaggaggtaagaccgctcatggcagtcgagattattgaacagttgcatagacagttcgccatattgtccggcggccgcggtgaggacggtgccccgatcatcactttccctgagttcagcggatttaaacacattccagacgaggacttcctgaacgtgatgacttacctgacttcaatcccatccgtggaagccgccagtattggattcatcgtggtgatcgatcgccgacgtgataaatggtctagtgtgaaggcttctctcactcgtattgctgtggccttccccggaaacctccagctcatcttcatcctacgacctagtaggttcatccagcgcactttcacggacatcggaatcaaatactatcggaacgagttcaaaaccaaagttcctattattatggtgaattcagtaagcgacctacacggctatatcgacaaatcccagttaacaagggagctcggtggaaccctagagtatcgccatggccagtgggtgaatcatcggaccgccatcgaaaatttcgctctcacactgaagacaaccgcccagatgctacagacctttgggtcttgtctcgccacggcagagctgcctagaagtatgctgtctactgaggatctccttatgtcacatactcggcagagggataaactgcaagatgagttaaaattactgggcaagcagggtacgactctccttagctgtattcaggagcccgcaaccaagtgcccgaactcaaaactgaacttaaatcaattggaaaatgtgacgacaatggagaggttgttagttcaactggacgagactgagaaggccttctctcacttttggagcgagcaccacctgaagttgaatcagtgtttgcaactccagcactttgagcacgatttctgtaaggcgaagctcgctctggacaacctgctcgaggagcaggccgaattcaccgggattggggactcagtgatgcatgtggaacagattctaaaagaacataaaaaattagaggagaagagccaggagccccttgaaaaagcgcagttactggccctggtaggagatcagctgatccagtcccatcattatgcagccgatgccattcggccacggtgcgtagagctcagacacctttgcgacgactttatcaatggcaacaaaaaaaaatgggatatactcggcaagagcctcgagtttcatcgccagctggacaaagtctcgcaatggtgtgaggcagggatctacctgttagcaagccaagccgttgataagtgccagagccgggagggggtagacatcgccctgaatgatatagccacattcctcggcacagtcaaagagtatccattgctatccccaaaggagttctataatgagttcgaacttctgctcactctggatgccaaggccaaggcccaaaaggtcctccagaggctcgatgatgttcaggagatctttcacaagcgtcaggtgtcactgatgaagctggccgcgaaacagacccgcccagttcagcccgtggcccctcaccccgaatcgtctcccaaatgggtctcttcaaaaacgagtcagcctagcacctctgtcccgttggctcgccctctgaggactagtgaagagccttacaccgagaccgagctgaattcaagagggaaggaggacgatgaaaccaaattcgaggtgaagtctgaagagatattcgagagccatcacgagagggggaatcctgagctggaacaacaggcccgcttgggggatctatcccccagacgccggatcatccgggatctgctagaaacagaggagatttacatcaaggagatcaagtcaatcatcgacggctacattacgcctatggattttatctggctgaagcaccttatcccggacgtactgcagaacaacaaggactttctctttggtaacatacgggagttgtacgaattccacaatcggacttttctaaaggagttagaaaaatgcgcagaaaaccccgaactactggcccattgcttcctgaaaagagtgtccctttatagtcaatag

SEQ ID NO: 31163 - DNA, 3225 bp, Artificial Sequence
  Description of Artificial Sequence: Synthetic coding sequence
atgcttagttgtttaaaggaagaaatgccaccccaagagctgaccagaaggctggccactgtgatcactcatgtcgatgagataatgcagcaggaggttagacccctaatggctgtggaaattatagagcagctgcataggcaatttgcaatcctctcagggggtcgcggagaggatggcgcgcccattataaccttccctgaattttccggttttaagcacatcccagacgaggactttctcaacgtcatgacttatttaacttccatcccatcagttgaggcagcatccattgggtttatcgtcgtcatcgacagacgccgcgacaaatggtcatctgtgaaagcctccctgacgcgcattgcagtagcatttcccggaaaccttcagctgatatttatattgaggcctagtcggttcattcagagaacatttactgacatcgggatcaagtattaccggaatgaatttaagactaaggttccgataattatggtgaatagcgtgagtgaccttcacggatacatcgataagagccagctcacacgagaactgggcggaactctggagtaccgacatggccaatgggtcaaccacaggaccgccattgaaaacttcgccttgaccttgaagacaacagcccaaatgctgcaaacctttgggtcatgtctcgccactgccgagctgcctaggtccatgctgagtacggaggatctcctgatgtcccatacacggcagcgtgataagctccaggatgagctaaaattgctgggcaaacaaggcaccaccctgctgtcatgcattcaggagcctgcaacgaagtgtcctaattcgaaactaaacctgaatcaactcgaaaacgtgaccacaatggaacgactgttagtccagttggacgagacagaaaaagccttttcacatttctggagcgagcaccacctgaagctcaaccaatgtctgcagctgcagcactttgaacacgacttctgcaaagctaaactcgccctggataatctgctggaggaacaagccgaatttacagggatcggcgatagtgtaatgcatgtggagcagatcctgaaggaacacaagaaactggaggagaagtcccaggagcctctggagaaggcccaactcttggccctcgttggcgaccagctgatccagagccaccattatgccgctgacgccattcgcccaaggtgtgtggaactgcgccacttgtgtgatgacttcatcaacggcaataagaagaaatgggatatactgggaaagtcactcgagttccatcgtcagctggataaggtgagtcagtggtgcgaggctgggatttatttgttggcctctcaggccgtcgataagtgtcagtcacgggaaggtgtcgatatcgcgttgaacgacattgcgacattcctcgggactgtaaaagagtacccgcttttgagcccgaaggaattttataatgagttcgagctgttactaactctcgatgcaaaggcaaaggcacagaaagtactccaacggctcgacgacgtacaggaaatctttcataagcggcaggtgtccctcatgaaactcgcggccaaacaaaccagacccgtacagcctgtggcccctcatccagaatcctctccgaagtgggtatcaagcaagaccagtcagcctagcacctccgtccccttggctcgcccacttaggaccagtgaagaaccctataccgaaaccgagttaaattcacgggggaaagaggatgatgaaaccaagtttgaagtgaaaagcgaggagatcttcgagagtcatcatgagagaggcaatcctgagcttgagcagcaggcccggttgggcgatttgtcccccagacggaggattatcagagatcttctagagacggaggagatctacattaaggagatcaaatccataattgatgggtatatcacgcccatggattttatctggctgaagcacctgattcctgatgtgcttcagaacaataaggactttctgtttggaaatattagggagctgtacgagtttcacaaccggacgtttctgaaagaactggaaaaatgcgcagaaaaccccgagctcctggcccactgctttctcaaaagaaaagaggacctgcagatttactttaagtaccataagaatctccctagagcccgggcgatttggcaagaatgtcaggattgcgcatatttcggggtctgtcagcgccagctggaccataaccttcctctctttaaatatttaaaaggaccgagtcagaggcttatcaaataccaaatgctgctgaagggcctgctggacttcgagtctcccgaggatatggagattgacccaggtgagctcggaggcagtgctaaggatggtcccaagcgaaccaaggactccgcgttctctactgaattacaacaggcattggccgttattgaggacctcatcaaaagctgtgaactagccgttgatctggccgcggtcaccgagtgtccagatgacataggtaagcttggcaagctcctcctgcacgggcccttctccgtgtggacaattcacaaagatcgctacaagatgaaagatctgattagatttaaacctagtcaacggcagatttatttgtttgaaagagggatagtcttttgcaaaatcagaatggagcctggtgaccaaggcctgagtccccactacagtttcaagaaaacaatgaaacttatgaccttgtcaatccgccagttggggaggggatcacaccgaaaatttgaaatcgcaagtcggaacgggctagagaagtatattttgcaggccgcgtctaaagaaattagggactgctggttctctgaaatatcaaagctgctaatggaacaacagaacaatatcaaggatcaggggaaccctcagttcgagatgtccacaagtaagggttcaggggccggcagtggtccttggattaaaaacatggagagagctaccaccagcaaagaggatcccgcatcgtcaactggcggtattaaggggtgttcgtcccgcgagttttcttccatggacacctttgaagactgtgagggggctgaggacatggagaaagaatcgagcgctctctctcttgcggggctgtttcagtccgatgacagccatgaaacttgcagctctaagtccgcctttctggagcgcggggagagttcacagggtgaaaaggaggaacgggacgaggaggaaacctag

SEQ ID NO: 31164 - DNA, 360 bp, Artificial Sequence
  Description of Artificial Sequence: Synthetic coding sequence
atggaagagcctgagatgcagctgaaagggaaaaaagtgaccgataagttcaccgagtccgtctatgtcctagcaaacgaaccgtctgttgctctttacaggttacaggagcatgtgaggcgatccctccccgagctggctcagcacaaggccgatatgcaacgatgggaggagcagtcccagggagccatctatacagtcgagtacgcctgtagtgctgtcaagaaccttgtagactcatctgtgtacttcaggagtgttgagggcctgctcaagcaggccattagtatccgagaccatatgaatgcctccgctcagggccactcccctgaagaacctccaccaccttcctctgcctag

SEQ ID NO: 31165 - DNA, 330 bp, Artificial Sequence
  Description of Artificial Sequence: Synthetic coding sequence
atggaagagcctgagatgcagctgaagggcaaaaaggtgacagacaagttcacagaatcggtttatgtgctggctaacgagccatccgtcgctctctatagactgcaggagcacgtgaggcggtctctccccgagctggctcaacacaaagccgatatgcagcgctgggaagagcagtctcaaggcgccatctacacagtggagtatgcctgctccgccgtgaagaatttagtggattcgagtgtgtattttcggtccgtggaaggcctcctgaagcaggccatctctatccgcgatcacatgaatgcctccgcccagggtcatcgatag

SEQ ID NO: 31166 - DNA, 717 bp, Artificial Sequence
  Description of Artificial Sequence: Synthetic coding sequence
atgctggccctcacactggccaaggcagacagcccgagaaccgctctgctgtgtagtgcttggctgctgacggctagcttctcggcccaacagcacaaggggagcctgcaggtccatcaaaccctcagtgtggaaatggaccaagtgctgaaagctttaagttttcccaaaaaaaaagcagccctgctgtctgcagctatcttatgtttcttaaggaccgctctccggcagtcgttcagcagcgctctggtggcattagtgccatctggtgcccagcctttgcccgccacaaaggatacagtccttgctcccctaagaatgagtcaagtcaggtctctggtgatcggcctgcagaatcttctcgtccagaaagaccccttgctgtctcaggcctgcgttggatgcctggaggccctgctcgactacctggacgcccggagccccgacatagctctgcacgttgcctcacagccatggaatcggtttctcctgttcaccctcctggatgctggtgagaatagtttcctgaggcctgaaatcctgcgtttaatgacactccttcagagcatgggccatctcgcggaccactccatggcacaaacactgcaggcctcgctagaagggctacctccctccacgagctctgggcagcctcctctacaagatatgttgtgtctcggcggagtggcggtgagtttaagccatataaggaactag

SEQ ID NO: 31167 - DNA, 1824 bp, Artificial Sequence
  Description of Artificial Sequence: Synthetic coding sequence
atgtgtttaaatctgttatctgcccccgagaagactggaccaccatccaaagaggagctctctgccgtgagcgagctgcttcagcatgggctgccgcaaatctcctcgcgaagccccgagtctctggcatttctctcagatcgtcagtacatggagggcgcggccaggcagaggcaatattgtatcctcttgttgttctatcttgcatacatccatgaggatcgcttcgtgtctgaagcagagctgtttgaagccgtgcagtcgtttttactgagtctgcaggatcagggcgaaagacccccgcttgtcgtgtttaaggcgtcaatatacttgctagctatctgccaggataaggacaataccctgcgtgagaccatggtctcggccatccgaaagttcctcgagggtattccagatctacaactcgtctatacgcaccaccccttgctgctccgttttttcctcctttacccggagctaatgagccgctatggacatcgcgtgttggagctctggtttttctgggaggaatccagctacgaggaactggatgacgtcacttctgcgggacaacccgccctgcctgccagcctggtagtattgttccagttgctgcgctcgatcccgtcaatcctgttaatcctgctggatctaatctattcatcacccgtggatactgctcataaggtccttatcagcctcaggacgtttttacggagaaatgaggatattcaggtgggtgggctgatccgtggacatttccttctaatattacagaggttgctggtggaacatggcgcctctccttccggggtgagtaagctgtgtgggaagtgttccccaacagacgtggatatccttcagcctagctttaattttctgtattggtccctccaccagacaacaccgtccagccagaagcgcgccgccgctgtcctgctgtctagcacggggctgatggaattgctggagaagatgttggcactgacccttgccaaggccgattctcccaggacagcgctcctgtgctctgcctggttactcacagcttccttttctgctcagcagcataaaggatcccttcaagtccatcaaaccctctcagtagagatggatcaggtgctgaaagccttatcatttccgaagaaaaaagctgctctgctctcagcggcgatactgtgcttcttgcggaccgctctgcggcagtccttcagtagtgcactggtggctttggtgccatccggagcccagcccctgcccgccacgaaggacactgttctcgcaccccttcgcatgagtcaggtcagaagtttggttatcgggctccagaatctgctggtgcagaaggatccactactgagccaggcctgcgtgggttgtctggaggctcttctggactatcttgacgccagaagtcctgatatcgcgcttcatgtggcctcccagccttggaatagattcctcctcttcacccttctggatgctggagagaattcctttctaagacctgaaatcttgcgactgatgacgctgtttatgcgatacaggagctccagcgtcctttcccacgaagaggttggggatgtgttgcagggtgtcgccttagcggatctatcaaccctgtctaacactaccctccaagctttacatggattcttccaacagctccagagtatggggcatctggcagaccattcaatggcccaaactctgcaagcctcccttgaaggcctccctcctagtacttcttctgggcaaccccccctgcaggacatgctatgcctgggcggtgtggctgtcagcttatcgcacattaggaattag

SEQ ID NO: 31168 - DNA, 3825 bp, Artificial Sequence
  Description of Artificial Sequence: Synthetic coding sequence
atggcagtgaggcaggcagctacagccggcacgcctgggccccggagggaagaggaggctgccttgctcttcgagcgggcacactatcgacacgacccaaggtggctcctgcctgttacaccacgactgtgccttgcttgcgctttggaacttttacctgaccctggcgtgtcactcgtgcgtaaaaaacacatgctgtcctgttttcaggacgctcttgttcgccacacatccttagttacccaactggtgtcccaagaccagagggtgtgtattcactttatatcggtgttgtttgggttgctttgcagcatggaagatgggtcagtcaccgatttatgcatagaggtattgattcaaattaccacacagctcaagctcgaacagacgatccgctgtctgttagacgagtgccataaggagctgtgcaatatgcctagcatgaggggcagcctcgccacacttacgctgctgggcaagttggtcgacgctatccccgccttagcagacgaactggttatggagcatggtaatctaatggaacacctactgcgtggtttggtctatcccagcgagggaatccaggcaagcgtgtgttatctctacggtaaactgtacagcagccctgtggccgccgagatgctcagcgggcattttcgggaaaagctgtttcccttatttctatcaattttagacggagcacagactaaagagttgcagataaattgcttaggcttgctaagacagctcttaaagtacgatctgttcgtttctatgattatgaaccaggacggactcggggaatcggccaagaatatagagggctcctcagggaacaccagtttaccattggtgctgaaaaaactgctgctcagccgggacgaaacactgcaagtggcctccgcccattgtatcactgccgtcttggttcattcacctgcaaagcacgctagcgccttcattcacgccgacatccctgaattcctgttcgaacatctcagttctagttctgaggtattggtctggtcaagctgcaactgcctcacactgttggtggaagaacccctgttcttttcaaaatgtcacacagtgtacgggattgaggctgtggttcgctccctacaggggagtctgaagatgaacaacatagagctccacaagcagggattactcctgttcgccgagattcttactcgtcagcctgaggagatcaagctgtttacctcctctgctatgtgtagggacgcaggtagggcgctgcaggaagctgtaagcagcccagtacttgaagtcgccgcggaagctcttaaagccacaagtgcattcctacgcaaggatcaccagagcacaccacctgtccagtatggagaactgcaggccctgctcgaggccatgctcaatagatgcgccgagttctcacagaccttactgtcccgtcgcccattaggtcatgccagctcaagagattccgagaaagccatcctccagagaggcaaattcctgctgtcaacactcgaagggtttagaagcgcgtgccggctggccatcgaatttcagtcggagcctagcgcgcaggagaacccgttcactgccccaagcgctaagaaggaagataccttggaagcgttctcagagtttctcctgtccgcttgcgattcgctctgtatacctatggtgatgcgccacctagaacagacaacacatcccgccttaatggaggtatttttgtcaattctgcacaacttgttcgtgatcgttccccatatgaaggagaaattcagcaaaaagctggcctcatcttctttcatccgccttactctcgaactgaaggctcggttctgttctggtctgagccacagtgctctaaaccaagtgtgtagtaactttctgtactacatgtgcctaaatcttttatccgccccagaaaagaccggccccccctccaaggaagagctgtctgcggtgtctgaattactccagcacggcttaccccagattagtagcagatcccctgaatccttggcatttctgtccgacagacagtacatggagggagctgctaggcagagacaatattgtatcctgttacttttttatctggcctacatccacgaagatcggttcgtgagcgaggccgagctattcgaggctgtccagtcctttctgctctccctgcaggatcagggcgaacgcccgccgctcgtggtgtttaaggctagcatatacctgctggcaatatgtcaggataaagacaacaccctgagggagactatggtctctgctattcggaagttcctcgaaggcatcccggacctgcagctagtctatacccaccaccctctgctcttgcggttcttcctcctttatcccgaactcatgtcgcggtacggtcatagggttctagagctttggttcttctgggaggaatcgtcctacgaggagctagatgatgtgacttccgcaggtcaaccggcgctgccagcaagcctggttgtgctatttcagctgctccgctccattccatcaatcctactaatacttctggacttaatctattcatcccccgtagatactgcacataaggtcttgatctcactacgcaccttcctacgcaggaacgaggatatccaggtggggggactgatccgtggtcacttcttgttaatactgcaacgactcttggtggagcatggagcctcgccttcgggagcttctggaaacctgccattgttgttgtcgctcctctccctgatgcagctgaggaatgtgtccgaacaggaactcgacagtgtggccatgaagctgcttcaccaggtttccaagttgtgtggtaaatgtagtccaaccgacgtcgatattctgcagcctagtttcaactttctttactggtctcttcatcaaacaaccccttctagtcagaaacgggccgcagccgtgctcctaagttctacaggactgatggagctcctggagaagatgcttgctcttactttggccaaggcagatagcccccgcactgcactgctttgtagtgcctggttactcactgcatccttcagtgcacagcagcataaaggatccttgcaggtgcatcagaccctgagtgttgaaatggatcaagtgctgaaagcattgtcgttcccgaagaaaaaagcagccctgttgtccgccgctatcctttgcttcttaaggacggcgcttaggcagtctttcagttccgccctcgtcgccttagttccttccggagctcagccacttcctgctactaaagatacagtgctggcccccctgaggatgtctcaggttaggtcactcgttattgggctgcaaaatctgctagtccagaaagatccgctgttgtcccaggcctgcgtgggttgcctcgaggcattactcgactacctggacgcacggtctccggatatcgccctgcacgtcgccagccaaccttggaaccggttcttattattcacgctgcttgatgccggggaaaattcgttcctgaggcccgagatcttacggctgatgactttgttcatgaggtacaggtccagtagcgtattaagtcacgaagaggtcggcgatgtgctccaaggcgtagctttggctgatctgagcactctgtccaatacaaccttgcaggctctacatgggttttttcaacagctgcagtcgatggggcatctcgctgaccactccatggcacagacactgcaagccagtctcgaagggctgcctccctccacttccagcggccaaccacccctccaagacatgttatgcctgggcggagtggccgtatccctgagtcacatccgaaactag

SEQ ID NO: 31169 - DNA, 1155 bp, Artificial Sequence
  Description of Artificial Sequence: Synthetic coding sequence
atgggacaccctcatcaggagagttcccttttcttcacggctagcgggaaccttccactgctgctcagcctgttatctctgatgcagctgcgcaatgtttcagaacaagagctggactcagtcgccatgaaattgctgcaccaggtgtcaaaattgtgcggcaagtgttcaccaactgatgtggatatccttcagcccagctttaatttcctgtactggtcccttcaccagacaacaccaagcagtcagaagcgtgctgccgctgtcctgctgagctccacaggcctcatggaactgctagagaagatgctggcactgactctggccaaggccgattcacccagaaccgccctgctgtgcagcgcttggctgttgaccgccagctttagcgcacaacagcacaagggtagtctgcaggtccaccaaacccttagtgtagagatggaccaagttctgaaagctctgtccttcccaaaaaagaaagctgccctgctgtcggccgctattttatgtttcctgcgcacggcactaaggcagtcgttctctagtgccctcgtagccttggtcccgagcggagcccaaccgctccctgctaccaaggataccgtgctggccccattgaggatgtctcaggttagatccttggtaattggcttacagaacctccttgttcagaaagatccacttctgtctcaggcttgcgtcggatgcctcgaggctctcttggactatttagatgccagatcacctgacatagctttacacgtggccagtcagccctggaacagatttttattgttcaccctccttgacgcaggagaaaatagctttttacgtcccgaaatattaaggctgatgacattgttcatgagataccggtctagctcggtgctttcgcacgaagaagtgggggacgttctccagggcgttgccctggccgacctcagcaccttgagcaacacgaccctgcaggcactccacgggttctttcagcaattgcagtctatggggcaccttgctgaccacagtatggcgcagacactccaagcgagtcttgaggggctcccaccctccacctccagcggtcaaccccctctccaggacatgttatgcctgggtggcgtcgccgtgtccctgagccatattagaaactag

SEQ ID NO: 31170 - DNA, 1521 bp, Artificial Sequence
  Description of Artificial Sequence: Synthetic coding sequence
atgaatcaagacggtctgggcgagtctgctaagaacatcgagggaagtagcggcaatactagcctgccactagtcctgaaaaagctcttgctttcgcgcgatgaaacactgcaggtggcaagcgcccattgcattacagcggtgctcgtccactccccagcaaagcacgcctcggctttcattcacgccgacattccagagttcctgttcgaacatctgtcatcaagcagcgaagtcctggtttggtcttcctgcaattgcctcacccttttggtcgaagagcctttgttcttcagtaagtgtcatacggtgtacggcatagaggctgtggtgcgatcattgcagggtagccttaagatgaacaatattgagctacacaagcagggccttttgctcttcgcagaaatcctgacgcgacaacccgaggaaatcaaattgtttacatcttccgctatgtgcagggatgcaggccgggctcttcaggaggccgtgagctcgcctgtcctagaagttgcagctgaggccctgaaggccacatccgcattcttgcgtaaagatcatcagagcactcctcctgtgcagtacggtgagcttcaggccctgctggaagccatgctcaacaggtgcgcagagttctcacagactctattgagccggcgtcctctgggccacgcatcctctagagactccgagaaggccattctccagcggggcaagttcctcctgtccaccctggagggattcagatccgcttgtagactggctatcgaatttcagagtgagccgtctgctcaagaaaacccttttacagccccaagcgctaaaaaggaagacacactggaagcattttctgagtttcttcttagcgcttgcgatagcctgtgtatccctatggttatgaggcacctggaacaaaccactcacccggccttaatggaggtgttcctgtcgattctccacaatcttttcgtgattgtgccccatatgaaagagaagttctcaaaaaaactggcttccagttctttcattaggcttaccctagagctcaaggcaagattctgttcggggctgtctcactcagcactgaaccaagtgtgttcgaacttcctctattatatgtgtctgaacctgctttcggcaccagagaaaactggccccccatctaaagaagagcttagtgcggtctcagaattactccagcatggcctaccacagatatcatcacgcagcccggagtctctggcattcttgagcgaccgtcagtacatggaaggggcggctcgccagcggcagtattgcattttacttctcttttatctggcctatatccacgaagacaggtttgtatctgaggccgaactgtttgaggccgtccaatctttcctcctgtccttgcaggaccagggtgaacgaccgcctctggtggttttcaaggctagcatctacctgctcgcaatctgtcaggataaggacaatactttgagagagcagttgcactgcagcctgatctccatctcttag

SEQ ID NO: 31171 - DNA, 810 bp, Artificial Sequence
  Description of Artificial Sequence: Synthetic coding sequence
atggaaggtgctgctcgacagagacagtactgtatcttgctgctgttttacctcgcctatatccacgaggaccgatttgtgagtgaggccgaactcttcgaggcagtccagtcctttcttctgagcttacaagatcagggtgagagacctcctctggtggtatttaaggcctctatttaccttctggctatttgtcaggataaggataacacgctccgggaaacgatggtgagtgcaataagaaaatttctggagggcatcccggacttgcagcttgtctacactcaccatcctctgctgctgcgttttttcctcctgtatcccgagctaatgtctcgctatggccaccgtgtcctagagctgtggttcttctgggaggagagttcttacgaagaattggatgatgtaacctccgcggggcagccagccctgcccgccagcctcgtggtcttattccagctcctacggtcgataccgtcgatcctgctcatcctcctggacctcatatatagctctcctgtagacaccgcacacaaagtgctcatctctttacgtactttcctgaggcgcaacgaagacattcaggtcggcggcctaattcgcgggcacttcttgctaatcctgcagagactgctggtggaacatggagcgtctccatccggggtgcttctcgttttgcattcactgggtgagcctactatcgccgccgaaccccccctacccgatgctgctcaggaatgcgtgagggcacgcactgggcagagaggtcacgaagccccaagccctcgctgccctggttgtctcggatag

SEQ ID NO: 31172 - DNA, 1203 bp, Artificial Sequence
  Description of Artificial Sequence: Synthetic coding sequence
atgtctaaagtgtcaaccatgttcagtgaagacgactttcaaagcaccgagcgcgccccctacggaccccagcttcagtggagtcaagacctgccaagagtgcaagtttttcgtgagcaagccaatcttgaagacaggagcccaaggagaacccagcggattacaggcggcgaacaggtgttgtggggaccaatcactcagatcttccccaccgtgcgccctgcagacctaaccagggtcattatgcctttggagcaaaggtctcaacattgtaaacctgaagagggcctccaggctcaggaggaggatctgggacttgtaggggcccaggcgctccaggccgaggagcaggaggctgcttttttcagctcaacactgaacgtgggcacattggaggaattacccgcggcggagtctccttcccccccacaatccccccaggaggagtcattcagcccaacagccatggacgctatctttggatctttgagcgacgaaggtagcggcagccaagagaaggaaggaccttctaccagtcccgacctgattgaccctgagtccttcagccaggacatcttgcacgataaaatcatcgacttggttcatctcctactgcgaaaatatcgtgtcaagggcctcatcactaaagcagagatgctagggtccgtaatcaagaactacgaggactatttccctgagattttcagggaggcatccgtgtgtatgcagctgctgtttggcattgatgtgaaggaggttgacccaacctcacatagctacgtgctggttacaagcctgaacttgtcatacgatggaattcagtgtaatgaacagtccatgccaaagtccgggctccttataatcgtgctgggtgtgattttcatggagggcaattgcattccagaagaagttatgtgggaagtgctttccatcatgggagtgtatgccggaagggagcacttcctgtttggggagcctaagcgcttactgacacagaactgggttcaggagaaatacctcgtataccgacaggtccctggaactgatcctgcctgctatgaatttctgtggggccctcgcgcacatgcggaaacatccaaaatgaaggtgctggaatacatcgccaacgcgaatgggagagatcctacgagttatcccagcctgtatgaggatgcgttgcgcgaagagggagagggtgtttag

SEQ ID NO: 31173 - DNA, 957 bp, Artificial Sequence
  Description of Artificial Sequence: Synthetic coding sequence
atgcttttaggccagaagtcacagcggtacaaggcagaagaaggactgcaggctcaaggcgaggccccaggccttatggacgtccaaatcccaactgcagaggagcaaaaggccgcaagcagttcatctaccttgattatgggaaccctggaagaggtgactgattcaggctcacctagcccgcctcagtctcccgagggagccagttctagcctgaccgtcactgactccactctctggtctcagagcgatgagggctcttcatcaaatgaggaggaagggccttcgaccagtcccgatcctgcccaccttgagagcctgttccgggaagccctggacgaaaaggtggccgaactggtccggttcctgctccgcaaataccaaatcaaggagcccgtcacgaaggctgagatgctggaatcagtgattaagaactacaagaaccactttcctgacatctttagcaaggcttctgaatgtatgcaggtgatcttcggtatcgatgtcaaggaagtggaccctgccgggcactcctacatcctggtgacctgtttaggccttagttacgatggactactcggagatgatcagtcaacccctaaaaccggattactcatcatcgtcctgggtatgatccttatggaaggctcaagagccccagaagaagccatctgggaggcactgtctgtgatgggactgtacgacgggcgcgaacacagcgtgtattggaagttgcgcaagctcctgacccaggaatgggtgcaagaaaactacttagagtaccggcaagcccctggtagtgaccccgtgagatatgagttcctgtggggaccgcgagccctcgcagagacatcatacgttaaggtgctggagcatgtcgtaagagtcaacgccagggtgcgcatcagctacccaagcttacacgaggaagccctcggagaggagaagggagtttag

SEQ ID NO: 31174 - DNA, 957 bp, Artificial Sequence
  Description of Artificial Sequence: Synthetic coding sequence
atgcttcttggacaaaaatcccaacggtataaagccgaagagggcttacaggcacaaggtgaggcccccggattgatggatgttcagatacccaccgccgaagagcagaaggccgcatcatccagctctaccctgatcatgggcactctggaagaggtcacagacagcggatctccttcaccacctcagtcaccagaaggagccagctctagcctgaccgtcacggattccaccttgtggtcacagtctgacgaagggtcgtcctcaaacgaggaggaaggccccagcacatcccccgacccagcccatcttgagagcctgttccgggaggccctggacgaaaaagtcgcggaattggtgcgctttttgctcaggaaataccaaatcaaagaaccagtgactaaggcagaaatgctggaatcggtgataaagaactacaagaaccacttcccggacattttttcaaaggcttccgagtgcatgcaggtcatatttgggattgatgtcaaagaagtcgatccagccggacactcttatatcctggtgacttgtctcggcttatcctacgacggcctgctcggtgatgaccagagcacacccaaaactggtctgctaatcatcgtgctggggatgattctcatggagggctctcgggcacctgaagaagcaatctgggaagcactgtcagtgatgggcctgtatgacggccgggaacatagcgtctattggaaattgagaaaactgctcactcaagaatgggttcaggaaaactacttggagtatagacaggcgcctggaagtgaccccgtgcggtacgagtttttgtggggccctcgggctctggcggagacgagctatgtgaaggtgctcgaacatgtggtacgtgtgaatgccagagtgcgcatcagctacccatccttacatgaggaggccctaggggaggaaaagggggtgtag

SEQ ID NO: 31175 - DNA, 957 bp, Artificial Sequence
  Description of Artificial Sequence: Synthetic coding sequence
atgttactggggcagaagagccagcggtataaggccgaagaaggactgcaggcccagggggaggccccaggccttatggatgtgcagatccccaccgcagaggagcagaaggcagcatccagttcctctactcttatcatgggcaccttagaggaggtaacggacagtggaagtcctagtccccctcaatcacccgaaggagcatcttctagcctgacagtgactgactcaactctgtggtcgcagagcgacgaaggctcatcaagcaacgaggaagagggcccctctacttcccctgatcccgcccacctggagtccctctttcgtgaagcactcgatgagaaagtggcagaactggtgcgctttcttctgagaaagtaccagataaaagagccagtaacgaaggctgaaatgctcgaaagcgtgatcaagaactataagaatcacttccccgacatcttctctaaagccagcgagtgcatgcaagtcatttttggcatcgatgtgaaagaagtggacccagcggggcacagctatattttagtaacatgcctgggcctgtcctacgatggcctgctgggcgatgaccagagtacacctaaaacaggcctcctgattatagttctggggatgatcctcatggagggatcccgcgcacccgaagaggccatttgggaggccctgagcgtcatgggcctgtacgatggacgagaacatagcgtttattggaagctgcggaagctgctcacccaggaatgggtgcaggaaaactacctagagtataggcaggcccccggtagtgacccggtgcgctacgaatttttatgggggcccagagccttggctgaaacctcgtatgtaaaagttctcgagcatgtcgtccgagtgaacgctcgcgtacgaatatcgtacccatctctccacgaagaggcattaggcgaagagaaaggcgtctag

SEQ ID NO: 31176 - DNA, 945 bp, Artificial Sequence
  Description of Artificial Sequence: Synthetic coding sequence
atgccgctggaacagcgcagccagcattgcaaacccgaagagggtcttgaggcacgcggtgaggcacttgggctcgtaggcgcacaagcaccggcaaccgaggaacagcaaactgcttcttcatcctctaccctggtggaagtcacactgggtgaagtccctgctgccgatagtccaagcccgccccactccccccagggagcgagtagcttttccactacgatcaattacactctgtggcggcagagtgatgagggcagctccaaccaggaagaggaagggcccagaatgttccccgatctcgaaagcgaattccaggccgcaatttcacgaaagatggtggagctcgtgcatttcctcctcttgaagtacagagcaagagagccagtgacgaaggctgaaatgcttgagagtgtgctgcggaattgccaggacttctttccagttatcttctccaaggcaagcgagtatctgcagctggtgtttgggatcgaggtggtagaggtcgtgcctatttctcacctgtatattttggtgacttgtctggggttaagctacgatggcttgttgggggacaatcaggtgatgccgaaaactggactactgataattgtattggccattatagcgattgagggcgattgtgctcccgaagagaagatctgggaggaactgtctatgctcgaggtattcgaaggaagagaagactctgttttcgctcacccgcgaaaactacttatgcaggacttagtgcaagaaaactatctcgagtataggcaagtccctggctcggacccagcctgctatgaatttttatgggggcccagagcgctgattgaaacaagctatgtcaaggttctacatcacactctaaaaatcggtggtgagccgcatatttcgtacccaccccttcatgagagggctctcagagagggggaggagtag

SEQ ID NO: 31177 - DNA, 945 bp, Artificial Sequence
  Description of Artificial Sequence: Synthetic coding sequence
atgcccctcgaacagcggtctcagcattgtaaaccagaagaaggcttggaagcgcgcggagaagctttaggcctggtcggcgcccaggcgcctgcgactgaagaacagcagaccgcttcctcctcatctaccttggtcgaagtgacactgggcgaagtccccgctgcagacagcccaagtcccccccatagtccccagggggcctcctccttcagcaccacaataaactacaccctttggagacagagtgatgagggaagcagcaaccaagaggaggaaggtccacgcatgtttcccgatctggaatctgagttccaggccgcaatatccagaaaaatggtggagctggtgcacttcttactgctgaagtatcgggctcgcgagccagttaccaaagctgagatgctcgagtctgtcctccggaactgccaagatttttttcctgttatcttctcaaaggcaagtgagtacctgcaactggtctttggtatcgaagtggtggaggttgtgcctatcagccatctgtacatactcgtgacctgtctgggccttagctacgatggcctattaggagataaccaagtcatgcctaagacgggcctgctgattatcgtgttggctattatcgccatcgaaggagactgcgcacccgaggagaagatatgggaagaactctcaatgttagaagtatttgaggggagggaggatagcgtctttgctcacccacgcaaattattgatgcaggatctggtgcaggaaaattacctcgagtatcgccaggtccctggttccgatcccgcatgttatgagttcttgtggggcccgagagcgttaattgagacatcatatgtaaaagtgctgcaccacacgttgaaaataggcggcgaaccacacatctcttacccccccctgcacgaaagggcgctcagagaaggcgaagaatag

SEQ ID NO: 31178 - DNA, 102 bp, Artificial Sequence
  Description of Artificial Sequence: Synthetic coding sequence
atgcctttggagcagcgatcccaacattgtaagcccgaagaaggactcgaagcaagaggcgaggctctgggcctcgtaggggcccaggccccggcgacttag

SEQ ID NO: 31179 - DNA, 363 bp, Artificial Sequence
  Description of Artificial Sequence: Synthetic coding sequence
atgcccttggaacaaagaagccaacattgcaaaccagaggaaggcctggaggcacgaggggaggctcttggcctggtgggggcccaggcaccggcaaccgaggagcaacagacagccagcagctcatcaacattggttgaagtcaccctcggcgaagtgcctgcagccgacagtccaagccctcctcactccccacagggagcttcctccttctccacaacaatcaattatacactgtggcgccagagcgatgaaggcagtagcaatcaggaggaggaaggaccacgtatgttccccgaccttgagagtgaattccaggccgccatctcacggaaaatggtggaactcgtgcacttcctgtag

SEQ ID NO: 31180 - DNA, 459 bp, Artificial Sequence
  Description of Artificial Sequence: Synthetic coding sequence
atgccacttgagcaaaggtcgcagcactgtaagcccgaggagggattagaggctcgcggcgaggctttgggcttggtaggggcccaggcacctgccactgaggagcagcaaacagcaagttcttcaagtacactggtcgaggtgaccttaggcgaagttccggcagcggactcaccttcccctccacacagcccccaaggtgccagtagcttctctactactattaactacacgctgtggcggcagtctgacgagggaagctccaatcaggaggaagagggcccaagaatgtttccagacctcgagagcgaattccaagccgccatttctaggaaaatggtcgagcttgttcactttctgctgctcaaatatcgggctcgcgaaccagtcaccaaagctgaaatgctggaatccgtgctgcggaactgccaggatttcttccctgttatctttagctag

SEQ ID NO: 31181 - DNA, 270 bp, Artificial Sequence
  Description of Artificial Sequence: Synthetic coding sequence
atgcccctggagcagcgctctcagcattgcaaacctgaagagggactggaggctcgaggcgaggccctgggccttgtgggggcacaggccccagcaacagaagagcagcagaccgctagtagctcatccaccctggtggaggtcacgttaggagaggttccggcagccgatagccccagccctccacattcccctcagggcgcttcctccttctccaccaccatcaattacacgctgtggcgacagagtgacgagggctcttctaattag

SEQ ID NO: 31182 - DNA, 447 bp, Artificial Sequence
  Description of Artificial Sequence: Synthetic coding sequence
atgcctctcgagcagaggtcacagcattgcaaacccgaggaggggctcgaggccaggggtgaggccctcggacttgtgggcgcccaggctccagcaacggaggaacaacagacagcttccagcagttctactctggtcgaggtgacgctgggcgaagtgccagcagccgacagcccgagcccaccccattcgccacagggagcgtctagctttagcacaacgataaattacacgctgtggcggcaatcagacgagggctcaagcaatcaggaagaagaaggccctcgcatgttcccagatctcgagagtgagttccaggccgcaatatcgcggaagatggtggagttggtgcactttctgctgttaaagtacagagcccgtgaacccgttaccaaggcagagatgcttgagtcagtgttgcggaactgccaggatttcttcccctag

SEQ ID NO: 31183 - DNA, 114 bp, Artificial Sequence
  Description of Artificial Sequence: Synthetic coding sequence
atgcctctggagcagaggtcacaacactgcaagcccgaggaggggctggaggcacgcggggaagcactgggcctggtgggcgcccaagctccagccaccgaggagcaacagtag

SEQ ID NO: 31184 - DNA, 1032 bp, Artificial Sequence
  Description of Artificial Sequence: Synthetic coding sequence
atgccccggggccaaaaatccaagcttagggctagagagaagcggcatcaggcccgctgtgaaaaccaagacctcggcgccacccaggcaacagtcgcagagggcgagtctccaagccccgcctacttgctgtttggagaccgaccccagaacctgccagcggcagagactccctctattccggaagcacttcaaggcgccccgtccacgactaatgcaatagctcctgtatcgtgctcctccaatgagggagccagcagccaggacgagaagagccttggaagctctagagaggccgaaggctggaaggaggatcctttgaataaaaaagtggtgagcctagttcactttctcttacagaaatacgagaccaaggaaccaattactaagggcgacatgattaaattcgtgattcggaaagacaaatgtcactttaatgagatcctgaaaagagccagtgagcatatggagctggctctgggcgttgacttaaaagaggtggatcctatccggcactattacgcctttttctctaaactagacctgacgtacgatgaaacaacaagtgacgaggagaaaattcctaaaacgggtctcctaatgatcgcactcggagtgatctttcttaacgggaatcgtgcacccgaggaggccgtttgggaaattatgaacatgatgggcgtctatgccgataggaagcactttctttacggtgacccgcgcaaggttatgactaaagatctggtacagctgaagtaccttgagtaccagcaggttcctaatagcgatccgccccggtacgaattcttatggggcccaagggcacatgcagaaaccagcaagatgaaggtacttgaatttgtagcaaagatccacgatacagtcccaagcgcctttccctcgtgttacgaggaagctcttagggacgaagaacagaggacccaggctcgggcggcagctcgtgcacacaccgcagccatggctaatgcacgaagcaggactacttcttcatctttctcccatgccaagtag

SEQ ID NO: 31185 - DNA, 2337 bp, Artificial Sequence
  Description of Artificial Sequence: Synthetic coding sequence
atggctcaaaaaatggactgcggggccggcctgctgggctttcaagctgaagcttccgtggaggacagcgctttactgatgcaaacacttatggaggctatccagatatccgaggcccccccaaccaatcaagccacagctgcggcaagtccccagtcctcgcaacctccaaccgccaacgaaatggcggacatccaggtgtctgccgctgccgcccggcctaagagcgcttttaaggtccaaaatgccacaaccaagggccccaacggcgtctacgatttcagccaggcacataacgccaaagacgtccccaatacgcaacctaaggcagcattcaagtcccagaacgccacacctaaggggccgaatgcagcgtatgatttttctcaggcggccacgacgggtgaattggcagcaaataagtccgaaatggcgttcaaagcccagaacgctacaaccaaggtcggccctaatgctacgtacaactttagccaaagcctgaatgctaacgacctggcaaactcacgccccaagaccccttttaaagcctggaacgacaccaccaaggctcccaccgcggacacccagacccagaatgtcaatcaggctaagatggctacttcccaggccgatattgagaccgatccaggaatttccgagcccgacggtgccacggcgcagacgtccgctgatggctcacaagcccagaacctagaatcacgaactatcatccgaggcaagcgaacccgcaaaatcaacaaccttaacgtggaggaaaactcctccggcgaccaacgcagggctcctcttgccgcaggcacctggcgaagtgcccctgtcccggtgactactcaaaacccgccaggcgctccacctaatgtcctttggcagaccccgctagcttggcagaaccctagtggctggcagaatcagactgcgcggcagactccgcctgctagacagagtccacctgcaagacaaactcctcccgcttggcagaatcccgttgcctggcaaaacccagtgatttggccgaatcctgtgatttggcagaatccagtcatttggcctaatcccatcgtctggccagggcccgtggtatggcctaacccccttgcctggcagaatcccccaggctggcaaacgccaccaggatggcagacgccaccaggatggcagggacctcctgactggcagggtccacccgactggcccttgccccctgactggcccctccctcctgactggcccttacctactgattggcccctcccccccgattggattcctgctgattggcccataccccccgactggcaaaaccttcgcccaagtccgaatcttagacccagtcccaactctagggcgtcgcagaaccctggggccgcacagccaagggatgtcgccctcctgcaggagagggccaataaactagtgaagtacctgatgttgaaagactacaccaaagtgccaatcaagcgaagcgagatgctccgcgacattattagagagtatacagacgtttatcccgaaataatcgagcgggcctgcttcgttctggagaagaaattcgggattcaattgaaggaaatagacaaggaagagcatctttacattctgattagcacgcctgaatcgctcgcaggcatcctaggtaccaccaaagatactcccaagcttggactgttactcgtaatcttaggggtaatattcatgaatggaaaccgggccagcgaggctgtactgtgggaggctctgcgaaagatggggttacggcccggagtacgccaccctttgctgggagatctccgcaagttgttgacctacgagtttgttaagcagaaatacctggattacaggcgcgtaccaaattctaaccctcccgaatacgagttcttgtggggcctcagatcataccatgaaacatcaaaaatgaaagtgctgaggtttattgcggaagtccagaaaagagatccgcgggattggaccgctcaattcatggaagccgccgatgaggccttagatgccctggatgcagcagcagctgaggccgaagcgagggcagaagcacgtacaaggatgggaatcggcgacgaggccgtgagtgggccatggtcctgggacgacattgagtttgagctcctgacatgggacgaggaaggcgatttcggtgacccttggagtcggattccctttactttctgggccagatatcaccagaatgccagaagcaggtttccgcaaactttcgcaggacccattatagggcccgggggtacagccagtgccaatttcgcagctaattttggggctatcggcttcttctgggtcgagtag

SEQ ID NO: 31186 - DNA, 2337 bp, Artificial Sequence
  Description of Artificial Sequence: Synthetic coding sequence
atggcccagaaaatggactgtggagcaggcttactgggatttcaagcagaagcctcggtggaggattcagctttattgatgcaaaccctgatggaggctattcagatcagtgaagcaccgcctaccaatcaggccaccgctgccgccagccctcagtcttcacaaccccccactgcaaacgaaatggctgatatccaggtgagcgctgccgccgcgaggccaaagagcgctttcaaagtgcagaatgccaccactaaggggcctaacggagtttatgacttttctcaagcacacaacgccaaagatgtgccaaatacacagccaaaggccgcttttaaatcccaaaacgcaacgcccaaggggccaaacgctgcatatgatttcagtcaagctgccactactggagagctggctgcaaacaagagcgagatggcgtttaaggcacagaacgctacaacaaaggtggggcccaacgcaacctacaatttctctcagagtctaaacgccaacgatctggccaacagtcgccccaaaacgcctttcaaagcctggaatgacacaacgaaggccccaactgccgacacacagacacaaaatgtgaaccaagcaaaaatggctaccagccaggcagatatcgagaccgacccgggcatatctgaacctgatggggccactgcacagacatctgccgacggtagccaggctcaaaatctcgagtcaagaaccattatccgaggcaagaggacgagaaagatcaacaacctgaacgttgaagagaattctagcggggaccagcgcagggcacctctagctgcaggcacatggcgctccgcccctgtacccgtgactacccagaatcccccaggcgcccctcccaacgtcctatggcaaaccccactcgcctggcagaacccgtctggatggcagaaccagaccgctagacagactccccccgcgcgccagtcccctccagcccgccagactcctcccgcttggcagaaccctgtggcctggcagaatcctgtcatctggccgaaccccgtaatctggcagaatccagtgatatggccaaaccctatcgtgtggcctgggcctgtggtctggcctaatccgttggcatggcagaatcctccaggctggcagaccccccccggctggcagactcctccgggatggcagggaccccctgattggcaggggccccctgactggcctttacctcctgactggcctctgccccctgattggccgcttcccacagattggccactaccccccgactggattccagccgactggccaatcccaccggattggcagaacttgcgcccgagtcctaacctgagacccagccccaattccagagcctcgcaaaatcccggggctgcacagccccgtgatgtcgccctcctgcaggaaagagctaataagctagtaaaatacttgatgttgaaggattatacgaaggttccaatcaagaggtctgagatgctgcgtgatattattagggaatatacggacgtttacccggaaatcatcgaaagagcttgttttgtgctggagaagaagttcggcatacagctcaaggaaatcgataaagaggagcatctgtacatcctgatatcaacacctgagtcactggcggggattctggggacgactaaggacacacctaagttaggactgcttctggtgatcctgggagtcatatttatgaacgggaacagagcttccgaggcagtgttgtgggaggcacttcgtaagatgggcctgcgccccggtgtgagacacccattattaggtgatctgaggaagctcctgacatacgagtttgtgaaacaaaaatacctggattacagacgtgtccccaacagcaatcctccggagtacgaattcttgtggggattgcgctcttatcacgaaacctcaaaaatgaaggtgcttcgttttattgctgaggtgcagaaaagggaccctcgggattggacagcgcagtttatggaagccgcagacgaggccctcgacgcactcgacgccgcagctgctgaggcagaagctcgcgctgaggctaggactcggatgggaattggggacgaggctgtatctggcccgtggagttgggatgacatagaatttgaacttttaacatgggacgaagagggggattttggcgacccctggtcccggataccgttcaccttctgggccaggtaccaccaaaatgctcgaagccgattcccccagacctttgccggacccatcattgggccgggcgggacggcttcagcaaacttcgcagctaattttggagcgattggctttttctgggtggagtag

SEQ ID NO: 31187 - DNA, 2220 bp, Artificial Sequence
  Description of Artificial Sequence: Synthetic coding sequence
atggccgaggggagcttcagtgtgcagtccgaatcatacagtgtcgaggacatggatgagggcagtgatgaggtcggcgaggaggaaatggtggaaggcaacgactacgaggaatttggagcctttgggggatacggtacactgacgtccttcgacatccatatacttcgagcatttggctccctaggccccggcctgagaatcctgtccaacgagccttgggagctcgagaaccccgtgctggcccagacactggtggaggcgctgcagctggaccccgagactctggctaacgaaactgccgctcgagccgcaaatgttgctcgcgccgccgcgagtaaccgcgcagccagagccgcagcagccgcggctcgcacagcgttttcacaagttgtggcctcacatagggtggcgacaccccaagtaagtggcgaagatacccagcccacaacgtacgctgcagaggcccagggcccaacaccagaacccccgctggcctcgccccaaactagccagatgttggttacatctaagatggccgctcctgaggctcccgccacgtccgctcagtctcagactggtagccctgcgcaggaagccgctacagagggaccctcctcggcttgcgcctttagtcaagccccttgcgcgagggaagtggatgctaaccggccatcaacagcgttccttggccagaacgatgtcttcgacttcactcagccggccggggtaagtgggatggcattccctagacctaaaaggccggctcctgcgcaagaagccgctaccgaagggcctagtgccgctagcggagtgccacaaaccggtcccggaagagaagtggctgcgacaaggcccaaaaccaccaagagcggtaaggccttagccaagactagatgggttgagccacagaatgtggttgcggctgcagccgctaaggcaaaaatggcaacaagcatccccgagcctgaaggcgctgctgccgcgaccgctcaacatagcgccgagccctgggcccgaatggggggcaagcggactaagaaaagcaagcacctagatgacgagtatgagtcttctgaggaggagagggagactcccgcagtgcctccaacatggagggccagccagcctagcctcacggtccgggctcagttagcaccacgtccaccaatggctccaagatcgcaaattccttcgcgacacgttctgtgcttgcccccacgtaacgtgacgttgctccaggaaagagccaacaaacttgtgaaatatttaatgatcaaagactacaaaaagatccctattaagcgtgccgacatgctgaaagatgtcattcgcgagtatgacgagcattttcctgagattatcgaacgtgccacctacacactcgagaagaaattcggcattcacctgaaggagattgacaaggaggaacatctgtacatactcgtttgcactcgggactcatcagcccgactgctgggaaaaacaaaggacactccaaggttgtctctgctgctggtcatcctcggtgtaattttcatgaacggaaaccgcgcaagcgaggcagtgttatgggaagcactgagaaagatgggcctgcgccctggcgtgaggcatccattcctgggggatttgagaaaactgattactgacgactttgtcaaacagaagtacctggagtataagaagattcccaattccaacccaccagagtacgagttcctgtggggcctgcgggcgcgacacgagacttcgaagatgcgggttctgcgctttatcgctcagaatcaaaatcgcgaccctcgggaatggaaagcccacttcctggaagctgtggacgatgcattcaaaacaatggatgttgacatggccgaggaacacgccagggcgcagatgcgcgcacagatgaatattggcgacgaggccctgatcggacggtggagctgggacgatatacaggtggagctgctgacttgggacgaagatggggactttggagatgcatgggctagaattccctttgccttctgggcgaggtaccaccaatacatcctgaattcgaatcgtgctaacaggcgcgccacgtggcgcgctggggtaagctctggaacaaacggaggagcaagtacgagcgtgctggacggcccctctacctccagtacaatcagaacacggaacgccgcaagggccggagccagcttttttagttggattcaatag

SEQ ID NO: 31188 - DNA, 2274 bp, Artificial Sequence
  Description of Artificial Sequence: Synthetic coding sequence
atggcagaagggtcgttctctgtgcagtccgagtcctactccgtggaagacatggacgaaggatctgatgaggtgggagaagaggaaatggtagaaggaaacgactacgaagagtttggcgcgttcgggggttacggtacgctcacctcattcgatattcatatcttgcgcgcattcgggtcacttggtcctggcttacgtatcttaagtaatgaaccctgggaactcgaaaacccggtgctcgcccaaaccctagtggaggctctccagctggacccagaaacactcgccaacgaaacagcggcgcgagcagctaacgtggccagggccgccgcaagcaatcgcgcagcccgcgctgcagccgcagccgcgcgaactgcctttagccaggtggtggccagtcatagggtggccacacctcaggtctctggcgaggacactcagccaaccacctacgcagccgaggcacaagggccaacccctgaacctcccctcgcctctcctcaaacgtcgcaaatgctggtgactagcaaaatggctgccccagaggctcccgctacctcagcccagtcacagaccggctcccctgcccaggaggcagccactgaaggtcccagttcagcatgcgccttctcacaggccccctgcgccagggaggtggatgcgaataggccctccaccgcatttctcgggcagaatgacgtgttcgacttcactcaacctgccggggtatctggtatggcctttccacgtccgaaacggccggctcccgcccaagaagctgcgactgagggaccatccgccgcatcaggggtgccgcagacaggccctgggcgggaagtcgccgctactcgtcccaagactactaaaagcggcaaagctctggccaaaactcgctgggtggagcctcaaaacgttgtcgcggctgccgcagccaaggccaagatggccacctccatacccgagcctgagggcgctgctgctgccaccgctcagcatagcgcagagccttgggcccggatgggggggaagcggacaaagaagtctaagcacttagacgacgagtacgaatcgagcgaagaagagagagaaacccctgcggtgccacccacttggcgggcatcccagccgagtctgaccgtccgggcgcaactggcaccccgaccccccatggccccccgatctcagatcccgtctagacacgtgctttgcctgccaccgagaaacgtgaccctgctgcaggaacgggccaataaattagtgaagtacttgatgattaaagattacaagaagatccctataaagagagcggatatgttgaaagatgttatccgcgagtatgacgagcacttccctgaaatcatagagcgcgctacatacacactcgaaaaaaaattcggaatccatctcaaagaaattgataaagaggaacacctgtatatccttgtttgtacgcgtgatagttctgctcggttactgggcaagaccaaggacacaccccgcttaagtctgttgctcgttattcttggggtgatttttatgaacggtaaccgagccagcgaagctgtcttatgggaagcactgagaaaaatggggcttcgtccaggcgtccgtcaccctttcctgggggatcttcgtaagctcataaccgatgacttcgtaaagcagaagaaccctgagctacgggaagaaactccactgtctatggccccctcctggtaccttgagtataagaaaatacctaactccaacccgccagaatacgagtttctgtggggactccgagcgagacatgagacaagcaaaatgagagtactgagatttatagctcaaaaccagaatcgggatccccgggagtggaaagctcactttttggaagctgtggacgacgcatttaagaccatggacgttgacatggccgaggagcacgcccgcgcccagatgagagcacaaatgaacattggggatgaagccctgatcggccgatggtcttgggacgacatccaggtggagctgttgacatgggatgaagacggagacttcggagatgcatgggctcgcataccatttgccttctgggcaaggtatcatcagtacatcttgaatagtaaccgggccaatcggcgcgccacatggcgtgcaggggtgtcttcgggtaccaacgggggcgcctccacatcagtgctcgatgggccatccactagcagcacgatccgaactcgcaacgcagccagggcgggggccagcttcttttcctggattcagcataggtag

SEQ ID NO: 31189 - DNA, 2091 bp, Artificial Sequence
  Description of Artificial Sequence: Synthetic coding sequence
atggaatccgagtacgttctctgtaattggaaggatcaactgtggccggcaaaagtcctatcacgatcggaaacaagctctaattccaaacgtaagaaggccttcagcttagaggtgcagatcctgagcctggacgaaaaaattaagctggactctactgaaactaagatcctaaacaaatctcagatagaggcgattgcggcgtcgctcggactccagtctgaagatagtgccccaccaaccgaggaaactgcttacggaaggagcttgaaagtcgctttaggcatactgaacgagagaacaaacttgtcacaagcttcaaccagcgatgaggaagagatcaccatgctcagtcagaacgtcccccaaaagcagtccgacagccctccccataagaagtaccgtaaagatgaaggggatctgcccgggtgcctcgaggagcgtgagaattctgcctgcttgctcgcgtcatctgaaagcgatgactcattgtacgacgacaagagccaggccccaacaatggtcgataccataccatccgaagtggagactaaatccctgcaaaacagctcctggtgtgagactttccccagcctgtccgaggacaacgacgagaaggaaaataagaataagattgacatcagcgccgtgatgagcgtccacagtgccgtcaaagaggaatccgcttgtgtcaaagacgaaaagtttgccccacccctgtctccccttagttccgatatgctgatcatgcccaaggctctgaaagaagaatctgaagatacatgcctggagacacttgctgttccttctgagtgcagtgccttctccgagaacatcgaggaccctggagaggggccaagtaatccttgccttgacacatcccagaaccaacccagcatggagtctgagatgggagccgcagcctgcccaggcagctgcagccgcgagtgcgaggtgagtttttctgcatcaaacccagtgtgggactactcgcacctgatgtctagcgagcggaatttccagcgccttgactttgaggaactcgaagaagagggccaggcgtctgacaagtcgttgctgcccagcagaataaatttgagcctactagatgacgacgaggaggacgaggagctgccccgattcatcctccactacgagactcacccatttgagacagggatgatcgtttggtttaaatatcagaagtacccattctggcctgccgtgatcaagtcaatccggcggaaagaaagaaaagcgtctgtgttattcgttgaggccaatatgaattcagagaagaaagggattcgggtcaactttaggcggctgaaaaaattcgactgcaaggagaaacaaatgctcgtcgataaagcaagggaagactactcggagtccattgactggtgtatcagcctgatttgcgattatagggtgcggatcgggtgcggcagcttcaccggcagccttcttgaatactatgccgccgatatttcctatcccgtacggaaggagaccaaacaagatacctttcggaataagtttcccaaactgcacaacgaggacgcccgcgagccgatggcggtgacctcccagacaaagaagatgtccttccagaaaatccttccggaccggatgaaagctgccagggacagggcaaataagaacctggtggattttatcgtcaacgctaaggggacggagaaccacctactcgcaatagtcaacggcaccaagggctcaaggtggttgaaatcatttctgaatgccaataggtttactccctgcatcgaaacctactttgaagacgaagaccagttggacgaggtcgtgaaatatctgcaggaggtgtgcaaccagatcgaccagatcatgcccacatggattaaggacgacaagatcaaattcatcctggaagtcctgctcccagaggcaatcatctgttccattagtgcggtggacggcttggactatgaggccgctgaggctaagtatcttaaagggccatgtttaggctaccgagaacgtgagctttttgacgcaaagatcatctatgaaaaacgccgtaaggccccgactaatgaagcacactag

SEQ ID NO: 31190 - DNA, 2091 bp, Artificial Sequence
  Description of Artificial Sequence: Synthetic coding sequence
atggaaagcgaatacgtgctgtgcaattggaaagaccagctctggcctgcaaaggtgctctctcgatcggaaaccagttcaaacagcaagcggaagaaggccttctctttggaagtccagattctcagcctggacgagaagatcaagctggacagtactgagacgaaaatccttaataagagccagattgaggctatcgcagcaagcctcggtcttcagtctgaggatagtgcccctccaactgaggaaacagcctatggccgatcactgaaagtggcgcttgggatcctaaatgaaaggactaatctcagccaggcctccacaagcgacgaggaagagattactatgctgtcccagaacgtgccccagaagcagtcagactcgcctccacataagaagtaccgcaaagatgaaggtgacctgccaggttgcctggaggagcgcgaaaacagcgcttgtttgctggcctccagcgagtcagacgattcactgtacgatgacaaatcgcaagcaccaaccatggttgataccatccctagcgaagtcgagacgaaaagcttgcaaaatagctcatggtgcgagacctttcccagcctgagtgaggataatgacgaaaaagaaaacaagaacaagatcgatattagtgctgtcatgagcgtgcactccgcggtgaaagaagaatcagcctgcgttaaagacgaaaagttcgcgcctccgttgtctcccctttctagtgacatgctgatcatgccgaaagccttaaaagaggagtcagaagatacttgtttggaaactttagctgtgccctccgagtgttcagcctttagtgaaaacattgaggaccccggggaggggcccagcaacccctgcctggatacatcacagaaccagccttccatggaaagtgaaatgggcgccgcggcctgtccaggttcctgttcccgcgagtgcgaagtctcattcagcgcgagtaaccctgtttgggattatagtcatctgatgtccagcgagcgtaacttccagcggctggattttgaggagctggaagaagaagggcaggcctcggacaagagcttattaccctcccggatcaacttatctctcctagatgatgatgaggaggatgaagagctacctcgattcatccttcactatgaaacccacccgttcgaaactggaatgatcgtttggtttaagtatcaaaagtatcccttttggcctgccgttatcaagtccatcaggcggaaagagagaaaagcaagtgtgctctttgttgaggccaatatgaatagtgagaagaaagggattcgcgtgaattttcgccgcctgaagaaattcgactgcaaagaaaagcagatgctggtggacaaagcccgagaggactatagcgaaagtatcgactggtgtatttctttgatctgtgattaccgcgtgaggataggatgcggaagctttactggcagtcttctggagtattacgcagcagacataagttaccccgtgcgcaaagagacaaaacaggacacattcagaaataagtttcccaagcttcataatgaggacgctcgcgaaccaatggcagtcacatcacagactaagaagatgtcctttcaaaagattctgcccgaccggatgaaggctgctcgtgatcgtgccaacaagaacttggtcgatttcatagtaaatgccaaaggcactgaaaatcatctccttgccatcgttaacggtactaaaggaagtagatggctgaagagctttctcaacgctaataggtttacaccatgtatcgagacctacttcgaggacgaagatcagctcgatgaggtggtaaagtacctccaggaggtgtgcaatcagattgatcagatcatgcccacttggattaaggacgataagatcaagtttatcttggaagtcttgctcccagaggccatcatttgtagcatctcagcagtagatggcttggattacgaagcagctgaggctaaatatctcaaaggaccctgcctcgggtatcgggaacgtgagttgttcgatgccaagataatttacgagaagcgtcggaaagcccccaccaacgaggcccattag

SEQ ID NO: 31191 - DNA, 2091 bp, Artificial Sequence
  Description of Artificial Sequence: Synthetic coding sequence
atggaaagtgaatatgtgttgtgtaactggaaggaccagctgtggccagctaaggtgctatctcgatctgaaacgtcgtcaaatagcaagcgcaagaaggctttctcactagaggtacaaattctatctctggacgaaaagattaagttagatagcaccgagacaaaaattcttaataaaagccagatcgaggccattgcagcatcactgggccttcagagtgaggattcagcaccccctacagaagagaccgcctatgggagaagtctaaaggtggccctcgggatcctaaatgagaggaccaacctgtcacaggcttctaccagcgacgaagaagaaattactatgctatcacagaacgtgccacagaagcagtctgactccccaccacacaagaaataccggaaagatgaaggagatttgcccggttgtcttgaagagcgggaaaatagcgcatgtctgctggcctcttccgagtcagacgactctctgtacgatgacaagtcacaagccccaaccatggtagacaccatacctagcgaggtcgaaaccaagtccctgcagaattccagctggtgcgagacatttccatccctctccgaagataatgatgaaaaagagaacaagaataagattgatatatcagccgtgatgtcagtccatagtgcagtgaaagaggaaagtgcctgcgtcaaggacgaaaaattcgctccacccctgtcccccctctcatccgatatgttgattatgccaaaagcactgaaggaagaaagcgaggatacatgcttggagacactggctgtgcccagcgaatgcagtgctttttccgagaatattgaggatccaggggaggggccatccaacccctgtttggatacatcacagaaccaaccttcaatggagtcagaaatgggggctgctgcctgccccggatcttgcagccgcgagtgcgaggtcagcttcagtgcctcaaatccagtgtgggactactcccacctgatgtctagcgagcgcaacttccagaggctggattttgaggagctcgaagaggaggggcaggcctccgacaaatcactgctgccaagtcgcatcaatcttagcctactggacgacgatgaggaagatgaggagctccctcgcttcattctacattacgaaacccaccccttcgagactggtatgattgtgtggtttaagtaccaaaagtaccccttctggcctgctgtgattaaatccattaggcgcaaggagcgaaaggcctccgtgctcttcgtggaagccaacatgaacagcgagaagaaagggattagagttaatttcaggcggctgaagaaattcgattgtaaggagaaacagatgctggtcgacaaggctagggaggactatagtgaatctattgattggtgtatatccctcatatgtgattacagagtgaggatcgggtgcgggtcctttaccggctctctgctcgaatactacgctgccgacattagttaccctgtaagaaaggagacaaaacaggacacatttaggaacaagttccctaagctacacaacgaggacgctagagaacccatggcagttacctctcagactaagaagatgagttttcaaaaaattctacctgatcgcatgaaggctgccagggaccgggcaaacaaaaacctggttgacttcattgtaaatgccaagggcaccgagaaccatcttcttgctatcgttaacggcaccaaaggctctagatggctgaaatcttttctcaacgcaaatcgcttcaccccttgcatagaaacctattttgaggatgaggaccagcttgacgaagtagttaagtatctgcaggaggtgtgcaaccaaatcgatcagataatgccaacctggatcaaagacgacaaaattaagtttattctggaggtgctgcttccggaagcaatcatatgttcaatctccgccgtcgatggacttgattacgaggcagcagaggccaagtatctcaagggaccatgtctcggctacagggagcgggaactcttcgacgctaagattatctacgagaagcggagaaaggccccaactaatgaggcccactag

SEQ ID NO: 31192 - DNA, 396 bp, Artificial Sequence
  Description of Artificial Sequence: Synthetic coding sequence
atggctcgttctcttgtgtgtctgggagtaataatcttacttagtgcattttccggccccggggtgcggggcgggcccatgccaaagctcgccgacagaaagctgtgtgcagaccaggagtgttcacatccaatctccatggctgtggcgcttcaggattatatggcccctgattgccgattcctcactatccataggggccaggtcgtgtacgtcttttccaaattgaagggccgcggccggctgttctggggtggttccgtgcagggcgactactacggcgacctggcggctcgactaggatacttcccttcaagtatcgtgagggaggatcagacactgaagcctggcaaggtggacgttaagaccgacaagtgggatttctactgccagtag

SEQ ID NO: 31193 - DNA, 2226 bp, Artificial Sequence
  Description of Artificial Sequence: Synthetic coding sequence
atggctgagggatcctttagtgtgcagtctgagtcatattccgtggaagacatggacgagggctccgacgaagtcggagaggaagagatggtggagggaaatgactacgaggaattcggagctttcggcggatacggcaccctaacatccttcgatatccatatcttacgggcgtttggatccttgggacctgggcttcggatcctgtcaaatgagccatgggagctggagaaccccgttttagcacaaactttggtggaggcattacagctcgacccggaaacgctggccaacgaaactgccgcccgggctgccaacgtcgctcgcgccgccgcctccaacagagcagctcgcgcagccgccgctgcggcccgaactgcattctcccaggtggtggcctcccaccgtgtagccaccccccaggtctccggagaggatacgcagccaacgacttatgccgcggaggctcaagggcctacgcctgagccacctttggctagtcctcagaccagtcagatgctggtgacatctaagatggccgcacctgaagcccctgctacctccgcccaaagccagaccggtagcccggcacaggaagccgctacggagggccccagcagcgcctgtgcattcagccaggcaccctgtgcacgcgaggtggatgccaataggcctagtactgcatttcttggccagaacgatgtgtttgattttactcagccagcgggagtgagcggtatggctttccccagacctaaaagacctgcccctgcccaggaagccgcgaccgaaggtccatctgcagcttccggagtccctcagaccggtcctggccgtgaggtggcagcgactcggcccaagacaactaagagcggaaaggccctggcaaaaaccaggtgggtggaaccgcaaaacgtggtggctgccgcagctgctaaggcaaagatggctacttccattccagagcccgagggagctgctgcggccactgcccagcactcagccgagccttgggctaggatgggagggaaaagaactaagaaatctaaacacttggatgacgaatacgaatcttcagaggaggaaagagaaactccggcagttccaccaacttggagagcatctcagccttctcttacggtccgcgcccagctggctcccagaccaccgatggccccgagaagccagattcctagcagacacgtactctgcctcccgcctagaaacgttaccctcttacaggagcgcgctaacaaactggtcaaataccttatgattaaggactataagaagatccccattaaaagagcggacatgctgaaagacgtcataagagagtacgacgaacatttccccgagattatagagagagcaacttacacattggagaagaagttcggtatccaccttaaagagattgacaaggaagagcacctttatattttagtctgcacaagagattccagcgcacggcttttaggtaaaacaaaagatacgccacgcctgtccctgctgctggtgatcctgggtgttatttttatgaatggcaaccgtgcctctgaggccgtactgtgggaagctctaagaaaaatgggtctccggcctggagtgagacaccctttcctgggagatctgaggaaacttattacagacgacttcgttaagcagaagtacctggaatacaagaagatccccaattctaatcctcctgaatatgagttcctctggggtctgcgcgccaggcacgaaacaagcaagatgagagtcctgaggttcatcgcgcaaaatcagaaccgggaccctagagagtggaaagcccactttctcgaggcggtcgacgatgcatttaagaccatggacgttgacatggccgaggagcatgcgcgtgctcagatgagagcgcagatgaatatcggagacgaggcgctcataggtagatggtcctgggacgacattcaagttgagttgttgacctgggacgaagacggagatttcggcgatgcatgggccagaattccttttgctttttgggccagataccaccagtacatcctgaattccaaccgcgccaatcgtagggcaacctggagggccggcgtcagttcagggactaacggtggagcatcaacctctgttctcgacgggcccagcaccagttccaccatccggacccgcaacgcagcgagggctggcgcctctttcttctcttggatccagcacagatag

SEQ ID NO: 31194 - DNA, 4446 bp, Artificial Sequence
  Description of Artificial Sequence: Synthetic coding sequence
atgtccaagaccctcaagaagaagaaacactggttatctaaggtgcaagagtgtgctgtgagctgggccggcccaccaggggattttggagcagagatacgcggtggagccgaacgtggagaatttccctacctcggtaggctacgcgaagagccaggtggaggcacgtgttgtgtggtttctgggaaggcaccgagtcctggggacgttctactagaggtgaacggaacaccggtgagtggcctgactaatcgcgacacattggccgtcattcgccatttcagagagcccattcgcctgaagactgttaaaccaggcaaggtgatcaacaaagacctacggcactacttgtccctccaattccagaagggaagtattgaccacaagctgcaacaggtaattcgagataacctgtacctaagaacaattccctgcaccactcgcgctccacgcgacggtgaggttccaggagtcgactacaattttatttcagtggagcagttcaaagcactggaggagtcaggcgctttactggaaagcgggacttatgacgggaatttctacggcacacctaagccgcccgccgaaccaagtccttttcagccagaccctgtggaccaggtgctctttgataacgagttcgacgctgagagccaaaggaagaggacaacgtccgtgagcaaaatggagagaatggactcctccctccccgaggaggaggaggacgaggataaagaggctattaatggctccggtaacgcagagaatcgggagaggcactccgaatcctcagactggatgaagaccgtgccgagctacaaccaaactaattcatctatggacttccggaattacatgatgagagatgagaccctcgagccactcccaaaaaattgggaaatggcctatacggataccgggatgatttacttcattgaccataacaccaagacgactacgtggctcgacccccgcctgtgtaagaaagcaaaggccccggaggactgtgaagacggagagctgccctatggatgggaaaaaattgaagatcctcagtacggtacctattacgttgaccacttaaatcaaaaaacgcagtttgagaatcctgtggaggaagccaagcgcaagaaacaactggggcaggttgagatcggatcctctaagccagatatggagaagtcccatttcactcgtgatccatctcagctgaagggcgtcctcgtccgagcatccctgaagaagagcaccatgggatttggttttaccatcattggaggcgaccggccagacgaatttttgcaggtcaagaacgtcctgaaagatgggccagccgcccaggatggcaaaattgcccccggagacgttattgtcgacatcaacggcaactgtgttctgggtcacactcacgccgatgttgtgcagatgttccaactggtgcccgtgaatcagtatgtcaatcttacgctgtgtaggggctacccactgcctgacgattcagaagaccccgtggtggacatcgtcgcagcaacacctgtgataaacggacagtccctgacaaaaggcgaaacctgcatgaaccctcaggacttcaagccgggggcgatggtgctggagcagaacgggaagtcgggccacacactcacaggcgacgggttaaacgggccatccgatgcttcagagcagagagtaagcatggcgagcagtggatctagccagccagaattggtgacaatccccctcatcaagggacccaaaggctttggctttgccatcgccgatagtccgactggccagaaagtcaagatgatcctggactcccagtggtgccagggacttcagaagggggatatcattaaggaaatctatcatcagaacgtccagaacctgacacacctccaggtcgtggaagtgttgaaacagttccctgtcggggccgatgtgcccctcttaattctcaggggcggacccccctcccctaccaagactgcaaaaatgaagacagataaaaaggaaaacgctggcagcctggaagccataaacgagcccataccccaaccaatgccatttcctcctagcatcatccggagcgggtcacctaagcttgacccttccgaggtgtacttgaagagtaagacactctacgaggacaagcccccaaacactaaagacctggatgtcttcctgcggaagcaggagtcagggttcggattcagggttctcggtggggacggacccgaccaaagtatttatattggtgccatcattccattaggcgctgccgaaaaggatgggcggctcagagcagctgacgaacttatgtgtattgatggcatccccgtgaaggggaagtctcacaaacaggtgcttgatctaatgacaactgcggccagaaatggtcatgtcctactcaccgttcgccgtaagatattctatggagaaaagcagccagaggacgattcgagccaggcttttatttcgactcagaatggctctcccaggcttaaccgagcagaggttcccgcaaggccagcacctcaagaaccatacgatgtggttctgcagagaaaagaaaacgaggggttcggttttgttatacttacgtctaagaataaacccccaccaggtgtgatccctcacaaaatcggcagagtgatcgagggttcccccgccgaccggtgtggaaagctgaaggtcggagaccatattagcgcagttaatggccagtccatcgtcgagctgagtcatgacaatatagtgcaacttattaaagacgcaggagttactgtgactttaactgtgatcgcggaggaggaacaccatggccctcccagcgggacgaattcagcaagacagtcaccagccttgcagcacaggcccatggggcagagccaagccaatcatatcccaggggatcggtccgctctggagggcgaaattggaaaggacgtgtccaccagctatcgtcacagttggagcgatcacaagcacctcgcccagccagacaccgctgtcatatcagttgtcggtagtaggcacaaccagaatctgggatgctaccccgtggagttggaacggggcccgcggggctttgggttctcactgagggggggtaaagagtataatatgggtctgttcattctacgcctggccgaagatggaccagcgatcaaggacgggcggattcacgtcggtgaccagattgtcgaaatcaatggcgaacctactcaggggatcactcatacccgcgcaatcgaattaatccaggctgggggaaataaagtccttctgctgctgaggcccggtacaggtctcatccctgaccatggcgactgggatataaataatccaagctcaagcaacgtgatctatgacgagcagagccccctcccgcccagctcacactttgcaagcatcttcgaggaaagccacgttccagttatagaggagtctttacgggtgcagatttgtgagaaggcagaggagcttaaagacatagtccccgaaaaaaagtcaactttgaacgagaatcagcctgagatcaagcaccagtccctcctccagaagaacgtgtcgaagcgtgacccaccatcttcccacgggcatagtaataaaaagaacctgttaaaagttgaaaacggagttactaggcgaggtcggtccgtgagtcccaaaaagccagcttctcagcacagcgaggaacaccttgataaaattccaagccccttaaagaataatcccaaacgccgtccccgggaccagtctttgagtcccagcaaaggggaaaacaagtcttgtcaagtcagcactagagctggatccggtcaggaccagtgtcgtaagtccaggggtagatctgcatcccctaaaaaacagcagaaaattgagggatccaaggctcctagtaacgcagaggccaagctgctggagggaaaatcccggaggatagctgggtacacagggagcaatgccgaacagatcccagatggcaaagagaagtccgacgtcatccgcaaggatgccaaacaaaaccagctggagaagtcgagaacacggtctccagagaagaagattaagcggatggtcgagaagtccttgccgagcaagatgacaaacaaaaccacgtcgaaggaagtgtccgaaaatgagaaaggaaagaaagtgacaacgggggagacttccagcagcaacgataagatcggagaaaacgtccagctatctgagaaacgcctcaagcaggagccagaggaaaaggtagtctctaataagactgaagaccacaaaggcaaagagctggaagccgccgataagaataaggagacgggccgctttaagccggagtcaagctcacccgtaaaaaagaccctcatcacccccgggccctggaaagtgcctagtggaaacaaggttacagggacaataggaatggccgagaaaagacagtag

SEQ ID NO: 31195 - DNA, 3378 bp, Artificial Sequence
  Description of Artificial Sequence: Synthetic coding sequence
atgtcaaagacgctcaagaagaaaaagcattggttgtcaaaagtgcaagaatgtgccgtgagttgggccggcccccctggcgacttcggggcagaaattcgtgggggggccgagcggggtgaatttccttacctcgggcgcttgcgagaggaacccggcgggggaacctgctgtgtggtgtctgggaaagctccttcccccggtgatgtactgcttgaagtgaacggaaccccagtctctggattgacgaacagggatacattagctgtgattcgtcatttccgagagccaataagactgaagactgttaagccagggaaggttatcaacaaagacctgcgtcactacctgtctctccagtttcagaagggatctattgaccataagctgcagcaggttatcagggacaatctgtaccttcgcacaatcccatgcaccactcgcgctccccgagatggggaggtaccaggcgttgactacaactttatctcagtggagcagttcaaggccctggaagagagtggtgcattactcgagagcggtacctacgacggaaatttctatggtactccgaaacctcccgccgaaccctcgcccttccagcccgatcctgtcgatcaggtactgtttgacaacgagtttgatgctgagtctcaaaggaagaggacgacatccgtgtcaaagatggaacgaatggactcttctttgcccgaagaggaggaggacgaggacaaagaggccatcaacggaagcggcaacgctgaaaaccgtgagagacatagtgaatcatcagattggatgaaaaccgtgccttcgtataaccagacgaatagcagcatggactttaggaattatatgatgagagatgaaacacttgagccgctgcctaaaaattgggaaatggcttacaccgacacaggcatgatatactttattgaccacaacaccaaaactaccacatggcttgatccccggctctgtaagaaggcgaaagccccagaagactgcgaggatggtgagctgccttatggctgggaaaagatagaggatcctcagtacggaacctattatgtcgatcacctgaatcagaaaacccagttcgagaacccggtggaggaggcgaagagaaagaaacaactgggacaagtcgagataggctcctccaagccagacatggagaagtctcatttcactcgcgatcctagccagctcaaaggcgtactcgtacgggcctcgctgaagaaaagcactatgggtttcgggtttaccataataggtggcgacaggccagatgagttcttacaggttaagaacgtcctaaaggatggtccagccgcccaggacggcaaaatcgcacctggcgatgtgattgtggatatcaatggtaattgcgtattggggcacactcacgctgatgtggtgcagatgttccagcttgtgccggtgaaccagtacgtcaacctgaccctgtgccgaggctaccctctcccagacgattcggaagaccctgtggtagatatcgttgctgcaactcctgtgatcaacgggcagtcattgacgaaaggcgaaacatgcatgaacccccaggactttaagcccggagccatggtgttggaacagaatggcaagagcgggcacaccctcacaggggacggattgaatggcccctctgacgccagcgagcagcgcgttagtatggcctccagtgggtcctcccagcctgaactggtgactatccctctgatcaagggtccaaagggattcggcttcgccatcgcagattccccaactggtcagaaggtcaaaatgatcctggatagtcaatggtgccaaggtttacagaagggagatatcataaaggaaatttaccatcagaacgtacagaacctgacccatcttcaagtggtcgaggtgctgaagcagttccctgtcggagcggacgtgccccttttgatcctgagaggtggccccccctccccaacaaagacagcaaagatgaagaccgacaagaaggaaaacgccggctcgttagaggcaatcaatgagccgattccgcaaccaatgccatttccacctagcatcatacggtccggaagcccaaagcttgatccaagcgaggtgtatctcaaatcaaagacactgtacgaggacaagccgcccaatactaaagacctggatgtgtttctgcggaaacaggaatcggggttcggctttcgcgttttgggcggggacgggccagatcagtcgatctatattggggctatcattccactcggggccgcagaaaaggacggtcgactgcgtgcagccgatgagcttatgtgcattgatggaattccggttaaaggcaaaagccacaaacaagttctcgacctgatgactacagctgcaagaaatgggcacgtcctgttaacggtgagaagaaagattttttacggagagaaacaacccgaggacgattccagccaagcttttatttccacccaaaacgggagtcccagactgaaccgggcggaggtacccgctagacctgcaccccaggaaccatacgatgtcgtgctacaacgtaaagagaacgaggggttcggcttcgtgatcctaacaagtaagaacaagccacctcctggtgtgatccctcataaaattggccgagtcatcgagggttcccccgccgaccggtgtggaaagctcaaagtgggcgatcacatctcagcagtcaatggacagtcaatcgtggagctgagccacgataacatcgttcaactgataaaagacgctggagtcactgtgaccctaactgtcattgcagaagaggaacaccatggacccccgtccggaacgaacagtgctagacaaagcccagctctccagcaccggcctatgggacaaagtcaagcgaatcatatccccggagacagatcagcactggaaggggagatcgggaaggacgtttcgacgagttaccggcattcctggtccgatcataagcacctggctcagcccgacactgctgtcatctctgtggtcgggtctcgccacaatcagaatcttggctgttatccagttgaactagagcgagggccccgtgggttcggctttagcctgagggggggaaaggagtacaacatggggctgtttatcctgaggctggcggaggacggtcccgcgattaaagacggtcggattcacgtgggggatcaaatcgtggagataaatggtgagccaacccagggcatcacccatactagggcaattgagttgatccaggccggaggtaacaaggtcctgctactcttgcgccccggaactggcttgattcccgaccatggactcgccccatcagggctttgttcatacgttaaacctgagcagcattag

SEQ ID NO: 31196 - DNA, 3378 bp, Artificial Sequence
  Description of Artificial Sequence: Synthetic coding sequence
atgagtaagacactgaagaaaaagaaacactggctgtcaaaggtccaagagtgtgccgtctcctgggcaggacctcctggggactttggagccgagatccgtggaggagccgaaagaggagaattcccctatctgggacgcctacgggaagagccaggaggtggaacttgctgcgttgtttccggcaaagcgccatccccgggcgacgtgctgctggaagtcaatggaacaccagtttccggtcttactaaccgggacacacttgctgtcattaggcactttagggaacccatcaggctcaaaaccgtaaagcccgggaaagtcatcaacaaagacttgcgacactatctgtctctgcaatttcagaaaggatctatcgatcacaagctccagcaggtgataagagacaacctctatctccgaaccataccctgtacaacgagagcacccagggacggagaggtccctggagtggattataacttcatttctgttgagcaattcaaggcattagaagaatctggcgcactcttagaatccggcacgtatgatggcaatttctatgggacccccaagccaccagcagagccaagcccatttcagcctgatcctgtggatcaggtgttatttgacaatgagtttgatgctgaatctcagaggaaacgcacaacatcggtgagtaagatggagagaatggactctagccttccagaggaggaagaggatgaggacaaggaagctattaacggtagcggtaacgctgaaaatcgcgaacgccattctgagagctccgattggatgaaaacagtgccctcttataatcaaactaattcatctatggatttcaggaactacatgatgcgggacgagacactcgagccactccccaagaattgggaaatggcatacaccgacaccggaatgatctatttcattgatcacaacactaagacaaccacgtggctggacccacgtttatgcaagaaagctaaagcccccgaggactgtgaggatggagaattaccttacggctgggagaaaatcgaggatccacagtatggaacatactacgtggatcatctaaaccagaagacccagtttgagaatcctgtcgaggaggccaagcggaagaagcaattggggcaggtggaaatcggatcatcgaaacctgacatggaaaagtcccatttcacccgcgatccgtcccagctgaaaggcgtgttggttcgcgcgtccctgaaaaagagtacgatggggtttggctttactattataggcggagaccgtccagatgaatttctgcaggtgaaaaacgtcctcaaagacgggcctgctgcccaggacggcaagattgcacccggagacgtcatcgtcgacatcaatggcaattgcgtgttaggccacacacacgcagacgtagttcagatgtttcaactcgtcccagttaatcagtacgtgaatctcacgctttgccggggctacccactaccggacgattccgaagatccggtggtagatatcgtagctgccacgcccgttattaacgggcagtctcttaccaagggcgagacctgcatgaatccgcaggattttaagcccggtgctatggtccttgaacagaacggcaaatccggccacaccttgaccggcgacggactcaacggaccatcggatgcgtccgagcagcgcgtttcaatggcctcatccggatcctcccagccagaactcgtgactatccccctgataaaaggtcccaaggggtttggttttgcaattgctgacagtccaactgggcagaaagtgaaaatgatcctcgacagccagtggtgtcaaggcttacagaaaggagatatcatcaaggagatttaccaccagaatgttcagaacctgacacatctgcaggtggtggaggtactgaagcaattcccggtaggggcggatgtcccactgctcatattgcgcggaggcccaccttctcctaccaaaactgccaagatgaaaaccgacaagaaagagaacgcaggctctctggaggcaatcaacgagcccattccgcagcccatgccctttcctccctccattatccgatccggctcccccaagcttgacccttcagaagtctacctgaagtccaagaccttgtacgaagacaaaccccccaacacaaaggacctagatgtgtttctccggaaacaggaaagtggcttcggctttagggtgttgggaggcgatggtcccgatcagtccatttatataggggcaatcatccccctgggggctgcagagaaggatgggagactgagagcagctgatgagctcatgtgtatcgatggcattcccgttaagggcaagtcccataagcaggtgcttgacctcatgacaacagctgcgagaaacggccacgtattgctgactgtgcggcggaagatcttctacggtgagaagcagcccgaggacgactctagccaagctttcattagtacccagaacggtagtcctcgcctgaaccgcgccgaggtcccagctagacctgcaccgcaggagccatacgacgtcgtgctgcagcggaaagaaaacgagggcttcggttttgtcattttgactagcaaaaacaagccccctcccggggtgattccacacaaaataggtagagtgatcgaaggctccccagctgatagatgcggcaagttaaaagttggtgaccacatctcagccgtgaatggtcagtccatcgtggagctctcacatgacaacatagtgcagctaatcaaagacgccggcgtgaccgtgaccctcacagtcattgccgaagaggagcaccatggacccccatcaggaaccaattcagcccgtcaaagtcccgctctccagcatagacccatgggccagtcccaggcaaatcatataccaggagaccgcagtgccctggagggagaaataggtaaggacgtctcaacatcttaccgacacagttggtcagaccacaaacacctggctcaaccggatactgctgtgattagtgtggtgggctcccggcacaatcagaacttgggctgctatccagtagaactggaaaggggccctcgggggttcggatttagcctgcgaggggggaaggaatataatatggggctctttatactacgattagcagaggacggacctgctatcaaagatgggagaatccatgtgggcgaccagatcgtggaaatcaacggcgagcctactcagggcatcacacatactagagctatcgagctcatccaggctggaggtaataaagtcctgcttctgttgcggcccggtacagggctgatccccgatcacggcctcgccccgtctggcctgtgttcttacgtcaaacccgagcagcattag

SEQ ID NO: 31197 - DNA, 1230 bp, Artificial Sequence
  Description of Artificial Sequence: Synthetic coding sequence
atgggacagtcccaggctaaccatattccgggagacaggtctgccctggagggggagatagggaaggacgtatcgacctcttacagacacagctggtctgaccacaagcacttagcccaacctgatacagctgtcatttcagtagttggttccagacacaatcaaaacctggggtgctaccccgtggagctggaaagaggcccgcggggatttggcttctctctgcggggaggaaaagagtataatatgggtttgtttattttgaggctagccgaggacggccccgctattaaagatggacgcattcacgtgggggaccaaatagtcgaaataaacggggagccaacacaagggatcacgcatactagggctatcgaactgattcaggccgggggaaacaaggtgctccttcttttgaggcccggaactggactgatccctgatcacggcgactgggacatcaacaacccatcttcgtccaatgtcatttatgacgagcagtctcctctgcctccttcgagccattttgcatccatctttgaggagagccacgtgccggtgatcgaggagagcctgagggtacagatttgtgaaaaggctgaagagcttaaagacatagtcccagaaaagaagtccacacttaatgaaaatcaacccgagattaagcatcagtccctgttgcaaaagaacgtgtctaaacgggaccccccctccagccatggacatagtaacaagaaaaatttgctgaaagtggaaaatggtgtaacccggcgcggcagaagtgtttccccaaaaaaaccagctagccagcacagtgaggagcacttagataaaataccctcaccattgaagaataatccgaagaggcgaccacgcgatcagagccttagcccgtccaagggtgagaataagagctgtcaggtgagcacccgggccgggtcaggtcaggaccaatgtagaaaatctaggggtaggagcgctagtccgaaaaagcagcagaaaatcgaagggtccaaggcccctagcaatgctgaggctaaactattggaaggtaagtcaagacgcattgccgggtacacaggcagtaatgctgagcagatccccgacggcaaggaaaaatccgacgtaattcgcaaggacgccaagcagaatcagcttgagaaggctgagcaggggctgcagaggaaaaaaagcaaggagtggctcagaaacctttttcaccccaaatag

SEQ ID NO: 31198 - DNA, 1200 bp, Artificial Sequence
  Description of Artificial Sequence: Synthetic coding sequence
atgggtagcagtaggtgtggacccggggctcacccagttcatctttggccaccacatttcgcctttagtgggcatcacccgcgggacctggggccacactcaggaccggctttgctggttagtctcgcctctgaggtccaggaccttcacctggcacagagaaaggagatggcctctggcttttcaaaggggcccaccctgggtctattgcccgatgtgccaagtctaatggagactctgagttattcatactgttatgtggggattatgaccgggccctttttccgctacaggacctacttggactggttagaacagcccttccctggtgcagtgccatccttgagaccattgctacggcgcgcctggcctgccccgctcttcggcctgttgtttctgctctcctctcacttgtttccgctggaggccgtgcgcgaagacgccttctacgcacgacctttgcctgctcgcctgttctatatgataccagtgttcttcgcatttcgcatgaggttctacgtggcatggattgccgccgaatgcggctgtattgcagctggcttcggggcttatcctgtggcggcaaaggccagggcagggggcggaccgacactgcagtgccctccccccagctcacctgagaaggctgcatccctggagtacgattatgagactatcaggaatattgactgttacagcacggatttttgcgtccgagtcagggatggtatgcggtattggaatatgacagtccagtggtggttagcacagtacatctataagtccgctcctgcccgatcatacgttctgcgctctgcttggacgatgttactgtccgcctactggcatggtcttcatccaggctattacttgagcttcctcaccattccactctgtctggcagccgaagggagattggagagcgctctgagaggaaggttatcccccggcggccaaaaagcctgggactgggtgcactggttcctaaaaatgagggcctatgactatatgtgcatgggattcgtgctccttagcttggcagatactttacgctattgggcaagtatttacttttgtatccattttttggcactggccgctctgggcctcggattagctttaggcggcggctcccccagcaggcgaaaagccgcctcccaacctacaagtcttgctccggagaagctcagagaagagtag

SEQ ID NO: 31199 - DNA, 1200 bp, Artificial Sequence
  Description of Artificial Sequence: Synthetic coding sequence
atgggatctagtagatgcggcccaggcgctcacccagtgcatttatggccaccccatttcgctttctctggccatcacccacgggacctgggcccccactccgggcccgcactccttgtcagtttggcatctgaagttcaggacctgcatctggcccagaggaaagaaatggccagtggtttctccaagggccccactttgggtctgctacccgacgtgcccagcctcatggaaaccttatcttactcatattgctatgtggggattatgaccggcccattcttcagataccgaacttacctcgactggctggaacagccctttcccggggcggtcccttctctcagacccctgcttcgacgggcttggccagctccactgttcggtttgctgtttttgttatcatcgcacctatttcccctggaggcggttcgggaggatgccttctatgccaggccattgcccgctcggctgttttacatgatcccagtgtttttcgccttcaggatgcggttctacgtcgcctggatagcagccgagtgcggctgtattgccgccggtttcggtgcctatcctgtggcggccaaggccagagctggagggggtcccaccttacaatgtcctcctccaagttccccagagaaagctgcttcccttgaatatgactatgagactattcgcaacatagactgctacagcacagacttttgcgtgcgagtgagggacggtatgagatattggaatatgactgtccagtggtggctcgcgcagtacatctataaatccgcaccggcccgctcctacgtgcttcgctctgcgtggactatgctgctttctgcctactggcatgggttacatcccggttattacttgagtttcctgaccatacctttgtgcctcgcggctgagggtcgactggaatccgcacttcggggcaggctttccccaggtggccagaaggcttgggactgggttcactggtttctgaaaatgcgcgcctacgattacatgtgcatgggcttcgtgctactctccttagccgataccctgcgatattgggcttctatctatttctgcatacacttcctcgccctggcagccctgggtctgggactcgctctcggcggaggctctccctcgcggcgaaaggccgcttcccaaccaacatccctggctccagagaagttgcgggaggaatag

SEQ ID NO: 31200 - DNA, 1200 bp, Artificial Sequence
  Description of Artificial Sequence: Synthetic coding sequence
atgggatctagtagatgcggtccaggcgcccatccagttcacttgtggccaccacattttgcctttagcggacaccacccgcgcgatctgggtccccattccgggcctgcactgctcgtttccttagcatccgaggtacaggacttgcatctcgctcagcggaaagagatggcctcgggtttttccaaggggcctaccctgggattgctgccagatgtgccatctctcatggaaacgttatcctactcctattgctatgtaggtatcatgactggtcctttcttccgttataggacatatctcgattggctcgagcagccttttcccggggccgtgccaagcttgcggcctctgctgagacgggcctggccagcccctctctttggtctgctgttcctgcttagcagtcacctgtttcccctagaggccgtccgggaggacgctttttacgcccggccacttccagcccggctcttttatatgattcccgtctttttcgcctttcgaatgaggttctatgtcgcctggatcgccgctgaatgtgggtgcattgccgctgggttcggcgcatatcctgtggccgcgaaagcgcgggccgggggcggccctactctccagtgcccaccccctagctcaccggagaaagcagcctctctcgaatatgactacgagactattcggaacatagactgctacagtaccgacttttgtgtacgagtgcgggacggaatgcggtactggaacatgaccgtccagtggtggcttgcccagtacatctataagtctgcacccgctagaagttacgtgttacgaagcgcatggacaatgctgctgagcgcctattggcacggcctgcaccccgggtactacctctcgttcctcactatccctctgtgcctggccgcagaggggagattggaaagcgctctccgaggtcggctgtctccaggtggccagaaagcttgggactgggtccattggtttctgaagatgcgcgcatacgattatatgtgcatggggttcgtcttgttgtcactggctgatacattacgatattgggccagcatttacttttgcattcattttctggccctagctgccctcgggctcggtctggctctaggaggtgggtccccaagccggcgtaaagcggccagtcaacctacaagtctggcaccggagaaacttcgggaggagtag

SEQ ID NO: 31201 - DNA, 1200 bp, Artificial Sequence
  Description of Artificial Sequence: Synthetic coding sequence
atggggtcctcgcggtgtggcccgggggcccaccccgtgcacctctggcccccacatttcgccttcagtgggcaccaccccagggaccttggcccacactccggtcccgccctgttggtctccttagcatccgaggtgcaggacctgcatctggctcagcggaaggaaatggcatctggattctctaagggacctactctcggcctcctgccggacgtcccttccctcatggagaccctgtcgtactcttactgctacgtgggcataatgaccggcccattcttccggtaccgcacctatttagactggctggagcagccgttcccaggcgctgtgcccagtctgcgcccccttctgaggcgcgcgtggcccgcgcctctctttggcttgctgttcctgctcagctctcacctgtttcccctggaagccgtacgtgaagatgcattttatgccagacccttgcctgcaaggctgttttacatgatcccagtgttcttcgctttccgaatgcggttttatgtggcatggattgctgctgagtgtggctgtattgccgccggttttggggcttatcccgtggcagcaaaggctcgggccgggggcggccctactctgcagtgtcctccaccatcatctcccgaaaaggccgcttccctcgaatatgattacgagacaatccgaaatatcgattgctatagcacggacttctgtgtgagagtgcgagatgggatgcgatattggaacatgaccgtgcagtggtggttggcccagtacatttacaagagtgctccagcgcggtcatatgtgctccgatctgcttggactatgttgttgtctgcttattggcacggccttcatcccggctattacctgtcctttctcacgatcccgctttgtttggcagccgaggggcgtcttgagtctgccctgagagggagattgtcgcccggaggacaaaaagcatgggactgggtccactggttcctgaaaatgagagcctacgattacatgtgtatgggtttcgtgttactctctctcgccgacacccttcgctactgggctagcatctatttttgcatccactttttagcgctggcagctttgggtctgggcttggccctcggaggggggtcgcccagtagacggaaagcagcatcccagccaacaagtctcgctccagagaagctgagggaagagtag

SEQ ID NO: 31202 - DNA, 1200 bp, Artificial Sequence
  Description of Artificial Sequence: Synthetic coding sequence
atggggtccagccggtgcggacctggagctcatcccgtgcatctctggcctccgcatttcgcattttcgggccatcaccctagagatctaggcccccatagtggtcctgcattgctggtgagcctggcatcagaggtgcaggatctccatttggcccaacggaaggagatggcgagcggcttctcaaaggggcccactttaggtcttctccctgatgtcccatccctcatggagacactgtcctatagttattgctatgtgggcattatgacgggcccgttttttagataccgaacgtatctggactggctggaacaaccctttccaggcgcagtacctagcctccgtccgctgcttcgacgcgcctggcctgcccccctgtttggacttcttttcctgttgtctagccacttgttccctttggaagccgttagagaggacgccttttatgctcggcccctgcctgccagattattttacatgatccctgttttttttgcgttcaggatgcgtttctatgtcgcctggatagctgccgagtgtggctgcattgctgcagggttcggcgcctaccccgttgccgcaaaagcaagagctggtggtgggcccactctgcagtgtccgccaccgagtagcccagagaaggcggccagcctggagtatgactacgaaactattcgcaatattgattgttacagcaccgacttctgtgtcagagtgcgcgacgggatgcgctactggaacatgactgtccagtggtggctggcgcagtacatatacaaatccgccccagcacggagctatgtcctcaggtccgcatggactatgttactgtcggcatactggcacggcctacatccaggttactacttgtccttcctgactattccgctctgccttgccgccgaagggcgtctggaatcagctctacgggggcggctatctcctggtggtcagaaggcctgggattgggttcattggttccttaaaatgcgcgcttatgattacatgtgtatgggcttcgtcctcctgtcattggctgataccctgaggtactgggcaagcatctacttttgcatccatttccttgccttagctgcgctcggactggggttagccctggggggaggtagcccatcacgtagaaaggcagctagccagcctacttccctcgctccagagaagcttcgggaggaatag

SEQ ID NO: 31203 - DNA, 1200 bp, Artificial Sequence
  Description of Artificial Sequence: Synthetic coding sequence
atgggttcaagtcgctgcggacccggcgcacaccccgtgcatttgtggcctcctcactttgcgtttagcggccaccatcctagagaccttggcccgcacagcggccctgcccttttagtttccctggcttccgaagtccaagatttgcatttggcccagcggaaagagatggcctcaggattttcgaaaggtccaactctcgggcttttacccgatgttcccagtctgatggaaaccctgagctacagctattgctacgtgggcattatgacagggccattcttcaggtaccgcacgtatctggattggctggaacagccatttccgggtgcagtgccttccttacgcccactactccgacgtgcttggccggctcctttatttggcctcctttttttgctcagcagccatctgtttccactcgaagccgtgagggaagacgcattttatgcacgtccacttcccgcacgcctattctatatgattcccgtcttcttcgcctttcgaatgcgtttttacgtggcctggatcgcggccgagtgtggctgtatcgcggccgggttcggagcgtaccctgtggcggctaaggcaagagctggaggtggaccaaccctgcagtgtccacccccaagttcccctgagaaggcagcgtctctagaatacgattatgaaactatccgaaatatagattgttactctaccgatttttgtgtgcgggtgcgggatggaatgcggtactggaatatgacagtccagtggtggttagcccagtacatttacaagagcgctcctgcccgatcttatgtcttacgatccgcatggacaatgttgctgtctgcctattggcacggactccaccctggatactacctgagctttttgactatcccactgtgccttgccgcggaggggcgcctggagtctgcgctaagaggcagactttcacctggcggccagaaggcatgggattgggtgcactggtttctcaaaatgagagcctatgattacatgtgcatgggtttcgtgctcctgagcttggctgacacgctgcggtactgggcctcaatttacttctgtattcatttcttggcgttagctgccttaggactgggcttagccttgggcggtggttctccaagccgtcgaaaggccgcctctcaaccaacttctctggcccccgaaaagctgagagaagagtag

SEQ ID NO: 31204 - DNA, 1200 bp, Artificial Sequence
  Description of Artificial Sequence: Synthetic coding sequence
atgggatcaagtagatgtggaccaggcgcacatcccgtccacttatggcctcctcatttcgccttctctgggcaccatccccgcgatctgggaccccattccgggccagcactcctggtgagcttggcttctgaggtgcaggatctgcacctcgcccaacggaaagagatggctagtggcttctctaaaggaccaacattgggcctgttgcccgacgtcccctccctgatggagacactgtcctacagctactgttatgtgggcattatgactgggccttttttccgatacagaacatatctcgactggctcgaacagccattccccggggctgtcccttctcttagaccgctgctgagacgcgcctggcccgcccccctgtttgggcttctgtttctactgtctagccacctctttccacttgaggcagtccgggaagacgccttttatgcaaggcccttgcctgccagactgttctatatgatccccgtgttttttgctttcagaatgcggttctatgtggcgtggatcgctgctgaatgtgggtgtatagcagccgggttcggcgcctatcctgtggcggctaaggcgagagccgggggtggccctaccctacagtgtccccctccttctagtccagagaaggcggcctccctagaatacgattatgaaacaattcgaaatatcgactgttattccacggacttttgcgtccgcgtcagggacgggatgcggtactggaacatgacagtgcagtggtggctcgcacagtacatctacaaatccgcccctgctcgcagctatgtgcttcggagcgcatggacgatgctattgagtgcatattggcatggcctccaccccggatactatctgtccttcctcacgatccctctctgtctggccgcagaaggccgcctggaatccgctttaagaggacgtctgtccccgggtggccagaaggcatgggattgggtgcactggtttctcaagatgagggcttacgactacatgtgtatgggcttcgtcttactcagcctggctgacaccttgcgctattgggcctccatatacttctgtatccactttctggctctcgccgcccttggcctcggactggctctgggtggcgggtctccttctcgaagaaaggccgcctctcagccgacgagtttagcccccgaaaaactgcgcgaagaatag

SEQ ID NO: 31205 - DNA, 1200 bp, Artificial Sequence
  Description of Artificial Sequence: Synthetic coding sequence
atgggtagttctcgttgtggccccggtgctcaccccgtgcacctgtggccgccccacttcgcctttagtggccatcatcctagggaccttgggccgcattccggtcctgccctgctggtaagccttgcttccgaggtgcaagatcttcacttggctcagcgcaaggaaatggccagtggattctccaagggacccacgctgggccttctgcccgatgttcccagtttaatggaaaccctctcatatagctattgctacgtgggtattatgactggtccctttttccgataccgcacttatcttgattggctggaacaaccatttcccggggctgttcccagcctacgccccctgctacgccgcgcatggcctgcacccctctttgggttgctgttcctactgtcttcacacttgtttccccttgaggccgtccgggaggacgctttttacgcgcgccctctccctgctagactgttctacatgatacctgtcttctttgccttccgcatgcgattctatgtggcttggatcgctgccgaatgtggctgcatcgctgcggggttcggtgcctacccagtggccgcaaaagctagggccggagggggtcctactctgcaatgcccacctccctcatcgcccgagaaagccgccagtctggagtatgactacgagacaattcgaaacatcgactgttattccaccgacttttgcgtaagggtccgtgatggcatgaggtactggaacatgactgttcaatggtggcttgcacagtacatatacaaaagcgctccagcaagaagttatgttcttcggagcgcgtggaccatgctgctgtccgcctactggcatggccttcacccaggttactacttaagctttttgactattcctttatgtctggctgccgagggcagattagagtcggccctgcggggaagattaagccctggggggcagaaggcctgggactgggtacactggttcctgaaaatgcgggcctacgactacatgtgtatgggattcgtgctcctttccttggccgatactctgcgatactgggcatcaatttacttttgcattcattttcttgctctggcagcactcggactgggtttggccctaggaggtggatccccatcacgaaggaaagccgccagtcaaccaacatccctggctcctgaaaaactgagggaggagtag

SEQ ID NO: 31206 - DNA, 1200 bp, Artificial Sequence
  Description of Artificial Sequence: Synthetic coding sequence
atggggtccagccgctgcggaccaggggcccatcctgtgcatctgtggccaccccacttcgccttcagcgggcatcatcccagagacctcgggccccactctgggcctgcgctgcttgtgagccttgcgtcagaggtacaagacctccacttagcccagcgaaaggaaatggcctcggggttcagtaagggacccacactgggtctgcttcctgatgtgccatccctcatggagactctctcatatagttactgttacgtcgggatcatgaccggaccattttttcgctaccgtacctacctggattggctggaacagcccttccccggggctgtgcccagtctgagacccctgctgagaagggcctggcccgcacctctgttcggcctcctgttcctcctgtcctctcatctctttccgttagaggccgtcagggaggacgccttctacgctagacccttgccagcccggttgttttacatgatccccgtcttctttgcatttcgtatgaggttctacgtggcctggatagcagctgagtgcggctgtattgccgctggattcggcgcctatccagtcgctgctaaagctcgcgccggaggaggccccaccctccagtgcccaccgccctctagtcccgaaaaggccgccagcctggagtacgattacgagacaattagaaatatcgactgctattcgacagatttctgcgtccgcgtccgtgatgggatgaggtactggaatatgactgtccagtggtggcttgcgcagtatatctataaatcagccccagccaggagctatgtattgcggagcgcctggactatgcttttaagcgcatattggcatggcctgcatcctggatactatctatcttttcttacaattcccctttgcctagcggcagagggccggctggagagcgctctgcgtgggagactgagtcccggagggcaaaaagcatgggattgggtacactggtttctcaaaatgcgcgcatacgactacatgtgcatggggtttgtgctgctgagcctagcagacactctgcggtattgggcctccatctacttctgcattcacttcttagctctcgccgccctgggcctcgggctggccctcggcggaggatccccaagcaggagaaaggccgcctcacagccaacaagcttagcacccgaaaagcttagggaggagtag

SEQ ID NO: 31207 - DNA, 1200 bp, Artificial Sequence
  Description of Artificial Sequence: Synthetic coding sequence
atgggatcttcgagatgtgggcccggagcccacccagtgcatttatggccgcctcactttgcctttagcgggcatcatccccgggacctgggacctcacagcgggcctgcgcttctcgtgtcattagcctccgaggtccaagacctccacttagcacagcgaaaggagatggccagcggtttctctaagggccccacccttggcttgctgccagacgtacctagtctgatggaaactctttcatattcctattgctacgttgggatcatgacagggccattcttccgctataggacctatcttgactggctcgagcaaccattcccaggcgccgtcccatccctcaggccgctgcttcggcgcgcctggccagcgccactgtttggcctgctcttcctgctgtccagtcacctgttccctctggaggccgtgcgggaggacgccttctatgcccgcccgctgcctgcccgattgttttacatgatacctgtgttctttgcgttcagaatgcgcttttacgtagcctggatcgccgccgagtgtggctgtattgctgctgggttcggggcgtaccccgttgccgccaaagctcgcgccggtggcggtcctacactgcaatgccctccgcccagctcccctgaaaaggccgcatccctcgagtacgactatgagacaattcggaacatagactgttactctaccgatttttgcgtgagggtgcgcgacgggatgcgctactggaatatgactgtacagtggtggttagcccagtatatttataaaagtgcacccgcaagatcatatgttttaagatctgcgtggacaatgcttctgagtgcctattggcatgggctgcatccgggctattatcttagtttcctaaccatccctctgtgcctggccgccgaggggcggctggaaagtgccctgcggggccggctcagccccggcggccaaaaggcctgggactgggtccattggtttctgaaaatgagggcatacgattacatgtgtatgggattcgttctgctttcactggccgatacgctgcgctattgggctagcatctatttctgtatccacttcttggctctggccgctctgggcttaggactggctctgggaggcgggtctccatcacgacggaaagctgcgtcccagcctacatctcttgctcctgagaagctgcgcgaggaatag

SEQ ID NO: 31208 - DNA, 1200 bp, Artificial Sequence
  Description of Artificial Sequence: Synthetic coding sequence
atggggagctcccggtgcgggccgggagctcatcctgttcatctgtggccccctcacttcgcgttcagcggccaccacccgagggacctcgggccacattcaggcccggcattgttagtatcattggcatctgaggttcaggatctgcacctggcccagaggaaggaaatggcttccggattctctaaagggcctacactgggcttgctgcccgatgtgcctagtctgatggaaacactcagttacagttactgttatgtgggcatcatgaccggcccttttttccgctaccggacctatctcgactggcttgagcagcctttccccggcgctgtgcccagcctccgtccccttctgaggagagcgtggccagccccccttttcgggctcctctttctgctctcgagtcacctgtttccgctggaagctgtcagggaggacgctttttatgcccgacccctgcccgcccggctgttctacatgatccccgtgtttttcgcttttagaatgcggttctatgtcgcttggattgcggctgagtgtggatgcattgctgcaggattcggagcctaccccgtggccgcaaaggcacgcgcaggaggaggtcccacattgcagtgtccacccccgtcgtcccccgaaaaggctgcctccctcgagtacgattacgagaccataagaaacatagactgctactccactgatttctgcgtcagagtgagggatgggatgcgatactggaatatgaccgttcaatggtggcttgcacagtatatctataaatctgcacccgcacggagctacgtgctgcgttcagcatggactatgctcctgtcagcgtattggcatggactccaccctggctactacctctcatttctgacaatacccctctgcctggccgctgaagggaggctggagtctgcccttcgggggagactcagccccgggggtcagaaggcctgggactgggttcattggttcctgaaaatgcgcgcatacgattatatgtgcatgggatttgtactgttgagtctggctgacactctgagatactgggcaagcatttatttctgcatacactttctggccttggcggccctcggactaggtttagcccttggggggggtagcccaagtcgcagaaaggcagcatcccagcctacgtctctggcacctgagaagttgagggaggagtag

SEQ ID NO: 31209 - DNA, 1200 bp, Artificial Sequence
  Description of Artificial Sequence: Synthetic coding sequence
atgggtagcagccgctgtggaccgggggcccaccctgtgcacctgtggcctccccattttgcattttctgggcaccatccgagagacctcggaccacatagcggcccagctctgctagttagccttgcttccgaggtccaagacctgcatctggcccagcgaaaagaaatggcgtctgggttttcaaagggaccaaccctggggcttttgccagatgtgccttcactgatggaaactctgagctacagctactgctacgtaggtattatgaccggtccatttttccggtaccgaacctacctggactggctggagcagcccttcccgggggccgtgccgtcactgagaccattactgaggagagcctggccggcccccttgtttgggttgttgttcctgctttccagtcatctgttcccattagaggcggtacgcgaggatgctttctacgccagacctttacccgcccgccttttttatatgatccccgtcttttttgcttttcgcatgcgcttttacgttgcttggattgctgccgagtgtggttgcattgctgctggctttggagcttaccccgtggctgccaaggcgagagccggcgggggacccaccctgcagtgccctcctcctagctcgccagaaaaggccgcaagcctggagtatgactatgaaacaatacgaaatatagactgctacagtacggacttctgcgtgcgtgttcgagacgggatgaggtactggaacatgacagtacagtggtggcttgcccagtatatctataagagcgccccagccagatcgtatgtgctgcggtcagcctggactatgctgttatccgcttactggcacggcctccaccctgggtattacttgtcttttctcaccatccccctgtgcctcgccgcagagggtcgtctggagtcagcccttcgcggccgattgagcccaggcggacagaaagcttgggattgggtccactggtttcttaaaatgcgggcatacgattatatgtgtatgggtttcgtgctcctttctctggcagatactctgcgatactgggcctcaatctacttctgtatccatttcttggcattggccgccttgggccttggcctcgcgttgggcggcggaagcccatctagaaggaaagccgcctctcagccaacatctctggctccagaaaagctgcgagaggagtag

SEQ ID NO: 31210 - DNA, 876 bp, Artificial Sequence
  Description of Artificial Sequence: Synthetic coding sequence
atgtcaatgcccctacaccaaatctcggccatcccatcacaggacgccatcagcgcaagggtctacagaagcaagacaaaagaaaaagagagggaagaacagaatgagaaaacccttgggcactttatgagtcactcttctaacatcagcaaagccggcagtcccccttccgcctctgccccggcacccgttagcagcttttctcggaccagcatcaccccgtcatcgcaggacatatgccgaatttgccattgtgaaggggacgatgaatctcctttaatcactccttgccactgtactggtagtctccattttgtacaccaggcctgtttgcagcaatggattaagtcttctgacactcgctgttgcgagctctgcaaatacgagtttattatggagactaaattgaaaccactccgaaaatgggaaaagctccagatgacttcttctgagcggcgaaaaattatgtgtagcgtgacatttcacgttatagcgataacatgtgtggtgtggagtctttatgtcttgatagaccggaccgctgaagagatcaaacaagggcaggctaccggaatcctggagtggcctttctggacgaagcttgtggtcgttgctatcggattcaccggaggcctgctgtttatgtatgtgcagtgcaaggtgtacgtgcagctatggaaacggctgaaagcgtataacagggtcatttatgtacagaattgtccggagacttccaagaagaatatttttgagaagtcacccctgaccgagcctaattttgagaacaaacatggttatggcatctgccactccgacaccaattctagttgttgcacagaacctgaagatacaggggccgagatcatccacgtgtag

SEQ ID NO: 31211 - DNA, 1089 bp, Artificial Sequence
  Description of Artificial Sequence: Synthetic coding sequence
atggcaagcggcagcgccggcaaacctaccggagaagccgctagtcctgctcctgcttccgctattggcggagcttcatcccagccaagaaagcgattagtgtcagtgtgcgatcattgtaaaggtaagatgcagctggtggccgacctgttactgttgagttctgaggccagacccgtgctttttgagggccccgccagcagtggagcaggggctgagtcttttgagcagtgccgggacacaatcatagcacggaccaaaggcctgagtatattaacccatgacgtgcagagccagcttaatatgggcaggttcggggaagcgggagacagcctggtggaactgggggacctcgtggtgagcttaaccgagtgctccgcacacgccgcttatctggctgcggtagcaacacccggagcccagcctgcacagcccgggctcgttgatagatatagggtgacccggtgcaggcatgaagttgaacaaggttgtgccgtgctgagggcgactccgttggctgacatgactccacagttgctcctcgaggtgtcacaggggctctctagaaacctgaaattcctcaccgatgcctgtgctctggccagtgacaaaagccgcgatagattcagccgcgaacagttcaagctgggtgtgaaatgcatgtcaacttccgcatcagcgttactcgcttgcgtgagagaggtgaaggtcgccccgtcagagctagcacgtagcagatgcgcactatttagcggccctctagtccaggcagtgagtgcgctggtcggctttgctacagaacctcagtttctcggacgcgcagcagccgtcagcgccgagggcaaagctgttcagaccgcaatcttgggtggggctatgtccgtggtgtcagcctgcgtacttctcacccagtgtcttcgggacctggctcagcatccggacggtggcgctaaaatgtcagaccacagggaacgcctgcgcaactcagcttgtgctgtgtcggagggttgtaccctcctttcccaggccctacgggaaagatctagccccagaacactgccaccagtgaactctaattctgttaattag

SEQ ID NO: 31212 - DNA, 879 bp, Artificial Sequence
  Description of Artificial Sequence: Synthetic coding sequence
atgcgggaatggtgggttcaagttggtctgctggctgtccctttgttggcggcatatcttcacattcccccgccgcagttgtctccagccctccatagctggaagtcctcaggcaaattcttcacctataaaggcctgaggattttttatcaagactccgtgggtgtggtgggaagcccagagattgttgtcttactccacggcttcccgaccagctcctacgactggtataaaatctgggagggattgaccttgcgctttcacagagtgatcgccctggattttctcgggttcggcttcagcgataaacctcggcctcatcattacagcatttttgagcaagcctcaatagtagaagctctgctcagacatctcgggctgcagaatcgacgcattaatcttctctcacacgactatggggatatcgtggctcaggaactcctttacagatataagcaaaacaggtcgggtagactgactattaagtccttgtgcttaagcaacggggggatcttccctgagactcataggcctcttctgcttcagaaactgctgaaggacgggggcgtgttaagtcctattcttacaaggctgatgaatttctttgtgttttcacgcggactgctgcagtacataaaccagcgcaagaaatttcgtaggcgttgggtcggcgccctggcatccgtgacgatccccatccacttcatctacggtccacttgaccctgtcaacccctatcccgaattcctcgaactgtataggaaaacgctgcctcggtccacggtatcgatcctggacgaccacataagccactatccccagctcgaggatcctatgggattcctgaacgcgtacatgggcttcatcaacagcttctag

SEQ ID NO: 31213 - DNA, 981 bp, Artificial Sequence
  Description of Artificial Sequence: Synthetic coding sequence
atgcgcgaatggtgggtacaagtggggctcctcgcggttcctctcctcgcggcctacctccacattccaccaccgcagttgtcaccggcgctgcacagctggaaatcttcgggcaagtttttcacatataagggattgcgaatattctaccaggactccgtcggtgtcgtcggcagtcccgagatcgtcgtgcttttgcacggattccctaccagttcttacgattggtataagatttgggaggggctgacgctgagatttcatcgcgtgatcgcccttgattttctgggcttcggttttagcgacaagccccgaccacaccattatagtattttcgagcaggcttcgatagtcgaggcattactgagacaccttggtttgcaaaaccgacgaattaatctactgtcacacgattatggcgacattgtagctcaggaactgttatatagatataagcagaaccggtcaggcagactaactatcaagagcctatgtctgagcaatggagggatttttcccgaaacccatcgccccctgctcctgcagaagctgctcaaggatggaggagtgctcagccccatcctcactcggctgatgaactttttcgttttttcccggggtctcactcctgtcttcggtccatatacacgtccgagcgaatcagaactgtgggatatgtgggctggcattaggaataacgatggaaacctggtgatcgattctctgctccagtatatcaatcaacgcaaaaagtttcgtcggcgctgggtcggagctctcgccagcgtgaccatccctatccacttcatttatggccctttagacccagtgaacccatatccagaattccttgagttgtaccgcaaaacccttcccagatccaccgtgtcaatcctcgacgaccatatctcccattacccacagttggaggatcctatgggtttcctgaacgcttacatgggatttattaactctttctag

SEQ ID NO: 31214 - DNA, 879 bp, Artificial Sequence
  Description of Artificial Sequence: Synthetic coding sequence
atgagggagtggtgggtccaggtgggactgctagctgtgccactgctggctgcatacctacatattcctcctccacagctctctcccgcactgcatagctggaaaagcagcggtaaattctttacctacaagggcttgcgtatcttctatcaggacagtgtgggcgtggtgggaagcccagagatcgtggttctgctacatgggtttccaactagctcatatgactggtataagatctgggaaggcctcacgctccgcttccacagagttatcgcccttgatttccttggcttcggtttctctgataagccacgtccacatcattatagcatttttgagcaggccagcatagtcgaagctttactgcggcacctgggtctgcagaacaggagaataaatcttctgagccatgattatggcgatatcgtagcccaggagctgctgtatcgctacaagcaaaataggagcggccgtctcacaatcaagtctctatgcctgagcaacggcgggatctttcccgagacccaccggcccctgctgctacaaaagcttctcaaagatggaggagtcctgtccccaatcctcactcgactcatgaacttctttgtcttctcaagaggattgcttcaatatatcaatcagagaaaaaagtttcgtagacgctgggtcggagccttggcttccgtcacaattcccatccactttatctacggacccctggatcctgtgaacccataccccgagttcctggagctttaccgcaagactttgccaaggagtaccgtcagcattcttgatgatcatataagtcattatcctcagctcgaagacccgatgggattcttgaacgcctacatgggatttattaattctttctag

SEQ ID NO: 31215 - DNA, 981 bp, Artificial Sequence
  Description of Artificial Sequence: Synthetic coding sequence
atgcgagaatggtgggtgcaggtcggccttctcgctgtcccgttgctcgccgcgtatttacatatacctccgcctcagttgagccccgcccttcacagttggaagagttcgggcaagttcttcacttacaaggggctacgcattttttaccaggattctgtgggcgtagtggggagccccgagatcgtcgtgctgctgcacggattccccacttcttcgtatgattggtataaaatctgggaaggcctgacgctccggtttcatagagtgattgctcttgacttcctgggattcgggttctcagataagccccgcccccaccattatagcatttttgagcaggcctccatagtagaggcactattgcggcacttgggcctgcagaatagacgtattaacctgttgtcacatgattatggcgatatcgtcgcccaggaattgctgtacagatacaagcagaaccgcagtggccgcctgacaatcaaaagcttatgcctgtccaatggcggaatcttccctgagacgcacagaccactcctgctacagaagctgctgaaggacgggggggtcctctcgcctattctgacacggctaatgaattttttcgttttttctaggggtcttacccccgtgtttggaccttatactagaccgagcgagtccgaactctgggatatgtgggccggaatccgaaacaatgatggcaacttggtaatcgatagcttgcttcagtatataaaccagaggaaaaagttcagaagaaggtgggtgggggcgctcgccagtgttaccatcccgattcatttcatttacggcccattggacccagtcaacccatacccagaattcctggaactctaccgtaaaacactgccacggtctaccgtgtccatcctcgacgatcacatatctcactatccacagttagaagacccaatgggcttcctgaatgcttacatggggttcatcaacagtttctag

SEQ ID NO: 31216 - DNA, 801 bp, Artificial Sequence
  Description of Artificial Sequence: Synthetic coding sequence
atgcggaccgaacccctgtgtggagcgtctcccctgctggtccccggcgacccctactccgtggtagttttgcttcaaggatatgcagaaccagagggggtcggggacgccgtgcgcgccgatggatccgttacccttgtgttgccccaaacacgcgggcccgcgtctagtcacagagagtccccccgcggaagcggcggcgccgaggccgctttggaggaagccgctagaggcccgattctggtagatactggagggccttgggcaagggaggcactgctcggcgcattggccggccagggagtcgctcctggcgacgtaacattggtggtcggcacccacggtcacagcgaccacatcggtaacctggggctgttcccaggcgcggctttgctggtttcacatgatttctgcttgcccggcggcagatacttaccccacgggttaggggagggacagccactcaggctcggcccaggacttgaggtatgggccacgcccggacatggaggacagcgcgatgtgtctgtggtggtggcgggaactgctctggggaccgtggtagtggccggcgatgtgtttgaaagagatggcgatgaggattcatggcaagccttaagcgaagatcctgccgcgcaggaaaggtcccgaaaacgcgtccttgtggtcgccgatgtggttgttcccggtcatggccctcccttcagggtgctgcgcgaagcaagccagcccgagactgagggcggaggcaattcccaacaggaacccgtggtgggagacgaggagcccgccctccattag

SEQ ID NO: 31217 - DNA, 342 bp, Artificial Sequence
  Description of Artificial Sequence: Synthetic coding sequence
atgaggactgagcctttatgcggtgcttctcccctgttagtgccaggcgatccgtattctgtggtggttttactgcagggttatgcagaacccgagggggtgggggacgcagtgagagccgatggcagcgtcacgcttgtcctcccgcagacccggggcccagcctcatcccaccgtgagagccctagaggcagcggcggtgccgaagctgccctggaagaagctgctcgaggtcctatcctggttgacactggcggtccttgggcccgcgaggccctgctgggcgccttggctggccaaggggtagcccctggagacgttacgctggttgtgggaacctag

SEQ ID NO: 31218 - DNA, 840 bp, Artificial Sequence
  Description of Artificial Sequence: Synthetic coding sequence
atgtccgctctggaatggtacgcccataaatccttaggggacggcatattttggatccaagaaaggttctatgagagcggtaacagggcaaatatttggttagtccgcggctccgagcaggatgtggtaatcgacactggcttgggactccgaagcctacctgagtatctctatagttccggacttctgcaagatagggaggcaaaggaggacgccgcccgccgccccctgctggccgtcgctacccacgtgcattttgaccatagcggcggattgtaccagtttgatcgggtggccgttcatcacgccgaagcagaggccctcgcaagaggtgataactttgagacagttacctggctctccgactcggaagtcgtccggacgccgtcacccggttggagagctcggcagttcagggttcaggcagttcagcccaccctgattcttcaagacggggatgtcatcaacctgggcgacagacagctgaccgtgatgcacatgccaggacacagtcgtggctccatctgtctacatgacaaagatcgaaaaattctcttttccggtgacgtagtgtacgatggatctctgattgattggctgccctacagccgcatatctgactatgttgggacttgtgagaggcttatcgagctcgtagataggggtctagtggaaaaggttttgcccggacatttcaatacattcggggccgagagactattccggctggcttctaactatatatctaaagcaggaatatgtcataaagtgagcacttttgcgatgcgatccctggcctccctggccttgagggtaactaactcccggacttccccctag

SEQ ID NO: 31219 - DNA, 600 bp, Artificial Sequence
  Description of Artificial Sequence: Synthetic coding sequence
atgtcagctctcgaatggtacgcacacaaatcactgggagacggtatcttttggatacaggaacgcttctacgagtccgggaaccgtgctaacatctggctggttcgaggtagcgaacaagacgtggtgatagacactggtctgggattgagatctctacccgagtatctgtattcaagcgggctgctccaggatcgcgaagccaaggaggacgccgcgcgcaggcctctgttggctgtggctacccatgtgcattttgatcacagtggcggcctgtatcagttcgatcgggtggccgtgcaccacgcggaggcagaagcgcttgcgcgtggagacaactttgaaactgtgacctggctgagcgacagtgaggttgtgagaactcctagccctggctggagagcccgccagttcagggttcaggccgtgcagcctaccctcatcctgcaggatggaaacggcccacctagggcccgagccctggtaaaaggagggtactgggaagagactgtccgcgttccgcacgtggccgatttgcgagggcacaagggggattacttcgggacctcccaaagtcacttctgtttcacactcccctag

SEQ ID NO: 31220 - DNA, 630 bp, Artificial Sequence
  Description of Artificial Sequence: Synthetic coding sequence
atggcagcccgaaggcctctgctggccgtagctacgcatgtacactttgaccattctggggggctgtaccagtttgatagagtcgcggtgcaccatgcagaggccgaagcactggcccggggggataacttcgagaccgtgacctggctgagcgactccgaggtcgtgaggactccatcgccagggtggcgggcaaggcagttccgcgtgcaagctgtgcaaccaacactcatccttcaagatggcgatgtgatcaacttaggagatcgccagcttaccgtcatgcacatgcccggtcactctcgcggttcaatttgtttacacgataaggaccgaaagattctgttctcaggcgacgtcgtctacgacgggtcccttatcgattggctcccctattcccgaatctcagattatgtcggcacgtgcgagcgattgattgagctggtggatcggggcctcgtcgaaaaagtcctcccagggcatttcaacacattcggtgctgaaaggctttttagactggcgagtaattatatatccaaagccggtatctgtcataaagtatccactttcgcgatgaggtcactcgcgagcttggccctgagggtgactaattctagaaccagcccctag

SEQ ID NO: 31221 - DNA, 840 bp, Artificial Sequence
  Description of Artificial Sequence: Synthetic coding sequence
atgtctgccctcgaatggtatgctcacaagagtctgggggacggaatcttttggattcaggagaggttttacgaatctggcaatcgagcaaacatctggctggtcaggggctccgagcaggacgtcgtgattgatacgggcctcggccttagaagtctgcctgagtatctgtattcctccgggctgctccaagatagagaggctaaggaggatgcggcccgacgtccactgctcgccgtcgccacacacgtgcactttgatcatagtggaggcctgtaccagtttgaccgcgtagccgtgcaccatgcggaagccgaggccctagcaagaggagacaacttcgagactgtgacctggctctcagattctgaggtagtacggaccccttctccgggctggcgcgctcgtcagttccgagtgcaagccgtccagcctacactgatcctccaggatggcgacgtgatcaacctgggggacaggcaactgactgttatgcacatgccaggccattcacgtggctccatatgtctgcatgacaaggatcgcaaaattctgttttccggggatgtcgtctatgatggaagcctgattgactggctgccttactctcggatcagcgattatgtggggacttgtgagagactgatcgaactggtggataggggactcgtagaaaaggtcttgccgggtcatttcaatacatttggcgcagaacggcttttcagactggcctcaaactacatcagtaaggctggaatctgtcacaaggtcagcacgtttgccatgcgttccctcgcttcactggctcttagggtcactaactcacggaccagcccttag

SEQ ID NO: 31222 - DNA, 153 bp, Artificial Sequence
  Description of Artificial Sequence: Synthetic coding sequence
tcatgcacctacgcatctttctgcaagtgtaaggaatacaagtgtacctcttgcaaaaagaattgttgctcctgttaccctgtaggctgcgctaaatgcgctcaggggtgtatctgcaagggcgcttccgacaaatgttcctgctgtgcatag

SEQ ID NO: 31223 - DNA, 123 bp, Artificial Sequence
  Description of Artificial Sequence: Synthetic coding sequence
atggacccaaactacagttgcactactggggggagttgcacatgcgccggctcttgcaagtgcaaagaatgtaagtgtacaagttgcaagaagtcttgttgcttctgctgtcccatgggatag

SEQ ID NO: 31224 - DNA, 186 bp, Artificial Sequence
  Description of Artificial Sequence: Synthetic coding sequence
atggatcccaattgttcctgcacgacaggagtgtcctgtgcatgtaccgggagttgtacgtgtaaggagtgtaagtgtacctcctgcaagaagagttgttgctcttgctgccctgtgggctgcgcgaaatgcgctcatgggtgcgtttgcaaggggactctggaaaattgttcctgttgtgcctag

SEQ ID NO: 31225 - DNA, 879 bp, Artificial Sequence
  Description of Artificial Sequence: Synthetic coding sequence
atggaaacggcagagaaggagtgtggtgcattgggcggcctgttccaggcaatcgtcaacgacatgaagtccagctaccctatttgggaagacttcaatagcaaggccactaagttgcactctcagttgagaaccacggtcctggccgcggttgcctttctcgacgcctttcagaaggtggccgacatggctacgaacacacggggggcaactcgtgatatcggatccgccctgactaggatgtgcatgagacaccggtcgatcgaaacaaaattaaggcagttcacgaatgccctgttggagtctctcatcaaccctctccaggaacggattgaagattggaagaaagccgccaatcagttggataaggatcacgccaaagagtataagagagctcgccatgaaataaaaaagaaaagctccgatacactgaaattgcagaagaaggcgcggaagggcaagggcgacctgcagccacagcttgacagcgctctccaagacgtgaatgatatgtacttgctgctcgaggagactgagaagcaggccgtgcgaagggcactgatcgaggagcggggccggttctgcacctttataaccttcctccagcctgtggtgaacggcgaactcactatgctcggggaaatcacgcatctacagggcattattgatgatctggttgtgctgaccgccgaacctcataaactccccccagcaagtgagcaggtaattaaggacctcaagggaagcgattattcctggtcatatcagactcctcccccatctgtgcccagtgagcccttcgtgtccttcctgtctgtaagattctggaagaactctccactacttcccgccccaagtaccccttcttcaccaatctag

SEQ ID NO: 31226 - DNA, 2244 bp, Artificial Sequence
  Description of Artificial Sequence: Synthetic coding sequence
atggagacggcggagaaggaatgcggggcattgggtggactgtttcaggcgatcgttaacgatatgaagtcgtcctacccaatctgggaggacttcaactcaaaagcaacgaagcttcattcacagctaaggaccactgtcctggctgcggttgcttttctcgatgcctttcaaaaggtagcagatatggctacaaatactcgtggggctaccagagacattggctccgctttgactaggatgtgcatgcggcacaggtctatcgaaactaagctccgccagttcacgaatgctctgctcgagtccctgattaatccattacaggagaggatcgaagattggaaaaaagctgcgaaccaactggataaggaccacgctaaagagtacaaacgcgcccgccacgagatcaaaaaaaagagctccgatacccttaagctccagaagaaggcccggaaggaactgttggggaagggcgatctgcagccccagctggattccgcactgcaagacgtgaacgacatgtacttacttctagaggagacggaaaaacaggcggtgaggcgggccctgatagaagagagggggcggttttgcacctttatcacatttctgcagcctgtggttaacggcgaacttacaatgctgggtgagataacccatctccaggggataattgatgacttagtggtccttacggctgagccacataagctgcccccagcttcagagcaggtaatcaaggatctgaaagggtcggattactcgtggtcttaccagacgccaccttcctccccttcgtcctcaagcagtcgcaagtcttccatgtgctccgcacccagcagttccagcagcgcaaaaggcggcggcgccccttggcctggtggcgcccagacatacagccctagtagtacctgccgttatcgatctctggcccagcctgccactaccaccgcccgcctcagcagcgtgtcctcgcacgacagcggatttgtgagtcaggatgccacctattccaagcctcccagtcccatgccctcggacattacttcacagaagagttcttcgagcgctagtagcgaagcttcagagacctgtcagtctgttagcgagtgctcttcacccacgagcgactggtcaaaggtgggctctcacgagcagcctagtggagctactctccagagaaggaaggatagggtggaactactccgagacactgagcccggaccagcctcggggggcactcttggcccctcaggcgaagaagcgccacgcccccggatgtccccggccacaatcgctgccaagcatggagaggaagtatcgcccgccgcgtccgacctcgcaatggttctgacccgcggtctatccctcgagcaccagaagagctcccgagacagccttcagtattcctcaggctactccacgcagacgaccacgccatcttgctccgaggatacaatcccctcacagggctcagattacgactgctactccgtgaacggtgacgccgattcagaagggccaccagagtttgacaaatctagtaccattccgaggaactccaatattgctcagaattaccgccgtctcatccagacaaaacgccctgcaagtactgctgggttacctacagctggactgcccaccgccactggcttgccctccggcgctccccccggggtagccactattcgcagaacaccatccactaaacctacggtgcggcgggccctgagttctgcagggccgatacctattcgacccccaatcgttccagtcaaaacacccacagtcccagatagcccaggttatatgggacccaccagagcaggctctgaagaatgcgtgttttacaccgatgagaccgcctccccactggccccagatcttgctaaggcttcacctaagcgcctgagccttcccaacaccgcctggggctcccctagccccgaggccgcgggttatcctggcgctggagctgaagacgagcagcagcagctggctgcaaaccggcattctctcgtcgaaaaacttggtgaattagtggctggcgcccacgcactgggcgaaggtcaattcccatttcccacagcactgagtgcgaccccaacggaagagaccccaactccaccccctgccgctacatcggatccgcctgcagaagacatgctagtagccataagacgcggagtaagactgcgtcgtaccgtgactaatgatcggagcgctccaagaatactatag

SEQ ID NO: 31227 - DNA, 1149 bp, Artificial Sequence
  Description of Artificial Sequence: Synthetic coding sequence
atggagccgcgagcaggtgtttccaagcaagacattcgcgagcaaatttgggggtatatggagagtcagaacttggccgattttcctcggcccgtgcatcaccgaatcccgaactttaaggggtcctacctggcttgtcagaacattaaggatcttgacgtgtttgcccgcacccaggaggtgaaggtagaccccgataaaccgctggagggcgtgcggcttctggtactgcagtcgaaaaagacattattagtacccactccacggctgagaaccggcttgtttaacaaaattacccctccacccggagccaccaaggacattctacgaaaatgcgccacatcgcagggagtgaggaattactccgtgccaattgggctggattcccgcgtgctcgttgaccttgtcgtagtgggctcagtggccgtttctgaaaaaggatggaggataggcaagggagaaggctatgctgatctcgaatatgctatgatggtctctatgggggcagtgtctaaggaaactcctgtagttaccatcgtccacgactgccaagtggtcgatatccctgaggagttggtggaagaacatgatatcacagtcgattacatcctgacccccactagggttatagccactggatgtaaacgccccaagcctatgggcataacctggtttaaaatcagcctagaaatgatggagaagatcccgatcctgcgctctctgagagcaagggagcagcaagcaggaaaggacgtgaccttgcagggagagcaccaacacttacccgaaccaggttgtcagcagaccgtaccattatccgtaggcaggcgcccccctgacacccccgggcccgaaaccaactccatggaggccgcccccggatcacccccgggcgagggggcccccttggctgcagatgtatacgtcgggaacctcccaggagacgctagagtgtcggacctgaaaagggctctgagggaactgggatcagtgccactgcgcttgacttggcagggtccccgtagacgcgccttcctgcactatccagattcggctgcggcacaacaggcagtgagctgtttgcaagggctgcgccttggaacggacacgcttcgggtggccctggcgcgccagcagcgggacaaatag

SEQ ID NO: 31228 - DNA, 1152 bp, Artificial Sequence
  Description of Artificial Sequence: Synthetic coding sequence
atggaaccgcgcgccgtaggcgtgagcaagcaggatatccgtgagcagatttgggggtacatggaatcccaaaacttggcagattttcctaggcccgtgcatcatcggattcctaactttaaaggctcctatcttgcttgccagaacatcaaggacctggatgtgtttgctcggacccaggaggtcaaagtggatccagacaagcccctcgagggcgttcggctgctcgtcttgcagtctaagaaaacccttctggttccaacacctcggctccggacgggcctcttcaataaaatcacccctccccccggtgctacaaaagatatcctgcgaaaatgcgcaacctcccagggagtgcgtaactatagtgtgcccattgggcttgactcccgggtactggtggacctggtggtggtggggtctgtcgcggtcagcgagaagggctggaggattggaaaaggcgagggctatgccgacctcgaatatgccatgatggtgagcatgggtgccgtgagtaaggaaactccagtggtgacaatagtacatgactgccaggtggtggacatcccggaggagctggtcgaggaacacgatatcactgtggattatatcctcacacccacgagagttattgcaactggatgcaagcgccccaagcccatgggcattacttggttcaagatttcactggaaatgatggagaagatccctatactacgatctctgagggcacgcgagcagcaagccgggaaggacgtgactcttcagggcgagcaccagcacctcccagagccaggatgccaacagactgttcccctgtctgtgggccggcgcccgccagataccccagggccagagactaatagcatggaggcagcccccgggagcccccctggagagggagctcccctcgctgctgatgtttacgtgggtaacttgccaggagatgcgagggtgtctgatctaaagcgggcccttcgcgagctggggtcagtccctctgagactgacttggcagggcccgagacgccgagctttcttgcactaccccgattctgccgctgcacagcaagccgtttcctgcctccaaggactgaggctcggtactgacacgctgagagtggcactcgcccgccagcagagagacaaatag

SEQ ID NO: 31229 - DNA, 1152 bp, Artificial Sequence
  Description of Artificial Sequence: Synthetic coding sequence
atggaaccgagagccgtgggcgtgagtaagcaggacatccgggagcaaatttggggctatatggaaagccaaaacctcgctgacttccccagacccgtgcaccaccgcatccctaactttaaaggcgcttctcatgccgcagagcagcttccacggctgcaggccttcaaaacagctaggacaatcaaggtgaaccctgacgctccacaaaagtctgccagattctttgtcctggagtccaaaaagaccctcctggtgcccacaccccggctacgcacggggctgttcaacaaaatcaccccgccccccggcgccacaaaggacatacttagaaaatgcgccacgtctcagggtgtccgcaattattcagtgcctattggtctcgatagcagggtcctcgtcgatctggtcgtagttggatcggtggcagtgtccgaaaaggggtggagaatcgggaaaggggaggggtatgctgatctggagtacgccatgatggtttccatgggagctgtgtccaaggaaacccctgttgtgactattgtgcacgattgccaggttgtggacataccagaggaattagttgaggagcacgatattaccgtcgattacatcctgactcctacgcgtgttatcgccacgggctgtaagcgtcccaagcctatgggcataacgtggtttaagatcagcctcgagatgatggagaagattccgatcctgcgcagccttcgagcgagggagcagcaggctggcaaggacgtgacactccagggcgagcatcagcatctgcccgaaccaggttgccagcagaccgtccccctctccgtgggcaggcggcctcccgatacgcctggtcccgagaccaactccatggaagctgcccctggcagtcctcctggtgagggggcaccattagccgcagacgtctatgtcggcaatctcccgggagacgcacgagtctccgacctgaaacgggcgcttagggagctcggatccgttccactgagactcacctggcaggggccaagacggcgggcattcctgcattaccccgatagtgctgccgcacagcaggctgtctcctgtctgcagggtctgaggcttggaaccgatacactccgggtggcactcgcccggcagcagcgagataagtag

SEQ ID NO: 31230 - DNA, 1146 bp, Artificial Sequence
  Description of Artificial Sequence: Synthetic coding sequence
ggacctaggttaggcgtttcgaagcaggacatccgggaacagatctgggggtatatggagagccagaaccttgccgactttcccaggcccgtgcaccaccgaatccccaatttcaaaggatcgtacttagcttgccagaatataaaggacttggacgtcttcgcgcggactcaggaggtgaaagtggatcctgacaagcccctcgaaggagttcgcttgcttgtgctgcagtctaaaaagacactcctggtcccaacaccgcgcctgcgaacaggcctttttaataagataacaccgccccccggagcaaccaaggatatactaagaaaatgtgctaccagtcaaggcgtccggaactacagcgttccaatcggcttggacagtagggtcctggtggacttggtggtcgttggatctgtagcggtgagcgagaaaggctggcggatcgggaagggggaaggatatgcagacctggagtacgccatgatggttagcatgggcgccgtgtccaaagagacacccgtggtcacaattgtgcacgattgtcaggtggtcgacatccctgaagaactggtggaggaacacgatattacagttgactatattctcaccccaacacgcgtgatcgccactggatgcaaacggcccaaaccaatgggaatcacatggttcaagatctcgcttgaaatgatggagaagattcctatactcaggagcctgcgcgccagggagcagcaagcaggaaaggatgtgacacttcagggggagcatcaacacctccctgagccaggatgccagcagactgtgccactctcagtagggcggagacccccagatacccctggccctgagactaattctatggaagccgcacctggatccccacctggcgagggtgcccctcttgccgctgacgtttacgtcggcaaccttccaggagatgcacgtgtgtctgacctcaagagggccctcagggagttagggagcgtgcccctaaggctgacctggcagggacctaggcgccgagccttcttacactatccagacagcgcagctgcccagcaagctgtgtcttgtctgcagggcctgcgtctgggtaccgacactctacgggtagctttagcccggcagcagcgagacaagtag

SEQ ID NO: 31231 - DNA, 663 bp, Artificial Sequence
  Description of Artificial Sequence: Synthetic coding sequence
atgatggtcagcatgggcgcagtgtccaaagaaactccggtggtgacgatcgtgcatgactgtcaggtggtagacatccctgaggagctggtggaggagcacgatataactgtcgactatatcctcacaccaacccgggttatcgcgacggggtgcaaacggccaaagcctatggggataacatggtttaagatctccttggagatgatggaaaagattccaattctcaggtctctaagagcccgtgaacagcaggccggtaaagacgtcaccctgcagggggaacaccaacatctgcctgaacccggatgccaacagaccgtcccgcttagcgtcggcagaagacctccagacacaccggggcccgaaacaaactccatggaagcagcgcctggatctccccctggggaaggagcaccccttgccgccgacgtgtacgtgggcaaccttccgggagacgcgcgagtgagcgatctcaagcgggctctgagggagttgggttccgttccactgagattgacctggcagggaccccgacgccgcgcctttttacactacccagatagtgcagccgctcagcaggctgtgtcctgtttgcagggactgcgattgggtacggacaccctgagggtggcactggcacgtcagcagagggataaatag

SEQ ID NO: 31232 - DNA, 579 bp, Artificial Sequence
  Description of Artificial Sequence: Synthetic coding sequence
atgtgttctgaacccaagcaccacgtcaatggcaaccgcaccgtggaaccctttccagaagggactcaaatggctgtgttcggtatggggtgcttttggggggcagagcgcaagttttgggtgctgaagggagtctactccacacaagtcggatttgccggtggatatacttccaacccaacctataaagaggtgtgcagcgagaaaaccgggcacgcggaggtggtccgcgtagtgtatcaaccggaacacatgagttttgaggaattattaaaagttttctgggagaaccatgaccccacacagggaatgagacaaggcaatgatcacggcactcagtataggagtgcgatatatcccactagcgctaagcaaatggaagccgcactgtcctcaaaggaaaactatcagaaggtcctatccgagcacggttttgggccgattaccactgatataagggaaggacaaaccttctattacgctgaggattatcatcagcagtatctgtcaaagaaccctaacgggtattgcggactggggggcactggcgtgtcgtgccccgtcggtattaaaaaatag

SEQ ID NO: 31233 - DNA, 588 bp, Artificial Sequence
  Description of Artificial Sequence: Synthetic coding sequence
atgctgtcagcaacacgcagggcttgccaactcctcctactccactccctgttccccgtgccacgcatggggaactcagcgtccaatattgtttcgccacaggaggccctgccaggacgcaaggagcagacacccgtggctgccaagcatcatgtgaacggcaatcggaccgtggagccattcccggagggtactcagatggcagtgtttgaaaaaacggggcacgcagaagttgtcagggtagtgtaccagcctgagcatatgtcttttgaggagcttttgaaggtgttctgggagaatcatgaccctacccagggcatgaggcagggcaatgaccatggcacccagtatcggtccgcaatctatcctacgtctgctaagcagatggaggccgcactgtcaagtaaagagaactaccaaaaggtactgagtgaacacggatttgggcctataacaactgacatacgagaagggcagacgttctattatgccgaagactaccatcaacagtacttgagcaagaatcccaacggctactgtggcctcggcggaactggggtttcatgtcctgtggggattaagaagtag

SEQ ID NO: 31234 - DNA, 510 bp, Artificial Sequence
  Description of Artificial Sequence: Synthetic coding sequence
atggccgtgtttggcatgggctgtttttggggcgccgagaggaaattttgggtgctgaaaggtgtctattctacccaagtgggatttgccggggggtacacttccaacccgacgtacaaggaagtgtgcagcgaaaaaacagggcacgctgaggttgttcgcgtcgtctaccaacctgagcacatgtcctttgaggagctgcttaaagtcttctgggaaaaccacgacccaacccagggcatgcgacaaggaaacgaccatggcacacaatacagatctgcaatctatcccacgtcagctaaacagatggaggccgctctttccagtaaagaaaactaccagaaggtcctctccgaacacgggttcggccctattacaaccgatatcagggaaggccagacattctactatgcagaagattaccatcagcagtaccttagcaagaatcctaatgggtactgcggcctggggggaactggggtatcgtgtcccgtgggcattaaaaaatag

SEQ ID NO: 31235 - DNA, 627 bp, Artificial Sequence
  Description of Artificial Sequence: Synthetic coding sequence
atgggagaacctgcattcacatctttcccgtccttacccgtgctgggcaagctaaaacggaatatgatgccttgggcattacaaaaaaaacgggagattcatatggctaaagcacatcgtcgacgtgcggcgcggagcgctttgcctatgcggctaacatcatgtattttccgccggccggtgacccgtatccgttctcaccccgataaccaggtgcgtagacgaaaaggagacgaacacctcgaaaagccccagcagctctgtgcttataggcgactccaggcgctgcagccgtgctccagccaaggcgaaggctcctcgccacttcatttggagtccgtgttgagtatcctggcacccggaaccgctggggaatcactcgaccgggcaggggctgagcgagtgcgctcccctctcgagcctactccgggtcggttccctgcagtggctgggggccctaccccaggaatggggtgccaactcccccccccccttagcgggcagctggtcacaccagcagacatcagaaggcaggccagaagagtcaaaaaagcccgggaacggctggctaaggccttgcaagccgaccggttggctcgccgagccgaaatgctgactggagggtag

SEQ ID NO: 31236 - DNA, 627 bp, Artificial Sequence
  Description of Artificial Sequence: Synthetic coding sequence
atgggggagcctgctttcacaagctttcccagtctgcccgtactgggcaaacttaagaggaatatgatgccttgggcacttcagaagaaacgtgaaattcatatggcgaaggctcaccgtcgacgtgcggcccgctccgccctccccatgagactgacaagctgtatatttcggcgccccgtgacccggattaggtctcaccctgacaaccaggttcgcagaaggaagggcgacgaacacctggaaaaaccccagcagctctgcgcctaccgacgacttcaggcactccagccttgcagtagtcagggggagggttctagtccactccacctcgagagcgtactttccatactcgccccaggaactgccggcgaatctctggatcgagctggcgccgaacgggtgcggtcccccctcgaaccgacccccggcagatttcctgctgtggcaggaggaccaacacccgggatgggatgccagctgcccccccccctctccggacagcttgttacgcctgccgacatccggcgacaggcgagacgagtaaaaaaagctcgggagcggttagcgaaagcattgcaagcagataggctcgccagacgcgctgagatgctgacggtaagatag

SEQ ID NO: 31237 - DNA, 627 bp, Artificial Sequence
  Description of Artificial Sequence: Synthetic coding sequence
atgggggagcctgcctttacatcattcccttctccccctgtcttgggcaagctgaagcgcaatatgatgccatgggccctccaaaaaaagcgcgaaattcacatggccaaggctcatagaaggcgtgctgctcggagcgccctgccaatgcgcctcaccagctgtatctttcggcggccggtgacaagaataagatcacaccctgacaaccaggtgaggagacgcaagggagacgaacacttggagaaacctcagcagctgtgtgcctacaggaggctccaagccttgcaaccctgctccagccaaggagagggcagctcacccctccatctcgagtcagttctgagcatcttggctccaggtacagctggcgagtcgctggaccgggctggcgctgaacgcgtccgcagccctcttgaaccgacccctgggaggttccctgccgttgctgggggcccaactcccgggatgggttgtcagctgccccccccgctgtctggacagttggtgacaccagcagacattagacgacaggcccgacgggtgaaaaaagcccgggagcgccttgccaaagcactccaggcagaccgcttggcgaggcaggccgagatgctgacctgccggtag

SEQ ID NO: 31238 - DNA, 627 bp, Artificial Sequence
  Description of Artificial Sequence: Synthetic coding sequence
atgggcgaacccgcgttcacatcctttccctccccacccgttcttggtaaactgaagcgaaacatgatgccttgggcacttcagaagaagcgggagatccacatggctaaagcacacagaaggcgtgctgctcgaagtgctctaccaatgcggctcacctcttgtatcttccgaagacctgtgacccgcatccggtcccacccagacaaccaggttaggagacgcaagggtgatgaacatcttgaaaaaccccagcagctctgtgcttacagacggcttcaggcgcttcagccttgcagttctcaaggagagggctccagtcccttacatctagaaagtgttctatctattctggcaccaggcacagccggtgaatctctggacagggcaggagccgagcgggtgaggatacctctggagccgacacctggcaggttccccgccgtggccggtggcccaacaccaggcatgggctgtcaactcccgccccccctgtctggccagttagtgacacccgctgatattaggagacaggctcgccgtgttaagaaggccagggaaaggctggccaaagccctgcaagccgatagacttgccagacaggccgagatgcttacgtgccgctag

SEQ ID NO: 31239 - DNA, 627 bp, Artificial Sequence
  Description of Artificial Sequence: Synthetic coding sequence
atgggcgaaccagcatttaccagttttccttcacccccagtcttaggcaagcttaagcgtaatatgatgccatgggcattgcaaaagaagcgggagattcatatggccaaagcccacagaaggcgcgccgcacggtcagcgttgcctatgcgcctcacctcatgtatattcaggcggccagtgactcgaatccggtcccaccctgataatcaggttcggaggcggaaaggcgacgagcatttagaaaagccgcagcagctgtgtgcttacagacgattgcaggcactacagccctgcagttcacagggggaaggctccagtccattgcatttagaatcggtgctctccatcctggcccctggaacggccggagaatcattagacagagcgggcgccgagagggtaagaattcccttggagcctacgccaggaagatttccggccgtagcgggtggtccaacacccgggatgggatgtcagctgccccctccactgagcgggcagctcgtcacgcctgccgatattagaagacaggctaggagagtaaaaaaagctagagagcggcttgctaaggctctgcaggcagaccggctggctcgtcaggccgagatgctgaccggcggttag

SEQ ID NO: 31240 - DNA, 627 bp, Artificial Sequence
  Description of Artificial Sequence: Synthetic coding sequence
atgggtgaacccgcatttacttcttttccctcaccacccgtgctgggaaagcttaagagaaatatgatgccctgggccctgcagaagaaacgggagatacacatggcaaaggcccaccgacgacgcgcagcaagatctgccctgcctatgcgcctgacttcatgcatcttccgtcggcctgtgacacgcataagaagccaccccgacaatcaggtgagaaggcgaaagggggatgagcaccttgaaaaaccccagcagttgtgtgcataccggcggctgcaggccctgcagccctgcagctcgcagggggagggctccagtccactccacctggaatctgtgctgagcatccttgccccagggactgctggagaatccctggacagggccggcgcagaacgcgtgaggattccgctggagccaacacctggtaggttccccgcagtggccgggggccctactccaggcatgggctgccagcttcctccccctctctctggccagttagtaactcccgctgacatccggaggcaggcccggagagttaagaaagccagggaaaggctcgctaaggctctgcaagccgaccgacttgctcgccaggccgaaatgctgacagtgcgctag

SEQ ID NO: 31241 - DNA, 615 bp, Artificial Sequence
  Description of Artificial Sequence: Synthetic coding sequence
atgggggagccagccttcacatcatttccatctctccctgtgcttggcaaattgaagagaaacatgatgccatgggctctgcagaaaaagcgcgagattcatatggccaaggcccaccggagaagagccgcaagatctgctctgccgatgcgtctcactagctgcatttttagacggccggtgacacgtatcagatcacaccctgataaccaggtgagaagaagaaaaggagacgagcatctggagaagccccagcagctttgtgcctaccgccgacttcaggcactgcagccatgtagtagccagggagaaggctcttccccactgcatcttgaatcagttctgagcattctggccccagggacagctggcgagtccctcgaccgagcgggggctgagcgggtgagatctcctctggagcccaccccgggacgttttcctgctgtggcagggggcccaacaccgggcatggggtgccaactgccacctccactaagtggccaactggtgaccccagcggacattaggagacaagcacgtcgtgtaaaaaaagcccgggagcgattggctaaggccctacaagccgaccggcttgctaggagagcagagatgtag

SEQ ID NO: 31242 - DNA, 759 bp, Artificial Sequence
  Description of Artificial Sequence: Synthetic coding sequence
atgtcaagtgaagtatcagctcgcagagacgccaaaaaactggtccgaagcccttcaggtctgcgcatggtgcccgagcacagggccttcgggagtcctttcggcctggaggagccacagtgggtccccgacaaagagtgtaggcgctgcatgcagtgcgacgccaaatttgacttccttactagaaagcatcactgtagacggtgcggcaagtgtttctgtgatcgctgttgttcccagaaagtgccccttagacggatgtgtttcgtcgaccccgttcgccaatgtgctgagtgtgctctggtaagcctaaaagaagccgaattttacgacaagcaacttaaggtcctgctgagcggtgccacgtttctggtaacgtttggaaattcagagaaacccgaaacaatgacctgtcgtctttctaataatcagaggtacctgttcctggatggcgactcccactacgaaatagaaattgtgcacatctccacggtgcagattctcacggaggggtttcccccaggagagaaagatattcatgcatatactagcttgagaggatcacagccagcgagcgagggtgggaacgcccgcgccactggcatgttcttacaatataccgtgcccggcaccgagggcgtaacacagttaaagctgactgtagttgaggacgtcaccgtgggcaggcgtcaggctgtggcctggttggtcgccatgcacaaggccgccaagctgctctacgaatctcgagaccagtag

SEQ ID NO: 31243 - DNA, 2808 bp, Artificial Sequence
  Description of Artificial Sequence: Synthetic coding sequence
atggcacccgcagagatcttgaatggaaaggaaatcagtgcccaaattcgggcccggctcaagaaccaggttacccagcttaaagaacaggtgcctgggtttacacctaggctggccattcttcaggtaggcaacagggatgattccaacctctatatcaacgtgaagctcaaagctgccgaagaaatcggtattaaggctacgcacatcaaactgccaaggacgaccactgaaagcgaggtgatgaaatacattacttcattaaatgaagactctaccgttcacggcttcttggtacagttgcccctcgactctgagaacagtatcaacacagaggaggtcataaatgccatagctcccgaaaaggacgtggatggactcacaagcatcaacgcgggtaaactagcccgaggggacctgaacgattgttttattccctgcactcccaagggctgcttggagcttatcaaggaaaccggtgtaccgattgctggcaggcacgctgtggtcgtgggtcggagcaagatcgtgggcgctcctatgcacgacctgctgctctggaacaatgcgactgttactacctgccattcgaagacagcccacctcgatgaagaagtgaacaagggggacatcctcgtcgtggccaccggacagccggagatggtcaaaggagagtggatcaaacccggagcaatcgtcatagattgcggcatcaattacgtgcctgacgataaaaaacccaacggccgaaaagtcgtgggcgacgtggcctacgatgaagccaaggagagagcaagttttatcacccctgttccagggggagtcggccctatgaccgtcgccatgttaatgcagagcacagttgaaagcgctaaacgttttctggagaagtttaaaccgggcaaatggatgattcagtacaacaacctgaacctcaaaacacccgtcccatcggacatcgatatatcaagaagctgcaaacccaagcccattggcaagctggcaagagaaattggcctcttgtctgaagaggttgagttatatggtgaaactaaagccaaggttctgctttctgctctggagcggctaaaacacaggcctgatggaaagtacgtggtggtgactgggattacccccacaccactcggcgagggaaaatctacaacaacaattggcctcgttcaggccctgggtgcacacctatatcaaaacgtcttcgcatgcgtgagacagccctctcaagggcctacattcggaattaaggggggagccgcgggcggtggttattctcaggtgattccgatggaggagttcaatctgcatttgaccggggatatccatgccattacagctgctaataacctcgtggcagctgcaatcgacgctcgcatctttcacgaattaacccagacagataaagccctctttaaccgcctagtgccatctgtgaacggagtgagacgcttttcagatatccaaatcagaagattgaaaagactgggcattgagaaaactgaccccaccaccttaacggatgaagagataaacagattcgctagactcgatatcgacccggaaaccatcacctggcaacgggttttagacactaatgataggttcctacgcaaaattacaattggacaggccccaaccgagaaaggacataccagaaccgcacaattcgacatatccgtcgctagtgaaattatggctgttttggccctaaccactagcctggaggatatgagggagaggctcgggaagatggtggtagccagcagcaagaaaggagagcctgtctcagctgaagacttgggcgtgtcgggtgccttaactgtgctcatgaaggacgcgattaaaccaaatcttatgcagaccttagagggcactcccgtgttcgtccatgccggccctttcgctaatattgcccacggcaacagctcaatcatagctgacaggattgccctgaaactcgtgggcccagagggcttcgtagtcacagaagccgggtttggtgcagatatcggcatggaaaagttttttaatatcaagtgcaggtatagcggcttatgccctcatgttgtggtcctcgttgctaccgtgcgggcactgaaaatgcacgggggcggccctacggttactgccggtttaccactcccaaaagcttatatccaggagaacctggagctggtcgaaaaaggttttagtaatctgaaaaaacaaatcgagaacgcccggatgtttggcatccccgttgtcgtcgcagttaatgcattcaagactgacacagaatcagagctcgacctgatttcgagactctctcgggaacacggagcattcgatgccgtgaaatgtactcactgggccgagggcggtaaaggggccctggccctggcacaagcagttcagcgcgcagcgcaggccccttcctctttccagctgctttacgatctgaaactgccagtcgaagacaagatccgtatcatagctcagaagatatacggcgcggatgacattgaactgctacctgaggctcagcataaggcagaagtttacacaaagcagggttttggcaaccttcctatctgcatggccaagacccatctgagcttaagtcataacccggaacagaagggtgtgcccaccggctttattctgccgattagagacatcagagcctctgttggcgccggattcctgtacccactggtgggaacaatgagtaccatgcccggtcttcccactcggccctgcttctacgacatcgatctggatcccgagaccgagcaagttaacggactcttttag

SEQ ID NO: 31244 - DNA, 852 bp, Artificial Sequence
  Description of Artificial Sequence: Synthetic coding sequence
atggctcaccgtggagcccactttgcttttcgcagccggtggcagaagactgatgatgagctgtgtcggcactccatgtcattcattctccacaaagcaatccgcaacgacttttttcagtcctacctttacctgttagaaaaaattcccctcgtgaagctttatgccctgacaagccaggttatcaatggggaaatgcagttttacgcccgcgccaagttgttctaccaagaggtgccagcaactgaggaaggtatgatggggaactttatcgagctgtcatcccccgatatacaagcgtcgcagaagttcctgaggaagtttgttgggggacccggacgcgccgggacggactgtgccctcgactgcggcagcggaataggcagggtgtccaagcacgtactgttgccagtcttcaattcggttgagcttgtcgacatgatggagagcttcctgctagaagcgcagaactatttgcaagttaagggggacaaagtagagagctaccattgttactcgcttcaggagtttaccccgccattccgacgctatgatgttatttggatccagtgggtgagcggccacctgacagataaagaccttctcgcattcctctcgagatgccgagacggactcaaagagaatggcatcataatactgaaagataacgttgccagagaggggtgcatactggaccttagtgattcaagcgtgactagggatatggatatcctccgatctctgattcgcaaatcaggcctcgttgtgttgggccaagagaagcaggacgggttccctgagcaatgcatcccagtttggatgttcgccctgcatagcgatagacactcttag

SEQ ID NO: 31245 - DNA, 1191 bp, Artificial Sequence
  Description of Artificial Sequence: Synthetic coding sequence
atgaaagagtgcaatgcaaccagacgtccacaaatgtcttttctgaagatggatatgacccaaatggagtttccggacgcctctttccaggttgtcctggataaggggactctggacgcagtactgactgatgaggaggagaagaccttgcagcaggtggaccggatgctcgccgaagtaggacgtgtcttacaagtgggaggaagatacctgtgcatcagcctggcacaagctcatatcctaaagaaagccgtcggccacttctcacgcgaggggtggatggtgcgcgttcatcaggtcgctaacagccaggaccaggtgttggaagctgagccacagttcagtctccctgtatttgccttcattatgaccaaatttcgcccagtgccagggagcgcactgcaaatcttcgagctctgcgcccaggaacagcgtaaaccagtgcgtctggagtcagctgagaggctggcggaggcggtgcaagaacgacaacagtatgcctggttatgctctcaactccgccgcaaggcccgccttggctctgtcagcttagatctgtgtgatggcgatacaggggaaccccgttacactctacatgtcgtcgacagcctgccgttgttcgtgcacgaccacttcccaaagtcatgtattgatgctgtggagatcgatccctcaatgctggaggtggccacacaatggttcggcttcagccagtcagatcggatgaaagttcatattgctgatggtttggactatattgcttctcttgcaggcggaggtgaagctcgaccttgctatgacgtgataatgttcgatgttgacagcaaggatcctacgctcggaatgtcttgcccaccaccggcgtttgtggagcagtcctttttgcagaaagtaaaatccatcctcacacccgaaggagtgtttatcctgaatctggtgtgccgcgatcttggcctgaaagactccgtgttagccggcctgaaggccgtttttcccttgctctatgtccgtaggatcgagggcgaggtcaatgagattctgttctgccagctccaccccgagcaaaaactcgcaactcccgaattgcttgagaccgcgcaggctcttgagagaaccctgagaaagcccggacggggctgggacgacacctatgtcctctccgatatgctgaagacggtgaagatcgtgtag

SEQ ID NO: 31246 - DNA, 2100 bp, Artificial Sequence
  Description of Artificial Sequence: Synthetic coding sequence
atgaatttacttccgaaaagctcaagagagtttggaagtgtggattactgggaaaaatttttccagcagaggggcaaaaaagccttcgagtggtatggaacatatctcgaactgtgtggggttcttcacaagtacattaagccaagagaaaaagtgctggtcattggctgtggcaattccgaactctcagagcaactgtacgacgtcggatatagagacattgttaacatcgacatcagtgaggtcgtaatcaagcagatgaaggaatgcaatgccacaaggagaccgcagatgagctttctgaagatggacatgacccagatggagtttcccgacgcgagcttccaggtagtgctcgacaaggggaccctggatgccgtcctaaccgatgaggaggaaaagacacttcaacaggtggatcggatgctggccgaagtcggacgcgtattacaagtggggggtagatacctctgtatttccctcgctcaggctcacatcctgaaaaaagctgttggacatttctcgagagagggatggatggtgcgggttcaccaggtcgccaactctcaggatcaggtgctcgaggccgaacctcagtttagtctcccagtattcgcttttatcatgactaagtttcggccagttcctgggtcagccctgcaaatatttgagctttgcgctcaggaacagcgaaagccagtgaggctggagagtgctgagcgcctcgctgaagcagtccaggaaaggcagcagtatgcttggctgtgctcccagctcagaaggaaggcacgtctgggcagcgttagtcttgacttgtgcgatggagataccggggagccaaggtacacactccacgtcgtggatagcccgaccgttaaaccatcacgggataaccactttgcgatttttattatcccccagggacgtgaaactgaatggcttttcgggatggatgagggcagaaaacagttagctgcaagcgctggctttcgtagactcatcaccgtggcgttacatcgtggccagcagtatgagagcatggatcacatccaggccgaactcagcgctcgggtgatggagttagctcccgctggcatgcctacacaacagcaggtgccattcttgtccgtcggaggcgatatcggggtaagaactgttcagcatcaggactgcagtccgctgagcggcgattatgtcatcgaggatgtgcagggtgatgataagcgatactttcgccgcctgatcttcctgtcgaacaggaatgtggtgcaatctgaggctagactcctgaaggacgtctcccataaggcccagaagaagcgaaagaaggatcgcaaaaaacaacggcccgcagacgctgaggatcttcctgccgcccccggacagagcattgataagtcttacctttgctgtgagcaccataaggccatgatagccggactggccctcctgcggaaccctgaacttcttcttgagatccccctcgcgctgctggtggttgggctgggcgggggaagtctgccattgtttgtgcatgatcactttccgaagagttgtatcgatgcggttgaaatcgacccctctatgctggaggtggctacccagtggttcggcttctcacagtcggatagaatgaaagtacacatcgcagatggcctggattacatcgctagtctggcaggtggcggggaggcccgcccctgctacgatgttattatgttcgacgtggatagcaaggatcctaccctcggcatgtcatgtccgccccctgcattcgtggagcaaagctttcttcaaaaggtcaaatctatcctgacccccgaaggggtgtttattctcaatttggtctgccgggatctaggcctcaaggacagtgtcctggcggggttgaaggccgtattcccgctcctctacgtgcgacggatcgaaggcgaggtcaatgaaatattattctgtcaattacacccagagcagaaacttgccacaccagagttgctcgagactgcccaggctctggaacgcacccttagaaaacccgggcggggctgggacgacacttacgttctatcagacatgctgaagaccgtcaagatagtttag

SEQ ID NO: 31247 - DNA, 1842 bp, Artificial Sequence
  Description of Artificial Sequence: Synthetic coding sequence
atgaaagaatgcaacgccaccagaagaccacagatgtctttcttaaaaatggatatgacccagatggagtttcccgacgcttcgtttcaagtggtgttggataagggaaccttggacgcagtcctgacagacgaagaggaaaaaacattacagcaggtcgatagaatgctggctgaagtcggaagggtcttgcaagttggcggaaggtacctctgtatcagtctcgcccaagcacatattctaaagaaagccgtgggacatttcagccgcgaggggtggatggtacgcgtgcatcaagtggccaattcccaggaccaggtgctagaagctgagccccaattctcgctgcctgtgttcgcattcattatgaccaaatttagaccagtgccgggcagtgccctgcagatcttcgagttatgcgcccaagagcaacgcaagccagttcggctggaaagcgccgagagactggccgaggcggtccaagaaaggcagcagtacgcatggctatgttcgcagcttcgccggaaggctcgcttgggttcagtgtccctcgacctgtgtgatggtgatacaggcgagccacgttacaccctgcacgtcgtggacagcccgactgttaaaccctcccgtgataaccactttgcgatttttattataccacagggcagggagacagagtggctttttgggatggatgagggtaggaagcagctcgctgcgagtgctggattccggcgcttaatcaccgttgccctacatagagggcagcagtacgagagcatggaccatatccaggctgagctgagcgcccgagtaatggagttggctcccgccgggatgcctacacagcaacaggtcccttttctgagcgtggggggggacattggtgtgagaaccgtgcaacatcaggactgtagccctctttctggcgattacgttatcgaggatgtgcagggagacgataaacgttactttagacggctgatcttcctgagcaaccgcaatgtggtgcaatccgaagcacgcttactgaaagacgtgtcccacaaggcacagaaaaaacggaagaaagacaggaaaaagcaaaggcctgccgatgccgaggacttgcctgccgcccctggccagagcattgacaagagctatctctgctgtgagcatcataaggcaatgatcgccgggctggctctactccggaatcctgaactccttcttgaaatcccgctggccctgctcgtggtgggtcttggaggagggagcttgcctttgtttgtccacgaccacttccccaaatcatgcatcgacgcagtagagatagaccccagcatgctggaggtggcaacacaatggttcggcttcagccagagtgataggatgaaggtgcatatcgccgatggactggactacattgctagccttgccgggggaggcgaggctcggccctgctacgatgtgatcatgttcgacgtcgattcaaaggacccaactttaggcatgtcttgcccccctcccgccttcgtagagcaaagctttttacagaaagtgaagtcaatcctcacgccggagggggtgtttatcttgaacttggtctgcagggacctcggccttaaggacagcgtcctggctggcctcaaggctgtcttccctcttctctatgtccgccgaatagaaggggaagttaatgaaattctcttctgccagctacatcctgaacaaaagcttgccacgcctgagctccttgagacagctcaagccctggagcgcacactgcggaaaccgggtcgcggctgggacgatacctacgtgctcagtgacatgctcaaaaccgttaagatcgtgtag

SEQ ID NO: 31248 - DNA, 1632 bp, Artificial Sequence
  Description of Artificial Sequence: Synthetic coding sequence
atgaatctccttccaaagtccagtcgggagttcgggtcagttgattattgggaaaagtttttccaacagcgcggcaagaaggcctttgaatggtatgggacctatctggaactttgtggggtcctgcacaagtatatcaagccaagggaaaaagtactggtcattgggtgcgggaactccgaactgtcagagcagttgtacgatgtaggctaccgggacatcgtcaacatagatattagtgaggttgtaatcaagcaaatgaaggagtgtaacgccacaagacggccgcagatgtccttcctgaagatggatatgactcagatggaattccccgatgcttcctttcaagtggtgttagacaaggggactcttgatgccgtccttacggacgaggaagagaaaactctgcagcaggtggatcgaatgttagcagaggtggggagggtactgcagggacgcgagacggaatggcttttcgggatggatgagggacgaaagcagcttgccgcttccgcagggttcagacgccttattactgtggctttgcatcgtggacaacagtatgagtcaatggaccatattcaggccgagctgtctgccagggtgatggaactggcacctgccgggatgcctacacagcaacaggtcccattcttgtccgtcggtggggacattggagtgcggacagtgcaacaccaagactgctccccactgagtggggattatgtaattgaggatgtgcaaggcgatgacaagcgctattttaggcgtctcatctttctctcaaatagaaatgtggtgcagtccgaagcgagactgctcaaggacgtgagtcacaaagcccagaaaaagaggaagaaggaccgcaagaaacaacggcctgctgatgccgaagatttgcccgcggcacccgggcagagcatagataagtcctacctctgttgcgaacaccacaaagccatgatcgcagggctggccttgctgcgaaaccccgagctgttgctggagatcccactggctttgctcgtggtcggcctggggggaggctcccttcccctgttcgtgcatgatcattttcctaaatcttgcattgatgccgtggaaattgacccaagtatgctcgaagttgctacccagtggttcggcttttctcagagtgataggatgaaagttcacattgccgatggactcgactatattgccagcttagccgggggaggcgaggcacggccctgttacgacgttatcatgttcgatgtggactccaaggaccccacactaggtatgagctgtcctcctcctgcattcgtcgagcagtccttcctgcagaaggttaagtccatcctcacacccgaaggtgtctttatcttgaacctggtttgtagagatctcggtttgaaagacagcgtgctcgctggccttaaagcagtattcccattgctgtacgttcgccgcatcgagggcgaggtgaacgagattctgttctgtcagctgcatcctgaacagaagttggccaccccagaacttttagaaactgctcaagctctggagcgcacgttgagaaaaccaggtagagggtgggatgacacttatgtcttatcagacatgttgaaaacggtgaaaatagtgtag

SEQ ID NO: 31249 - DNA, 2097 bp, Artificial Sequence
  Description of Artificial Sequence: Synthetic coding sequence
atgcgagccttcgtggtgtctagagagtttggtagcgtcgattactgggagaagttcttccagcagcgcggtaaaaaggcatttgagtggtacgggacatatctcgagctgtgtggggtgctgcacaagtacatcaaacccagggaaaaggtgcttgttattgggtgcggcaattccgaattgtctgaacagctgtacgacgtaggttaccgggatattgtaaacattgacatttcggaagttgtcatcaagcagatgaaggaatgcaatgcaactcggagaccacagatgtctttcttgaagatggacatgactcagatggagttccctgacgccagttttcaggtggtactagataaaggcacccttgacgccgtgttaacggatgaggaggagaagactttgcagcaagttgacagaatgctcgccgaggttggcagggttcttcaagtgggaggaaggtatttgtgtatttcgttagcccaggcgcacatattaaaaaaggccgtcggccatttctcacgagagggatggatggtgagggtccaccaagtcgcaaacagtcaagaccaggtcttggaggctgagccacagttttctctgcctgtgtttgcttttattatgacgaaattccgtcccgttccaggtagcgccttgcagatcttcgagctctgcgcccaggaacaacggaaacctgtgcggttagaaagcgctgaacggttagcagaggctgtccaggagcgtcaacagtatgcctggctctgttctcagctcaggcgaaaagcacgactcggttccgtttctctggacctgtgcgatggcgatactggggagccccgatatactctccacgtggtggactcacctactgttaagccatcccgcgataatcacttcgctatctttatcatcccccaagggagagaaaccgaatggctgtttggaatggatgaaggccggaaacagctggccgccagtgctgggttccgccggctgatcaccgtggctttacatcgcggacagcagtacgaatccatggatcacatccaggccgaactttctgctagggttatggagctcgctccagccgggatgcccacccagcagcaggtgccatttcttagtgtcggcggtgacattggggtgagaacagtgcaacatcaggattgctctccccttagcggagactacgtcatcgaggacgtacaaggagatgataagagatatttccgcagattgatctttcttagtaacaggaacgtggtccagtcagaggctcgcttacttaaagacgtaagccataaggctcagaaaaagcggaagaaagacagaaaaaaacagcgcccagctgatgcggaggatttgcctgctgcacccggccagtccattgataaatcatatctttgctgtgagcatcacaaggctatgattgccggtctggcgctgctgcggaatccggagctcttgcttgagattccacttgcacttctggtggttggactgggaggcggatcactgcccctattcgtgcacgaccacttccccaagagttgtattgatgctgtggagatcgaccctagtatgctggaagtggccacccaatggttcggcttcagtcagtccgatcggatgaaagtccacatcgctgacggattggattacattgcctcgcttgcagggggaggcgaggctaggccttgttacgatgtgatcatgtttgatgttgacagtaaagaccctactctgggaatgtcttgccctcctccagctttcgtcgagcaatcctttttgcagaaagttaagagcatactcacacccgagggcgtcttcattctcaacctggtctgccgggacttaggccttaaggacagtgtgctggctggacttaaggccgtgtttcccctgctctacgtgagacgcattgagggggaggtgaatgaaatcctcttctgccaactccacccagaacagaaacttgcaacgcccgagctgctcgagaccgcgcaggctctagaacgcacgttgcggaagccggggaggggctgggacgacacttacgttctgtccgacatgctcaagaccgtcaaaatcgtttag

SEQ ID NO: 31250 - DNA, 822 bp, Artificial Sequence
  Description of Artificial Sequence: Synthetic coding sequence
atgctcagatacccctatttttgtagaatgtacaaggaatgtctgtcttgttggttggagtctggaatccccaatcttggggtatggcctaaccggattcacactaccgccgagaagtatcgggaatatgaggcccgtgagcaaacagaccaaactcaggcccaggaactgcaccgctctcaggatcgcgatttcgaaactatggcgaagctgcacatacctgttatggtggacgaagtggtccattgtctcagcccacagaaaggacagatttttctggatatgacctttgggagtggcggccataccaaggctattttgcagaaggaatctgatattgtcctgtatgccctggaccgcgaccctactgcctacgccctcgctgagcatctgtcagagctctatcctaaacagatcagagctatgttgggacaattcagccaggccgaagcgctgctcatgaaggccggggttcagcccggtacctttgacggtgtccttatggaccttgggtgttcttccatgcagctggataccccggaacggggattcagcctcagaaaggatgggcccttggatatgagaatggatggtggccgctaccctgatatgccgaccgccgcagacgttgttaatgcactggaccagcaggccctggcctctattcttagaacttatggggaggaaaagcacgccaaaaaaatcgcttccgcaattgttcaggccagaagtatctacccaataacccgcacccagcagctcgcatccattgttgccgaatactctgaaacctactttcctgttgcgcagactctttactag

SEQ ID NO: 31251 - DNA, 822 bp, Artificial Sequence
  Description of Artificial Sequence: Synthetic coding sequence
atgctcaggtacccatacttctgccgcatgtataaggagtgtcttagttgttggttagaaagcggcatcccaaatcttggcgtgtggcctaacagaatccacaccacagcagagaagtatcgagaatacgaagctcgtgagcaaacagaccagacccaggcccaggaattgcatcgaagtcaggacagggacttcgagaccatggccaagctgcatatccctgtgatggtggatgaagtagtccattgcctgagcccacagaagggtcaaatctttttggacatgaccttcggttcaggtggccatactaaggcgatcctgcagaaggaatccgacatcgtcctatacgctctggaccgggacccaaccgcctatgccctcgccgagcatctgagcgaattatacccaaagcaaatccgtgctatgttgggacagttcagtcaggcggaggccctcttgatgaaagctggagtccagccagggaccttcgacggtgtcctcatggatttgggatgctcctctatgcaattggacacaccggagcgtggcttctccctgcgcaaagacggccccctggatatgaggatggatggggggaggtatccagacatgccaacggctgctgacgtggtgaacgccttggaccagcaggccttagcatctattctgcgaacctacggcgaggaaaagcacgccaaaaaaattgcctccgccattgtccaagctcggtctatctaccccattaccaggacacaacagctggccagcatcgtagcagagtactctgagacctacttccctgtcgcgcagactctttattag

SEQ ID NO: 31252 - DNA, 300 bp, Artificial Sequence
  Description of Artificial Sequence: Synthetic coding sequence
atgctgaggtatccttacttttgccgtatgtacaaagagtgcctatcctgctggttggagagtggcattccaaacctgggcgtttggcctaacaggatccatacgaccgcagaaaagtatagggaatacgaagcaagggagcagactgaccaaacacaggctcaggagttgcaccgaagccaggatagggacttcgaaaccatggccaagctacacatacctgtcatggtcgacgaggtcgtacattgcctatcaccccagaaaggtcagagcctcggagttaggtcagtgggaatttag

SEQ ID NO: 31253 - DNA, 1224 bp, Artificial Sequence
  Description of Artificial Sequence: Synthetic coding sequence
atgcttcgttacccttacttctgtaggatgtataaggaatgtctttcttgctggctcgagagcggcattccaaatctcggtgtctggcccaatcgcatccacacaactgctgagaaatacagagaatacgaagccagagaacagacagaccagacccaggcccaggagctgcaccgctcccaggatcgcgattttgaaacaatggccaagttgcatattccggttatggtggacgaagtcgtgcactgtttatcccctcaaaagggccagattttcctggacatgacatttggcagtggcggacacaccaaagccatactacagaaggagagcgacatcgtcctttacgctctagaccgggaccccacagcgtacgcccttgccgaacatctatcggaactgtacccaaaacagattcgggccatgttgggacagtttagccaagcagaggctttgttaatgaaggccggggtccaacctgggacctttgacggtgtcctcatggacctaggttgcagttcgatgcaactcgacaccccggaacgaggcttttcattgaggaaagacggacctttagatatgcggatggatggcgggcgatatcccgatatgcccaccgccgctgatgtggtgaatgccttagaccagcaggctctggcctccatcctccgaacatacggcgaggaaaagcatgccaagaaaatcgcctctgctatcgtgcaggcgagatctatctacccgataacaagaacccagcagttagcctcaatcgtggcaggcgcatttcctccatccgcaatttacaccaggaaggacttacttcagaggagcacacacatcgcaactaaaaccttccaggctttacgcatcttcgtcaacaacgaacttaatgagctctacaccgggctgaaaacagcacaaaagttcctgagacctggcgggcgactggtggccctatccttccacagtttagaagatcggatagtaaagcgcttcctgctgggcataagcatgaccgaacgctttaatctcagcgtacgtcaacaggtgatgaaaacctcccagctgggttctgatcacgaaaacactgaggaggtctcaatgaggagggcacctcttatgtgggagctgattcacaaaaaggtgctgtcgcctcaggaccaggacgtgcaggacaacccccgaggcagatctgccaagcttagggctgcgataaagctatag

SEQ ID NO: 31254 - DNA, 1689 bp, Artificial Sequence
  Description of Artificial Sequence: Synthetic coding sequence
atggcactgtccaagtctatgcatgcaagaaataggtacaaggataagccccccgacttcgcctatcttgctagcaaataccccgattttaaacaacatgtgcagatcaatctcaatgggcgggtgagcctgaactttaaagatccagaagctgtccgggccctcacctgcacactcctgcgcgaagacttcggattgtctatagacattcccttggaacggttaatacccaccgtgcccctgagactaaattatattcactgggtcgaagacctgataggtcatcaggactccgacaaaagtacactgcgtagagggatcgacattggcaccggcgcaagttgtatctatcctctcctcggggcgacgcttaacggctggtattttttagctacagaggtggacgatatgtgttttaattacgcaaagaaaaacgtggagcagaataacctgagcgacctgattaaggtggtcaaagtccctcagaagactctcctgatggatgctctgaaagaagaatccgagattatttatgacttttgcatgtgtaaccctcctttttttgcaaatcagctcgaggcgaaaggagtgaattcccggaaccctagaagaccacctccttcaagcgtaaataccggggggattaccgaaataatggctgaggggggagaactggaattcgttaagagaatcatccatgacagtctccagttgaagaaacggcttaggtggtattcctgcatgcttggcaaaaaatgctccttggcgcctctgaaagaggaactcaggatacagggcgtcccaaaagtgacttacacggaattctgccagggaagaaccatgcgttgggccctggcctggtcattctatgatgacgtcactgtgccctcccccccctctaagcgccggaagctcgagaaaccgagaaagcccattaccttcgtggtcctggcttctgtgatgaaagaactgtcactgaaggcaagtccattgcgttccgagaccgccgaagggatagtcgtcgtgactacctggattgagaaaatcctgaccgaccttaaggtgcagcataagcgggtcccctgcgggaaggaggaggtgagtctgtttctgaccgccatagagaacagctggattcatttaagaagaaaaaaacgcgagagggtccggcagctcagggaagttccaagggcccccgaggacgtaattcaagccctcgaggagaaaaaaccaacacccaaagaatcagggaattcacaggagctcgcaagagggccgcaggaacgcacgccttgcgggcccgctctcagggagggagaagcagctgcggtggaaggaccgtgtccgagccaggaatcgctcagccaggaggaaaacccagagcctactgaggacgagcggtcagaagagaagggtggagttgaggtgcttgaatcttgccagggttcctcgaacggggcacaggatcaggaagccagtgaacagtttggttcgcctgtagctgagcgcggtaaaaggctgcctggggtggccggtcagtatctgtttaagtgtttgattaatgtcaagaaggaagtggacgatgcactggttgagatgcactgggtggaaggacagaaccgcgatctgatgaaccagttgtgcacctatattagaaatcagatctttcgtctagtggccgtgaactag

SEQ ID NO: 31255 - DNA, 675 bp, Artificial Sequence
  Description of Artificial Sequence: Synthetic coding sequence
atggcactctcaaaatcaatgcatgcccgaaatcgctataaagacaagccgccagactttgcctatctggctagtaagtatccggactttaaacaacacgtgcaaatcaatctcaacggccgagtttctttaaactttaaggacccggaggcagttagagcactgacatgcaccctgttgcgcgaagattttggactcagtattgatataccgctcgagcggttgatccccactgtgcctctccggctgaattacattcattgggttgaggacttaatcggtcatcaggacagcgataagagcaccctgcgccgcggcatcgacatcggaacgggagcaagctgcatctacccgctgctgggcgccactctcaacgggtggtacttcctcgctactgaggtggatgatatgtgcttcaattacgcaaaaaaaaatgttgagcagaacaacctgagcgatctgattaaggtagtgaaggtgcctcagaagaccctgttgatggacgctcttaaggaagagtcggagatcatctacgatttttgcatgtgtaatcccccctttttcgccaatcagcttgaggccaagggagtgaacagtagaaatcctcgccgacctcctccaagtagcgtgaatacaggcgaatccctcgagccagggcgccggagactccagtag

SEQ ID NO: 31256 - DNA, 606 bp, Artificial Sequence
  Description of Artificial Sequence: Synthetic coding sequence
atgaaagagttgtccttgaaggcttcccccctgcgttctgaaactgctgaaggtatcgtggtggtcacaacttggatcgagaagatcctgacggatttgaaagttcagcacaaaagagtgccctgcggcaaagaggaggtgtccctgttcctcaccgccattgagaacagctggatccatttgagacgaaaaaaacgagaacgggtccggcagctcagagaagtgccaagagccccagaagacgtcatccaggctcttgaagagaagaagccgactcctaaggaatctggaaactctcaggagctagcccgtgggccacaagagcgcaccccatgcggccccgctttaagggagggcgaagcggccgctgtagaggggccatgcccctcacaggagtcactttcacaagaggaaaaccccgaaccaactgaggatgagcgctctgaagagaaaggaggcgttgaggtactcgaatcttgtcaaggcagtagtaatggagcccaggaccaagaagcatgttggctcaagctcgccccacagctctggaccgcctcagcgagatctgaggggctattcgtcgagtcaggcttaggcagtaccgcgtag

SEQ ID NO: 31257 - DNA, 1035 bp, Artificial Sequence
  Description of Artificial Sequence: Synthetic coding sequence
atggccgaaggaggggaactggaatttgtgaagagaatcatccacgattctctccagctgaaaaaacgtctcaggtggtactcttgcatgctgggaaaaaagtgcagcctcgccccactgaaggaggagctgaggattcagggggttccaaaagtcacatacaccgagttttgccagggaaggacgatgcggtgggccctcgcttggtccttttacgatgatgtcaccgtgccgtctcccccttcaaagcggcggaagctggaaaaaccaagaaagcctataacatttgttgtgctcgcctccgtgatgaaggagctgagcctgaaggcctcacctttgcggtctgagacggccgaaggcatcgtggtcgtaaccacgtggattgagaagatcttgaccgatcttaaggtccagcacaagcgagtgccctgtggcaaggaggaggtgtccttgttcctgactgccattgagaactcttggattcacttaagaagaaagaagcgggagagggttcgtcagttgcgcgaggtacctcgggcaccagaggacgtgatccaggccctggaagagaaaaaacccacaccaaaggagtccgggaactcccaggagctggcccggggaccacaggagcgcaccccttgcggcccagctttgcgcgaaggcgaagccgcagccgttgaggggccttgcccttcccaggaatcactgagtcaggaagaaaaccccgagccgaccgaggacgaacgttctgaagaaaagggaggcgttgaagtccttgagtcgtgccaggggagcagcaacggagctcaggaccaggaggccagcgagcagtttggatcccctgttgctgaacgcggaaagaggttaccaggagtcgcgggacaatatctctttaagtgcctgatcaatgtgaaaaaggaagtggacgatgccctagtggagatgcactgggtcgaagggcagaacagagatctgatgaaccagttatgtacttacatacggaaccagatttttaggctggtggccgtcaactag

SEQ ID NO: 31258 - DNA, 795 bp, Artificial Sequence
  Description of Artificial Sequence: Synthetic coding sequence
atggatgtctgtctaagctcggctcagcagcctggccggcgcggcgaagggctgagctctcctggcggctggttggaagctgaaaagaagggcgcccctcagaaggacagcaccggtggagtgttagaagagagcaataaaattgaacccagcctacatagtctgcaaaaatttgtccctactgactacgcgtcctatactcaggaacattacaggttcgccggcaaagagatcgttatccaggaatctattgagagctacggcgccgttgtctggcctggggctatggccctctgccagtacctcgaggaacacgcagaggagctgaactttcaggatgctaaaatactcgagattggtgctggtccaggtctcgtgagtatagttgcatctattctcggggcccaggtcaccgcaaccgacttgcccgacgtcctgggtaaccttcagtacaatcttctgaagaacaccttgcagtgcaccgcccacctccccgaagtcaaggagcttgtctggggggaggatctggacaaaaactttccgaagagcgctttctactacgactatgtactcgcctccgacgtggtgtaccaccattatttcttagataagcttctgaccaccatggtgtatttgagtcagccaggaacggtgctcctgtgggctaataaattcagattctcaacagattacgaatttctcgataaattcaagcaggtgtttgacaccactcttctggccgagtatccagagtcttcggtcaagctgttcaagggcattctgaagtgggactag

SEQ ID NO: 31259 - DNA, 489 bp, Artificial Sequence
  Description of Artificial Sequence: Synthetic coding sequence
atgtgggggaggcttttagcagcttttccccccgtgcccactccccagagcacacttttctaccgagccgacgtcgttgttacagacctggaggaacttcaggacctcctgaagatgaacataaatatgaacaagcacttagtgaccggatctgttcaggctaaggtgctgaagtggggagaggaaatagagggatttccctctcccccagactttatcctgatggctgactgcatctattacgaggaatcacttgagccgctgcttaagaccctgaaggatatcagcggcttcgagacttgtatcatctgctgttacgaacagcgtaccatgggcaagaacccagagattgaaaaaaaatacttcgagctgcttcagctagatttcgacttcgagaagatccccctggagaaacatgatgaggagtatcggtctgaggatattcacataatctacatccgcaagaagaaaagcaagtttcccagctag

SEQ ID NO: 31260 - DNA, 585 bp, Artificial Sequence
  Description of Artificial Sequence: Synthetic coding sequence
atggctgacacacttgaatcttcactggaagatcccctcagaagtttcgtgcgcgtgctggagaagagagatggaacagtacttagacttcagcagtactccagcgggggcgtgggctgtgttgtgtgggatgccgcaatcgttctatccaagtacctggagacaccagaattttcaggagacggagcccatgctctaagccgccggtcggtgttggagctaggaagcggcacaggggcagtgggtctcatggctgcaacattgggcgccgatgttgtggtgactgaccttgaggagctgcaggatcttctaaaaatgaacatcaacatgaacaagcacctggtgactgggtccgtccaggctaaggtgctgaagtggggtgaggagatagagggcttcccatccccccccgatttcatactcatggccgactgtatttattacgaagaaagcctggagccactccttaaaactttgaaagacatatctggcttcgagacctgcattatctgctgttatgagcagcgaacaatgggaaagaatcctgagatcgaaaagaagtactttgagaaattcccttcctag

SEQ ID NO: 31261 - DNA, 690 bp, Artificial Sequence
  Description of Artificial Sequence: Synthetic coding sequence
atggccgacacgctggaatcaagcctagaggatccactgcgaagttttgtaagggtgctggagaagcgagatggtacagtacttcggttgcaacagtactcttctgggggggtaggatgtgtggtgtgggacgctgcaatcgtactgagcaagtatctcgaaaccccagaattctccggagatggtgcccatgccctcagcaggcgttccgtactagagttaggtagcggtactggagctgtggggctcatggcggccacgctcggtgccgatgtggtcgttacagatctggaagaactccaggatcttcttaaaatgaacattaacatgaataagcatttagtgaccgggagcgtccaagcaaaagtgttgaaatggggcgaggagattgagggattcccatcgcccccggacttcattcttatggccgactgtatctactacgaggagtccctggaaccactgctcaagactttaaaggacattagtggcttcgaaacatgtatcatctgttgttacgagcagagaacaatggggaagaatccagaaatcgagaaaaagtacttcgaactattgcagctggactttgactttgaaaagattcccctggaaaaacatgacgaggaatatcgatccgaggatatacacatcatatatatccggaagaaaaaatccaagtttcctagctag

SEQ ID NO: 31262 - DNA, 618 bp, Artificial Sequence
  Description of Artificial Sequence: Synthetic coding sequence
atggtacagctcgctcccgcagccgccatggatgaggttacgttcaggagtgacaccgttttaagtgacgtccacctgtacacgcccaaccacaggcacctgatggtgcgtctcaactccgttggccagcctgtgttcctcagccagttcaaactgttatggtcgcaggacagctggaccgattcgggtgccaaaggggggtcccacagagacgtgcatactaaagaacctccctctgctgagactgggtcgactggatcgcccccagggtctgggcacggcaacgaggggttttccctgcaggcggggactgacacaaccggacaggaggtcgcggaggcgcaactggatgaggatggggatcttgacgtggtgcgccgcccaagggctgcatctgactccaatcccgcaggtccactcagagacaaggtccaccccatgatcctcgcccaggaagaggacgacgtgctcggagaggaagctcaggggagccctcacgacataattagaataggagtggcagggaggcctgcccccgggaggttgcacccagtacccactggccctctgccaaggatgtactcagccggggcccggggacggcatggagctcggtag

SEQ ID NO: 31263 - DNA, 1215 bp, Artificial Sequence
  Description of Artificial Sequence: Synthetic coding sequence
atggtgcagcttgcccctgcagccgccatggacgaggtgactttccggtcagatacagtactttcagacgtccatctgtatacccccaatcatcgacacctgatggttcgcctcaattctgtgggacagcctgtgtttcttagccagttcaaattgttgtggtctcaagatagctggaccgactctggggctaaaggagggtcccaccgggatgttcacactaaggaaccccccagcgccgagacagggtccaccggatcaccccccggaagcggacatgggaatgagggctttagtctgcaagcgggcacagatactaccggccaagaggtggcagaggcacaactcgatgaagacggcgaccttgacgtggtccggcggccgagagcggcttccgattccaatcctgctggtccacttcgcgataaagtccatcccatgatcctagcacaggaggaagacgacgtgctgggcgaagaggcgcagggatccccccacgatattatccggatcgagcacaccatggcaaccccactagaggatgtgggaaaacaggtctggaggggggccttactgctggccgattatatcctttttcgacaggacctgttcaggggatgcacggccttagagctgggggccggtaccgggctcgcctccatcatcgccgctacgatggcccgcaccgtgtattgcacagatgttggagccgatctgcttagcatgtgccagaggaatattgccctcaacagtcatctcgctgccaccggaggtgggatcgtgcgagtgaaagagctggactggctgaaggatgatctatgcaccgaccccaaggtgccattcagctggtcacaggaggaaatttcagacctgtatgatcatacaaccatacttttcgcggctgaagtgttttacgacgatgacctaaccgacgctgtattcaaaaccttgtcccgcctcgcccaccggctcaagaacgcatgcacagcaatcctttccgtcgagaagcgcctgaactttacactgaggcacttggatgtgacatgtgaggcctacgatcacttccgcagctgcctgcacgcgctggagcagcttgccgatggtaaactgcgctttgtcgtggaacccgttgaagccagtttcccacagctgctggtgtacgagaggctccaacagctcgaactctggaagattattgccgaacccgtgacctag

SEQ ID NO: 31264 - DNA, 1137 bp, Artificial Sequence
  Description of Artificial Sequence: Synthetic coding sequence
atggcaggaagttaccccgaaggcgcccccgcagtgctagctgacaagaggcagcagttcggaagcaggtttcttagggatcctgctcgcgttttccatcataatgcctgggacaatgtggaatggtcagaagagcaagctgcagccgcagaaaggaaggttcaagaaaactccatccaaagagtttgccaagagaaacaggtggattacgagatcaatgctcacaaatattggaatgacttctataagattcacgagaacggcttcttcaaggaccgtcactggctgtttaccgaatttccagaacttgcaccgagccagaaccagaatcacctgaaggactggttcctcgagaacaaatcagaggtgcccgaatgtaggaataacgaagacgggcctggcctcattatggaagaacagcataaatgttctagcaagtcactcgaacataagacccagaccctgcccgtcgaagagaacgtgacacagaaaatttcggacttggagatctgcgctgatgagttcccggggagttctgccacctacagaatacttgaggtcggatgtggggtggggaacaccgtgtttccaattctgcaaaccaataacgaccccgggctttttgtgtattgttgcgatttttcttccaccgccatcgaacttgtgcagacaaacagtgaatacgatccatccaggtgcttcgcctttgtacacgacctgtgcgatgaagagaagagctatcccgttcccaagggcagccttgatataatcatcttaatttttgtcctctctgcaattgtgcctgataagatgcagaaagccattaatagattatccaggctgctcaagcccggcggaatgatgttattacgggactacggacggtatgacatggcccagcttaggtttaaaaaaggccaatgcctgagtgggaatttctacgtccgaggcgacgggacaagagtttatttcttcacacaggaggagctcgacacactgttcactaccgccggactggaaaaagtacagaatttggtggataggaggcttcaggtaaacaggggtaagcagcttaccatgtaccgtgtgtggatccaatgcaagtactgcaaacccctactgtcatctacctcttag

SEQ ID NO: 31265 - DNA, 654 bp, Artificial Sequence
  Description of Artificial Sequence: Synthetic coding sequence
atggccgggtcctaccctgaaggtgctccagccgtgctcgcagataagaggcagcaatttggcagtagattcttacgagatcctgcaagggttttccaccacaacgcatgggacaacgtcgaatggtccgaagaacaagcagctgcagccgagaggaaggtgcaggaaaacagcattcaaagggtttgtcaggagaagcaggtagattatgagatcaacgctcacaagtattggaacgatttttataaaatacatgagaatgggttctttaaagatagacactggctgttcaccgagtttccagaactcgcgcccagccagaaccagaatcacctgaaggattggttccttgaaaacaaaagcgaggtgcccgaatgccgaaacaacgaagatgggcccggcctgataatggaagagcaacataagtgttcctccaaatctttagaacataaaacccagaccctgcccgttgaggaaaatgtgacacaaaagatctctgacctggaaatatgtgcagatgagttcccaggtcagcctcctacggagtactggaggctcgctgttgtatgggagacacaatccttccagttctacaaaagaacaatgacccaggactctttatttatagcggtgattttcctgcctcagttatag

SEQ ID NO: 31266 - DNA, 1137 bp, Artificial Sequence
  Description of Artificial Sequence: Synthetic coding sequence
atggcaggttcatatcctgagggagcaccagccatcctggctgacaagcggcaacagttcggctcacgtttcttaagtgacccagcccgcgtcttccaccacaacgcctgggacaacgtcgaatggtcagaagagcaggccgccgccgctgagagaaaagtgcaggaaaacagcatccagagggtttgccaagaaaagcaggtcgattacgagattaatgctcataagtactggaatgatttttacaaaattcacgaaaacgggttcttcaaagatcgccattggctgtttaccgagttcccggaactcgcccctagtcagaaccagaatcatttgaaggactggttcctggaaaacaagagtgaagtttgcgaatgccggaataatgaggacggacctggattgattatggaagaacagcataaatgttcctccaagtccctggaacataagacacagaccccccccgtagaagagaatgtgacccagaaaatcagcgacttggaaatctgcgccgacgagttcccaggcagtagcgctacctacagaatcctggaagtgggctgcggcgtgggaaacacagtttttccaatcctgcaaaccaacaatgacccgggcctgttcgtttactgttgtgacttctcttctactgctatcgaattggtgcaaactaactctgagtacgacccgagcagatgctttgcattcgtgcatgacctgtgtgacgaagagaaatcgtatccagtacccaagggatcattagacatcattattcttattttcgttttgagcgctgttgtgccagataagatgcagaaagcgattaaccggctgtcacggttgttaaaaccaggaggcatggtgcttcttagagactatggccgttacgacatggcccagctgcgattcaagaaggggcagtgtctaagtggcaacttctacgtcaggggcgacggaacccgcgtgtatttcttcacgcaggaagagttggatacgttgttcacaaccgctgggctcgagaaggttcagaatcttgttgatcgccgactacaggtcaacaggggcaagcagcttacaatgtatagggtctggattcaatgcaaatactgcaagcccctactctcttccacatcatag

SEQ ID NO: 31267 - DNA, 1419 bp, Artificial Sequence
  Description of Artificial Sequence: Synthetic coding sequence
atgagtgtcgttcaccagctctctgccggctggttgctggaccatctatcttttatcaacaaaattaactatcagctccaccagcatcatgagccctgctgtcgaaagaaagaattcactacctccgtgcatttcgagtctttgcaaatggactcggtatctagttccggagtttgtgcagcttttattgcgagcgatagctccacgaagcctgagaacgacgatggcggcaactatgaaatgttcaccaggaagttcgtctttcggcccgaactcttcgacgttacaaagccctatataactccggcagtgcataaagagtgccagcagtccaacgaaaaggaagatcttatgaacggagtaaagaaagaaatttctatttcaatcatcgggaagaagcggaaacgatgcgtggtgtttaaccaaggagagctggacgccatggaataccacactaagatcagggagctgatcctggacgggagcctccagctaattcaggaagggctcaaatcagggtttctttaccccttgtttgaaaaacaggacaaagggtcaaaacccatcacactgcctttggatgcctgcagcctttccgaactctgcgagatggcaaagcacttgccatccctgaatgaaatggaacatcagacgctacaactcgtcgaggaggatacgtcagtgactgagcaagacttgtttcttagggtcgtggagaacaattcatcatttaccaaggtgattacactcatgggccaaaagtacttgctgccaccaaaatcatcatttttgctgtctgatatctcttgcatgcagcctttactgaactatcggaagacctttgacgtgatagtgattgatcccccctggcaaaacaaatccgtgaaacggtcgaatagatatagttatctgagtccgttgcagattcaacagattcccatccccaagctggcagcccctaactgcctgcttgttacgtgggtgaccaaccgacagaagcacttgagattcataaaagaggagctctatccttcgtggtcagtggaagtggtcgcagaatggcactgggttaagatcacgaattcaggcgagtttgtgttccctctggacagtccgcacaaaaagccctatgagggactgatcctgggacgcgtccaagaaaagacggctctgcctcttcgaaacgccgacgtcaacgtcctgcctattcctgaccataaattgatcgtgtctgtgccctgcactctgcattcccataagcccccactggccgaggtgctcaaggattatattaagcctgacggcgagtatctggagcttttcgctcggaacctccagcctggctggacttcatggggcaatgaggtgcttaagtttcagcacgtcgattattttatcgctgtagagagtggaagttag

SEQ ID NO: 31268 - DNA, 1419 bp, Artificial Sequence
  Description of Artificial Sequence: Synthetic coding sequence
atgtcagtggttcatcagctgagcgcaggatggttgctggatcatttgtccttcattaataagataaattaccaactccaccagcaccatgagccttgctgccggaagaaggaattcacaacgtctgtacatttcgaaagcttacagatggattcagtgtcctcatctggagtgtgtgctgcttttatcgcatcagactccagcaccaaacctgaaaatgatgacgggggcaactatgaaatgtttaccagaaaattcgtgtttaggccggaactgttcgatgtaaccaagccttacatcaccccagctgtgcataaggagtgccagcagtctaacgaaaaggaagatcttatgaatggggtgaaaaaggagatatctatttcaatcattggtaagaagaggaagagatgtgtggtctttaaccagggcgagctcgacgccatggagtatcataccaagattcgggaattgatcctggacggctcgctgcagcttattcaggagggactaaaaagtggttttctgtaccctctgttcgaaaaacaggacaaaggaagcaagcccattacactcccccttgacgcttgcagcctgagcgaactgtgtgaaatggcaaagcatctgccaagcctgaatgaaatggagcaccaaaccctccagcttgttgaggaagacacatccgttaccgagcaggacctgttcctgcgggttgtggagaataatagctccttcacaaaagttatcaccttgatggggcagaaatatttactgccccctaagtctagcttcctcctttccgacatatcctgcatgcaacctctcctgaattataggaagacatttgatgttattgtgatcgatcccccatggcagaacaagagtgtaaaacggagtaatcgttatagttacctgtctccactgcagattcaacagatccctatccccaagctggccgctcctaactgcttactggtgacctgggtgactaataggcaaaaacacctgaggttcatcaaggaggagctatatcccagttggtccgtggaagtggtggctgaatggcattgggtgaaaattactaacagcggtgagttcgtcttccccctggattcgccccacaagaaaccctacgaaggactaatcttaggccgtgtccaggaaaaaactgctctccctcttaggaacgccgacgtcaacgtgctaccgatccctgatcacaaactcatagttagcgtgccctgtacactccactcacacaagccccctcttgccgaagtgctgaaagactatatcaagcctgacggtgaatatcttgagcttttcgcgaggaaccttcagccaggctggacttcttgggggaacgaagtcctgaaatttcaacacgtggattactttattgcagtggagtccggcagttag

SEQ ID NO: 31269 - DNA, 855 bp, Artificial Sequence
  Description of Artificial Sequence: Synthetic coding sequence
atggcttccctgcagcgcaaaggactgcaggccaggatcttgacatccgaggaggaggagaaactcaaacgggaccagacactggtcagtgacttcaaacagcaaaaactcgagcaggaagcccagaaaaactgggacctgttttataagcgcaactcaactaatttcttcaaagatagacattggacaactcgggagtttgaagagttaagatcctgtagagagttcgaagatcagaagttgactatgttggaggctggatgtggcgtcgggaactgtttgttcccgctgctggaggaggatccaaacatttttgcatatgcatgtgactttagcccaagagctattgagtacgtgaagcagaatcctctgtatgacacggaacgatgcaaagttttccagtgtgacctgactaaggatgaccttcttgatcacgtgccacctgaaagcgtggatgtcgtcatgctgatcttcgtcctgagtgccgtgcatccggacaaaatgcacctggttctgcagaatatatacaaagttcttaagcctggaaagagcgtgctgtttcgcgattatggcctgtatgaccacgcaatgctgcgatttaaagcgtctagtaaactgggggagaatttctacgtgcggcaggacggcactaggtcatatttttttacggacgactttttagctcagctgttcatggacacaggatatgaagaggtcgtgaacgaatacgtcttccgggagaccgtgaacaagaaggaaggattatgcgtcccaagggtattcttgcaatccaaattcctgaagccaccaaagaacccctctcctgtcgtgctcggtctggaccccaagagttag

SEQ ID NO: 31270 - DNA, 855 bp, Artificial Sequence
  Description of Artificial Sequence: Synthetic coding sequence
atggcatctctgcagcgcaaagggctccaggcccgcatcctaacctccgaagaagaggaaaagcttaagcgagaccagaccttggtgtctgacttcaaacagcagaagttggagcaagaggcccagaagaattgggacttgttctacaagagaaattccacgaatttctttaaggacaggcattggacaacgcgggagtttgaagagcttcggagctgcagagaatttgaggatcaaaaattgactatgctcgaggctggatgtggtgttggaaactgcttatttccactgttagaggaggaccctaacatcttcgcatacgcctgcgacttctctcctagagctatagagtatgtgaagcagaacccgctatacgacactgaacggtgcaaggtattccaatgtgatctgacaaaggacgacctattggatcacgttcctccagaatccgtggacgttgtcatgctaattttcgtgctcagcgctgtgcatccagacaaaatgcacctggtgctgcaaaatatctacaaagtactcaaacctgggaaatctgtgttgttcagggactatgggctgtacgaccacgctatgttgcggttcaaagcctcttctaagcttggcgaaaacttctatgttaggcaggatgggacccgtagttacttctttactgatgactttctcgcgcagctgttcatggacactggttacgaagaagtcgtgaacgaatacgtctttagggagacggtcaataaaaaagagggcttgtgtgtgccaagagtgtttctgcaatcaaagtttctaaagcccccaaaaaacccgtcaccggttgtactcgggttagacccaaaatcttag

SEQ ID NO: 31271 - DNA, 735 bp, Artificial Sequence
  Description of Artificial Sequence: Synthetic coding sequence
atggacatcttggtgcctttgttgcaattgctggtgctgttactgacgctgcccctccatcttatggcattattgggctgttggcagcctctgtgtaagagttattttccatacttgatggccgtgctgacaccaaagtctaaccggaaaatggagagcaaaaaacgggagttattttcacagattaaaggcctgacaggcgccagcggtaaggttgccctgttagagctcgggtgcggcactggcgcaaattttcagttctacccaccagggtgccgcgtaacgtgcctggatcctaacccccactttgagaaattcctaactaagtccatggctgaaaatcggcacctgcaatacgaacgttttgttgtggcacctggcgaggacatgcggcagctggctgacggaagcatggacgtcgttgtctgtaccctcgtgttgtgcagtgtgcagagcccgcgaaaggtccttcaagaggttaggcgtgtcctgcggcccgggggcgtccttttcttttgggagcatgtggcggaaccttatggttcttgggccttcatgtggcagcaggtgttcgagccgacctggaaacacatcggagacggctgctgtctcacacgcgaaacctggaaagacttagagaatgcccagttcagtgagatccaaatggagcgccagcccccacctctaaagtggctgcctgtcggtccacacatcatgggtaaagcagttaaatag

SEQ ID NO: 31272 - DNA, 957 bp, Artificial Sequence
  Description of Artificial Sequence: Synthetic coding sequence
atgcgcttactggccggctggctgtgtttgtccctggcctctgtgtggctggctaggaggatgtggaccctgaggtctccattgacccggtccctctacgtgaacatgacatccggacctggaggcccagcagccgcggcaggcggtagaaaggagaatcaccagtggtacgtgtgcaatcgtgagaagttatgtgaatctttgcaggctgtctttgtgcagtcttacctggaccaagggactcagatcttcctcaataattctatcgaaaagtcagggtggctgttcattcagttgtatcattctttcgtaagcagtgttttctctctgttcatgtcacgcacgagcattaatgggcttctcggaagaggcagcatgtttgtgttctccccagaccagtttcaacggcttcttaagattaacccagactggaaaacacaccgactacttgatctcggagccggagacggcgaggttacgaaaattatgtcaccgcacttcgaagagatctacgctacggaactctcggagacaatgatttggcaactgcagaaaaagaaatacagagttttaggaatcaacgaatggcagaatacaggcttccagtatgatgtgatttcctgtctcaatctgcttgaccggtgcgatcagcccctaacactcctcaaggatatacggtccgtgcttgaaccaacacgaggccgggttatcctggctctggtgctcccatttcacccatacgtagaaaatgtcggaggcaaatgggaaaaaccttctgaaattttagagattaagggacaaaactgggaggaacaggtgaacagcctgccggaggtattccggaaagcaggcttcgtgattgaggcttttactagactaccttacctatgtgagggcgatatgtataacgactactacgttctcgatgacgctgtctttgtgctgaagcctgtgtag

SEQ ID NO: 31273 - DNA, 954 bp, Artificial Sequence
  Description of Artificial Sequence: Synthetic coding sequence
atgagactgcttgctggttggttgtgcttgtcactcgcgagcgtgtggctcgcacggcgcatgtggacactgagatctcccctcaccaggtccctgtacgtaaatatgacatctggacctggagggcctgccgctgcggcaggtggcaggaaggagaaccaccagtggtacgtgtgcaaccgcgagaagctgtgtgaatccttgcaggccgtgtttgttcaatcctacttagaccaggggacacagatctttctgaacaattctatcgagaagtcaggatggctgttcatccaactctaccacagctttgtgagcagcgtgttctctttgttcatgagccgtactagtattaacggcctcctgggacgtggcagcatgttcgtgttcagtcccgaccagttccaacgcctgttaaagattaacccagattggaaaactcacagactgctcgaccttggagccggcgatggcgaggtcacaaaaattatgtctccacattttgaagaaatctacgcaaccgagctcagtgagactatgatttggcagttacaaaagaaaaagtacagggtacttgggataaacgagtggcagaacactggtttccaatatgacgtgatctcttgcctgaatcttttagaccggtgtgatcagcccctcacactactgaaggacatccggtctgtactggagccaaccagaggaagggttattctcgccctggtcctgccgtttcacccgtacgttgaaaacggagggaaatgggagaagcctagcgaaatcctggaaattaaagggcagaactgggaggagcaggtaaactcactgccagaagtctttcggaaggctggattcgtgattgaagcgttcacccggctcccatatctatgtgagggggacatgtacaacgattattatgtcctcgatgacgccgtgtttgtactgaagccagtatag

SEQ ID NO: 31274 - DNA, 849 bp, Artificial Sequence
  Description of Artificial Sequence: Synthetic coding sequence
atgtggactctaagatcccccttaacgcggtcgctgtatgtcaaagagaatcatcaatggtatgtttgcaaccgggaaaagctatgtgagtcactacaggctgtcttcgttcaatcatacctggaccagggaacccagattttcctgaataacagcatcgagaaatctgggtggttgttcatccagttatatcacagttttgtgagcagcgttttcagtctgttcatgtcccgcacttctattaatggcctcttgggccgtggctcaatgttcgtgttctccccagatcagtttcaaagactactcaaaatcaacccggactggaaaactcacagattgctggacctgggcgcaggggacggcgaggtcacaaagatcatgtccccacattttgaagagatctatgctaccgagttgtccgaaactatgatctggcagctccaaaagaagaaatatcgtgtcctgggcattaacgaatggcagaataccggattccagtacgatgttatatcatgcctaaacctactggatcgttgcgatcagccgttaacgctgttaaaggatatcagaagcgttctcgaacctacgagaggacgagtcatcctcgcgctggttctgccatttcacccttatgtcgagaacgtgggcggcaagtgggagaagcccagcgagatcctggaaatcaaaggtcagaactgggaggagcaagtcaactcacttcctgaggtgtttcggaaagcaggattcgtcatcgaagccttcactcgcctcccttacctgtgcgaaggcgacatgtataacgattactacgtcctcgatgatgcagtgttcgtactcaagccagtctag

SEQ ID NO: 31275 - DNA, 165 bp, Artificial Sequence
  Description of Artificial Sequence: Synthetic coding sequence
atgatgaaacctcaagctgagaccggggaagcagcacgggacccttccctgcggccagccaggacagtgttagttggatctctctcatggctccgcaaacaattgcaacccacgcactgcaaatacgaaggtcctcgcaaagccaggcgcctttggtttgcttag

SEQ ID NO: 31276 - DNA, 231 bp, Artificial Sequence
  Description of Artificial Sequence: Synthetic coding sequence
atgatcgctggagagcacaggctggatccagctactatatcactgggcgttgatcagaccgatgaccatcagcaacctacacatagcagaatcagaaagaagagggtgtcccccacctctgtttggtttcagccttatttctgcatcttgaaaactctctgtaccaccttagacaccgtccaagacgatgcaacatcgtcctggatgcttatatgccatgtcgatttctag

SEQ ID NO: 31277 - DNA, 7290 bp, Artificial Sequence
  Description of Artificial Sequence: Synthetic coding sequence
atggacatgtccgatcccaatttctggactgttctgagtaactttaccctgcctcacttacgctcaggaaaccgactgcgacggacgcagtcgtgcaggacctccaatcgaaagtctctcatcggcaatggacagtcacctgccctgccaaggcctcactcccctctttccgcccatgcgggcaatagcccccaagatagtcctcggaatttcagcccctcagcttctgcgcattttagttttgctagacgaacggatgggcgaagatggagtctggctagcctcccgagctccggctacggcacaaacacgccatcttctaccgtgtcaagtagctgttcatcccaggaaaagctgcatcaattgccctaccagcctaccccggacgaactgcatttcctgtccaaacacttttgtaccactgaaagcatcgccaccgagaatcgctgtaggaacacgccgatgaggcctcgctcccgatctcttagtccagggcgttcccccgcctgctgtgaccatgagataattatgatgaaccacgtgtacaaggagaggttccctaaggccaccgcccagatggaggagcgtctgaaagaaattatcacatcctattcccctgacaacgttctgcccctggccgacggcgtactgtcattcacccaccatcagataatcgaacttgccagggattgcctggataagagccaccaaggcctgattacctctcggtacttcctggagctgcagcacaaattggataagctgctgcaagaggcccacgatagatcagaatccggcgagctggcgtttatcaagcaactcgtccgcaagattctgatagtgatagcccggccggccagactgttagagtgcctggagttcgacccagaggaattttactatctgctagaggcggccgagggccatgccaaggagggtcagggaatcaaaactgatatcccaaggtacatcatctcacaactgggcttgaacaaggatcctctggaagagatggcacacctggggaactacgactcaggaacagcagaaactcctgaaaccgatgaaagtgtgtcttcaagcaatgcttctcttaagctccggaggaagccccgcgaatcagacttcgagaccattaagctcatctcgaatggggcctatggagcagtgtatttcgttcgacacaaggaatcacgccagaggttcgcaatgaagaaaatcaataagcagaatctcatcttacggaaccagatccagcaggctttcgtcgaacgagatattctaacttttgccgagaaccccttcgtagtgagcatgtattgcagcttcgagactcgcagacatttgtgtatggtcatggagtacgtggagggcggagattgtgccaccttaatgaaaaatatggggcccctgcctgtggatatggcccgcatgtattttgctgagaccgtcttggccctcgaatacttgcataactatggcatcgtgcatagagacctgaagcccgataatctgcttgttacaagcatgggccacatcaaactcaccgacttcgggctctccaaagtgggcctgatgtccatgacaactaatttatacgaaggtcatatcgagaaagatgcgagggaatttctagataagcaggtttgtgggactccagaatacattgccccggaggtgatcctgcgtcagggctacggcaagcccgtggactggtgggccatggggatcattctgtatgagtttctagttggatgcgtcccctttttcggggacaccccggaagagctatttggccaagttatctctgacgagataaactggcccgagaaagacgaggcccctccaccagatgcacaggacttgattactctgctgctgcggcagaaccctctcgagcggcttggcacaggcggagcatatgaggtgaaacagcatagattctttaggtccctcgactggaatagcctccttcgtcagaaggcggaatttattccacagctcgaatcagaggacgacacttcctattttgacacccgctccgagaagtaccatcacatggagacggaagaggaggacgacaccaatgatgaggactttaatgtcgagatccgacaattctcttcatgtagtcatagattcagcaaagtgttcagctcaattgaccgcatcacccagaattctgcagaagagaaggaggactcagtggataagactaaaagcaccactctcccttctacagaaaccctgtcttggtccagcgagtactcagagatgcagcagttgtctaccagcaactctagcgataccgagtctaacaggcacaaactttcctccggcctcctccctaaattggccatcagcacagagggcgaacaggacgaagcagcctcctgccctggcgacccacatgaggagcccggaaagcctgctttaccacctgaagagtgcgcacaggaggaaccggaagtaaccactcccgccagtaccatctcatcctccaccctcagcgtggggagctttagtgagcacttggaccagattaatggccgctctgagtgcgtggactccacggataatagtagcaaaccaagttctgagcccgcatcacacatggctaggcagaggcttgaatcaacggagaaaaaaaagattagcggtaaagttacgaagagcttgagcgctagtgcccttagcctcatgatccccggagacatgttcgctgtatcccccctgggctcaccaatgtcgccccacagcctgtcctcggaccccagttctagcagggactcttctccatccagggactcaagtgctgcctctgctagtccacatcagcccatcgttatccactcttcgggcaagaattacggatttaccatccgcgcaattcgggtctacgtgggagattccgatatctataccgttcatcatattgtttggaacgtcgaagaaggtagccctgcctgccaggcggggctgaaggcgggagatcttatcacccatataaacggtgagcctgtccatggtctagtgcacacagaagtcatcgagctgctgctgaagagcggtaacaaagtgagcattacgaccacaccctttgaaaacacctctattaagaccggccctgctaggagaaattcatacaagtccagaatggtacgacgctctaagaaatccaagaaaaaggagagtctggaaaggcgcagatccctgttcaaaaaactggctaagcagccaagtccccttttacacacgtcgcggtccttttcctgtctgaatcgcagcttgtcctcaggggagagcctaccagggagtcctacccacagcctgagtccacgatctccaactccatcctatcgtagcactccagacttccccagcggtacgaactccagccaatcctcctcaccttccagcagtgcacccaattcacccgccggttccgggcacatccgcccatccaccctgcacgggctggccccgaagctaggcggccaacggtacaggtccggtcggcgcaagagcgccgggaacatcccactttctccactcgcgcgcacacctagccctacccctcaaccaactagccctcagaggtcccctagtccacttctggggcacagcttgggaaattcaaaaattgctcaggcatttccaagtaaaatgcactctccccccacaatcgtgcggcatatcgttcgccccaaaagcgccgagccacccaggagccctttgttgaagcgcgtccagagcgaggaaaagttgtctccatcttatgggagtgacaaaaagcacttgtgttcccgaaaacactccttggaggttactcaggaagaagttcagagagagcaaagccagagagaggcaccgctccagtctttggatgagaacgtttgcgacgtgcctcctctcagccgggctaggccagtcgaacagggctgccttaagaggccggtctcgcggaaggtcggaaggcaagagtctgtggatgatttggacagagacaagctgaaggccaaggtggtggtgaaaaaagcggatggatttccggagaagcaggagtcacaccaaaagtcacacgggcccggcagcgacctcgagaattttgccttgtttaagctggaggaacgagagaagaaagtgtaccccaaggccgttgaaagaagcagcacctttgaaaataaagcctccatgcaagaggctccacctctgggctcgctcctgaaggatgctcttcacaagcaagcctctgtgagggcctcggaaggcgctatgagtgacggaagagttcctgccgaacaccgccagggcggtggagattttcgacgcgcgcccgccccaggaacactgcaggacgggctgtgccatagcctggacagggggatcagcggcaagggcgagggcaccgaaaagtccagccaagcaaaggaattacttaggtgcgaaaagcttgacagcaagctggcaaatattgactacctcagaaagaagatgagcttggaagacaaagaggacaacctctgccccgtgctgaagcccaaaatgactgccggctcacatgaatgtcttcctggcaaccccgttaggccaacaggtggacagcaagagcccccacctgccagtgagtcccgcgcattcgtgagcagcacccatgcagctcagatgtctgccgtgtccttcgttcccctgaaggccctcactggcagagtggacagcggaacggagaagcctgggctggtggcaccggaaagcccagtgcgtaagtccccttcagaatacaaactagagggccgctcagtctcttgcctaaagcccattgaaggcactctcgatatagctctgctgtccgggccgcaagcttcgaagactgagctgccgagcccagaatccgcacagagtccttccccatcaggagatgtgagggcaagtgttcctcccgtcctgcctagcagctccggcaaaaaaaacgatactacttcagccagagagctatccccttcgtcactgaagatgaataaatcttacctcctagagccatggttcctgccaccctcaagagggctgcagaatagccccgctgtgtcactaccggaccctgagttcaaacgcgaccgcaaaggaccacatcccacggctcggtccccaggaacagtcatggagtccaacccacagcagcgcgaaggttccagtcccaaacaccaggaccacacaaccgatccaaagcttctgacgtgtctgggccaaaatcttcacagcccagacttggctaggcccagatgcccacttccacccgaggcctcacctagcagggaaaagccaggactgagagagagctcggagagaggcccccccacagctagatctgagaggtcagcagcccgggcagatacctgtcgggaacctagtatggagctttgttttcctgagaccgccaaaacctcagacaattctaagaatctgctgtccgtgggtaggacacaccctgacttctacacccagactcaagctatggagaaagcttgggcccccggcggaaagaccaaccataaggacggcccaggagaagcgcgaccaccccctagagacaactcttcactccactccgccgggatcccgtgtgagaaggagctgggcaaagtcaggagaggggttgaacccaagccggaggcgcttttggcaagacgaagtttgcagccaccaggtatcgagtccgaaaagtcagagaagctgtcatcctttccctcccttcagaaggacggagccaaagaaccagagcggaaggagcaacccttacagcgccacccgtctagtatccccccccctcccttaactgcaaaagacttatcgtcgcccgcagcgaggcagcattgctctagcccttcccacgcctccggcagggaacccggagctaaacccagcaccgctgagccctcttccagtcctcaggaccccccgaagccggtagctgcgcattccgagagcagctcgcataagcccaggccgggtcctgatccaggccccccaaaaaccaaacatccggaccgaagtcttagtagccaaaaacccagcgtgggggctacgaagggcaaagagcctgctacccagtcgctcggaggatcctcaagggagggtaaaggccattctaagagtggacctgacgtctttcccgcaactcctggcagccagaataaggcttctgacgggataggtcagggcgagggcggcccctctgtgcctctccacacagaccgagcccctttggacgctaagccccaacccacctcaggcggccgccccctcgaagtcctcgagaagcccgtgcatctgccaagaccagggcacccgggaccctccgaacctgcggatcaaaaactgtcagcagtgggagagaagcagactctgagccccaaacacccaaagccatcaaccgtgaaggattgtccaaccctgtgcaaacagacagacaataggcaaaccgataagtctccatctcagccggcagcgaataccgaccgccgcgccgagggtaaaaagtgcaccgaggctctttatgctccggccgaaggcgacaagttagaagctggcctgtctttcgttcactctgaaaatcggctaaagggtgcggagcgacccgcagcaggggttggaaagggattccccgaagccaggggcaaaggtccgggaccacagaaacctcctaccgaggcggacaagcccaacggcatgaaaagatcgccatctgccacaggacagtcatccttccgtagcaccgcactcccagagaagagtctcagctgcagctcatctttccctgaaacgagggctggtgtgcgagaagcatcagctgcctccagcgacacatcttcagccaaagccgcaggagggatgcttgagctgccagccccatcgaacagggatcaccgaaaggcacagccagccggggagggccggactcatatgaccaagtcagactccttgccttcttttcgggtgagtactttgcctctggaaagccaccaccccgaccctaacacaatggggggcgcttctcaccgagacagggctctctccgtgaccgccaccgtcggtgagacaaagggcaaggaccccgcgccggcacagccccccccagcgagaaaacagaacgtgggacgcgatgtgactaaacctagcccagcacccaacaccgaccggcccatctctctttccaacgagaaagactttgttgttagacagagacgcgggaaggagtcactgaggagctctccgcataagaaggctctctag

SEQ ID NO: 31278 - DNA, 7335 bp, Artificial Sequence
  Description of Artificial Sequence: Synthetic coding sequence
atgaaggctcagagagaacgcctgcagatcccagggctgaccctcgacctcacaccccgtagtcttagtccaaccccctcctccccaggaagtccatgcagccccctattggctttccacttttggagttgccgcaccagtaatcgcaaatccctaattggcaatggccagtcaccagctctccctaggccacatagtccactcagtgcccacgcaggcaactcaccacaagactctccccggaatttcagtccatccgcctccgcccatttcagtttcgccaggagtctgaataggaccgatggccggaggtggagtctagctagcctaccaagcagcggctatggtaccaacaccccatcctcaacggtttcttctagttgttcatcacaagagaagctccatcagctgccctaccaaccaactcccgatgaattgcactttttgtctaaacacttctgtacaactgaatccatcgccactgagaatagatgcaggaacacaccaatgcgtcccaggagccggtctctgagcccaggcaggtctcccgcgtgctgcgaccacgagatcattatgatgaaccatgtatataaggagaggttcccaaaagcgactgcacagatggaggagcgactgaaagagataatcacctcttattcacctgataatgttctgcctcttgctgacggagtgctgtcattcactcatcaccagatcatcgagttggctcgggactgtcttgacaagtcccatcagggactgatcacatcccgctactttttagagctccagcataaactggacaagctgcttcaagaggcccatgatcgctcagagtctggagagctggcttttatcaagcagctagtgcggaaaatcctgattgtcatcgctaggcctgctaggctactggagtgcctagaattcgatccagaagaattttattacctcctagaagcagctgaaggccacgcgaaggaggggcagggtattaagactgatattcctcgatacattataagccaactcggacttaacaaagatccgttggaagaaatggcacacctggggaattatgactccgggactgcagaaacgcccgaaacagacgaaagcgtgagcagttcgaatgcttcactgaagcttcgcagaaaaccacgtgagagtgactttgagactatcaagctgatctcaaacggggcatacggggcagtgtatttcgtcagacataaggaaagtaggcagcgctttgctatgaagaagattaacaaacaaaatcttattctgcgcaatcagattcagcaggccttcgtggaaagggatatcttaaccttcgccgaaaatccctttgtggttagtatgtattgtagtttcgagacccgtaggcatctgtgtatggtgatggaatatgttgaaggaggtgactgtgctacactgatgaagaacatgggccctcttcctgtggatatggctcgcatgtacttcgcagagactgtcctggccttggagtaccttcacaattatggaattgtccatagggatctgaaaccagataatctgctggtgacatccatgggacacattaagctcacagatttcggactcagtaaggtcggcctgatgagcatgacaacaaatctctatgagggacatatcgagaaagatgcacgcgaatttctggataaacaggtgtgcggcactccggaatatatagcccccgaagtgatcctgcgccagggctacggtaaacccgtagattggtgggccatgggcattatcctttatgagttccttgtcggctgtgtaccatttttcggggatacccctgaggagttatttggccaggtgatttcagacgagatcaattggccagagaaggatgaggcccccccacctgacgcacaggacctgattacattgctgttacgacagaatccgctagaacgtctggggacaggaggtgcgtatgaggtcaagcagcatcgattctttaggtctctggattggaacagcctgctcagacagaaggcggaattcatcccccaattagagtccgaggatgacacttcttattttgatacaagaagtgagaaatatcaccatatggaaactgaagaagaggacgatacaaacgacgaagactttaatgtggaaatccgacagttctctagctgttcccatagattttccaaggtgttctcatcaatcgatagaatcacgcagaactctgctgaggagaaagaagacagcgttgacaaaacgaagtcgactactctgccctcaactgagacgctgtcctggagtagcgagtattcggaaatgcagcagctgtcaaccagcaatagctcagacactgaatctaacagacataaactgtcaagtgggctgctgccgaagctcgccatttccactgaaggcgaacaggacgaagccgcaagctgccctggcgatccccatgaggagcctgggaaacctgcactgccccccgaggaatgcgcacaggaggagcctgaagtcactaccccagcgagtaccatctcatctagtaccctgtccgttggatctttttccgaacatctcgaccaaattaatgggcggtccgagtgtgtggacagcactgacaattcctcaaaaccatcctccgaacctgcctctcatatggccagacagcggctggagtccactgaaaaaaaaaaaattagcggcaaggtcactaaatccctgagcgcctctgctctctcactcatgatccccggtgatatgttcgcagtgagtccattgggatcacccatgtcccctcattccctctcatctgacccgagctcttcaagagactcctccccttccagagacagttcggccgctagtgcttcacctcaccagccaatcgtcattcacagtagcggaaagaactacgggtttaccatcagggctatccgagtgtatgttggagacagcgacatttataccgttcaccacatagtctggaacgtggaggagggatcacccgcgtgccaggcagggctcaaggccggggacttaattacccatattaatggcgagccggttcacggactggtccacacagaggtgatcgagcttctgctcaaatctggaaataaggtgtccatcaccactaccccattcgagaataccagtataaagacaggcccagcgcgccgaaatagctacaagagtaggatggtgcgccgtagtaagaagagcaagaaaaaggaatccctggagcggaggaggagcctgttcaagaagcttgcgaaacaacctagtcctttgctccatacctcaagatctttttcctgcctgaatagaagcttaagtagtggcgagtccctgcccggatcgccgactcattccctctccccccgatcccccacccctagttaccgctcaacaccagacttcccaagcggcaccaatagtagtcagtctagcagtccttccagctcggccccgaactctcctgctggttctgggcatatccgcccatctaccttgcacgggttggctccgaaacttggcggccagaggtaccgatcagggcgccgtaaaagcgccggcaacattcccttgtcccccttagctcggactcccagtccaacacctcaacctaccagtccccagagaagtccctcaccccttctcggtcacagccttggtaactcaaaaatagctcaggcctttccttccaaaatgcattcaccccctacgattgtgcggcatattgtgaggcctaagtccgcagaaccccccagatcgcccctcctgaaacgagtccagtctgaggagaaactttcaccaagttatggatccgataagaaacatttatgcagccggaaacactcactggaagtgacgcaagaagaggtgcagcgggaacagtctcagagggaggcaccgctccagagccttgacgaaaacgtttgtgatgtcccccccctgagcagagcaagaccagtcgaacaaggctgtcttaagcggccagtgtctcggaaggtgggacggcaagaatctgtcgatgacctggaccgcgacaagcttaaagcaaaagtggtggtgaaaaaggcggatgggttcccggagaagcaggaatcccaccagaagtcccatggccccgggagcgacctggaaaacttcgcactgtttaagctggaggaaagggagaagaaagtctaccccaaggccgttgaaaggagcagtacttttgaaaacaaggcgtctatgcaggaggccccccctctgggatctctcctgaaagatgcattgcacaaacaggcctctgtgagggctagtgagggagcaatgtctgacggccgggtcccggcggaacacaggcagggtggaggtgatttccgaagagccccagcgcctgggacactccaggacggattgtgccatagtctcgacagaggcatcagcgggaagggcgagggaactgagaaatccagccaagccaaagaactattgcgatgcgagaaactcgatagtaagctggcgaatatagattacctgcgcaagaagatgagtctcgaagacaaggaggataatctctgtcctgtgctcaaaccaaagatgaccgccggatctcatgagtgcctcccggggaacccggtgcggccaacaggagggcagcaggaacctcctcctgcttccgaaagtagagcctttgtcagctctactcatgccgcccaaatgagtgcagtgtcattcgtgcctctgaaggccctgactggaagagtcgattctggcactgagaaaccagggcttgtggcccctgagagtccagtacggaagtctccatctgaatataaattagagggccgctctgttagctgtctaaaaccaattgaaggaacattggacatagctctgttatccggacctcaggcctccaaaacagagctgcctagtccagagtctgcacagtctcccagcccaagtggagatgtgcgggcaagcgtgccccccgttcttccaagtagctccgggaagaagaatgatactaccagcgcccgggagctcagcccctctagcctgaagatgaataagtcctatttattggagccatggtttctgcccccgagccgcgggcttcagaatagcccagctgtctctttgccagatccagaatttaagagagatagaaagggtcctcacccaactgctcgatctccaggaactgtgatggagtctaacccacagcaacgcgagggttcttcccccaaacatcaggatcacacgactgacccaaagctgctcacatgtctggggcagaaccttcattcccctgacctggctcggcccaggtgtccactccccccggaagcgtctccttcaagagagaaaccagggctacgtgaaagctctgagcgggggccccctacggccaggtccgagaggagcgcggccagggccgatacgtgccgggaaccttctatggagctgtgcttcccagagacagcgaaaaccagcgacaacagcaagaatctcttgtctgtcggtcgcactcatccggatttttacacccaaacacaagcaatggaaaaggcttgggctcctggcggcaagactaatcataaggatggccctggcgaggcccgcccaccacctagggacaacagctcactgcatagtgccggaattccatgcgaaaaggagctaggcaaagtgagaaggggtgtcgaacctaaacccgaggccctcctggcacgccgatctttgcagccaccaggcatcgaatcggaaaaaagtgagaagctctcctcattcccttccctgcagaaggacggtgcaaaagaaccagagaggaaagagcagccactccagagacacccgagcagtattcctccccccccgcttactgccaaagacctgagttccccggcagctcgacaacactgtagtagtccctcgcacgcatccgggagggagccaggcgctaagccatccaccgctgagccctcttcctctccccaggacccccccaaaccggtcgccgcccattccgaatcttctagccataagccgaggcccggtcctgatccgggacctcccaagacaaagcatcctgacaggagtctgagctctcagaaaccatcggtgggcgccacaaagggaaaagaacccgcaacccaaagccttggggggagttctcgtgaggggaaaggccatagcaaatcaggcccagacgtgtttccagccactccaggttcccagaacaaagcaagcgacgggattggccagggagaaggcgggccctccgtcccactgcacaccgatcgggcccccctggatgccaagccgcagcccacctctggcggacggccactagaggtactagagaagcctgtgcacttgccgcgcccgggacatcctggccccagcgagcccgccgaccagaagctatcagctgtgggcgagaaacagactctgtcgcctaagcacccaaaaccaagcaccgttaaggactgccctacactttgtaaacagacggataatagacaaacagacaaaagcccctctcagccagctgccaatactgaccgccgggccgagggaaagaagtgcactgaagctctgtacgccccagcagagggcgataagttggaggccggtctgtcttttgtccattccgaaaatcgactaaaaggggctgaaagacccgccgcaggagtagggaagggatttcctgaggctcgtggaaagggtcccgggccacagaaacctcctactgaggccgacaagcctaacgggatgaaacggagtccaagtgccacaggacagagctcttttcgatccactgctctgccggagaaaagtctcagctgtagctcctcatttccggagacccgggctggcgtgagggaggcgtctgctgccagtagcgacactagtagcgccaaagctgcgggcggcatgctggagctccctgcgccttccaatcgggaccacaggaaagcacagccggccggtgaaggaagaacacatatgactaaaagtgattcactgccttccttccgcgtgtctacattgcccctggaatcgcaccaccctgacccaaataccatgggcggtgcctcccacagagatagagctctgagtgttaccgctaccgtcggtgagactaaaggtaaggatcccgcccccgcccagccccctcccgcccgaaagcagaatgtgggcagggacgttaccaaacccagccctgccccaaacaccgacagacccattagcctgagcaatgagaaagactttgttgtcagacagagaagaggcaaagagagtctccgcagcagcccgcataagaaggccctttag

SEQ ID NO: 31279 - DNA, 7305 bp, Artificial Sequence
  Description of Artificial Sequence: Synthetic coding sequence
atggatgagagcagtattctccggcgacgcggcttgcagaaggagctttctctgcctcgaaggggctcgcttattgacagtcaaaagtggaattgtctggtcaaacgctgccggacctcgaacaggaagtctctgattggaaacggccagtcgcccgctctaccaagacctcattctcccctgagcgcacatgcaggaaactcaccacaggattctccccgtaacttttcccccagtgcctccgctcacttctcatttgctcgaaggaccgatgggagacgctggagcctcgccagtctcccttcctctggatatgggaccaacaccccctcaagcactgtgtcctccagctgtagcagccaggaaaaactccatcaactcccgtaccagccaacaccagatgagcttcatttcctgagtaaacacttctgtacgacagaaagtatcgcaactgaaaacagatgcagaaataccccaatgcgtccgcgcagccggtctttgagtcccggcaggagccccgcatgttgtgatcacgagatcatcatgatgaatcacgtgtacaaagagaggtttcccaaagccacagcccagatggaagagaggctgaaagagatcattaccagctactcccctgataacgtccttccactggccgacggagttctgagttttacccaccatcagatcatcgaattagctagagattgccttgacaaaagccaccagggccttattacatctcggtatttcctggagttacagcataaactggataaacttctacaggaagctcacgatagatccgagagcggtgagctggccttcattaaacagctagtgaggaagatactgattgtgatcgcccgccccgcccgcttactagaatgtctggaattcgaccccgaagagttttactatctgttggaggccgctgagggccacgccaaagaggggcaaggcattaaaacagatattccaaggtacattatttctcagctcggactgaacaaggacccactggaagaaatggcccatctcggaaactacgatagtggcactgcagaaacccccgaaacagatgagtcagtgtcatcctcaaatgcgagcctcaagctgagacgcaagccgagagaaagcgacttcgaaactatcaaattgatcagcaatggcgcctatggtgcggtctatttcgttaggcacaaggaatccagacagaggttcgcaatgaaaaagatcaacaaacagaatctaatcttgagaaatcagatccagcaagcgtttgtcgagagggatatccttaccttcgccgagaacccattcgttgttagcatgtactgtagttttgaaacccgtagacacctctgtatggtcatggaatacgtggaaggcggggattgcgcaactcttatgaaaaatatgggtccgttacccgtagacatggccaggatgtacttcgccgagacagttcttgctctggaatacttgcataattatgggatagtgcaccgagatttgaagccagacaacttattagtgactagtatgggccacattaagctgactgatttcgggcttagcaaggtaggtcttatgagtatgacgacgaacctttacgagggtcacatagaaaaagacgcccgtgagttcctggacaagcaggtttgtggcacccccgagtacattgccccggaagtaatactaaggcagggctacgggaagcctgtggattggtgggctatgggcataatactctatgaatttttggtgggatgcgtgccgtttttcggggacaccccggaagagctgtttggacaggtgataagcgatgagattaactggcccgagaaggatgaagccccacctccagatgcacaggaccttattacccttctcctccgtcagaacccactggagaggctggggactgggggagcttatgaggttaaacagcatcgctttttccgctccctcgattggaacagcctgttgcgacaaaaggctgaattcatcccacaattggagagtgaggatgacacatcttatttcgacactcgctctgaaaaatatcatcacatggaaacggaggaggaggatgacacaaacgatgaggattttaacgtcgagatcaggcaattcagttcttgctcgcaccgtttttctaaagtgttttccagcattgacaggatcacacagaacagcgcggaagaaaaggaagactcagtagacaaaacgaaatccacaactctgccatcaactgaaacgctgtcttggtcttccgagtacagcgaaatgcagcagctatcaacctctaatagttctgataccgaaagtaatcgccacaaactcagctccgggctactacctaagctggcaatctccactgaaggggagcaggacgaagccgcatcatgcccgggtgacccgcatgaggaaccaggaaagcctgcgctgccccctgaagagtgcgcacaggaggaaccagaggtgacaacaccagcatcaacaattagtagtagcacactgagcgtggggtcattttcagagcatctagatcagattaacggccgatcagaatgtgtggactcgaccgataattcttctaagccttcttctgaacccgcctcgcatatggcacggcagcgcctagagtccacagaaaaaaaaaagatcagtggtaaggttacaaaatcgctgtcagccagcgccctcagcctgatgatcccaggggatatgttcgctgtgtcacccctgggtagtccaatgtcccctcatagtctgtcttccgaccctagtagtagccgggactcctcccctagcagagacagtagtgcagcctccgccagcccacaccagccaatagtgatacatagctcagggaagaactatgggtttacgatacgcgcaattcgcgtgtatgtaggcgattcagacatttatacagtacaccacatcgtctggaacgtggaagaaggaagccccgcgtgccaggccggcctcaaggcaggggacctcatcacgcatatcaatggggagccagtgcatgggctggttcataccgaggtgatcgagctgttgctgaaatccggcaacaaggtgagcataactactactccgtttgagaataccagcattaagacagggcccgccaggcggaatagctacaagtccaggatggtccggcggtctaaaaagtcaaagaaaaaagaatctcttgagaggcgaaggtcactctttaagaaacttgcgaagcagcccagcccactgctgcatacctccagatctttcagctgcttaaaccgctcgctcagctctggcgagtcgctgccaggctctcctacccactcgctgtcgccaaggtctcccacacctagttacaggagcacaccggactttccatcaggcacaaactctagccaatcttccagcccttcatcttcggcccctaacagccccgccggatccggccacatccggccttccacactgcacggactggcacccaagctgggcggccagcggtaccgtagcggaagaagaaagtctgctgggaacatccccctgagccctctcgcccgaaccccctcgccgacgccccagcccacatctcctcagcgctcgcccagccccttgctcgggcattctctcggcaattcaaaaatcgcccaagcctttccatctaaaatgcactcccctcccacaattgtacgccacattgtccggccaaagtccgccgagcctccaaggagccctttgctcaagagggtgcaatcagaagagaagctcagtccaagttacggtagcgataagaagcacctctgctcacgcaagcacagcttggaggtaacacaggaagaagtgcagcgagaacaatcacaaagagaagcaccattacagagccttgacgagaacgtgtgtgatgtccccccactctccagagccaggccagttgagcaggggtgcctgaaaagaccagtctctcgcaaggtaggccgacaggaatctgtcgacgatctggaccgggataaattgaaggctaaggtggtggtgaagaaggcagatggcttccccgaaaaacaggagagccaccagaagtcacatgggccaggctctgatctcgagaatttcgcactgtttaaactggaggagcgtgagaaaaaagtataccccaaggccgtcgagaggtcttcaacatttgagaacaaagcctctatgcaggaggcacctcctttaggctccctgctcaaggacgccttacacaagcaggcatccgtgagggcatcagaaggggctatgagtgatgggagagttccagcagagcatcggcaaggcgggggtgatttccgacgcgcccctgcccccggcactttgcaagacgggctttgtcattctttggacagaggtatatccgggaagggcgagggtacagaaaagtctagtcaggccaaggagcttctgaggtgcgaaaagctggactctaaactggccaacatcgattatcttaggaagaagatgtccctcgaggacaaggaagataatctctgccccgtccttaagcctaagatgactgccggctctcacgagtgcttgcctggtaatccagtcagaccgacagggggccagcaggagcctccgcccgcttcagagtcccgtgccttcgtctcaagcacacacgccgcccagatgtcagctgtttcttttgtgccgttgaaggctctcaccggtagagtggattccggaacagagaagcctggcctggtggctcccgagtctccagtacgaaaatcaccatccgagtacaaactggaagggagatcagtttcctgcctgaagcccatcgaagggacactcgacatcgccctgctcagcgggccacaggcatcaaaaacggaactcccaagcccagaatcagcccaaagcccttccccctctggcgacgtgcgggcttctgtcccaccagtactcccctcaagttcaggcaagaagaatgatactacctcagcgagagagctgtccccatcatcactcaagatgaacaaaagctatctgttagagccgtggtttctgccaccctctcggggtctccagaacagtcccgccgtttcgctgccagatccagagtttaagagggaccgaaaggggcctcatcctactgctaggtctccgggaaccgttatggagtctaatcctcaacaaagggaaggatcctcacccaagcatcaggatcatacgaccgaccccaaattactgacctgtctcggacagaacctgcacagtcctgacctggctcgtccaaggtgtcctctgcccccagaggcctccccctcacgtgaaaagcctggtctgcgcgaatcatcagagcgcggcccgccaaccgccaggtctgaaagaagtgcagcgagagctgatacttgtagggagccctccatggagctgtgcttcccagagaccgccaaaacgagtgacaattccaagaacctgctgagtgtcggtagaacccaccctgacttttacacgcagactcaagcgatggaaaaggcttgggcaccaggaggtaagacaaaccacaaagacggccccggagaagctcgcccacctcccagggataacagctctctccacagcgccggcataccctgcgaaaaagaacttggcaaggtgagacggggtgtggagcccaaacccgaggccctgctagcaagacgcagcctgcagcctcccgggatcgagagtgagaagtcagagaagttgtcttctttccctagcttgcagaaggacggcgccaaggagccagagcggaaggagcagccactgcagcggcacccttcaagtattccaccaccacccctgactgcaaaagatctatcctctcctgctgccagacagcattgttcctcaccaagccacgcttctgggagagagcccggcgcgaaaccctccactgcggagccttcttccagtcctcaagatcctccaaagcccgtggcagctcacagtgagtctagctctcataagcccaggcccggtccagaccctggcccccctaagaccaaacacccagacagatctctcagttcacagaaaccgagcgtaggagccaccaaagggaaggagcctgctacccaatctcttggaggcagttccagggaaggtaaagggcatagcaagtccggccccgacgtgttcccagctacccccggtagtcagaataaggcttccgatggaattggccagggggaaggaggacccagcgtcccgctgcatactgaccgcgccccactcgatgcaaaaccccagcctacatctggcggccgcccactagaagtcctggaaaagcctgttcatctcccaaggcccggacaccccggtccatctgagcccgcagatcagaaattgagtgcagtgggcgagaaacagaccctcagtcccaaacatccgaaacctagtaccgtcaaagattgccctaccctatgtaagcagacagacaacagacagaccgacaagtcaccatctcagccagcagctaatacagaccggcgggcagagggcaagaaatgcacagaggctctgtatgcccccgcggaaggggacaaactggaagcgggtctgtcctttgttcactcggagaacagactgaaaggtgcagagagacccgccgcgggtgtggggaagggctttcccgaggccagaggaaagggacctggaccccagaaaccacccactgaagccgacaagccaaatggaatgaagcggagccccagcgctacggggcagagtagctttaggtcgactgcactgcccgagaagagtctctcttgttcctcttcttttcctgagacgagggctggagtcagggaagcatccgctgcttccagcgatacttcctccgccaaggctgccggaggcatgttagaattgcccgcaccatctaacagggaccaccggaaagcccagcctgctggggagggcaggacacatatgacaaaaagcgattcgctaccaagctttcgggtctccactctgccactggaatcacaccaccccgatcctaacacaatgggcggtgcaagccaccgcgaccgggccctcagcgtcaccgccacagtgggagaaactaagggtaaggacccagcccccgcccagcccccccctgctcgtaaacaaaatgtgggccgcgatgtgaccaagccttctcccgcacccaacacagatcggccaatcagcctgtccaacgagaaagacttcgttgtaagacaacggcgcggcaaggaatccctccgcagcagtccacataaaaaggccctgtag

SEQ ID NO: 31280 - DNA, 7881 bp, Artificial Sequence
  Description of Artificial Sequence: Synthetic coding sequence
atgggagagaaagtgtccgaggctcccgagcccgtgccccgggggtgctctgggcacggctcccgcactccagcctcagcgctcgttgcagcctccagtccaggcgcttcaagtgccgaatcctcctcaggttccgaaaccttaagcgaggagggcgaaccaggaggtttcagtagggagcaccagcccccgccccctcccccacttggtggtaccctgggggcccgggcaccggccgcctgggcaccagcatcggtcctgttggagcgcggagtgctggctttacctccccccctgcccggcggcgctgtccctccagcccctcgaggatctagcgcatcccaggaagaacaggatgaagaactggaccatattttgtcccccccacccatgccttttaggaaatgctcaaatcctgatgttgcttcggggccaggaaaatcacttaaatataagcggcagctcagtgaggacggcaggcaattgcgccgcggttcactgggcggtgcgctgaccggtagatatctgttgcctaatcctgtcgctggacaggcatggcctgctagcgcagagaccagcaatttagttagaatgcggtcacaggcccttggacagagtgccccaagtttgactgcttccttgaaagagctctcactgccacggagggggtcattctgcagaacgtctaacagaaaatctttgatcgggaacgggcagtcccccgctctgccgcggccccactcgccactgagcgcccacgccggcaactcgccccaggattctcctagaaatttttctccctctgccagcgctcactttagctttgctagatccctgaatcgcactgacggccggagatggtctctagctagcttgcctagctctgggtatgggactaacaccccttcctcaaccgtaagctcctcctgctcttcgcaagagaagcttcatcagctgccttaccagcctacacctgatgagctgcactttcttagcaagcacttttgcacgaccgaatccatcgccacagagaacagatgccgaaacacccctatgaggccccggtcacgatccctgagcccaggcagatccccggcgtgctgcgaccacgaaatcatcatgatgaatcatgtatacaaggaaaggtttcccaaggccaccgcccaaatggaggagcggctgaaagaaatcatcacttcttatagtcccgataacgttctaccactggcggacggagtgctgtcattcacacatcatcagataatagaactcgctagggactgtttggacaagagtcatcaggggctgattacttcacggtacttcttagagttgcagcacaaattggacaaactgctgcaggaagcccatgatagaagtgaaagtggggagctggctttcatcaagcagctggtaaggaagattttaatagtgatagcccgccctgccaggctgcttgagtgcttagaatttgaccccgaggaattttattaccttctggaggcagctgaaggtcacgctaaagaggggcaggggatcaagaccgatattcctcgatacattataagtcaactcgggctgaataaagaccctctcgaggagatggcccacttggggaactatgatagtggaacggccgaaactcccgaaaccgacgagtcggtctctagtagtaacgcttcgttgaaactccgccgcaaacctagggagtcagacttcgaaacgattaagcttataagcaacggcgcatacggtgctgtctacttcgtgaggcacaaggagagccgacaacgtttcgctatgaagaaaatcaataaacagaatttaatcttgaggaaccaaatccagcaggccttcgtggaacgggatatactcaccttcgccgaaaatccattcgttgtgtccatgtactgttcattcgagacgaggcggcacctttgcatggtgatggagtacgtcgaaggcggggactgcgccaccctaatgaaaaacatgggtccattgcctgtagatatggcccggatgtacttcgccgaaactgtgttagccctggaatacctgcacaactacgggattgtgcaccgcgacctcaagcccgataatctacttgtgaccagcatggggcacataaagctgaccgactttggactgagcaaggtggggctgatgagtatgacgaccaatctgtatgaaggtcatattgagaaagacgcgcgggaattccttgacaaacaagtatgcggcactcctgaatatattgccccggaggtgatcctgcgccagggatatggaaagccggtggattggtgggccatggggataattctctatgaatttctcgtgggatgcgtgccattctttggcgacacacctgaggaacttttcggccaagtgatctcagatgaaataaattggccagagaaagatgaagccccaccacccgacgctcaggatctcattacccttctcttaaggcaaaaccctctagaaaggcttggcacaggcggagcttacgaggtgaaacaacatcgattctttcgttccctggactggaatagtctgctgcgacagaaagccgagttcatcccacagctggagagcgaggatgatacatcctatttcgatactcggagtgagaagtaccaccatatggagaccgaagaggaggatgataccaatgatgaggattttaacgtggagattcggcagttttcaagctgcagccaccggttctctaaggttttctcctcaattgaccgtatcactcaaaatagtgcggaggaaaaggaggactcggttgacaaaaccaagtctacaacccttccctccacagagaccctgagctggtcttcagagtattccgaaatgcagcagctatccactagtaactcttctgataccgaaagcaatcggcacaaactgagctctggactgctcccaaaactggctatttccaccgagggcgagcaagacgaagctgctagctgccctggtgatccgcacgaagaacccggcaagccagcgttgcccccggaggagtgcgcccaggaggagcctgaagtgacaactcctgccagtacaattagctcaagtaccctatctgtagggagcttctctgaacaccttgatcaaatcaatggcagaagcgagtgcgtggactctacggacaactcctcgaagccgagcagtgaacccgccagtcacatggcacgacagcgcctggagagcacggaaaaaaaaaagataagtggaaaagtgaccaaatcactctctgcctccgccctatcattaatgatcccaggtgacatgtttgcagtgagccctctcgggagtcctatgtcaccacactcgctgtcctccgatccatctagctcccgcgacagcagtccttcacgcgactcttccgctgcttctgcctctccacaccagccgatcgtgatccattctagtggcaaaaattacggctttaccattcgagccattcgcgtttacgttggagactcagatatttataccgtgcatcacattgtgtggaatgtcgaggaaggctctccagcttgccaagctggtctcaaagctggtgacctgatcacacacatcaacggcgaacctgtgcatggcctcgtgcacactgaggttatcgagctcttgctgaaatcaggcaataaggtgtctatcacaaccaccccttttgaaaacacttccatcaaaactggaccagccaggcggaactcttacaaatcacgcatggtgaggagaagcaagaagagtaaaaaaaaagagtcgcttgaaaggcggcggtcactcttcaaaaagttagccaaacaaccttcgcccctgctgcatacttctaggtcattctcatgcttaaatcgtagcctaagctctggtgagtctctgccaggcagtccaactcatagtctgagcccccgttctcccacgccttcttacagaagcacacctgactttccttcgggtacaaactccagccagtcatcaagcccctccagctcggcaccaaactctccggctggtagcgggcatatccgcccctctacacttcatggcctggctccaaagctggggggtcagcgctatcgatcaggcaggcgcaagtccgccggaaatatccctttatctccactggccagaacaccatctccgacaccccagcccacatcccctcaacgttcaccctcaccactcttgggccactcactggggaacagtaagatcgcccaggccttcccctccaagatgcattcccctcccacaattgtcagacatatcgtacgccctaagagcgccgaacctcccaggtccccactgttgaaaagggtgcagtcagaagagaaactctctcccagttacgggagcgataaaaagcacctgtgtagcaggaagcacagcctggaggtgacacaggaggaggtgcagcgggagcaatcacagagggaggctcctctgcagagtctggatgagaacgtctgtgatgtgccgcccctgtctcgagctcgacctgttgagcagggatgcttaaagcggccggtgagccggaaggtaggaaggcaggaaagcgtggacgatctcgatcgagataagctcaaggccaaggtagttgtgaagaaagccgacggtttcccagaaaaacaagagtcacaccaaaagagccatggaccgggcagcgatcttgagaattttgctctctttaagttggaagaaagagagaaaaaggtgtatcccaaggcggttgaaagatcgtccactttcgagaacaaggccagcatgcaggaggcccctcctcttggttctctgcttaaagatgcacttcataaacaggccagtgtgcgcgcctcggagggcgccatgagcgatgggcgggttcctgcggaacatagacaggggggaggagactttagacgggcgcctgcacccgggaccctgcaagacggtctatgccactctctggatagaggtatatcaggaaagggagaaggcaccgagaaatcttcccaggctaaggagctactccgatgtgagaagttggattccaagctcgccaacatcgactaccttcgaaaaaaaatgagtctggaggataaggaggacaatctctgtccggtcctgaagccaaaaatgaccgcaggcagtcacgagtgtctgccaggcaatcccgtgcgccccaccgggggccagcaggaaccccctcctgcatccgagtcccgggccttcgtgtcatccacccatgccgcacagatgagcgcggtctccttcgttccgctgaaagcactgaccggccgggtcgactccgggaccgaaaaaccaggattggtcgctcctgaaagcccagtccgcaaatcccccagcgaatataaacttgagggacggagtgtgtcatgcctgaaaccaatcgaggggactctcgatatcgccctgctgtctggcccccaggcatcgaagacagagttgccaagccccgagagcgcacaatccccatcaccgtctggtgacgtccgcgcatcggttcccccagtgctgcctagttcttcgggcaaaaagaacgacacaacgtctgcacgagagctgtctccaagtagtctcaaaatgaataaatcctacctgttggagccctggtttctacctccaagtcgaggactccagaactcgcctgccgtatcactgcccgatccagagttcaaacgggaccgcaaagggcctcaccccacagctaggtcgccaggaacggtcatggaatccaatcctcaacagcgagaggggtcatccccaaaacatcaggaccacacaaccgacccgaaacttctgacctgtctcggtcaaaacctgcacagtcccgatttggcacgtccaagatgcccccttccacctgaagcaagtcctagtcgggaaaagcctggtctcagggaatcctcggagaggggtcccccaactgcaaggagtgaacgctcagctgcgcgggctgatacatgcagggagccctccatggagctgtgttttcccgaaactgcaaagaccagcgataattccaaaaacttgcttagtgtgggccggacccaccccgacttctatacacagacccaggctatggaaaaggcttgggctcctgggggtaaaactaatcacaaagatggacccggagaggcccggccccctcccagagataactcttccctgcactccgctggcatcccatgcgagaaagaattgggcaaggtgagacggggagttgaacccaagccagaggctctgttggcgcgtcgctctctgcagccaccaggaatagagtccgagaagagtgagaaactctctagtttcccatcgttgcagaaagacggcgccaaggaaccagagcgcaaggaacaacccctccaacggcacccatctagcattccgcccccacccctgaccgctaaagacctgagctcccctgctgcaagacagcactgcagttccccctcccacgcatcaggacgcgaacccggagctaaacccagtaccgctgaacctagctcaagtccccaggatccacccaagccggtcgcggcccactcggaatcttcctcccacaaaccacgccctggaccagacccaggaccgccaaagacaaagcaccccgatagatcactgtccagccagaagccatctgtcggtgccacgaaggggaaggagcccgcaacccagagtttagggggcagtagtcgtgagggaaaaggacacagcaagtctggtcctgatgtcttccccgcaaccccagggtcccagaataaggcatcagacgggataggccagggcgaaggagggccctccgtacctcttcacacagacagggcccccctcgatgccaaaccgcaacctacaagcggtggtaggcctctggaagtcctggagaagcccgtgcatttaccaagaccgggtcaccctggaccatctgaacccgccgaccagaagctgtccgcggtgggggagaaacagactttgagtccgaagcacccgaagccatctacagtgaaggattgtcccacactgtgcaagcagacagacaatagacaaacggataaaagcccaagccagcctgcagccaatacagacagacgggctgagggcaaaaagtgcaccgaggccctctacgctcctgcagaaggggataaattagaagccgggctgtccttcgtgcactctgaaaataggctaaaaggcgcggaaaggccagcagccggagtgggcaaagggtttcctgaagccaggggaaagggcccaggaccacagaagcctcctactgaggccgataagcctaacgggatgaaacggtctcctagcgccactggacagtcctcatttaggtcgactgccctgccagagaagtcgctatcatgtagctcttcttttcctgagacccgggcgggcgtgagggaggcaagtgccgcctcctccgataccagctctgccaaagccgccggggggatgcttgagcttccggctccgagcaaccgagaccacaggaaggcccagcctgcaggggagggccgtactcacatgaccaagtcagacagcttaccatctttcagggtaagcacactacccctggagtcacatcacccagacccaaacactatgggcggcgctagtcatagggatcgggcactcagtgtgaccgccacagtaggcgagactaagggtaaagatccagcccccgcgcagcccccgccagcaaggaagcagaacgttggcagagacgtgacaaaacccagtcccgctcccaacacagatagacctattagcctgtcaaatgagaaggattttgtcgtccgacaaagaaggggaaaggagagccttcgctctagccctcataagaaagccctgtag

SEQ ID NO: 31281 - DNA, 7335 bp, Artificial Sequence
  Description of Artificial Sequence: Synthetic coding sequence
atgaaagcccagcgtgagagactgcaaatcccgggcctcacacttgatctgactccacggtccctgtcccccaccccttcttctcctggcagcccctgttctcccctgctcgcctttcatttctggtcttgtaggacctccaacaggaaaagcctgattggaaacggacagtctccagccctgcctagaccacactctcctctgtccgcacatgctggaaactccccccaggattcaccacgcaacttctcaccaagtgccagtgcccatttctctttcgctaggcggaatgatcgaacagatgggcggcgctggagccttgcatctcttccttcaagcggttacggcacaaatacaccatcatccacagtgagcagctcctgtagcagtcaggagaagctgcaccagttgccctatcagccaacgcctgacgaactccacttcctgagcaaacacttttgcactacggaatcaattgctactgaaaaccgctgccggaatacacctatgagaccccgctcccggagtctgagcccgggtaggtctcccgcctgctgtgaccacgaaattatcatgatgaatcacgtttacaaagaacggttccctaaagcaaccgctcaaatggaggagcgtctgaaagagatcataacgtcttactccccggacaacgtgctccctctggccgatggagtgctctcttttactcatcaccagataattgagctggcaagggattgcttagataagagtcaccagggcttaataacctcacgctacttcttggagttgcagcacaaattggacaaactgctgcaggaagctcatgatcgctcggagtccggagagctggcctttattaaacaactcgtaagaaagatccttatcgtcatcgcccggccggctcgcctcctggaatgcctggagtttgaccctgaggagttttactatttgttggaggcagccgagggccacgcaaaagaaggccagggaatcaagactgacattccacgctatattatctcccaattgggcctcaacaaggatccccttgaagagatggcccaccttggcaattacgactctgggacagccgagacacccgagacagacgaatccgtatcctcaagtaacgcttctctgaagctgaggaggaagccacgcgagagtgactttgagaccattaagcttatcagcaatggcgcatacggcgctgtatactttgtccgacataaggagtccagacaaagatttgcaatgaaaaagatcaacaagcagaacttgattctccgcaaccagatccagcaagctttcgtcgagcgggatattttgactttcgcagaaaatccattcgtggtctcaatgtactgcagcttcgaaactcgcaggcacttgtgtatggtgatggagtatgttgaaggcggggactgtgccaccctcatgaagaacatgggcccgctcccagttgacatggcgcgtatgtacttcgccgagaccgtgctggccctggagtatttgcataattacggaattgtgcatcgcgacttgaaacctgacaacctcctggtcactagcatgggtcacattaagcttacagacttcggcttatctaaagtggggctcatgagtatgacgactaatctgtacgaaggacatattgaaaaggatgcgagggagttcctcgacaagcaagtatgcgggacccctgagtacatcgcacccgaagtcattctgagacagggctacggaaagcccgtcgactggtgggccatgggcatcattctctatgaatttcttgtgggttgtgtgccctttttcggcgataccccggaagagttatttgggcaggtaatcagcgatgaaataaactggcctgaaaaggacgaggctccaccacccgacgcgcaagatctgattacgctgctccttcgacagaacccccttgaacggttagggaccggtggcgcttacgaagtgaaacagcaccggtttttcagatccctggattggaactcactacttcgtcaaaaggccgaattcatcccccagctcgaaagcgaggatgatactagctacttcgacacccgtagtgaaaaataccaccacatggaaaccgaagaggaggacgacacaaacgatgaggacttcaacgtcgagatcaggcaatttagctcctgtagtcatcgcttttcaaaagtgttttccagtattgaccgcataacacaaaatagcgccgaagaaaaggaggatagcgtggataagacaaaatcaacaacactgccttcaaccgaaactctgtcctggagttctgagtactctgaaatgcaacaactgtccacttcaaattcctctgatacagaaagcaatcggcataagctgtcctcagggcttctgccaaagttagctataagcactgagggagagcaggatgaagctgcctcctgccctggggaccctcatgaagaacccggtaagcctgcgttaccacctgaggagtgcgcccaggaagagccagaggtcactacccccgctagcaccatcagttcttctacattgtctgtgggaagtttcagcgaacacctggaccagattaatgggaggtctgagtgtgtagactccacagacaactcctccaagccatcgtcagaacccgccagccacatggcccgccagcggctcgaatctaccgagaagaaaaaaatttcaggcaaagtaacgaaaagtctaagtgcaagcgcgctgagtttgatgattccaggagatatgttcgctgtgagtcctctggggtctcccatgtccccacacagcttgtcaagcgaccccagctctagtcgggactcttctcctagcagagacagctcagcagcatctgccagcccgcaccagcccattgtgattcactccagcggtaagaactacggcttcacaatccgtgccatccgagtctatgtgggtgactccgacatatacacggttcaccatatcgtgtggaacgtagaggagggttcccctgcctgccaggctggacttaaagcaggagatttgatcacacatatcaacggcgaaccggtccatggtctggttcacactgaggtgatagagctgctgctcaagtccggcaacaaggtttccattacaactaccccattcgaaaatacttctataaaaaccggacctgcgcgtagaaatagctacaaaagtagaatggtgcgccgaagcaagaagagcaaaaagaaggagagcttggagaggcggaggtcacttttcaaaaagctcgcaaaacagccctcccctctgctccatacttcacgatcattcagctgcctcaaccgctctctctctagcggcgagagtctgcctggttccccaacgcactcactgagtccaaggtccccaactccaagttacaggagcacccccgattttccaagtgggacgaattcttctcagagcagcagtccctcctcatctgctcccaatagccccgctgggagtggtcacatccggccaagcacactccacggactcgctcccaagctcggcgggcagagatatcgaagcggtagacgtaaatctgctgggaacatccctctctcgcccttggctcgaacaccttccccgaccccccagcccaccagccctcagcgcagcccaagccccttgctgggacatagccttggcaactcaaaaattgcccaggcgtttccttctaagatgcattcgccgcccactatcgtgaggcacatcgtacgcccaaaaagcgcagagcccccaaggagtcctctgctgaagagagtgcagtccgaggagaaactgtcgccctcatatgggtcagataaaaagcatttgtgcagcaggaagcactctctcgaagtaacccaggaagaagttcaaagggagcaaagtcagcgagaggcccctttgcagagtttggacgaaaatgtctgcgacgtgccgcccctgtcccgggcccgcccagtagaacagggctgcctgaaacgtccggtaagccgtaaggttggaagacaggaaagcgtcgacgacttggaccgcgataaattgaaggcaaaagtagtggtaaaaaaagccgacggctttcctgaaaagcaagagtcccaccagaagtcccatggaccaggatctgacctggagaactttgcgctgttcaaactcgaagaacgcgagaagaaagtttatccgaaagcggttgagcggtcctccaccttcgagaacaaggcttccatgcaagaggctcccccactgggatccctgctgaaggatgcactccacaaacaagctagtgtgagagcctcagagggtgcgatgtcagacgggcgtgtgccggccgaacaccggcagggcgggggtgactttaggagagctcctgccccaggcaccctgcaagatggactgtgtcactcgctggatagaggcatcagcgggaagggagagggcacagagaaaagcagtcaggccaaagagttgctgagatgtgaaaagctggacagcaagctggccaatattgattatctcagaaagaagatgtccctggaagacaaagaagataatctgtgtcccgtgctgaagcccaaaatgacagccggcagtcatgagtgcttacccggaaatcctgtgcgcccaacaggtggccagcaggagccaccacccgcctctgaatctcgagcatttgtgtccagtactcatgctgcccagatgagcgctgtgagctttgtccccctcaaggcattaaccggccgtgtggactcaggaaccgaaaagcccggcttggtagctcctgagagcccggtgaggaagagtccctccgagtataagctcgaaggccggagtgtgtcatgtcttaagccgatagagggcacacttgatatcgccctgctgtccggcccccaggcctccaaaacagaacttcctagtcccgaaagtgctcagagtccaagcccttccggtgacgtacgggcctccgtacccccggtcctgcccagctcttctgggaaaaagaacgacacaacatcagccagagagctttccccttcttcactgaaaatgaataagtcttacctgctggaaccgtggtttctcccaccatcacgcggtctgcagaactcgcccgccgtgagtctccccgacccagagtttaagagagacaggaaggggccgcatcccaccgctcgaagccccggtactgtaatggagagtaatcctcaacagcgtgaagggtcatcccctaaacatcaagaccacaccaccgatcccaaacttctgacctgcctgggacagaatctacactccccagatttagcacgaccacggtgcccactgccccctgaagcttccccctccagagagaaaccagggctccgtgaaagttcggaaaggggaccacccacagctcgatcagaacgctccgcggcaagggccgatacctgtcgagagcccagtatggagctctgctttccggagacagctaaaacatccgataatagtaaaaacctgttgtctgtgggcaggactcatcccgatttctatacacagactcaggcaatggagaaggcttgggcccccggggggaagaccaatcacaaagatggacccggagaggccagacccccacctagagacaatagttctctgcattctgcaggcataccctgcgagaaggagcttggcaaagtccgcaggggggtcgagcctaaacctgaggctctcctagcaaggcgatctctgcagcctcctgggattgaatccgagaagtcggaaaaacttagcagctttccctcacttcagaaagacggggctaaggagccagagaggaaggaacagccattgcagagacacccatccagtatcccccctccccctcttaccgccaaagacttatcctctcctgccgcccgacagcactgttctagcccgtcccacgcttccggtcgggagcccggagcaaaacccagtacagctgagccatctagcagtccccaggatccgccaaaacctgtggcagcacacagcgagtccagttcacataagcccagaccaggtccagaccctggcccacccaagaccaaacaccccgatcggtcattgtcaagccaaaaaccctcagtcggtgctacaaaagggaaggaacccgcaacacagtctttgggcggttcttcgagggagggcaaaggccatagcaaatcgggcccagacgtatttcccgctaccccaggctctcaaaacaaagccagtgacggaatcggccagggtgaagggggtcccagcgtgccactacacactgacagggctcctcttgacgccaaaccccagccaacctccggcggtcggcctctggaggtcctcgagaagccggtgcacctgcctagaccaggacaccctggcccaagcgagccagccgaccagaagctctcagcagttggagagaaacagacactttcccccaagcatccaaagcccagcactgtcaaggattgccctaccctgtgcaaacagaccgataaccggcagactgataagtcaccatctcagcccgctgcaaacaccgatagacgcgctgagggcaaaaaatgtaccgaggccttgtacgccccggccgaaggcgacaaactggaagccggcctgtcattcgtgcactcagagaatcgccttaagggagccgaacggcccgccgctggggtgggcaaaggattcccagaggcacggggtaagggcccaggcccccagaagccgccaactgaagccgacaagcccaatggcatgaagaggagccctagtgccactgggcagagttcctttaggtctacagccttacccgagaaatcgttgagctgcagtagctcatttcctgaaacgagagctggcgttcgcgaggccagcgctgcctcaagtgataccagctcagccaaggccgccggggggatgcttgaattaccagcccctagcaatcgcgatcaccgcaaagcccagccagccggagagggtaggacccacatgacaaagagcgacagcttgccttcctttagggtgtctaccttgccactggaatctcatcatccagacccaaacacaatgggcggcgcatcacaccgagaccgggcactttctgttactgctacggtgggtgaaacaaagggcaaagatcccgctcctgcacagccccccccagctcgaaaacagaacgtcgggcgggacgtgaccaagccatcccccgcccccaataccgaccggccaatctctttaagcaacgaaaaggactttgtggtacgacagcgccgtgggaaagaatctctgaggtcctcgccccacaagaaagcactttag

SEQ ID NO: 31282 - DNA, 753 bp, Artificial Sequence
  Description of Artificial Sequence: Synthetic coding sequence
atgggtgagaaggtatctgaagcgcccgaacctgtaccgcgaggatgttcagggcacggcagcaggacaccggcaagcgcactggtggcggcttccagccccggagcctccagcgcagagagttctagtggaagtgagacccttagcgaggaaggagagcctggaggattttcccgtgagcaccaacctcctccacccccccctctcggcggtacgcttggggcacgggcgccagccgcctgggctccagcttccgtcctgttggaacggggtgtgctggcgctgccgccaccgttgccagggggagccgtgccaccagccccacggggcagttccgcgagccaggaagagcaagacgaggagctggatcatattctgtcgcctcctccaatgccattcaggaaatgttccaatcctgatgtcgccagcgggcctggcaagagtctgaagtataaaagacaactaagcgaagacgggaggcagttacgccgaggcagcctggggggagccctgaccgggcgctacctgctgcccaaccctgtggccggtcaggcctggccagcaagcgcagagacaagtaatctcgtgcgtatgaggtctcaggccctaggtcagtcagccccttctttgacggcgagtctgaaggagctgtccctcccaagaagaggctccttgattgactcccaaaaatggaactgcctggtgaaaagaccggtctgcccaaatgcaggccggacatctccactcggctag

SEQ ID NO: 31283 - DNA, 2982 bp, Artificial Sequence
  Description of Artificial Sequence: Synthetic coding sequence
atggatatgtcagatcctaatttttggaccgtgcttagtaattttactctgccgcatctgcggtcagggaaccggttacgtcggacgcagagctgcaggacctcaaaccggaagtcgcttatcggaaacggccagagtccagccctccctcgaccccacagccctctgagtgcccacgctggtaatagtcctcaggatagtccaagaaacttcagcccaagtgccagcgcccactttagtttcgcacgacgcaccgacgggagacggtggtcactcgcctctctgccctccagtggctacggtactaatacacctagttctacggtctcttctagttgttcatctcaggaaaagttacaccaactgccatatcagcctacaccagacgagctccactttctcagtaaacacttctgcacaacagagagtatcgctacagaaaaccggtgccggaatacgcctatgcgtcccagatcaaggagtctgtccccggggcgatctccggcctgttgcgatcacgagataatcatgatgaaccacgtgtataaagaaaggtttccaaaggccacagctcaaatggaggaacgcttgaaagaaatcataacgtcatacagcccggataatgtgcttccgttagccgacggagtgctatcatttactcatcaccagatcatagaacttgcacgggactgcctggacaagtcccaccagggccttattacaagccgttacttcttagagctgcaacacaaattggataagttactgcaggaggctcacgacaggtccgagagcggagagctggcctttatcaaacagctggttcgcaaaattcttattgtgatcgctcggcccgccaggctactggaatgtctggagttcgatcccgaggagttctactacctcctggaagccgccgagggtcacgctaaggagggccaaggcattaagacagatataccgagatatatcatttcccagctcggcctgaataaggatccactggaggaaatggctcacctcggcaattatgatagcggtacagcagaaactccagagactgacgaatctgtatcctcctctaacgcgagtctgaaactccggcgcaaaccacgcgaaagcgactttgagacaataaagctgatttccaatggagcgtatggagctgtttatttcgtgcgacacaaagagtctcgacagagattcgcgatgaaaaaaataaacaagcaaaatctcatcctaagaaaccaaatccagcaagccttcgttgagcgcgacattctgacgttcgccgaaaatcccttcgtggtgtccatgtactgttcatttgagacgaggagacatctgtgtatggtgatggagtacgtggaaggcggggactgtgccacactgatgaagaatatgggaccacttcctgtggacatggcacgtatgtatttcgcagagacagttctggctctggaatacctccataattacggaattgtacaccgcgatttgaagcctgataatctcttggtcacctcaatggggcatattaagctgactgacttcggtctctcaaaggtgggcttgatgagtatgaccactaacctctatgagggtcacatcgagaaagatgccagagaattcctcgataaacaggtgtgcgggacaccagaatacatagcacccgaggtaatactgcggcaggggtatggaaaacccgtggactggtgggctatgggtattatcctttatgaattcctggtgggctgcgtgccattctttggcgatacacccgaagagctcttcggccaggtgatttctgatgagatcaactggcctgagaaggacgaggccccccctcctgacgctcaggacttgattactctgctcctaaggcaaaatcccctggagagactggggactggaggggcctatgaggtgaagcagcacaggtttttcaggtccctggactggaattcattactgagacagaaggccgagttcatcccccaacttgagtctgaggatgatactagctacttcgatactcggtccgagaagtaccatcacatggagaccgaggaggaagacgacaccaatgacgaggacttcaacgtcgagatacgccagttctcaagctgtagccaccggttcagcaaagtgttttcctctatcgacagaataacccagaatagtgccgaggagaaggaggacagcgtggataaaactaaatccacgaccctgcccagtacggaaactttgagctggtcctctgagtatagtgagatgcaacaactctccacttctaactcatccgataccgagtccaacagacacaagcttagttccgggctattgcccaaactcgcaatcagcactgagggcgagcaggatgaagcagcatcttgccctggggatcctcacgaagagcccggcaaaccagccctcccccccgaggaatgtgctcaggaagaacccgaggttacgacccccgcgagcactatctccagtagcacactgagtgacatgtttgcagtgtcgcccttgggtagccccatgtcaccccacagcctgtcgtccgatccatcgagttcccgggattctagccccagtagagactccagcgccgcttccgccagtcctcaccaaccaattgtgatccactcctcaggcaagaattacggatttactataagggctattcgagtgtatgtaggagactcagacatttacacagtacatcacatcgtttggaatgtggaggagggttcccccgcatgccaggccggccttaaggcaggggacttgatcacccatatcaacggagaacccgttcacggcctggtccacacggaagttattgagctgctcctgaaaagtggcaataaggtgagcattaccacaaccccctttgaaaacacttccatcaagaccggccccgcccggaggaactcctataagagtaggatggtccggcggtctaagaagagctag

SEQ ID NO: 31284 - DNA, 507 bp, Artificial Sequence
  Description of Artificial Sequence: Synthetic coding sequence
atggacatgtcagaccccaacttttggaccgtgcttagtaacttcacactgccccacctgagatctggcaatcggctccgtcgcactcagtcctgtcgcacgtctaaccgaaagagcttgatcggaaatgggcaaagtccagcgctcccaagaccacatagtcccctctctgcccatgccggtaactcaccacaagactcaccacgcaatttcagtccaagtgcctctgcacacttttccttcgcccgtaggaccgatggccggcgctggagccttgcatccttaccatcgtccgggtacggtacgaacaccccctcaagtacggtcagcagcagctgctcaagccaggagaaattgcatcagctcccttaccagcctactcctgacgagcttcacttcctctctaagcacttttgtaccacagaaagcatagctacggagaaccggtgtagaaacacaccaatgaggccgcggtcccggagtctttcgccgggccggagcccttag

SEQ ID NO: 31285 - DNA, 7872 bp, Artificial Sequence
  Description of Artificial Sequence: Synthetic coding sequence
atgggcgaaaaagtgtctgaagccccagaaccggtacctcggggatgttctggccatggctcaagaaccccggccagcgccttggtcgccgcctccagcccgggagcctccagtgctgaatccagctctggatcggagactctctcagaggagggtgaaccaggcggcttttctcgggaacaccagccacccccacccccccccctcggcggaacacttggcgccagggctcccgctgcttgggcacccgccagcgttctcctcgagcgtggtgtgcttgccctgcccccccccctccccggaggggcagtgcccccagcaccccgaggctcctctgctagtcaagaagaacaagatgaagagctcgatcatatcctttccccaccacctatgccgttcaggaagtgtagcaatccagacgtggcctccgggccagggaaatcgctgaagtataagcgccagctctcagaggacggacgccagctcaggagagggtcccttggcggcgccttaacgggtagatacctactccccaatcccgtggctgggcaggcctggcctgcaagtgctgagacctctaatttggtgaggatgcgatcgcaggcgcttggacaatccgccccaagtctcacagctagcttgaaggagctgtccctcccacgcagaggatcattctgtagaacctcgaatagaaaaagtctgataggaaacggccagtcccccgcactccctcgcccacactctcctctgtccgcccatgcggggaactcgccccaggattcacccagaaacttctcccccagcgcatctgctcacttcagcttcgcccgccggacggacggccggcggtggagcctggcatccctccccagttccggatacggaacaaatacaccctcctccactgtttcgtcctcttgctcatcacaggaaaaactacatcagttgccctaccagccaacaccagacgagttacacttcttatccaagcacttttgtaccaccgagagcatcgccaccgagaatagatgccgcaataccccaatgagaccaagaagccgatccttatcgcctgggcgtagtcctgcatgttgcgaccacgagatcattatgatgaaccatgtgtataaggaaaggttcccaaaggcgactgctcagatggaagaacggctgaaagagattatcaccagttatagtcctgacaacgtgctgccactcgctgatggcgttctttccttcacacatcaccagattatcgagctagcgagagattgcttagacaagagtcaccagggactgatcacatcaaggtacttcctcgaactccagcacaagttggataaactgctccaggaggctcatgataggtccgagtcaggtgagctggcattcatcaagcagctcgttagaaagatcttgatcgtaatcgccaggccagccaggctactcgaatgcctcgaatttgacccagaagaattctactacttactagaagccgccgagggccatgcaaaagagggccagggaatcaaaacggatatacctaggtacatcattagccagctcggcctgaataaggacccgctcgaagagatggcccatttggggaactacgactccggcaccgcggagactcctgaaacggatgaatccgtgtccagctccaatgccagtctgaagttaagacggaagccacgcgagtctgacttcgagaccataaaactgattagtaatggagcctacggagcagtctacttcgtccgccacaaggagagccgccagagattcgccatgaaaaaaatcaacaagcagaatcttatcttgcgaaatcagattcaacaggcatttgtggagagggatatactgacctttgctgaaaaccccttcgtggtgagtatgtactgttcatttgagacgcgcagacacctctgcatggtcatggagtacgttgagggcggagattgcgcaaccctgatgaagaacatgggaccgctgcccgtggacatggctagaatgtactttgcagagactgtgctggcgctggagtatctccacaactatgggatcgttcaccgggacttgaagcctgacaatctgttagttacctccatgggacatattaaattgactgattttgggctgagcaaggttggtcttatgtctatgacaacaaacttgtacgaaggccacatcgagaaagacgctcgggagtttctggacaagcaggtctgcggtacacccgaatacattgcgccagaagtcatcctgcgacaggggtatggcaaaccagtcgactggtgggcgatgggaattatcctgtatgaattcctggtagggtgtgtgcccttcttcggcgatacacctgaggagctgtttggacaggtaatttctgacgaaatcaattggcccgagaaagatgaagcaccgcctccagatgcccaggacctcattaccttattactccgccagaacccactcgagcgcttgggcaccgggggggcatatgaggtgaaacaacatcgattcttccgttcccttgactggaattccctccttcggcagaaagcagagttcattccccagctggaatctgaggacgatacgagctactttgacactaggtcagagaaatatcatcacatggagaccgaggaggaggacgacacaaatgatgaggactttaatgtagaaattcggcagttctcttcctgctcccatcgctttagcaaagtgtttagcagcatcgacaggatcacccaaaattctgcagaggaaaaagaggacagcgttgacaagaccaagtccactacattacccagtactgagaccctgtcctggagctctgaatattctgagatgcagcagctgtcaacaagcaacagcagcgacactgaatcgaatagacataaactcagcagcgggctgcttccaaagttggctatatctacagagggagagcaagacgaggccgcctcttgccctggggatccgcacgaggagcccggaaagcccgccctgccacctgaggagtgtgcccaagaggaaccagaagtcaccactcccgcatcaactatatcatctagtacgttgagcgtggggtctttttcggagcacctggatcagatcaacggacgtagtgaatgtgtagacagcacagacaattctagcaagcccagctctgaacctgcttcccatatggcacgccagcgccttgagagtactgagaagaaaaaaatctcaggaaaggtgaccaagagcctcagtgcttcggccttgagtttgatgatcccaggcgatatgtttgccgtctcccccctgggctctccaatgtcaccacacagtttgtcatcagacccatcttcgagccgggattcatcccccagtcgcgatagtagtgcagcctcagcatcgccgcaccagccaatagtcatccacagctctggcaaaaattatggatttacgatcagagccattcgcgtttacgtgggcgactctgacatctacaccgtgcatcacatcgtctggaatgtggaagagggatcccctgcctgccaggccgggctgaaggccggcgacctgatcacccacatcaacggggagcctgtgcatggccttgtgcatacggaagttatcgaacttttactgaaatctggaaacaaagtgtctatcacgaccacccccttcgaaaacactagcatcaaaactggccctgcacgacggaactcttataagtccaggatggtgcgtcgttctaaaaagtctaaaaaaaaagagagcttggaaaggcgccgatcactgtttaaaaagttagccaagcagccatcacccctcctgcatacctcccggtcatttagctgtctgaaccgctccctgtcctcgggcgagtctctgccgggctcaccaacccatagtctcagccctcggtcacctaccccttcttaccgttcaaccccagacttccccagtggtaccaacagtagccagagcagctcgcctagctcctccgcgcctaatagccctgccggttccggtcatatcaggccttccactctgcatgggttagccccgaagctcgggggacagcggtatagatccgggcgacggaagtctgctgggaatatcccccttagccccctcgcccggactcctagcccgacccctcagcctacttcaccacagagatcccccagcccattgctcggacattcccttggaaattcaaagatagctcaggcttttcctagtaaaatgcacagcccccctacgatagttcgccacatcgtccgccctaaaagtgctgagcctccccggtcacccttgctaaagagagtccagtctgaggagaaactgagcccatcctatggttcagacaaaaagcatctgtgcagtagaaagcactccctggaggtcactcaagaggaagtgcagcgcgagcagtcacagcgagaggctccattacagagtctggatgagaacgtgtgtgatgttcccccactgagccgagcccgccccgttgaacaggggtgtctgaagagacccgtgtcgcggaaggtggggaggcaggaatctgtggatgacctcgatagagacaaattaaaggcaaaggtggtagtcaaaaaggctgacggctttccagaaaagcaagagagccatcagaagtctcacgggcctggcagcgacctggagaatttcgccctctttaaacttgaggagcgcgagaaaaaggtgtacccaaaggccgtagaacggtcatccacatttgaaaacaaggcctctatgcaggaagcgcctcccctgggcagcctccttaaagatgctctgcataagcaagcttccgtccgcgcctcagagggcgcaatgtccgacgggagagtacccgcggagcaccgccaagggggaggggatttccggcgagcccctgctcccgggaccctgcaggacggcctgtgtcacagcctggaccgaggtatatcaggtaagggcgaaggaactgagaagagcagtcaggctaaggagctgcttcgctgcgagaaactggattctaagctggccaatatcgattacttgcgcaagaagatgtctctcgaggataaggaagacaatctttgtcctgtccttaagcctaaaatgactgccggatcgcatgaatgccttcctggcaatccagtgcgaccgaccgggggccagcaggaaccgccacccgcctccgagtctcgggcctttgtttcaagtacccacgccgcccaaatgtccgctgtgagcttcgtacctttgaaggcattgacagggagagtggactcgggcactgagaagcctggcctggtagctccggaatctcctgtccggaaaagcccatccgaatacaaactggagggccgctcagtaagctgtctcaaacctatcgagggcactctggatatagctctcctgagcggcccacaggctagtaaaaccgaattgccttctcctgagtcagcccagtccccaagcccatcgggagacgtccgggcatcagtgccccctgtgctgccttcaagctccgggaagaaaaatgacaccacttccgccagggaactgtcgccttccagcctgaagatgaacaaaagctacctccttgagccttggttccttccaccatctagggggcttcaaaattcccctgccgtctcccttcctgaccccgagtttaagagggatcggaaggggcctcaccctacagcaagatcgcccggcaccgtgatggagagtaacccccaacagagagaggggtcatcccccaagcatcaggatcacaccaccgacccaaagctgttaacatgcctgggtcagaatttgcattcacccgacctcgcccgtcctcgctgccctctgccccctgaggcttcccctagtagggaaaagccgggactccgagaaagcagcgagcgcggcccacccacagcccggtctgaacggtccgccgcccgagccgatacttgcagggagccctccatggaactgtgtttccccgagacggccaagaccagtgataactccaaaaatctgctctctgtcggtaggacccatcccgatttttatactcaaacacaggccatggaaaaggcttgggcccccggcgggaaaacgaaccataaagacggacctggagaagcacgccctcctcccagagacaatagctccctgcatagcgctggcatcccgtgtgagaaggaactcggaaaggtgaggaggggagtggaacccaagccggaggcgctgctggccagacgatcactgcagccaccaggcatcgagagtgaaaagtctgagaaactctcctcatttccctctctgcagaaagacggtgccaaggagcctgaacggaaagaacaaccgctgcagcgtcatccctctagcatccctccacctccgcttacagccaaagatctgagctcccccgcggctaggcaacattgctcaagcccaagccacgcaagtgggcgcgagcccggggctaagccatcaacggccgaacccagctccagtcctcaagacccacccaagccagtagctgcccatagtgagtccagcagccataaaccacgcccaggccctgaccctgggcccccaaagactaagcaccccgaccgcagtctctctagccagaagccctctgttggggcaacaaaggggaaagaacccgcaactcaatctctgggcggatcatctcgcgaagggaagggacactccaagtcaggcccagatgtctttccagcgactcctggctctcaaaataaagccagcgatgggataggccaaggggaagggggtcccagcgtgccgctgcataccgacagggcacctctagacgccaaaccccagccaacatcggggggccgaccgctcgaagtcctggaaaagcccgtgcatctgccacgacccggccatccggggcctagtgaaccggcagatcagaaactgtctgctgtaggagaaaagcagaccttgagccccaaacaccctaaaccttccacagtaaaggactgtcccaccctgtgtaaacagaccgacaacaggcagacagataagtccccctcgcagccagccgcaaataccgaccgacgcgcagaagggaaaaaatgcacagaggccctatatgcccctgcggaaggggataagctggaggctggactcagctttgtgcattcagaaaatagattgaagggcgccgagagacccgctgctggcgtgggcaaaggattcccagaagctcgaggaaagggtccaggtcctcaaaaaccccccaccgaggctgacaaacccaacggtatgaaacgctctccatctgctacgggccagtctagcttcaggtctacagccttacctgagaagagcctctcctgtagttctagttttcctgagactcgcgctggggtcagggaagcctctgcggcaagcagcgacacctcgtccgccaaggccgcgggtggaatgctggagttgcccgcccccagcaatcgggaccacagaaaggctcagccagcaggagaaggccgtacacatatgacaaagtccgactccctgccctcgtttcgcgttagcaccttgcctttagagtctcatcaccccgaccctaacacaatgggaggtgccagtcacagggaccgggcgctatccgtcacagccacagtgggggagacaaaaggtaaggaccccgcccccgctcaaccccctcctgctcgaaaacagaacgttggccgcgacgttaccaaacccagcccagctcccaacactgatcgccccatctccttgtccaatgagaaagacttcgtggttaggcaacggagaggcaaggagtctctgcgctcaagtcctcacaagaaggcgctgtag

SEQ ID NO: 31286 - DNA, 1152 bp, Artificial Sequence
  Description of Artificial Sequence: Synthetic coding sequence
atggccgaaccgcgtcaggaatttgaagtgatggaagatcatgccgggacatatggccttggggatagaaaggaccagggcggctatactatgcatcaggatcaggaaggcgacaccgacgctggactgaaggcggaagaggccggtattggtgacacaccttctctggaagatgaggctgcaggccacgtgacacaggcaagaatggtcagtaaatctaaggacggcacaggttccgacgacaaaaaagctaaaggggctgacggaaagactaagatcgcaaccccgcggggcgctgccccaccagggcagaaggggcaggctaacgccacccgcatccccgcaaaaactccgccagctcccaagaccccaccaagttccggagaacctcctaagtctggcgatcgttcaggctattcatctcctggttcccctgggacccctggtagccgttctcgtactccgagtctaccaacccccccaacaagagagcccaagaaggtcgcggtcgttcgcacgcctcctaagtcaccctcaagcgcgaaaagtaggctccagactgctcctgttccgatgcctgacttaaagaacgtgaaatcgaagatagggtcgaccgagaacctgaagcaccagccaggcggagggaaagtacagatcataaataagaaactagacctgtctaacgtgcaatccaagtgtggatccaaagacaacatcaagcacgttcctggcggtggatcagtgcagatcgtctacaaacccgtcgacctgtccaaggttacatcaaagtgtggatctcttggcaatatacaccacaaacccggaggcggtcaagttgaagtgaagtccgagaagcttgattttaaagatcgggtacagtcaaagatcggaagcctcgataatattacccacgtcccaggcgggggcaataaaaagatcgaaactcataagttgactttccgcgaaaatgcaaaggccaaaaccgatcacggggcagagatagtgtataagtctccagttgtttctggggacaccagccctaggcatctgtctaacgtgtcatcaaccggttctatcgatatggtggacagtcctcagctggctacccttgcagatgaagtctcagcctcactggctaaacagggcctctag

SEQ ID NO: 31287 - DNA, 1239 bp, Artificial Sequence
  Description of Artificial Sequence: Synthetic coding sequence
atggcagagccccgccaggagttcgaggtcatggaggaccacgccggtacatacgggctgggcgaccgcaaggatcagggcggctatacgatgcatcaagatcaggagggagacaccgatgccggactcaaagaatccccactccaaacgcctacagaggatggaagcgaggagccaggaagtgagacctcagacgctaaatcaacccccacagccgaggctgaggaggctgggatcggagatacacccagccttgaagacgaagctgcagggcatgtcacgcaagctcgcatggtgtctaagtccaaagatgggactggctcggacgataagaaagctaaaggagccgatggaaagacgaaaattgcgactcccagaggggcagcgccaccgggtcagaagggacaggctaatgccacgcggatacctgcaaaaaccccccctgctccaaaaactcctcccagctctggtgaacctcctaaatcaggcgatagaagcggatattcgtcccccggctcaccaggaacacccggatccaggtcgaggacaccctcgctgccaaccccaccaactcgcgaacccaagaaggtcgccgttgtccggaccccaccgaaatccccctcatctgccaaatccagacttcaaacagcgcccgtgcccatgcccgatctgaaaaacgtaaaatcaaaaatcggctctacggagaacctcaaacaccagccaggaggcggcaaggtccagatcatcaacaagaaactggacctgtccaatgtccagtccaaatgcggttcaaaggataacatcaagcatgtaccagggggcggaagtgtccagatcgtgtataagcccgtagatctgtcaaaggtaacgagcaagtgcggttccctggggaatatccaccacaaaccaggcggcggccaggtcgaagtgaagtccgagaaactggactttaaagacagagtgcagagcaaaatcggatcactggacaatatcacgcacgtgccggggggcggtaacaagaagatagagactcacaagctgaccttcagggagaatgcaaaggccaagactgaccacggtgcggagattgtatacaagagtccagtcgtgagtggcgacaccagccctagacacctcagcaacgtgagcagcactggcagcatagatatggtggattcaccccaattagcaacgttggccgatgaagtgtccgcaagcctggccaaacagggcttatag

SEQ ID NO: 31288 - DNA, 1326 bp, Artificial Sequence
  Description of Artificial Sequence: Synthetic coding sequence
atggcagagccccgccaggaattcgaagtgatggaagaccatgctggtacctacggattaggcgacaggaaggatcaaggtggttacacgatgcatcaagaccaagagggggatacagacgctggactcaaagaaagtcccctgcagacaccaacggaggatggcagcgaggagcccggtagcgagacgtctgatgcaaagagtacaccaactgccgaggacgtgaccgcgccgctggtcgacgagggggctcctgggaagcaggccgccgcccagcctcatactgagattccggagggaacaaccgcagaagaggctggtatcggagatacgccatccctcgaggacgaggcagcaggccatgttacgcaggctcgaatggtttccaagagcaaagatggcacagggtccgacgataaaaaggcaaaaggggcagatggtaaaacaaaaatcgctacccccagaggcgcagcacctcccggtcagaaggggcaggcgaatgccactagaatccctgccaagactcccccggccccgaaaacaccgcccagcagtggagaaccacccaaaagcggagatcgatccggctacagttcccccggctcacctggaacaccgggatcccggtcacggaccccaagtctgccgactcccccgacccgggagcctaagaaagtggctgtggtgcgaacccccccaaaatccccatctagcgcaaagtcgcgcctccagacagcgcccgtcccaatgcctgatctgaagaatgtgaagtctaaaataggaagcacagaaaatctgaagcaccagccaggagggggtaaggtgcaaatcataaataaaaaactggatctgtccaatgtccaaagtaagtgcggtagcaaggacaacattaaacatgtgccgggtgggggcagcgtccagattgtgtataaaccagttgacctgagcaaggttaccagcaagtgtggaagcttggggaatatccatcacaaacccgggggtggccaggtggaagtcaagagtgagaaactggacttcaaggatcgcgtccagagtaaaatcggaagcttagataatattacacacgtccccggcggcgggaacaaaaagattgagactcacaagttaacattccgagagaatgccaaggccaaaactgaccatggggccgaaattgtctacaagagtccggttgtctctggcgatacctcaccacgacacctgagtaatgtgtcttctactggaagcattgacatggtcgattcaccccaactggccacactcgcggatgaggtttcagcaagcctcgctaagcagggtctgtag

SEQ ID NO: 31289 - DNA, 795 bp, Artificial Sequence
  Description of Artificial Sequence: Synthetic coding sequence
acacgtgaggctgaaggggccgacggcaagacaaagatcgcgacacctaagggtcaagccaacgccacacggatccccgctaagactccgcctgctcccaaaacacccccatccagcggcgagcccccaaaatctggggacaggtcgggctattcaagcccaggatcaccaggaacaccgggctcccgatcacgcacgccctcgctgccgacccctcctacaagggagcctaagaaggtggcggtagtgaggacgcctccaaagtctccaagctcggctaaatccaggctacagacagccccagtacccatgcccgatttgaagaacgtgaaatctaagataggcagcaccgagaatctgaaacaccagccaggcggaggtaaggtccaaatcgtatacaagccggtggatctctctaaagtgacctctaagtgtggttccctcggaaacatccaccacaaacccggaggcggtcaagtagaagtgaagtctgagaagcttgattttaaggatcgcgtgcaaagcaagatcggctcccttgacaacataacccacgtgccaggcggaggtaataagaagattgaaacccataaacttaccttcagggagaacgccaaagcaaagaccgaccacggcgccgaaatcgtgtataagagcccagtcgtgagtggcgacacctctcccagacacctctcaaacgtttcatctacaggttcgatcgacatggtggattcaccccagctcgctacacttgccgacgaagtctctgcgagcttagctaagcaaggcctgtag

SEQ ID NO: 31290 - DNA, 651 bp, Artificial Sequence
  Description of Artificial Sequence: Synthetic coding sequence
atggcggagccccggcaggaattcgaagtaatggaggaccacgccggcacctatggtctgggggatcgcaaggatcagcgggaacccaaaaaggtggccgtggtgcggaccccccccaagtctccatcttctgccaagtccagactccagactgctccggtacccatgcctgacctgaaaaacgtgaaatccaaaattgggtctacggagaaccttaagcatcaacctgggggcggaaaggtccagatagtttacaagcccgtggatctgtccaaagtgaccagcaagtgcggatccttggggaacatccaccataagccaggagggggccaagtggaggtgaagtccgagaaactcgatttcaaggatagagtgcagagcaagattgggagcctggacaatataacccatgtgccagggggagggaataaaaagatcgagactcataagttaactttccgcgaaaatgcaaaggccaagacagaccacggcgcagagatcgtctacaaatccccagttgtgagcggcgacaccagccctcgacacttgtccaatgtctcctcgaccggcagcattgacatggtggacagtccacagctcgccacgcttgctgacgaggttagtgccagcctggccaaacaaggtctctag

SEQ ID NO: 31291 - DNA, 1152 bp, Artificial Sequence
  Description of Artificial Sequence: Synthetic coding sequence
atggccgagccacgacaggaattcgaggtgatggaggatcatgctggaacctacggccttggtgatagaaaggatcaaggtgggtacaccatgcaccaagaccaggagggcgacacagatgcgggactaaaagctgaggaggctggtatcggcgataccccctctttagaggacgaggccgcaggccacgtcacacaggcgaggatggtaagcaagagtaaagatgggacaggctcagacgacaagaaggcgaagggggcagacggtaaaacaaagatagctacaccaaggggcgccgctccccctggacagaagggccaggcgaatgccaccagaattcctgccaagaccccacctgccccgaagacacctccatcttcgggtgaaccgcccaagagtggtgatcgatctggctactcatctcccgggtccccaggcacacccggtagcagatccagaaccccatccctacctacaccccccacccgtgaacccaagaaggtggcggtcgtgaggacgccacctaagagcccctcatcagcgaagtcaaggctgcagacggcccccgtgcccatgccggacctcaagaacgtcaaaagcaaaatcggaagcacggagaatctcaagcatcagcctggcggaggaaaggtgcaaattattaataagaaactggatctgtcaaacgtgcagtctaagtgtgggagtaaagataacatcaagcacgtaccggggggaggaagcgtgcaaattgtctataaacccgtggacttgtccaaggttacttctaaatgcggcagccttggcaacatacatcacaaaccaggggggggccaggtcgaagtaaagagtgagaagctggacttcaaggaccgagtccagtctaagatagggtctctcgacaacattacgcatgtgccaggcggaggcaacaaaaaaatagaaacacacaaactcacctttcgcgaaaatgccaaagcaaaaaccgatcacggcgccgaaatcgtgtataagtcaccagtcgtgagcggcgataccagtccgagacacctgtctaacgttagttctaccggcagcatcgatatggtcgactcccctcagctggcgactctcgccgacgaggtgtccgcatctcttgccaagcagggattgtag

SEQ ID NO: 31292 - DNA, 951 bp, Artificial Sequence
  Description of Artificial Sequence: Synthetic coding sequence
atgcttagggccctgcaacagcgcaagcgcgaggcaggaataggcgataccccgagccttgaagatgaggcggccgggcatgtgacccaagccaggatggtctctaaaagtaaggatggcactggctcagacgacaaaaaggctaagggcgccgacgggaaaaccaaaatagccaccccacggggggctgctccccctggccagaaaggccaggcgaatgcgacacgcattcctgctaaaactccacctgctccgaaaacgccgccatcatcaggggagcccccaaagagtggcgaccggagcgggtattcttccccagggtcccccggcactcccggatcccgttcccgaacccctagcctaccaactcctcctacaagggaaccaaagaaggtagcagtagtgcggactccgccaaaatcaccctcctccgccaaatctcggctgcaaaccgctccagtacctatgcctgacctcaaaaacgtcaaatcaaaaatcgggagcacagagaatctgaaacaccaaccaggcggtgggaaagtccaaatcgtttacaaacctgtagatctgtcaaaggttacctccaaatgcggttcactgggaaatatccaccataagcccggaggtggtcaggttgaagtgaagtctgagaaactggattttaaggatcgcgttcaatcaaagatcggaagtctggacaatattactcacgtaccagggggaggcaataaaaagatcgaaacacacaaactgacattcagagagaacgccaaagctaaaactgatcatggcgccgaaatagtatacaagtccccagtcgtgagcggggacacttctcctaggcacctgagcaatgtgtccagcaccggatccatcgacatggtagattccccccaactcgcaaccctagccgacgaggtaagcgccagcctggcaaaacaaggactgtag

SEQ ID NO: 31293 - DNA, 2277 bp, Artificial Sequence
  Description of Artificial Sequence: Synthetic coding sequence
atggccgagccacgccaggaatttgaagtgatggaagaccacgctggcacctatggtctgggcgacagaaaagatcagggcggatatacaatgcaccaagaccaagaaggggacaccgacgctgggcttaaggagagtcctctgcaaacacccaccgaagacggaagtgaagaaccaggcagcgagacaagcgacgcaaaatcgacgcccaccgctgaggacgtcacagcccccctggtggacgaaggtgccccagggaaacaggctgccgcacaacctcatacggaaattccggaaggaacaactgccgaggaggcgggcattggcgatacaccgtctctcgaggacgaggctgctggccatgtcacccaggagccagagtccggcaaggtggtgcaggagggttttctcagagagcccggaccgcctggactctcacaccagttgatgtctggcatgcctggggctccactactgcccgaagggccgagagaggctaccagacagcctagcgggacaggtccagaggacactgaaggaggcagacacgctccagagctgcttaaacaccagctgctgggagatttgcatcaggaggggccattgctgaagggggctggaggaaaagagcggcccgggagcaaagaggaggtcgatgaagaccgtgacgtggacgaaagctcgccacaggattcccccccaagcaaggcttccccagcccaggatggacgaccaccccagactgctgcacgcgaagcgaccagcataccaggattccctgcagaaggcgccattcccctccctgtcgattttctatctaaggtatccacagagatacctgcctcagagcctaatgggccatccgcaggacgagcaaagggccaggacgcaccattggagtttactttccacgtcgaaattacacctaatgttcagaaggagcaagcgcactctgaagaacaccttggacgggccgcttttccaggtgcaccaggggaaggtccggaggccagagggccatcactgggcgaggataccaaggaagcagacctgcccgagccctccgaaaagcaacccgctgcagctccaagaggaaaaccagtgagttgggtcccgcagcttaaagcaaggatggtgtcaaaatcaaaagacggtactggcagcgatgacaaaaaagcaaagacctccacacggagctctgccaaaactctgaagaacaggccttgtttgagtccaaagcaccccacgcccggcagcagcgatcctctgatacagcccagctcacccgccgtgtgtccagaacccccgtcgagtccaaagtatgtcagtagtgtgacgccaaggaccggtagtagcggggccaaagaaatgaagcttaagggcgccgatggtaaaaccaagatagcaaccccaaggggcgcggcgccgcccggccagaaaggccaagccaatgctacccggattcctgctaaaaccccacccgccccaaaaacccctccctccagtggagagccccccaagtcaggtgaccgatccggatatagttcacctggcagccctggcactccaggtagtaggagcaggactccttccctcccgactccccctacccgggagcctaagaaagttgctgtggtgcgaactccacccaaatctcccagctccgctaaaagcaggctgcagaccgcaccggtgcccatgccagacctgaaaaacgtgaaatctaagatcggtagcaccgaaaatctaaagcaccagcctggtggcgggaaagtgcagatcatcaacaaaaagttggacctttcaaacgttcaatccaaatgtggctcaaaggataatataaagcacgtgcccgggggcgggtcagtgcaaattgtgtacaaaccagttgatctgtctaaagttacatctaaatgtggttctttaggcaacatccaccataaaccaggcgggggacaagttgaggtcaaaagcgagaagctcgactttaaagacagagtccaatccaaaattggctctctggataacattacccacgtcccggggggcggtaacaagaagatcgagacccataaactcacctttcgcgaaaacgcgaaggctaagacagatcacggcgcagagatcgtgtataagagccctgtcgtctccggagacactagccccagacatttgagcaacgtgagctccacaggctctattgacatggtcgactccccacaactggccacactggccgacgaggtcagtgcaagccttgccaaacaaggcctttag

SEQ ID NO: 31294 - DNA, 2331 bp, Artificial Sequence
  Description of Artificial Sequence: Synthetic coding sequence
atggcggagccgcgacaggaattcgaagtaatggaggaccatgccggcacttacggactaggagaccgcaaagaccaaggcggttacactatgcaccaggatcaggaaggggataccgatgcaggcctgaaagaaagccccctccagacccctaccgaagatgggagcgaagagcccgggtcagagaccagtgatgccaagagcacccctacagccgaggatgtcactgcacccttggtggacgagggggctcccggcaagcaggctgcagctcagccccacacagagatccctgagggcaccaccgccgaggaggcaggaattggggacactcctagtcttgaagacgaagctgccgggcatgtgacacaggaaccagagtccggcaaagtggtccaggagggatttctccgagagccagggccccccggccttagccaccagttgatgtccggcatgccaggagctcctctgctgcccgagggcccccgcgaggcaacccggcaaccatctggcactgggcctgaggacacagagggcggaaggcacgcaccagagctcctcaaacatcagctgcttggggacttgcaccaggaaggaccgttgcttaagggcgccgggggaaaggagcggcccggcagcaaagaagaggttgacgaagatcgtgatgtcgatgagtccagcccccaagactctcccccttctaaagcgtcacccgctcaagacggccgcccacctcagaccgccgctcgggaggccactagcattccaggatttcctgccgaaggagcaatccctctgcccgttgacttcttgtccaaggtctcaactgagatcccagcttccgagccgaacggtcctagcgcaggccgggccaaggggcaagacgcaccccttgaatttacattccatgttgagataaccccgaatgtccagaaggagcaagcacactcagaagagcatttggggcgcgccgcttttccgggtgctcccggggaggggcccgaagcacgtggcccgagcctgggggaagataccaaggaagcagacctcccagagccatccgagaaacagccggctgcggcgccacgcggtaagccggtgtcgtgggtccctcaactgaaggctcgaatggtgagtaagagtaaagacgggaccggctccgacgataagaaggccaagacttccactcggtcttcggccaaaacgctcaagaatcgcccttgcctcagtccgaagcatccaactcctggaagctccgatccattgatccagcccagctcccctgctgtgtgtccggagcctccctcctcacccaaatacgtgtctagtgttacccctagaaccggcagctccggtgcaaaagagatgaagctgaaaggggccgacggcaagactaaaattgccacacctaggggggccgctccgccaggacagaagggacaggctaatgccacaaggatcccagccaaaacaccccctgcccctaagaccccgcctagcagtgcaaccaagcaggtgcaacgccgcccaccccccgcaggtccccgcagcgagagaggagagcccccaaaatcaggcgaccgcagcggatactcatcaccaggaagccctgggacccccggctcacggtcaaggactccaagccttcccaccccccctacccgcgagccaaaaaaggttgcggtggtgcgaactccccccaagagcccctccagtgctaagtcaagacttcagaccgcccctgttcctatgcctgacctcaagaacgtaaaatccaagataggaagcacagagaatctgaagcatcaaccaggcgggggaaaggtgcaaataatcaataaaaagctggacttgagtaatgttcagagcaagtgcggatcaaaggataatatcaaacatgtgcccggaggcggatccgttcaaattgtgtataaaccagttgacttgtcaaaggtcacctcaaagtgcggcagtcttggaaacatccatcacaaacccggaggtgggcaggttgaggtaaaatcggagaagctggatttcaaggatagagtgcaaagtaagatcggatccctggataacatcactcatgtgccagggggcgggaataagaagatcgagactcacaaactgacattccgagaaaacgcaaaagcgaagactgaccatggcgcagagatcgtgtataagtcccccgtcgtgagcggcgatactagcccgcgccacctatccaatgtgtcaagtaccggctcgatagatatggtggatagcccccagctcgctacacttgccgacgaggtgagcgcctctctcgctaagcagggcctgtag

SEQ ID NO: 31295 - DNA, 1233 bp, Artificial Sequence
  Description of Artificial Sequence: Synthetic coding sequence
atggctgaaccaaggcaggagttcgaggtgatggaggatcacgcgggaacttatggcctaggcgacaggaaagatcagggtggatatactatgcaccaggatcaggaaggcgacactgacgctgggttaaaagagtccccactgcagacacctacagaggacggatccgaggaacctggttctgaaaccagcgatgccaagagcactcccactgccgaggacgttaccgcacctctcgtggacgaaggtgcccctggcaaacaagctgccgcacagccccatactgaaattcccgaggggaccactgccgaagaagccggcatcggggataccccctcgctcgaggacgaagctgctggacatgttacccaggctcgtatggtgtccaaaagtaaggatggcacaggatcggatgacaaaaaggccaaaggcgcagacgggaagactaagattgccacgccacgcggagccgcaccccctggccagaagggacaggctaacgctacacgaattcccgctaaaactcctcctgcgcccaaaacaccaccgagttcaggcgagccacctaaatccggggacaggagtggatactcctctccaggttcgcccggtacgccaggaagccgatcaaggactccaagcctgccaacacccccaacccgcgaaccaaagaaggtggccgtggtcagaacacccccaaagtctccttcatctgcaaagtcgagattgcagaccgcaccagtgccaatgccggacctgaaaaatgtcaagagtaaaattggcagcacagagaatctgaagcatcaacccggcggtggtaaagtgcaaatcgtgtataaacccgtggatctgagtaaagtgacatctaaatgcggcagcttggggaatattcaccacaagcccgggggaggccaggtggaggttaagtccgagaagttggactttaaagatcgagtccagagcaagattggatccctcgataatattacacacgtgccaggaggcgggaataagaagatagagacacacaaactcacgttcagagagaatgcaaaagctaaaactgaccacggcgctgaaatagtttacaaatctcccgtggtgtccggtgacacctcaccgcggcacctttccaacgtgtcatctaccgggtccattgatatggttgactcgccgcagctggccacactagctgatgaagtctccgccagcctggctaaacaggggttatag

SEQ ID NO: 31296 - DNA, 1167 bp, Artificial Sequence
  Description of Artificial Sequence: Synthetic coding sequence
atggtggaggctgaggagctggcccaattaaggctgctaaatctggaacttctgcgccagctgtgggtcggacaggacgccgtgagacgctctgtggccagggcggcctctgagtccagcctggagagttccagttcttataatagcgagaccccaagtaccccagagaccagctcaacttcgcttagtaccagctgcccccgaggccgctcttctgtctggggtcctcccgacgcatgcagaggggatctccgtgacgttgctcgctctggcgtggcatcactgccccccgcaaagtgccaacaccaggaaagcctcggtcgccccaggcctcactccgccccatccctgggcacatcatccctgcgcgaccctgaaccaagcggcaggctgggggatcccggtccccaggaagcacagactccccgaagcattctggcccagcagtcaaagctgtccaagcctcgtgtgacattcagtgaagagagcgcagtgcccaaaaggtcctggaggcttagaccctacctgggctatgactggattgcaggctccctggacacatcatccagcatcacatcacagccggaagcctttttttctaagttacaggaatttagagagacaaataaggaagagtgcatctgcagccacccagagccacagctacctggacttcgcgagagcagcggttcgggggtcgaggaggaccacgagtgcgtgtactgttaccgcgtcaaccggcgactattcccagtgccagtagacccaggaaccccgtgtcgcctttgtcgcacgccccgagatcagcagggccctggtacgttggcacagcccgctcacgtaagggtgtctatacctctgtcgatcctggagccgccgcaccggtatcacatacaccggagaaagtcctttgacgccagcgacaccctcgccctgcctcgtcactgcctcctcggatgggacatctttccccctaaaagcgaaaaaagctctgctccaagaaacctggacttgtggtctagcgtgagcgcagaagcacagcatcagaagctgtccggcacttcttctcctttccatcccgccagtccaatgcagatgcttccgcctaccccaacttggagcgtgccgcaggtgccacggccccatgtcccgcgccagaagccctag

SEQ ID NO: 31297 - DNA, 1077 bp, Artificial Sequence
  Description of Artificial Sequence: Synthetic coding sequence
atggtagaagcagaggaattggcacaactgcggttgctgaacctggagttactgcgtcaactctgggtcggtcaggacgcagtccgtcgaagcgtggcccgggccgcgtcagagagtagtcttgagagttcctcatcgtacaactccgagactcccagtactccagagacgtctagtacatccttgtctacaagctgccctcgcggaagatcctcagtgtggggaccaccggatgcttgtcgaggcgatcttagggacgtggcaaggtctggcgtcgccagtctgcccccggccaagtgccagcatcaggagagcttaggcaggcctcgtcctcacagtgcgccctctctcgggacctcttctttgcgcgacccagagccatcaggcagactgggagaccctggcccccaagaggctcaaacccctcgcagcatcctggctcagcaaagcaagctgtcgaagccccgcgtgaccttcagcgaagagagcgctgtgccaaagcgctcatggcgcctccgtccctacttgggttacgactggattgccgggtccctggacacttctagcagcattacttctcaacctgaggcattcttttccaaactgcaggaatttcgcgagaccaacaaggaagagtgcatctgtagccaccccgagccgcagcttcctggactgagagagagcagcggaagcggtgtagaggaagatcatgaatgtgtgtattgctacagggttaatcgacggctgttcccagtcccagtcgacccggggactccctgtcgcctctgcaggacacctcgtgatcaacaaggtccgggtacacttgcacagccggctcatgtcagcacggcctgttgggcagggaccttttttctcaggagtctcagaaaggcccagccgcccggtacgtggacatccggccctcttagccccctcagaccctcaacaaggtcctgtccagctcccgcagctctcttcacccgccctcaccagtgtcgctgctgcccacgaccacgccccgggcagtgtcctaggtcactcgggccgaccagccacgggcggagcccagaggattag

SEQ ID NO: 31298 - DNA, 2070 bp, Artificial Sequence
  Description of Artificial Sequence: Synthetic coding sequence
tcctctggtctaacagtgactgctgttaaggatagcggcgaatggaatttagaagctggggcattggtgctggccgacgctggcctgtgctgtattgacgagttcaacagccttaaggagcatgatagaacatcgattcacgaagcgatggagcaacagaccatctccgttgccaaagcggggctcgtttgtaagctgaacaccaggaccaccattctcgccgctaccaacccgaaggggcaatatgacccccaggagagcgtgtcagttaatattgccctgggtagccctctcctttcacgtttcgatctcatcttagtgttgctcgacaccaaaaacgaggattgggataggatcatttctagcttcattttagagaacaaaggataccctagtaagtctgagaaattgtggagtatggaaaagatgaagacatatttttgtctgattcggaatctccagcccacactctcggacgttggtaatcaggttctgctgcgctattaccagatgcagcgccagtcggattgtagaaacgctgcaagaacaactatccggctactggaatctctcataaggctggcggaggcccatgcacgtctcatgtttcgagacaccgttactttggaagacgctattaccgttgtgtcagtcatggagtcatcaatgcaaggcggagctcttttggggggggtcaatgctcttcatacttcgttccccgaaaatcccggtgaacagtatcagaggcagtgtgagcttatcctggagaaactggaactgcagtcgcttctgagcgaagaacttcgcagactggagagactgcaaaatcaatcggtgcaccagagtcagcccagggttctggaggtggagacaacaccgggctctcttcggaacggtcctggagaagagtctaatttccggacttcttcccagcaggaaattaactacagcactcacatctttagtcctggaggaagtcccgagggtagccccgtgctggatccgcccccccaccttgagcccaacaggtctaccagtcggaagcacagcgcacagcataaaaataatcgggatgattccctggattggtttgactttatggccacacaccagtcggagcctaaaaacacagtggtggtttcccctcacccaaaaacttccggcgaaaacatggcctctaagatctccaactccacgagccaaggcaaggagaagagcgagcccggccaacggtccaaagtggatattggcttactccccagtccaggagaaaccggtgtgccctggcgagccgacaacgtggagtcaaataagaagaagcgacttgccctggacagcgaggccgccgtgagcgccgataagcctgattctgttctgacgcaccacgttcctaggaacctgcaaaagttatgcaaggagcgagcccagaagctctgcagaaattcaacgcgggtacccgcacagtgtaccgtcccttcacatccccaatctactcccgttcatagccctgatcggatgttagacagtcccaagcggaagcggccaaaaagtcttgcgcaagtcgaggagcctgctatcgagaatgtgaaaccccctggatcccccgtcgcgaaactcgctaagttcacattcaagcagaagagcaaactgatccatagtttcgaagaccacagtcatgttagcccaggagccaccaaaattgcagtgcatagccctaagattagtcagaggagaactcgcagggatgccgcgctccccgtgaagaggcctggtaagctcaccagcactcctgggaaccagatatcaagccagccgcagggagagaccaaggaggtgagccagcagccacccgagaaacatggtccgcgtgagaaggtaatgtgtgcaccagagaaaaggataatccagccggagctggagctgggcaacgagacgggatgcgcccacctgacgtgtgaaggcgataagaaagaagaggtgagtggatctaacaagtctggaaaagtgcatgcctgcacactggcaagactcgctaacttctgcttcacacctcccagtgaaagtaagtag

SEQ ID NO: 31299 - DNA, 1176 bp, Artificial Sequence
  Description of Artificial Sequence: Synthetic coding sequence
atgaacagcgatcaggtgactctggtgggacaggtcttcgagtcatacgtcagcgagtatcataaaaacgacattctgttgatattaaaagaacgcgacgaggacgcccattaccccgtagtggttaacgccatgacgctcttcgagacaaatatggaaatcggcgaatattttaatatgttcccgtctgaggtcctgactattttcgacagtgccctgcgcagaagtgccttgaccatcctgcagtccctgagccagcccgaggcagtctctatgaagcagaacctgcatgccaggattagcggcttgcctgtctgccctgaattagtccgggaacacatccccaagacaaaagacgtgggccactttctcagcgtgacagggacggttataaggacctccctcgtgaaggtcctggagttcgaaagagattacatgtgcaacaagtgcaagcatgtcttcgtgattaaggctgacttcgagcagtactacacattttgtcgccctagcagctgtccttcccttgagagctgcgatagctccaaatttacttgcttgagtggactgagtagtagtccgactagatgcagagattaccaggagattaagattcaggaacaggtccagcgcctatccgttggaagcatcccaagaagtatgaaagttattttagaagacgacctagtggactcctgtaagagtggagatgatctaaccatctacggtatcgtcatgcaaagatggaagccattccagcaggacgtccggtgcgaggtggaaatagtcctgaaagctaactatattcaggtcaacaacgaacagagttcaggcatcattatggatgaggaggtgcagaaggagttcgaggacttttgggagtactataaatctgatccattcgccgggaggaacgttattctggctagcctgtgcccacaggtgtttggtatgtatctagtcaaactggccgtggccatggtgctcgccggcgggattcagagaacagacgccacaggcacccgagttcgaggcgaatctcatcttcttttagttggagacccagggacaggaaagtcccagttcctgaaatacgctgccaagatcacgcctcgttcagttctgaccacaggcatcgggtccacctccgccgggattgtttgcgacaatttcaaatag

SEQ ID NO: 31300 - DNA, 3432 bp, Artificial Sequence
  Description of Artificial Sequence: Synthetic coding sequence
atgaacagcgatcaggtgacccttgtaggacaggtattcgaatcttacgtatcagaatatcacaagaatgacatccttttgatcttaaaagagcgggacgaggatgctcactatcctgtggtggtgaacgccatgacactcttcgaaacaaacatggaaatcggagagtatttcaacatgtttccatccgaggtgctgactatcttcgattctgcacttcgtcggtcagcactgaccatcttgcaatctctcagccagcctgaggccgtgagtatgaagcagaacctacacgcccgcatcagcggcttacccgtgtgtcctgagcttgtacgggagcatattccaaagaccaaggacgtaggccacttcctgagtgtgacaggaacggtgatccgaactagtctggtgaaggttctcgagtttgaaagggattatatgtgcaacaagtgcaagcacgtcttcgtgatcaaagccgattttgaacagtactacaccttctgtcggccttcctcctgcccttcattagagtcttgtgacagcagcaaatttacttgcctgagcgggctctctagttcgccaacacgatgtcgggactatcaagaaattaagattcaggaacaggtgcagcggctgtccgtcgggagcattccacgatctatgaaggtgatcctggaagatgatctggtggattcctgcaaatcgggcgacgacctcactatctacggaatagtgatgcagcgctggaaaccatttcagcaggacgtgcgttgtgaggtcgagattgtgcttaaagcgaactacatccaggtaaacaatgagcagtcatccggaataattatggacgaagaagttcaaaaggagtttgaggacttctgggaatactataaaagcgacccctttgcggggcggaacgtgatccttgcttctttatgcccccaggtgttcggaatgtacctggtgaagctggctgttgctatggtgcttgctggcggaatccagcggaccgatgctaccggcacccgtgtgagaggcgagtctcacctgctgctggtcggcgatcccgggactgggaagagccagttccttaagtacgctgccaaaattacacctcgcagcgttctgactaccgggattgggagtacttctgctggcctcactgtaactgccgttaaggattcaggcgagtggaatttggaggctggcgcgcttgtgcttgccgatgctgggctttgctgtattgatgagtttaactccctcaaagagcatgataggacctcaatccacgaggcaatggagcagcaaactatttctgtagccaaggcgggccttgtgtgcaaactgaacacacgcaccaccatactggctgccaccaaccccaagggacaatacgacccccaagaaagcgttagtgtcaatattgctctcgggagccccctcctatctcgatttgaccttatcctcgtgctgctggataccaagaatgaagactgggacaggatcatctctagcttcatcctggaaaacaagggctatcctagcaagtccgaaaaactatggtcaatggagaagatgaaaacgtatttttgtttaattcggaacctgcaacctacgctcagcgacgtcggcaatcaggtgctgctgagatactaccagatgcaacgacaatctgactgccgtaacgcggcccgaactactattcggctgttggagtccctcattaggctggccgaagcacacgcgaggctgatgttcagagacaccgtgaccctagaagacgccattactgtagtgtcggtgatggagagcagcatgcagggtggcgccctgctgggaggagtaaatgccctccatacgtctttccccgagaatccaggcgaacagtaccagagacagtgtgagctcatcctggagaagctggagcttcagtctctgttatctgaggagttaagacgattggagcgattgcagaaccagagtgtccatcagtcccagccgcgcgtgctggaggtggagacaactccaggctcccttaggaacggcccaggcgaggaaagtaactttagaacatccagtcagcaggagattaactacagcactcatatcttttctccggggggcagcccggaggggtccccggtgttggatccgccaccccaccttgaaccaaaccgaagcacttctaggaagcactctgcgcagcataagaacaacagagacgactcactggactggttcgatttcatggccactcaccagtcagaaccgaagaacacggtggtcgtgtcccctcatcctaaaaccagcggcgagaacatggcgagcaaaatctcaaactcgactagccagggtaaggaaaaaagcgagcctggccagagaagcaaggttgatatcgggctcctgccatcaccaggagaaacaggcgtgccttggcgtgccgacaacgttgagagcaacaaaaaaaaaaggctagcactcgacagcgaagccgctgtaagcgctgataaacctgattccgtcttgacacaccacgtacccaggaacctgcaaaagttgtgcaaagaacgtgctcagaagctgtgcaggaactctacccgcgtgcctgcacagtgcacagtgcctagccatccacaatctacgcccgtgcattctccagataggatgttggacagtcccaagagaaagagacctaagtcacttgcccaggtggaagagccagctattgagaatgtaaagcctcctgggtcaccagtcgctaaactagccaagtttacctttaaacagaagtccaaattgatccatagcttcgaggaccatagccacgtgtcccctggggccaccaaaatcgcggttcatagcccgaagatctctcagcgtcggactaggcgagatgccgcactccctgtcaaacgcccaggtaagctcacttcaacccctggaaaccaaataagcagtcaaccacagggagagacaaaagaggtttcccagcagccccctgagaaacacggccctagagagaaggtgatgtgtgcccctgagaaacggataattcagcctgagttagaacttggcaacgagactgggtgcgcccaccttacctgtgagggcgacaaaaaagaggaagtgtcgggttcaaacaagagcggcaaggtgcacgcctgcacactcgcaagactggctaatttctgctttactcctccctcagagtcaaagtcgaagagccccccgcccgagcggaagaacaggggcgagaggggccccagcagccccccgacaaccacggcccctatgcgtgtgtccaaacgcaaaagctttcaactgcgaggttcgaccgagaaactgattgtctctaaagaatctctgtttactttgccagagcttggtgacgaggccttcgactgcgattgggacgaggaaatgcggaagaagtcctag

SEQ ID NO: 31301 - DNA, 471 bp, Artificial Sequence
  Description of Artificial Sequence: Synthetic coding sequence
atgaatagtgatcaagtcaccctggtcggtcaggttttcgagtcctatgtttcagagtaccataagaatgatattctccttatactgaaagagagagatgaggatgctcattacccggtagtcgttaacgccatgacactgtttgagactaatatggaaatcggtgaatactttaacatgtttccgtcagaagtcttgaccatttttgattcggcattgcggagatccgcattgacaattctccagtcactgagccagcccgaagctgttagcatgaagcaaaacttgcacgcacgcatatccggactacccgtgtgtcctgagttggtccgcgaacacatcccaaagaccaaggatgtgggacacttcttaagcgtcaccggcactgtgataagaacttccctcgtgaaggtgctggagttcgagcgagattacatgtgtaataaatgcaagcacgtgtttgtgatctag

SEQ ID NO: 31302 - DNA, 237 bp, Artificial Sequence
  Description of Artificial Sequence: Synthetic coding sequence
atgaattctgaccaagtcaccctggtcgggcaggtgttcgagtcctatgtcagtgagtatcataagaatgacatcctgctgatccttaaggagagagatgaggacgcccactacccagtcgtcgtgaacgctatgacactattcgagaccaatatggagatcggcgagtacttcaatatgtttccttccgaggtactgactatttttgatagcgccttgaggagaagcgcattgtag

SEQ ID NO: 31303 - DNA, 2628 bp, Artificial Sequence
  Description of Artificial Sequence: Synthetic coding sequence
atgagcggcactaaaccagacattctatgggctccccatcacgtcgatcgctttgtagtgtgtgattccgagctctccctgtaccatgtggagtctactgtgaacagtgagctgaaagctgggagcctgaggctgtcagaagactcagccgccacgctgttaagcattaatagtgacacaccatacatgaagtgcgttgcctggtacctgaactacgacccagaatgcctgctggccgttggccaggccaatggaagagtggtgctcactagcctaggacaggatcataacagtaagttcaaagatttgatcgggaaagagttcgtacccaagcatgctcgccaatgcaacaccttggcatggaaccccctcgattccaattggctggccgctggactcgataaacacagagccgatttctccgtgctgatctgggacatttgcagtaagtatacccctgacatcgtgcccatggagaaagtcaaactgtcagcaggtgaaaccgaaaccacgctgcttgtaaccaagcctctgtatgagttgggccagaacgacgcatgtctaagtctgtgctggctacccagggatcaaaagcttctcctggcgggtatgcatagaaacctggctattttcgaccttagaaatacttctcagaagatgttcgtaaacaccaaagcagtccagggggtgacagtcgacccatatttccacgatcgtgtggcatccttctacgagggacaggtggcaatttgggaccttagaaagttcgaaaaacccgtgcttacgctgactgaacagccaaaacctctgactaaagtggcctggtgccccactcgtacagggctgctggctacgctcaccagagatagcaacatcataagattgtacgacatgcagcataccccgacaccaattggagacgagaccgagccaacaattatcgaaagatcagtgcagccttgcgacaactatattgcttctttcgcatggcacccaacaagtcagaataggatgattgtggtgacaccaaacaggactatgtctgactttaccgtatttgaacgcatctcccttgcatggagccctatcacatctctgatgtgggcttgcgggaggcacctctacgaatgcaccgaagaagagaacgacaactcgctggagaaggatatcgctacgaagatgcggctgagagccttatccaggtatggcctagacaccgaacaggtatggcgtaaccatattctcgccggcaacgaggatccccagttgaagtctctctggtatactttgcattttatgaaacagtatactgaagacatggatcagaagtctcctggcaataagggctcactcgtgtacgccggcatcaagagtattgtcaaatcgtcattgggcatggtggaaagtagcaggcataattggtcaggacttgataaacagtctgacatccaaaatctgaatgaagaacgcatattggctctgcaattgtgtggatggattaaaaaaggaaccgacgtagatgtcggtccttttctgaatagcctggtgcaggagggcgagtgggagcgagcggctgccgtggccctgttcaatctggatatccgccgcgctatacagatccttaacgaaggcgcctcatccgagaagggcgacctcaacttgaatgttgtggctatggctctgtcaggctacacagacgaaaaaaatagtctgtggagggagatgtgttccactcttagactccagctgaataacccttacttgtgtgtcatgtttgccttccttacttctgagacagggagttacgacggtgtgttgtacgaaaacaaggtggccgttagagaccgcgttgcttttgcctgtaagtttctgtcggatacccaacttaaccggtatatcgagaaactgaccaatgagatgaaggaggctgggaacctggaggggattctcctcactggcttgaccaaggacggcgtggatctgatggagagctacgtagatcgcacaggcgatgtgcagactgctagttactgtatgctgcagggctcccctctggacgtgctaaaagatgagcgcgtgcagtactggattgagaactaccggaatttgttagacgcgtggcgtttttggcataaaagagccgagttcgacattcacaggagtaaactcgaccctagttccaaaccccttgctcaggtgttcgtgtcctgcaatttctgtggaaagtccatttcttattcatgttctgcagtgcctcaccagggccggggatttagtcagtatggggtctctggatcgcctacgaagtccaaggtaacaagttgcccagggtgtaggaagccgctgccaaggtgcgccttgtgccttataaacatgggaacccctgtctcgagctgtcccggaggcacaaagagcgatgaaaaggtggacctctccaaagataaaaagctagcccagttcaataattggttcacatggtgccataattgcaggcacggcgggcatgcggggcacatgctgtcttggtttcgcgaccacgccgagtgtccagtatccgcctgcacctgtaaatgcatgcagctcgatacaacaggaaacctggtaccagcggagaccgtacagccttag

SEQ ID NO: 31304 - DNA, 2628 bp, Artificial Sequence
  Description of Artificial Sequence: Synthetic coding sequence
atgtcggggacaaagccagatattttatgggcccctcaccatgtagaccggttcgttgtctgtgattcagaattgtcactttaccatgtggaatctaccgttaattcagagttaaaggccgggtccctgaggctttctgaagattccgccgctaccctgctgtctattaactccgacaccccttacatgaaatgcgttgcttggtaccttaattatgacccagagtgccttctggcagtgggacaggctaacggaagggtggttctgacttcactgggacaagatcacaacagcaaattcaaagatctcattggcaaagagttcgttccaaaacatgcacgtcaatgcaacactctggcatggaatcccctggattccaactggctcgccgctgggctcgataaacaccgcgccgacttttcggtgctcatatgggatatatgctctaagtatacaccagatatcgtgccaatggagaaagtgaaactgtctgccggggaaacggagactaccttattagtgaccaaacccctttatgaactggggcagaacgatgcctgtctgagcctatgttggctccccagagatcagaagctattgctcgcaggtatgcacaggaacttggccatctttgatctgcggaacacttctcaaaagatgtttgtcaacacgaaagccgtccagggggtcactgtcgatccatacttccacgatagagtcgcgtcgttttacgagggtcaggtcgcaatttgggacctgcggaaatttgaaaagccagtcttgacactgacagaacagcccaaaccactgacaaaagtggcatggtgccccactaggactggcttactcgccactctgaccagagattccaacattatcaggctgtatgacatgcaacatacccccacacccattggcgacgagaccgagcccaccattattgaacgaagcgttcagccctgcgacaattatatcgcatccttcgcttggcaccccacgtcacagaataggatgattgtggtgaccccaaaccgcacaatgtctgacttcaccgtcttcgagaggatttccctggcttggtctccaatcacttccctcatgtgggcctgcgggaggcatttgtatgaatgcacagaagaggaaaacgacaactctctggaaaaagacatcgcaaccaagatgagactgcgagccctgtctaggtacgggctggacacagagcaggtgtggcggaaccacattctcgcagggaacgaagacccacagcttaagtctttatggtatacactgcacttcatgaagcagtacactgaagacatggatcagaagagtcctggtaataagggaagcctcgtgtatgccgggatcaagtcaatcgtaaaaagcagcctgggaatggtcgagtcctctaggcataattggtctggtctggacaagcagtcagacattcagaatctcaatgaagaacggatactggcccttcagctgtgcggttggatcaagaagggtaccgacgttgacgttggcccatttctcaattcgctggtacaggaaggagagtgggagagagctgccgctgtggcattgttcaaccttgatataaggagagccattcagatcctgaatgaaggagcgtcgagcgagaaaggcgatctcaatctgaatgtcgtcgccatggctctctctgggtacaccgatgagaagaattccctctggcgggagatgtgttccaccctaagacttcaactaaataacccgtatctttgcgtgatgttcgcattccttaccagcgagaccgggtcatacgacggggtgctgtacgaaaataaagtcgcagtccgagacagggtcgcctttgcttgcaagttcctgtctgatactcagctgaatagatatatagagaaactgactaatgagatgaaagaggccgggaacctggaggggatcttactaacgggcttaactaaggatggcgtcgacctgatggagagctacgtggaccggactggcgacgtccagacagcaagttattgtatgcttcagggaagccctttggacgtacttaaagatgaacgggtgcagtattggatcgagaattacagaaacttgctcgacgcctggcgcttctggcacaaacgcgctgagtttgacattcaccggtcgaagctagacccatcctcaaaaccacttgcccaagtgttcgtatcctgcaatttctgcggcaagtcgatctcctattcttgtagtgctgtgcctcaccagggaagagggttcagccagtacggcgtgtctggctccccaacaaaatccaaggttacttcatgcccagggtgtcggaagcctctgccacgttgcgccttgtgtcttatcaacatgggtacgcccgtttcctcttgtcccggcgggaccaagagcgacgagaaagtggatttgagcaaagataagaaattggcccagtttaacaactggtttacctggtgccacaattgtcgtcatggtggccatgcagggcatatgctgagttggttccgcgaccacgccgagtgccccgtaagtgcctgcacatgtaaatgtatgcagcttgataccacaggaaacctggtgccagccgagacagtgcagccctag

SEQ ID NO: 31305 - DNA, 195 bp, Artificial Sequence
  Description of Artificial Sequence: Synthetic coding sequence
atgagcggcacaaagcctgatattctgtgggcaccacatcatgtcgatcggtttgtggtgtgcgacagtgagctgagcctgtatcatgtcgagagtaccgtgaacagtgagctcaaagcaggttccctgcgactgtctgaagactccgcagccactttactgtctataaacagcgatacaccctatatgaagtag

SEQ ID NO: 31306 - DNA, 453 bp, Artificial Sequence
  Description of Artificial Sequence: Synthetic coding sequence
atgagtgggacgaagcctgatattctgtgggctcctcaccacgttgaccgattcgtcgtatgcgattctgagctatcactgtatcatgtcgagagcactgtgaactctgaactgaaggccgggagcttaagactaagcgaagattccgctgcaactctgctaagtattaactctgataccccttatatgaagtgtgtggcttggtatctcaactacgacccagagtgcttacttgccgtgggacaagcaaacgggcgcgtcgttctgacttctctcggccaggaccacaatagcaagtttaaagatctcattggaaaggaattcgtgcccaaacatgcccgccagtgtaacacactcgcctggaatcccttggattccaattggctggctgctgggttggacaaacaccgtgcagatttcagcgttttgatctgggacatttgctctaaatag

SEQ ID NO: 31307 - DNA, 195 bp, Artificial Sequence
  Description of Artificial Sequence: Synthetic coding sequence
atgtctggaacaaagcccgatatattatgggccccacaccacgtggaccgcttcgtcgtctgcgactcagagctctcactgtaccacgtggagtcgactgtcaactccgaactgaaagcaggctctcttcgattatccgaggactccgctgcaacactgctctcgatcaactctgacaccccctacatgaaatag

SEQ ID NO: 31308 - DNA, 540 bp, Artificial Sequence
  Description of Artificial Sequence: Synthetic coding sequence
atgtcagggaccaaaccagacattctgtgggctccacaccatgttgacaggttcgttgtgtgtgactcagagctgtcactgtaccacgtggagagcacagtgaacagtgagctaaaagccggcagcctgcgcttatcagaagacagcgcagccactttactttcgattaactcggatacaccgtacatgaaatgcgtggcctggtacctaaattatgatcccgagtgccttctggccgtgggacaggccaacggccgggttgtcctgacctccctgggtcaggaccacaatagtaagtttaaggacctaattggaaaggaatttgtgcccaaacatgcacgacagtgtaacacattagcgtggaatcccttggattccaactggcttgctgctgggctggataaacacagagcggacttctcggtgctgatctgggatatctgttcaaaatacactccggacattgtacctatggagaaagtcaagctcagcgcaggggagactgagaccaccttgttggtcacaaagcctttgtattag

SEQ ID NO: 31309 - DNA, 789 bp, Artificial Sequence
  Description of Artificial Sequence: Synthetic coding sequence
atggctctaggtctgaaatgttctcggatggtacaccccgcttttcggaattatctagccgctagtatccggcccgtatctgaagttacactgaagaaggtttacgagaggcaacatgggcaccggcagtacgtcgcatactcagctgttccagttcatcactttgctaccaaaaaggcaaaggccaagggaaagggcaagagccagacgcgcgtgaacatctcggccgccttcgtagaggatataattaacctggaagaagttaatgaggaaatgaaaagtgtcatcgaggcgcgaaaagacaactttaataagacactcaatatcggtacctcccctggtagcctcgacaagattgctgtcgtcacagcagacggaaagttggcgttgaaccagattagacaaatctctgtgaaactcccgcagttgattctggttaacatggctagctttcctgagttcaccgtcgccgccatcaaagccattcgtgagagcggcatgaatctgaacccggaggtggagggcacattgatccgggtgcccattcctcaggtcattcgagaacaccgcgagatgttggtgaaattggccaaacaaaatactaacaaggcaacctacagcttgcggaaggtatgcacaaatgccatgaacaaactgaaaaaatctaaggacaccgtatcagaggggacaatcaggctgacggagaagcagatctctcagatggcggacgatactgttgcagagttgtaccgacacctggccgtgaagactaaggagctgctgggatag

SEQ ID NO: 31310 - DNA, 738 bp, Artificial Sequence
  Description of Artificial Sequence: Synthetic coding sequence
atgagcgacgagttttccttggcagacgctctccctgaacactcacccgccaaaactagtgcagtttctaacaccaagccaggccagcctccacagggttggccgggctccaacccttggaataacccatcggccccgagttccgtgcctagcgggctcccacccagcgccactccttcaaccgtgcccttcgggccagcccctactggcatgtatccctcggtgcccccaacgggtcccccccccggaccccccgcaccgtttccaccatccgggccctcctgccccccccctggcggcccttaccccgcccccaccgtccccgggcccggtccaacgggaccctatccaactcccaacatgccttttccagaactcccacgcccctatggcgctcctaccgatcctgcagccgctggacccctggggccctgggggagcatgtcctctggtccatgggcacctggcatgggtggccagtaccccacccccaacatgccttatccgtcacctgggccctaccccgcacccccacctccccaggctcccggagctgcaccaccggttccctggggcaccgttcctccgggcgcttggggccctccagctccttaccctgctcccaccgggagttaccccacgcctgggctctacccaacaccgagtaacccattccaagtaccctcaggaccctctggcgcacctcctatgcctggcggaccacacagctaccattag

SEQ ID NO: 31311 - DNA, 690 bp, Artificial Sequence
  Description of Artificial Sequence: Synthetic coding sequence
atgagctcacatctagttgaaccaccgccccctctgcataataacaacaacaattgtgaggagaacgaacagtctttgcctcctcctgcggggcttaacagctcctgggtggagttaccgatgaatagctctaacggtaatgataacggcaacgggaaaaacggcggtttggagcatgttccatcctcaagttcaatccataacggtgatatggaaaaaatcctgttggacgctcagcatgagtcaggtcagtcgagctcccgcggcagcagccactgcgactctccctctccccaagaagatggacagattatgttcgatgtagagatgcacacttccagagaccacagttcccaatccgaggaagaggtggtggaaggagaaaaagaggtggaggccctgaagaaaagtgcagactgggtaagcgactggtctagcagacctgaaaatattccaccgaaggagttccactttaggcaccccaaaagatcagtctccctgagtatgcgtaagtctggcgctatgaagaagggtgggatcttctccgcagagtttctaaaagtctttatccccagcttgttcctaagccatgttctggccctggggctgggcatttatattggaaagcgactctctaccccttgccagcacctgctgcgggaacggaagagcccctggaagtgcgtttag

SEQ ID NO: 31312 - DNA, 4044 bp, Artificial Sequence
  Description of Artificial Sequence: Synthetic coding sequence
atgccagccgtccgggtttgggatgtagccgagcactcccaggtggccgagcttcaggaacacaagtacggtgtggcatgcgtcgcgttttcccccagtgccaagtacatcgtaagcgtggggtaccagcacgacatgattgtgaacgtttgggcctggaagaagaacattgtagttgcttcaaataaggtcagcagtagagtcaccgccgtcagtttcagcgaggactgttcttacttcgtgaccgccggaaacaggcatattaagttctggtatctcgacgactcgaaaaccagcaaggtaaacgccacagtacctctgttaggtcgtagcggactgcttggggaactccgaaataacctcttcacggacgtcgcttgtggacgcggtaaaaaggcggatagtacattttgcatcacttcaagcgggctgctgtgcgaattcagtgaccggaggttgctcgataaatgggtagagcttcgcaccaccgttgcccattgcataagtgtgagtcaggactacatcttctgtggctgtgctgacggtacagtgcgcctgttcaatccttcaaacttgcactttttgagtaccctgcccaggccacatgcactgggaaccgatattgctagcgtcacagaggcgtctcggttattctcaggcgtggccaacgcgcgttatcctgataccatagctctgacatttgaccctacaaaccagtggctgagttgtgtgtacaatgatcattctatatatgtgtgggatgttcgggatccaaagaaagtgggcaaggtgtattctgctctgtatcactcttcctgtgtgtggtctgtggaggaccttattaaaatcatctacgtggacggaaacacccaggctctcttggacacagaattgcctggcggtgataaagccgatgcatcccttttggaccccagggtgggcatccgtagcgtgtgtgtgagccccaacgggcagcatttggccagcggcgaccgaatgggcacattaagagtacacgagctacagtcattgtctgagatgctgaaggttgaagcccacgatagcgaaatactctgcttggaatactccaaacccgataccggcctcaaactcctcgcctccgcctccagggacagattaatccacgtcctcgacgcagggcgcgagtactcactgcagcagacactggacgaacattcatcatcaatcactgccgtgaagttcgctgcgtccgatggacaggtacgaatgatatcttgcggcgcggataaatccatctacttccgaacagctcagaagtccggagacggcgtccagttcacacgcactcatcacgtggttcggaagaccactctttatgatatggatgtagaaccatcatggaaatataccgccatcggatgccaagaccggaacataagaatttttaatatttcatcaggaaagcagaaaaaacttttcaagggaagccagggcgaagacggaacattaattaaggtacaaacagatcccagcggtatctacatcgccacttcgtgctcagataaaaacctcagtatcttcgacttttcgtcaggcgaatgcgttgccaccatgttcggacactctgagatcgtcaccggaatgaagttttccaatgactgcaaacacctgatctctgtctctggtgacagttgcatttttgtatggaggctatcctcagaaatgacaattagcatgagacagaggcttgccgagctcagacagcgccagcggggaggcaaacagcagggcccatcctcaccccaacgcgccagtggaccaaaccgccatcaagccccatcgatgctgtccccaggacctgcattaagctccgactctgacaaggaaggcgaggacgagggaactgaggaagagctgcccgctctgcctgtgctcgctaaaagtaccaagaaggccctcgcctcggtgccgtccccagctctgcctcggtcacttagccattgggagatgtctcgcgctcaggagagtgttggcttcctcgatccagcccccgcagcaaatcctggacctaggaggcgaggccggtgggttcagcctggagtggaactcagcgtgaggtctatgctcgatctgagacagctggagaccctcgctccaagcctccaggatccatcgcaggacagcctggccattataccgagcggaccccgtaagcacggccaagaagccctcgaaactagtttaaccagtcaaaacgagaagccaccccgcccccaggccagccagccttgcagctacccccatatcatcagactattatcgcaggaagaaggagtgtttgcacaggatctcgagccagcccccatagaggatggaattgtataccctgagccaagcgataatcctaccatggatacctccgagttccaagtgcaggcgcctgctagagggacactcggcagagtctatcctggaagccggtcgagcgagaaacactcccctgatagtgcttgttctgtggactacagctcaagttgcctcagcagccctgagcacccgaccgaggactcggagagcacggagcctctcagtgtggacgggatcagctctgatctagaggagccagccgagggggacgaagaggaagaggaagaagaaggtggaatgggcccctatgggctgcaagagggctccccccagactccagaccaggaacaatttctaaagcaacacttcgagaccttggcctccggagccgccccgggcgcacccgttcaggttcctgagcggtccgaatctagatcaatctcaagtagatttctgctccaggttcagacgcgcccgctgcgcgagcctagcccatcctcgagttcattggcgttaatgagcaggcctgctcaagtgccacaagcgagcggtgagcagccacggggcaacggagccaacccaccaggggccccccctgaggttgagcctagctccggcaacccaagtcctcagcaggctgcttccgtactgctgccacggtgtcgtctaaacccagactcatcctgggctccaaaaagagtcgctacagcgtctcccttttccggtctgcagaaagctcagtctgtgcactccctggtgcctcaggagcgacacgaggcctccctgcaggcaccctcgcctggcgcccttctgtcgagggagatagaggcacaggatgggttggggtcactaccgcctgctgacggaagaccctccaggccacacagttaccaaaatcccactactagttccatggccaagatatcccgctccatttctgtgggggaaaacctcggcttagtggcagagcctcaagcacacgccccaattagggtcagccccctctctaagctggctttgccatcgcgagctcacctagtgcttgatatcccgaagccattgcctgatcgccccaccttagcagcatttagcccggttaccaagggacgggcgccgggagaggctgaaaagccgggctttcctgtgggcctgggaaaagctcactccactactgagcggtgggcatgtttgggtgagggaactacacccaaaccaaggactgaatgtcaggcccacccaggaccttcctctccttgtgcccagcagctgcccgttagtagtttgttccagggtcccgagaatctgcagccccctcctccggagaaaacccctaatcccatggagtgcactaaaccaggggctgctctttcccaggacagcgaaccagccgtctctttggaacagtgtgagcaacttgtcgcagagctcaggggaagcgtccgtcaggccgtgcgactgtaccactcagtcgcaggatgtaaaatgccttccgcagaacagagtaggatagcacagctactcagagacactttctccagtgtccgtcaggagctggaggccgtagctggagcagtcttgagttcgcctggaagttctccgggtgcagtaggagcagagcaaactcaggcgctactggagcagtattctgaattactgctgcgcgccgtggagaggagaatggagagaaaactttag

SEQ ID NO: 31313 - DNA, 4545 bp, Artificial Sequence
  Description of Artificial Sequence: Synthetic coding sequence
atggctgtggaaggatctactattacatcgaggatcaagaatttactccgaagcccctccattaagctgaggcgcagcaaggctggaaatagaagagaggatctgagcagtaaggtaacactggagaaggttttgggaatcactgtctccggagggagaggattagcttgtgaccctagatctgggctggttgcatatcctgctggctgcgtggttgttttgttcaaccctcgcaaacataaacaacaccacatcttaaattcatctcgcaaaacaataactgctctggctttcagtcctgatgggaaatatttagttactggagagtctggccatatgcccgctgtgcgggtgtgggatgtggcggaacacagccaggtggccgagctccaggaacacaagtatggggtcgcttgtgtggcgtttagcccctcagccaagtacatcgtttcagttggataccagcatgatatgattgtgaacgtgtgggcatggaaaaagaatatcgtggtcgcttctaataaagtctcgagccgggttacagcggtttctttttccgaggactgctcttattttgtgaccgccgggaacagacacatcaaattttggtatctagacgatagcaaaacttccaaagttaatgccaccgtgccgctgctggggcggagcgggctcttaggggagcttagaaacaatttgtttacagatgtcgcctgcgggcggggcaagaaagccgatagcacgttctgcatcacctcttccgggctcttgtgcgaattttctgatcggaggttgctggacaagtgggtagaactgaggaacatcgattctttcaccaccacagtggcccattgcatatctgtctcccaggattatatcttctgtggctgcgccgatgggaccgtgagactgtttaacccatctaatctgcacttcctcagtacactcccgcgaccacatgccctcggcaccgatatcgcctctgtgaccgaggccagtaggctttttagtggcgtggcaaatgctcgatatcccgacactattgcactgactttcgatcctactaatcagtggttaagctgcgtctacaatgatcattctatctatgtgtgggatgtccgagaccccaaaaaggtcggaaaagtctatagcgccctgtatcactcttcttgtgtttggagtgtagaggtgtaccccgaagttaaagattccaaccaggcctgtctgcccccctccagttttattacctgctcgtccgataacaccatacgtctctggaataccgagtcaagcggggtacacggaagcacactccaccgcaatattctctcttccgacttgattaaaattatctacgtggatggaaatactcaggcactactggacactgagctacccgggggagacaaggccgacgccagtttacttgacccacgcgtggggatccggtccgtctgcgtctcgccaaacgggcagcatctcgcctcaggggacagaatgggcactctcagggtgcacgagcttcagtcactgagtgaaatgctgaaggtggaggcccatgattccgagatcctatgcttagaatacagcaagcccgacacaggtctcaaacttctggccagcgcctccagggaccggctcatccacgtattagatgctgggcgcgaatatagtctccaacagactctggatgagcattcatcatctattacagccgtcaaatttgctgcctctgacggacaggtgaggatgatcagctgcggcgcagataaatcaatctacttccgcacagcccagaaaagcggcgacggcgtccagttcactcgcacgcatcacgtagtgcggaagacaacactttatgacatggacgtggaaccaagttggaagtataccgccattggctgtcaggatcggaacatcaggatattcaatatcagcagcggaaaacagaagaaactgtttaagggcagccaaggggaggacggtactttgatcaaagtgcagaccgacccttccgggatttacattgcaacatcgtgttctgacaaaaacttatccatttttgacttctcctcaggagagtgtgttgcgactatgtttggccatagcgaaatagtgacgggcatgaaattctctaatgattgcaaacacctgatttccgtttccggcgactcctgtattttcgtttggcggttgtcttctgaaatgaccattagcatgcgccaaaggctggctgagcttaggcagcgccagagggggggaaagcaacagggtcccagtagtccccaacgtgcctctggtccaaatagacatcaagcgccaagtatgctcagccccggaccagccttgtcaagcgattctgataaagagggggaagacgagggcacggaggaggaactgcccgccctgcccgttctagccaaaagtaccaaaaaggcattggcctccgtccccagtccagccttacccagaagtcttagccattgggagatgtcacgcgcccaggagtccgttggatttctggaccctgccccggctgctaatcctggccccaggagacggggccgatgggttcagcccggagtggagctgtctgtccgttctatgctggacctgcggcagctcgagacgctcgccccaagcctacaggatccttcccaggatagcctggctattattccttcggggcccaggaaacacgggcaggaagccttggaaacaagcctcaccagccagaacgagaagccgccaagaccacaagcaagccagccttgcagctatccacacataattagattgctgtcgcaggaagaaggggtcttcgctcaagacttggaaccagcccctatagaggatggcattgtgtaccccgagccctctgataacccaactatggataccagcgaatttcaggttcaggcccctgcgcgcgggaccctcgggcgggtgtatccaggcagtcgctcatcagagaaacacagcccagattctgcctgctcagtcgactattctagctcttgtctaagctcgccagaacatccaaccgaggatagcgagagtactgagccactgtctgtggacggaatctcttctgatctggaggaaccagcagaaggcgacgaggaggaggaggaggaggaaggcggaatgggcccatacggcctgcaggaaggttcaccacagaccccggaccaggaacagtttctgaagcagcacttcgagacccttgcgtccggggccgcccctggggctcctgtccaggtgccagagcggagtgaaagtcggagcatcagctctcggtttctgctgcaggtgcaaacacggccacttcgggaacccagtccctcaagttcctctcttgcactgatgtctcgccccgcccaggtgccacaagctagtggtgaacagccccggggcaacggcgcaaaccccccaggtgcgccgccagaggtagagccttcctccggcaatccctcccctcaacaggcggccagtgtcctcctcccccggtgtcgactgaaccccgacagttcttgggcccccaagcgtgtcgccactgctagccctttttccggtttacagaaggcacagtctgtccacagcctggttccccaggagcggcacgaagcgagcctgcaggcccctagccccggggctctgctcagccgggaaattgaagcacaggacgggctgggcagcctgccgccggctgacgggcggccatcgcgaccacatagctaccagaatcccaccacatcctcgatggctaagattagccggtccatctcagttggagaaaacctggggttggttgccgagcctcaggctcacgcccctattcgcgtcagccctctgagcaaactggccctcccgtcacgtgctcatctggtccttgatatcccaaagcccctcccagataggcccacattagctgctttttcccccgtcaccaagggccgtgctcctggagaagcggagaaacccggattccccgtcggattgggcaaagcccactcgaccacagaacgctgggcctgtcttggcgagggaaccaccccaaagcctaggacagaatgtcaggcacatccaggtccctcttccccttgtgcgcagcagctgccggtctccagcttattccaagggccagagaacttgcaacctccacctcctgagaagacacccaatccgatggaatgtaccaaaccaggagcagcccttagccaggattctgaacccgctgtcagtttggaacaatgcgaacaactggtggctgagctgcgaggtagcgttcgccaggctgttaggctctatcactccgtagctggctgcaagatgccctcagctgaacaatctcgaattgcacagctacttcgggacaccttttcgagcgtgagacaggagttggaagcagttgccggcgccgtcctgagctcaccaggatccagtcctggagccgtcggcgctgagcagacacaggcactactggaacaatactctgaactgctgttacgagccgttgagcggcggatggagaggaagctctag

SEQ ID NO: 31314 - DNA, 4527 bp, Artificial Sequence
  Description of Artificial Sequence: Synthetic coding sequence
atggccgtcgaaggcagtaccattacatctcgcatcaaaaatctactcaggagtccttctattaaactgagacgtagtaaggctggcaaccgtcgagaggatctctccagtaaggtgacactggaaaaggtccttggtatcaccgtgtccggcggcagggggcttgcatgtgatcccagaagcgggctggtagcatatccagccggatgtgtggtagtgctgttcaaccctaggaagcacaagcagcatcatattctgaacagcagccggaagactatcacagctctcgccttttcacccgatgggaaatatctggtgactggagagagtggacatatgcccgccgtgagggtgtgggatgtcgccgaacatagccaggtggcagaactacaggagcacaaatatggggtggcttgtgtggctttcagcccatcagccaagtacatcgtatcggtgggatatcaacacgacatgattgttaacgtgtgggcgtggaagaagaacatcgtggtggctagcaacaaagtgtcatcccgtgtgactgccgtcagcttttcagaagactgctcttacttcgttaccgccggaaacagacacataaagttttggtacctcgatgactctaagacgtccaaagtgaacgccactgtgccactgctgggcagaagcgggctcctgggagaactgaggaataacctgttcactgatgtcgcatgcggcaggggtaagaaggctgactccacgttttgtattacaagcagcggattgctctgtgagtttagcgatcgccgcctgctcgacaagtgggtggagctgcgcactacagtagcccactgtatctccgtgtctcaggattacatcttctgcgggtgcgctgacggcacagttagattgttcaacccatcaaaccttcacttcctcagtacattgcctcgaccccacgcactcggcactgatattgctagcgtgaccgaggctagccggctattttctggggtagccaacgctcggtaccctgatacaatagcactgacttttgatcctaccaatcagtggctgtcctgtgtgtacaacgaccatagtatttatgtttgggatgtcagagaccccaagaaggtgggtaaagtctactccgcgctctatcacagtagttgcgtgtggtcagtcgaagtctatcccgaagtcaaggattctaatcaggcatgtctcccgccatcctcctttataacctgtagcagtgacaacaccatacggctgtggaatacagagtctagtggcgtgcacggctctaccttgcacaggaatatcctgtcatctgacctgatcaagattatctacgtagatgggaatactcaggcacttttggatacagagctgcccgggggcgacaaggccgacgccagccttttggacccacgggtcggaattaggtccgtttgcgtaagcccaaatggtcagcaccttgcgagcggcgatcgaatgggcactcttagggtgcatgagttgcagagcctttcagaaatgttgaaagtggaagcgcatgactcggagatcctttgcctggagtatagcaagcccgataccggtctgaagctgttggcctcggcatctcgggaccggctaattcatgttctcgatgcgggtcgtgagtactcacttcagcagacactcgacgaacattccagcagtatcactgcagttaaattcgctgctagcgatggacaggtgagaatgatttcttgtggggccgacaagtccatatactttagaacggctcagaaatccggggatggagtgcagttcacaagaactcaccatgtcgtcaggaagaccactctctacgatatggatgtggaaccaagctggaagtacaccgctatcgggtgccaagaccggaacattaggatatttaacatctccagtgggaaacagaagaagctcttcaagggttctcagggagaggacggtacactgatcaaggtacagaccgatccatctggaatctatatcgccacaagttgctcagacaaaaatctgtctattttcgacttttccagtggagagtgtgtggccaccatgtttggacacagcgagatcgttactggcatgaaattttcaaacgactgcaaacatctgatatcggtctccggagactcgtgcattttcgtgtggagactgtcgagcgagatgaccataagcatgcgccagcgcttggctgagctccgacagaggcagaggggcggcaagcaacagggtccatccagtccccagcgcgcctctgggcccaatcggcatcaggctcccagcatgctttcccccggacccgccttgtctagtgactccgacaaagagggcgaggatgaaggcactgaagaagagttgccggcattgccagtgctggctaaatcaaccaagaaggcactagcttctgtgccatctcccgccctaccaaggtcgctatctcactgggaaatgtccagagcgcaggagtccgtgggtttccttgaccccgcacctgccgccaatcccggtccacgtaggcgtgggcgttgggtgcagccgggcgtagaactcagcgtgcggtccatgctagatcttcgacagcttgagaccctagccccgtcactgcaggacccctctcaggacagcctcgcgatcattccctcaggacccaggaaacacggccaggaggccctggagacaagtcttacaagccagaatgagaaaccccctaggccacaggctagtcagccttgtagctatccgcacattataagactgctcagccaggaagagggtgtcttcgcacaagaccttgagcctgctccaatcgaagacggtatcgtgtaccctgagcccagcgacaaccccacgatggacacaagcgagtttcaggtccaagcacccgcacgcggcaccctggggagagtatatccaggatctaggtcaagcgagaagcactcacccgacagtgcttgtagcgtcgactattcttccagttgtctctctagcccggagcatcccaccgaggattcagaatctaccgaaccactgtcagttgatggcatctcaagcgatctggaggaacccgccgagggggatgaggaggaggaagaggaagaggggggcatgggtccgtacggtttgcaagagggatctcctcagacgcccgaccaggagcagttcctcaaacagcacttcgagacactggcctcaggcgcagcgcccggtgctcctgtccaggtgccggaacgcagtgaatctcgatcaatctcttcgcgtttcctgctccaagtacaaacgaggcccttgagggagccgtcaccaagttcctcaagtctggctctgatgagtcggcccgcacaagtgccccaggccagtggggagcaacccagaggcaatggcgctaacccacctggggccccgccagaagttgagccgagcagcggaaacccatcaccccagcaggcggccagtgtcctgctgccacgctgccgtctcaatccggattccagctgggcccctaaacgcgtggcaacagcgagcccgtttagtggattgcaaaaagcccagtccgttcatagcctggttccccaggagaggcacgaagccagtttgcaagctccctcccctggcgctttgttgtccagagaaattgaggcccaggatggcctgggtagtctaccccctgccgatggaaggccctccagaccacattcctaccagaatcctacgacctcatcgatggctaaaatctcccgaagtatctcagtcggagagaacctcggcctcgtagcagagccgcaggcccacgcacccattagagtgagtcctctcagtaaactggctctcccaagtagggcgcaccttgtgcttgatatacctaagccactgcccgatcgacccacactggcggccttttctccagttaccaaaggtcgggctccaggcgaagcggagaaaccggggttccccgttggacttgggaaagctcactctactacagagcgttgggcatgcctgggggagggcacaactcctaaacctagaactgaatgccaggctcatcccggaccttcaagcccttgcgcccaacagctgccggtgagcagcttgtttcagggccccgaaaacctgcagcccccacctccagaaaaaacgccaaacccgatggagtgcacgaagccgggcgctgccctctcccaagactcggagcccgctgtttcactagaacagtgtgagcagttagtggccgaactgcgagggtccgtgaggcaggccgttcgcctgtaccactctgtggccggatgtaagatgccttctgcagagcagagtagaatcgcccaattactaagagatacgttcagctcggtgagacaggagctggaagctgtcgccggcgctgtcttatcttctcccgggagctctcccggggctgtgggtgctgagcagactcaggcccttttggaacagtactcagagctcctactacgggctgttgaacggagaatggaacgcaagctttag

SEQ ID NO: 31315 - DNA, 471 bp, Artificial Sequence
  Description of Artificial Sequence: Synthetic coding sequence
atggccgtggaagggtctacaatcacttctcggattaagaatctccttcgaagcccaagtattaagctgagaagaagcaaagctggaaacaggcgggaggacttgtcatctaaggtgacactggagaaagtgttaggaattaccgtatctgggggtcgcggcctggcctgcgatccccgcagcggcctcgtggcatatcctgctggctgcgtggtagtgttgtttaacccccgtaagcacaaacaacatcatatcctcaattccagccgaaaaaccattacagccctggcattctcccccgacggaaagtatctggttactggagagtcgggccatatgccagctgtgcgggtatgggatgtggccgagcacagccaggtagctgagctgcaggagcataaatacggcgttgcatgcgtggcattttcaccttcggctaaatacattgtttccgtggggtatcagcattag

SEQ ID NO: 31316 - DNA, 3696 bp, Artificial Sequence
  Description of Artificial Sequence: Synthetic coding sequence
atggcagtcgagggaagtaccatcacttcccgtattaagaatctactccgcagcccgtcaattaagctcaggcgatcgaaggccggcaatcgcagggaagacctatcttctaaggtgacactggaaaaagtgctcggaatcactgtctctggtggacgcggcctggcctgtgaccctagaagtggcctggtcgcctaccccgccgggtgcgttgtggtcctgttcaaccccagaaagcataagcagcatcacatcctcaacagttcccgcaaaaccattactgccttggcattttcccccgacgggaaatatctcgttaccggtgagagcggccacatgcccgctgtcagggtctgggatgtagcagagcatagccaggttgccgaactgcaagagcataagtacggagtggcatgcgtggccttctctccaagcgccaagtacatagtatctgtaggataccaacacgacatgatcgtgaacgtttgggcatggaagaaaaatatcgtggtggcctcaaacaaggtgtctagccgggttacagcagtgtccttttctgaggattgctcatattttgtgacagccgggaatagacacattaaattttggtacctcgacgactctaaaacaagtaaggtaaatgctacggtgcccctcctcggacgtagcgggctgctgggggagttgcgtaataatctatttacggacgttgcctgcggcagaggcaagaaagccgattccactttttgtatcacaagctcaggcttgttatgcgagttctcagatcggcggctcttggataaatgggtggaactgaggaccactgtggcacattgtatttccgtgtcacaggactacattttctgcggatgcgcagacggaactgtgcggctttttaaccccagcaacctacactttctcagcactctgccccgcccccacgctctggggaccgatattgcatctgtcactgaggcttcccgcctgttcagcggtgttgccaacgctagatatcctgacaccattgcactgacgttcgatccaacaaatcaatggctgtcttgcgtttataatgatcattcgatatatgtgtgggacgtgcgcgaccctaagaaggtgggaaaagtgtatagcgccttgtatcactcaagctgcgtttggtcagtggaggtctaccccgaagtcaaagactcgaatcaggcctgcctgcccccctcatcttttatcacctgttcctcggacaatacgatccgcctgtggaacaccgagagttccggcgttcacggcagcactttgcaccggaatattttgagtagcgaccttatcaagatcatctatgtcgatggtaatacgcaggccctgcttgacactgaacttcccggtggggacaaggctgacgcgagcttgcttgaccccagagtcgggatccgctccgtttgcgtgtctccaaacggccagcacctggcctctggagaccgtatgggcactctgagggtgcacgaattgcagagcctgagcgaaatgcttaaagttgaagcacacgactccgagattctctgtctcgagtactctaagcccgatactgggctgaaactcttggcctccgcttcaagggaccgcctgatccacgtgctggatgcgggccgcgagtattctctgcagcagaccctggatgagcacagcagcagtattacggcggtgaagttcgctgcctctgatggccaggtccgcatgatctcatgcggtgctgataaatccatctatttccgtacagcccagaagtcaggcgacggagtgcaattcacgcgcacacaccatgttgtgaggaagacaactctatacgatatggatgtggaacccagttggaagtacacagccattggttgccaagatcgcaacatacgcatctttaacataagctcaggtaagcagaaaaagttgtttaaaggctcacagggcgaggacgggacgcttatcaaagtacaaacggatccctcgggtatatacatagctaccagctgtagcgataagaacctgagcatcttcgacttctcatccggcgaatgtgtcgccactatgttcggccacagcgaaattgtgacaggtatgaagttctcaaacgactgtaagcacctcatttccgtgtctggggacagctgcatttttgtatggcgcctgtcttccgagatgactattagcatgcggcagcgacttgctgagctcagacaaagacagcgtggcggaaagcagcaagggcccagttccccacagagagcatcaggcccaaatagacaccaagcccccagtatgctgtcccccgggcctgctctgtcaagcgactctgacaaggaaggagaggacgaaggcaccgaggaggagttgcctgcactccccgtgctcgccaagagcacaaagaaggcactggcctctgttccaagccccgctttacctcggtcgctttcccactgggaaatgtcacgagcccaagaatctgtggggtttttggatccagcccccgccgctaaccctggtccccgccgccggggcaggtgggtccaaccaggggtcgagctgtctgtacgctctatgctggatttgagacagctcgagactttagcgcctagcctgcaggacccatcacaagatagcttagccattattccttcaggccctagaaaacacggccaagaagcgctggaaacaagcctgaccagtcagaatgagaaaccgcccagacctcaggcttcccagccatgctcctatccgcacattattagactgctgtcacaggaggaaggggtgttcgcacaagacctggagcccgcgccgatagaagatggtatagtctatcctgaaccctcagataatcctaccatggacacgtctgagttccaggtgcaagctcccgcccgcggtaccctgggccgtgtctatccaggcagccgctcgagtgaaaaacactcccctgacagcgcctgcagtgtcgattacagctcaagttgtttgtcctctccagaacatccaacagaagattcagagagcacagaacccctgtctgtggatggaatctcttcagacctggaagagcccgccgagggggacgaagaagaggaggaggaggagggcgggatgggcccctacgggctccaggagggatccccccaaactcctgaccaggagcagtttctgaagcaacatttcgagaccctcgcaagtggagctgccccgggagcacccgtccaggtgcccgagcgcagcgagtctcggagcatttcgagtagatttctgctccaagtgcaaacgcgcccactacgggagccctcaccgtccagctccagtcttgcactcatgtctagacccgctcaagtccctcaagcctcggagccggcggtgagtctggagcagtgtgaacaattggtggctgagctcagagggtccgtgagacaggccgttagattgtaccatagcgtcgcgggctgtaagatgccaagcgccgagcaaagcaggattgcacagcttctcagggatacatttagcagtgtgcgccaggagctggaggcggttgctggagcagtgttaagttcccccggaagttcccctggggcagtgggggcagaacagacacaggctctgctggaacagtactcagaattgctgctgcgtgctgtggagcgcaggatggaaagaaaactttag

SEQ ID NO: 31317 - DNA, 2685 bp, Artificial Sequence
  Description of Artificial Sequence: Synthetic coding sequence
atgaacccaggatttgatctgtctagaaggaacccacaggaggactttgagttgattcagagaattggaagtggcacctatggcgacgtttacaaggcccggaatgtgaacaccggagagctggccgccattaaagtgataaaactggaaccaggcgaagattttgccgtcgttcagcaggagattatcatgatgaaagattgcaaacaccccaacatcgtcgcatacttcggttcttatctgcgcagagataagctgtggatctgtatggagttctgcggagggggaagcctccaagacatctaccacgtgaccggacccttgagtgagctgcaaatagcctacgtgagtagggagaccctccaaggcctttattatctgcactctaagggcaaaatgcatagggatatcaagggagcaaacattctcctgaccgataacgggcacgtgaagttagcagactttggtgtatcagctcagattactgccactatcgccaaacgaaaatcttttattggaactccttactggatggctccagaggtagcagccgtggagcgcaaaggtggctacaatcaactgtgtgatctctgggcagttggaattactgctattgagctggccgaattacagcctcctatgttcgatttgcatccaatgcgcgccctctttctcatgactaagtccaattttcagccacccaaattaaaagataaaatgaagtggtccaactcctttcatcacttcgtgaagatggccctcacaaagaacccaaaaaaaagaccaactgcagaaaagctgcttcagcatccgttcgtgacacagcacctgacacgcagcctggccatcgagctgctggataaagtaaataacccagaccactcaacctaccatgacttcgacgacgatgacccggaaccccttgtggcagtgccacatagaatacactcaactagtcgtaatgtgcgggaagaaaagactcgtagtgagatcacattcggccaggtcaaattcgaccctccactgcgtaaagagactgaaccacatcacgagctgcccgactctgatggattcttggatagctctgaggagatctattacaccgctcgttctaacctggacctgcagctggagtatgggcaaggtcaccaaggtggatactttctaggagccaataaatctctgctcaaaagtgtggaggaagagctgcatcaaagggggcacgtggcccaccttgaggacgatgagggcgatgatgacgaatctaagcactcgaccctaaaagcaaagattccccctcctctgcccccaaagcctaagtcaatcttcatccctcaggaaatgcacagcactgaagatgagaatcaaggaaccattaaacgctgccctatgtcaggatctccagcaaagccttctcaggttccacccagaccccccccaccgaggttgccccctcataagccggtggcactaggtaatgggatgagctccttccaattgaatggagagcgagatggatccctctgccagcaacagaatgagcatcggggaacaaacctctctcggaaggagaaaaaggatgttcccaaacccatctctaacggactgccacctacccctaaggtccacatgggcgcctgcttttccaaagtgttcaatggctgccctttgaaaatccattgcgcatcttcgtggatcaatccagacaccagggatcagtatctgatctttggggctgaggagggaatatatacacttaacctgaacgagcttcatgagacaagcatggaacagctatttccaagacgctgcacttggctgtatgtgatgaacaactgtctactctctatctcgggcaaagctagccagctgtatagtcataatctcccagggctgtttgactacgcgcgccagatgcagaagttgcctgtggctattcctgctcataagctaccggaccgtatcttgccccggaaattttctgttagtgccaagattcccgaaaccaaatggtgccagaagtgttgtgtggtgcggaatccatatactgggcacaagtatttgtgcggtgcgctgcaaacaagtatcgtgcttcttgaatgggtcgaacccatgcaaaaattcatgctgattaaacatatcgattttcctattccctgcccccttaggatgttcgagatgctggtagtccccgaacaggaatatccactggtgtgtgtgggagtatctagaggcagagactttaaccaagtggtgagatttgagacagtgaatccaaattctacttcctcctggttcaccgagtcggacaccccacaaaccaatgtcacacacgttacacaactcgaaagagacacgattctcgtgtgcttggattgctgcatcaagatcgtcaacctgcagggaaggctcaagagttctcggaagctgtcgtctgaattgaccttcgactttcagattgagtctattgtctgtttgcaggacagcgtgctcgctttttggaaacatggcatgcagggccggtcctttagatcaaacgaggtaacccaggaaatcagcgactcgactaggatatttaggctgctcggaagcgaccgcgtggtcgtactagagagccgacctacagataaccccaccgcaaatagcaatttgtatatccttgccgggcacgagaattcatactag

SEQ ID NO: 31318 - DNA, 2622 bp, Artificial Sequence
  Description of Artificial Sequence: Synthetic coding sequence
atgaaccctgggttcgacctctctcgccggaacccccaggaggattttgagctcattcagcggatcggcagtggcacttatggagacgtgtataaggcccgaaatgtgaacacgggggaactggctgccataaaggtcattaagctggaacctggagaggactttgcagtggtgcagcaagagattatcatgatgaaagactgtaaacaccccaacatcgttgcctacttcgggtcctatctccggcgagacaagctctggatctgtatggagttttgcggtgggggctctctccaggatatctaccacgtgaccgggcctttgtcagagctgcagatcgcttacgttagtcgcgagactctgcagggactctattatcttcattccaaggggaaaatgcaccgggacatcaagggtgctaatatcctgctgactgacaatggtcacgtaaagcttgctgattttggcgtgagtgcccaaatcaccgccacgatcgccaagaggaaaagcttcatcggtaccccatactggatggcaccggaagttgctgcggtagagcgtaaaggcggatacaaccaactgtgcgatctctgggccgtgggaatcacggccattgaactcgccgaattacaaccccccatgttcgatctacatccaatgcgggccctcttcctgatgacgaaaagcaatttccagcccccgaaactgaaagataagatgaaatggagcaactccttccaccactttgtcaagatggcactcacaaagaaccctaagaagcgccccaccgccgaaaagcttttgcaacacccattcgtcactcaacatctgacccgttctctggccatcgaactgctcgacaaagtgaacaatcccgaccacagtacctaccacgattttgacgatgacgaccctgaaccgctcgtagctgttccacatcgaattcattcgacctctagaaacgtccgagaggaaaaaacaagaagcgaaatcacctttggacaggttaaattcgaccctcctctgagaaaagaaaccgagcctcaccacgaactggacctgcaacttgagtatgggcaaggccatcaaggcggctattttctgggcgccaacaaatccttattgaaatcagtagaggaagagctacaccagcggggtcacgtagcccatctggaagacgatgaaggagatgatgatgagtctaagcattcgacccttaaagccaaaataccacccccattgccacccaaaccaaagtccatcttcattccccaggagatgcatagtaccgaggacgagaaccaggggaccatcaaacgctgtcctatgagtggctccccagccaagccgtcccaagtaccacccaggccaccccctcctcggctgcccccgcataaacccgttgcgttagggaatgggatgtccagtttccagctgaacggtgaacgagacggctctctatgccaacagcagaacgagcaccgcggtaccaatctgtcgcgcaaggaaaaaaaagacgttcccaagcctatcagtaacggcttgccacccacacctaaagtgcacatgggagcatgcttctctaaggtctttaacggctgtcctctcaagatacactgtgcctcttcctggatcaacccagacaccagagatcagtacctcattttcggcgctgaggaaggcatctataccctgaatctcaatgaactgcacgagacctccatggagcagttgttccctcgacgctgcacatggttgtacgtcatgaacaattgtttgctttcaatatctggaaaggcctcacagctctatagtcataacttaccgggtctctttgattacgcaagacaaatgcaaaagctgcctgtggccattccagcacataagctgcccgaccgcattctgcccagaaagttttcagtgagcgccaagattcctgagacaaaatggtgtcagaagtgctgtgtagtgaggaacccttacaccgggcataagtatctgtgtggcgccctgcagacttctatcgtgctcctcgaatgggtggagccgatgcaaaaatttatgcttatcaagcatatcgacttccctatcccatgtcccctcaggatgttcgaaatgctggtggttccggaacaggagtaccccctcgtgtgtgttggggtgtcccgcggccgagactttaaccaggtcgtccgcttcgagaccgtaaacccaaactctactagttcttggttcactgagtccgacaccccccagacgaatgtaacccatgtgacacagctcgaaagggatacaatcctcgtgtgcctggattgctgcatcaagattgtgaatttacagggtcggctcaagtctagcagaaaactatcaagtgagctgacattcgacttccagatcgagtccatcgtgtgcttacaagatagtgtgctcgctttctggaagcacgggatgcagggtcgatcctttcgaagcaacgaagtcacacaggagatctcggacagcacacgtatttttcgactactcgggtcagacagggtggtggtgctcgagagccgacccacagacaaccctacagccaacagtaacctctacatcctggccggacatgaaaattcttactag

SEQ ID NO: 31319 - DNA, 1344 bp, Artificial Sequence
  Description of Artificial Sequence: Synthetic coding sequence
atgcactccactgaagatgagaaccaggggaccatcaagcggtgtcctatgtcaggctcgcccgctaagccatctcaggtgccaccacgcccacctcctccacgactccccccgcacaaaccagttgccctcgggaacggaatgagtagttttcagctcaacggcgaacgggacggctccctgtgccagcaacaaaatgagcatcgtggtaccaacttaagccgcaaggaaaaaaaggatgtcccgaagcctattagtaatggactgccccctacccctaaagttcatatgggcgcctgcttcagcaaggttttcaatggatgtcccctgaagatccactgcgctagctcttggattaatccagacactcgtgatcagtatctaattttcggggctgaggagggtatctatactctgaatctgaacgagctccacgaaacatcaatggaacagctcttcccccggaggtgtacatggctgtatgtcatgaacaactgcctgttgagcatcagtgggaaagcttcacagctgtatagccataatctcccaggactgttcgactacgctcgccagatgcagaaactgcccgtggctatccccgcgcacaagctacccgaccgaatcctgccccgtaagttttctgtttccgctaagatccccgagaccaagtggtgccagaagtgctgcgtcgtcagaaacccctacacagggcataagtacttgtgcggcgccctgcagacaagcatagtacttctggagtgggtggaaccaatgcaaaaattcatgcttatcaaacacatcgatttcccgattccgtgccccctccgcatgtttgagatgctcgtggtgcctgagcaggaatatccgctggtatgcgtgggcgtgtcacgtggaagagacttcaaccaagtggttagattcgaaaccgtcaaccccaacagtaccagcagttggttcactgaatctgacaccccacaaacaaatgtaactcatgtgacccagctggaacgggataccattctggtttgcctcgattgttgcatcaagatcgtgaacctgcaaggccggctcaaaagcagtcgcaaactgtcatcagaactgacatttgatttccagattgagtcaattgtctgtctccaagacagcgtgcttgccttctggaaacacggaatgcaagggagaagtttcagatctaacgaggtaactcaggaaatctccgatagcactcgcattttcaggctgctggggtctgatcgggtggtagttctcgaaagtagacctacagacaacccaactgcaaattccaacttatatatcctcgcaggtcacgagaattcctactag

SEQ ID NO: 31320 - DNA, 480 bp, Artificial Sequence
  Description of Artificial Sequence: Synthetic coding sequence
atgcagaagtttatgctgataaaacatattgactttccaattccttgccccttaagaatgttcgagatgctggtggtccctgagcaggagtatcccctggtgtgtgtgggcgtaagtcggggccgggattttaaccaagtagtgaggtttgagactgttaaccctaactccaccagcagctggttcactgaatccgatactccacaaacaaacgtcacccacgtgacacagttagaacgcgacactatcctcgtctgccttgactgctgcatcaaaatcgtcaatctgcagggccggctgaagagctcccggaagctgtcgtcggaactgaccttcgacttccagatcgagtctatcgtgtgtttacaagactccgtactggcgttctggaagcacgggatgcagggaaggagctttcgaagcaacgaggttacccaggagatcagcgatagcaagaactttcaggccgcatggatttag

SEQ ID NO: 31321 - DNA, 1449 bp, Artificial Sequence
  Description of Artificial Sequence: Synthetic coding sequence
atgttttttctggttacctccgacgaatccaacaaaacgtggggcagaaataccgttttccggcaggaggagtttgaagacgttaagaggaatttcaagaaaaagggttgcacgtggggcccaaacagtatccagatgaaggataggactgattgcaaggaacgcatcaggcctctcagcgacggtaacagtccctggagcacaattcttataaagaatcaaaaaaccatgccactagccagcctgttcgttgatcagccaggaagctgcgaagagccaaagctgtctcccgacggcttggagcatcggaagcctaagcagattaagctccccagccaggcatacatcgacctgcctctaggcaaagacgcccagcgcgagaacccagccgaggccgaatcatgggaagaagctgcctccgctaatgcagctaccgtctccatcgaaatgacacccaccaacagtctcagccggagcccccagcggaagaaaacggagtccgctctttacggttgcaccgtcctgctggcctctgtagccctaggtctggacttgagggaacttcacaaggcacaggctgctgaggagcccttgccgaaggaggaaaagaagaagcgagagggaatctttcagcgggcgtccaaatcacgcagaagcgcatctccccctacaagcctccccagtacctgtggtgaggctagtagccccccctccttgcccctctcatctgcgctgggaatcttgagtaccccgagtttcagcactaagtgtctcctgcagatggatagtgaggaccctctggtcgattcagccccagtaacatgtgattcagagatgttaacacccgatttttgtcccacagcacccgggagtggccgcgagccggcgctcatgccacgccttgatactgactgtagcgtctccaggaatcttccatcctcattcctgcagcagacgtgtggtaatgtaccatactgcgcatcttccaagcatcggcccagtcatcaccgtcggacaatgagcgacggcaatcccacaccaacaggcgccacaatcatctcggctaccggcgcctcagctttacctctgtgcccgagccctgccccacattcgcacctgcctcgggaagtgtctcccaaaaagcacagcactgtgcatattgtgcctcaaagaagacctgcatcactgcggtcccggagtgatttacctcaggcgtatcctcaaaccgctgtgagccaattggcccaaacagcctgtgtcgtgggccgccccggaccgcaccctacccaattcttagctgcaaaagagcggaccaaatctcacgtgccctctctcctagacgccgacgttgaaggtcagtcccgagattacaccgtcccactgtgtcgcatgaggagcaaaacgtcccgcccctcaatctacgaactggagaaagaattcctaagttag

SEQ ID NO: 31322 - DNA, 1713 bp, Artificial Sequence
  Description of Artificial Sequence: Synthetic coding sequence
atggctctgaggggggcagcaggagccactgatacacccgtgtcatcagccggtggagcacctggcggctccgcctcttcatcatctaccagctctggcgggagtgcctccgcgggggccggtctctgggcagccctgtacgattatgaggcacggggtgaagacgaactgtcccttcgcagaggtcaactagtggaagtgctttctcaagacgccgctgtctctggggatgaaggatggtgggctggccaagtgcagagaagactgggcatttttcccgcgaactatgtggctccctgtcgaccagccgcgtctccggctccacccccgtcaagaccttcaagccccgtgcatgttgcctttgagcgcctcgagcttaaggagcttatcggggccggcgggttcggacaagtctaccgggcaacttggcaagggcaggaagtcgcagtgaaggccgctagacaggatcccgaacaggacgctgccgccgctgctgagagcgtgcgacgagaagcccggctgttcgccatgctgcgccaccccaacattatcgaactccgcggggtatgcctgcaacagccgcacctgtgcctggtcttggagtttgccaggggaggcgcactaaacagggcccttgccgccgccaacgcggctcccgaccctcgtgctcccggcccacgacgcgcccgcaggatccctcctcacgttcttgtaaactgggctgtgcaaatcgctaggggaatgctgtacttacacgaagaggccttcgtgcctatactacatcgtgacttaaagtcttccaacatccttctgctggaaaaaatcgagcacgatgacatctgcaataaaaccctcaagattaccgactttggcttggctcgggagtggcataggaccacaaaaatgtcaactgccggaacgtacgcctggatggcccccgaagtgattaagagttccctgttctctaagggcagcgacatctggtcttacggcgttttgttatgggagctactcacaggtgaggttccatatagagggattgacgggttggccgttgcttacggcgtcgccgttaacaagctcacgctgcctataccgagcacatgcccagagccttttgccaagttgatgaaagaatgttggcagcaagaccctcacatcaggccctcttttgcactgatacttgagcaacttaccgcaatagaaggagccgtgatgacggagatgccccaggagtcctttcactctatgcaagatgattggaagctcgagattcagcagatgtttgacgaattaaggaccaaggagaaggagctccgaagccgcgaagaagagctaaccagagccgctttgcagcagaaatcacaagaagagctgttaaaaagaagggagcagcagttagccgagcgtgaaatagacgtgctggagcgggaactgaacatcctgatcttccagctgaaccaagagaaaccaaaggtcaagaagcgcaaggggaaattcaagagatcccggctcaaactgaaggacggccaccggatttccctgcccagtgacttccagcataaaattaccgtgcaagcaagccccaacctagataaacgaaggtccctcaacagctcaagttcttctcctcccagtagtcctactatgatgccccggctcagggccatccagtgcgagctatcagctctgcctcgcggactgctctgctag

SEQ ID NO: 31323 - DNA, 3111 bp, Artificial Sequence
  Description of Artificial Sequence: Synthetic coding sequence
atggctctgcggggagccgccggcgccactgacactccagtgtccagtgctggaggtgccccgggaggaagtgctagcagtagttccaccagttcaggcggttctgcctccgccggcgccggactgtgggcggcgctgtacgactatgaagcccgcggggaagacgagctttcactgaggaggggccagctggtggaagttctgtctcaggatgctgccgtcagtggcgatgagggctggtgggctggacaggtacagcgacgtctgggtatttttcccgctaattatgtcgcgccctgccgtcctgccgcatccccagcccccccaccctcccggccctccagcccggtccatgttgccttcgaacgcctggagctaaaggagctaattggggccggtgggttcgggcaggtgtacagagctacttggcaggggcaggaggttgcagtcaaagccgctagacaggacccggaacaagatgctgctgccgcggctgagagtgtccgccgcgaggctcgcttatttgctatgttaagacaccccaatattatcgaactgcggggcgtgtgtctacagcagcctcatctctgcctcgtcctggagttcgcccgcggcggtgccctgaaccgagcgctggctgccgctaatgcagcaccggaccctagagcccctgggcccaggcgcgcgcggcgcatcccaccccacgtcctggtgaattgggccgttcagattgcccgcgggatgctgtacttacacgaggaggcctttgtcccgattctgcaccgcgacttgaagtcctccaacattttgttattggaaaagatcgagcatgacgatatctgtaacaaaacgctgaaaatcacagatttcggcctggcccgagagtggcacaggacaactaagatgagtaccgcgggtacctacgcatggatggcccccgaggtcatcaaaagcagcctgttcagcaaaggatcagatatttggagttacggagtgttgctgtgggagttacttacaggcgaggtcccctacagaggtatcgacggcctagccgtagcctatggcgtggccgtcaataagctcacattgcccatcccatcaacatgcccagagccctttgccaaacttatgaaagagtgttggcagcaggatccacacattcggcccagttttgccttaatcttggaacagttaacggccatcgaaggcgctgttatgactgagatgccccaagagagtttccacagtatgcaggatgattggaaattggagatacaacagatgttcgatgagctgcgtacgaaagagaaggagctgagatcacgggaggaagaactgactcgtgccgcccttcagcagaaatcacaagaagaactgcttaagaggcgggagcagcagttagcggaacgggagattgacgtgttagagcgggaactgaatattctgatttttcagctcaaccaggaaaagcccaaggtgaagaaaagaaaaggaaaatttaagcgttcccgattgaagttgaaagatggacatcgtatctccctcccaagtgactttcagcataaaattactgtgcaggcctctcctaatctggacaaacgaaggagtctgaactcgtctagctcctctcccccctctagtcctactatgatgccccggcttagagccatccaactaaccagcgatgagtcaaataaaacttggggacgtaatacagtgtttcggcaggaagagttcgaggacgtgaagcggaacttcaaaaaaaaaggctgcacctggggcccgaattcgatccagatgaaggatcgcacggactgcaaagaacggattagaccactgtccgacggaaattccccctggtccaccatccttattaaaaaccagaagacgatgcccttagcaagcctcttcgttgaccaaccgggatcttgtgaggaacccaagcttagtccagacgggctggaacaccggaagcccaaacagatcaagctcccaagccaggcctacattgacctccccctgggcaaagacgctcagagggaaaacccagccgaagctgaaagttgggaagaggccgcctcagccaatgcagccaccgtgagtattgagatgacccccactaacagtctgtcccgtagccctcagcggaaaaaaactgaaagtgctctttacggctgcacagtgctgcttgccagtgtagcactgggcctcgacttaagagagctgcacaaagctcaggcagccgaggaaccactgcctaaggaggagaaaaaaaagagagaaggaattttccagcgcgcaagcaagtctaggcgatcggcctcaccacccacctctctgccgagcacgtgcggagaggcatcctcccccccatcactgcctttgtcctccgccctgggaattctgagcactccatcctttagtactaagtgcttgctgcagatggacagtgaggatcctttggttgattcagcccctgtaacatgcgacagtgagatgttaacccccgacttttgtccgactgccccaggtagcggaagggaacctgctctgatgccccggctggatactgattgcagcgtttccaggaaccttcctagctccttcttgcagcaaacttgtggtaatgttccctactgtgcctccagcaaacacagaccgtcccatcaccggagaaccatgtccgatggaaaccctacaccgacaggtgccaccattatcagtgcgacaggagcttccgcactcccgctctgtccttctcctgcccctcattcccatctccccagagaagtctctccaaagaagcatagcacagtgcacatagtcccgcaacgtagacctgcgtctcttcggtctcgatcagacttaccccaggcctacccccagacggccgtgagccagcttgcacagaccgcgtgtgtggtgggacgacccggcccacaccctacacaattcctcgcagccaaagaacgcacgaagagccacgtgccgagcctcctggacgctgacgtggaaggtcaaagccgggattatactgtgcctctttgtaggatgaggagcaagacttccagaccaagtatctacgaactggaaaaggagttcctatcatag

SEQ ID NO: 31324 - DNA, 792 bp, Artificial Sequence
  Description of Artificial Sequence: Synthetic coding sequence
atggagaatttaaagcacattataacacttggacaagttatacacaaaaggtgcgaggagatgaagtattgcaaaaagcagtgccggcggctggggcaccgcgtcctcggcctgattaaacctctggaaatgctgcaggatcagggtaagcgctccgttcctagtgaaaagctcaccactgctatgaatcgcttcaaagctgccctggaggaggctaacggggagattgaaaagttctccaacaggtccaatatctgtagatttctcactgccagccaggacaagattctcttcaaagacgttaatagaaagctgtccgatgtatggaaggaactatcactgctgcttcaggttgagcagaggatgcccgtgtccccaatttcacagggagctagctgggctcaggaagaccaacaagacgccgatgaagatcggcgagcctttcagatgttgcggcgcgataacgagaaaatcgaagcctccctgagacgactggagattaacatgaaggaaattaaagagacactgcgacagtcactggagtcctccagcggcaagtctcccctcgagatatcaaggttcaaggtaaaaaatgtgaagacaggctccgcaagcgggtgcaattccgagaagatccggaaactagtggcggtgaagaggcagcaggagccactgggcgaggattgcccaagcgagctgagagagattatcgatgaatgtagggcacacgacccgtcagtgcggccgtccgttgatgaaatcctaaaaaaactgagtacattctctaagtag

SEQ ID NO: 31325 - DNA, 1416 bp, Artificial Sequence
  Description of Artificial Sequence: Synthetic coding sequence
atggaaaatctgaaacatatcattacactgggccaggtaatacataaaagatgcgaggaaatgaagtattgcaagaaacagtgcaggagactgggccaccgggtgctgggtctaatcaagcccctggagatgcttcaggaccagggcaaacggtccgtgccaagcgaaaagttgacgactgctatgaatcgttttaaagccgctcttgaagaggcgaacggtgagatcgagaagtttagtaataggagcaatatttgccggttcctgactgcgtcccaggataaaatcttgtttaaagacgtcaacaggaaactgagtgatgtctggaaggaactcagcttgctcttgcaggtggaacagcgcatgccagtctcccctatctcgcagggcgctagctgggctcaggaggaccagcaggacgccgatgaggatagaagggctttccagatgctgaggcgtgacaatgagaagatagaggctagcttgaggcggctggaaattaatatgaaagaaattaaagaaacgctgcgacaatacctcccaccaaagtgtatgcaggagataccacaggaacaaataaaggagattaagaaggagcaactaagtggctctccctggattctccttagggaaaacgaagtgagtaccttgtataagggggagtaccatcgggcccccgtggctatcaaggtttttaagaagctgcaagctggttcaatagctatcgttagacaaactttcaacaaggagataaagaccatgaaaaagtttgaatcgccaaacatcctgcgcatatttggcatctgtatcgacgaaaccgtgactcccccacaatttagcatcgtgatggagtattgtgaattaggcactctgagagaattgctcgaccgtgaaaaggatctcactctgggaaagaggatggtgttagtgctgggcgcagcccgagggctttatagactccaccactcagaagctccagagctgcatggtaagatacgcagctcaaattttcttgtcacacagggataccaggtcaaactcgcagggttcgagctaaggaaaacccagacttcgatgagtctggggactactcgcgagaagaccgaccgcgtgaaatcaacggcgtacctgagccctcaggagctggaggatgtgttctaccaatacgatgtcaagtctgaaatatactcttttggaatagttctctgggaaatcgccactggcgacataccctttcaaggatgcaattcagagaagattcgaaaactcgtggcagtcaagagacagcaggaaccactgggagaagattgtccatcagagttacgcgagattatcgacgagtgtcgggctcacgacccgagcgtccgcccttctgtagacgagatccttaaaaagttgtctactttctctaagtag

SEQ ID NO: 31326 - DNA, 651 bp, Artificial Sequence
  Description of Artificial Sequence: Synthetic coding sequence
atgtcattcctgttctcatcacgcagctcaaagacctttaagcctaagaagaatatccccgaaggcagccaccaatacgaactgctgaagcacgcagaagccaccttaggctctggcaatctgcgccaggctgttatgttacctgaaggcgaggatttgaacgaatggatagctgtcaatacagttgacttctttaatcagattaatatgctgtatggtacgatcaccgaattctgcaccgaggctagttgccctgtgatgtccgccgggccaagatacgaataccattgggccgacgggacgaacatcaaaaagccaatcaagtgttcggccccaaagtatatcgactatctgatgacctgggtgcaggatcagttggacgatgaaacactattcccaagcaaaatcggcgtgccatttccaaagaattttatgtccgtagccaagacaatcctcaaaaggctttttcgcgtgtatgcacacatctatcatcagcattttgactctgtgatgcaactgcaggaagaagcccacctgaacacttctttcaagcattttatcttcttcgtgcaggaatttaatctcatcgatagacgggaactggctccattacaggaactgattgaaaagttaggaagtaaggaccgctag

SEQ ID NO: 31327 - DNA, 447 bp, Artificial Sequence
  Description of Artificial Sequence: Synthetic coding sequence
atgttgttctacctcagctccagatccagcaaaaccttcaagcccaaaaaaaatatccccgagggctcacaccaatacgaacttctcaagcacgccgaggctactctaggttccggcaatctccggcaggccgttatgttaccagagggcgaagatctcaatgagtggattgcagttaatacggtggatttcttcaaccagatcaatatgctgtatgggactataaccgagttttgcaccgaggcttcttgccctgttatgtctgctgggccccggtatgagtatcattgggccgacggcactaacatcaaaaagcccatcaaatgcagcgcacctaaatacatagactacttgatgacatgggtccaggatcagctcgacgatgagaccctcttcccttctaagattggagaactcacattgtcaaaatactccttttttttctag

SEQ ID NO: 31328 - DNA, 807 bp, Artificial Sequence
  Description of Artificial Sequence: Synthetic coding sequence
atgcttggcgatcactgcagcctccccgaggatcaagctcgacctggtcaatccctgcagtccggactgtgttgtaaaatggtcctgcaggcagtttcaaaggttttgcgtaaatcaaaggccaagccaaatggcaagaagccagcagctgaagagagaaaggcctacttagaacctgaacacacaaaagccaggatcacggatttccagttcaaggagctggtggtgctcccaagggaaatcgatctcaatgaatggctggcttctaatactactaccttctttcaccacatcaatttgcagtattctaccatcagtgaattttgtacaggagaaacttgccaaactatggccgtgtgcaatactcagtactactggtatgacgagcgaggtaagaaggttaaatgtacagctcctcagtacgttgactttgttatgagttcagtccaaaagctcgttaccgatgaagacgtattccctacgaagtacgggcgcgagttccccagctcattcgagtccctcgtaagaaagatctgcagacacttgttccacgtgctggctcacatttactgggcgcatttcaaagaaacactggcgctcgaattgcatgggcatcttaacaccctgtatgtccactttatactgtttgctcgagaatttaacttgcttgatcctaaagagaccgcaataatggatgaccttactgaggtgctatgctctggcgcagggggcgtgcactcgggcgggagcggagacggagccggtagcggcggcccgggagctcaaaaccatgttaaagaaagatag

SEQ ID NO: 31329 - DNA, 654 bp, Artificial Sequence
  Description of Artificial Sequence: Synthetic coding sequence
atgtctaatccattcctgaaacaggtgttcaacaaggataaaacctttaggcccaaacgtaagtttgaacccggaactcaacgttttgaactgcataaaaaggcacaggcttctctcaacgcaggcctcgacctccgcctggccgtgcaactaccgcctggggaagaccttaatgactgggtggcggtgcatgtcgtggattttttcaacagagtgaatcttatctatggaacgatctctgacgggtgcaccgaacagtcctgtccggtgatgtctggcggacccaagtacgaatatcggtggcaggatgagcataaattcaggaaacccactgctctgagtgcccccaggtacatggatttactgatggactggatcgaggctcagatcaataatgaggatcttttcccaaccaacgtgggcacaccctttcccaagaactttctgcagacagtccgcaaaatcctgtctcgactcttcagggtgtttgttcacgtctatatccaccatttcgatcggatcgcgcagatgggtagcgaggcccacgtcaacacatgttataagcacttttattattttgtcaaagaattcgggctgatagacactaaagaattggaacccctcaaggaaatgacggcccggatgtgtcattag

SEQ ID NO: 31330 - DNA, 651 bp, Artificial Sequence
  Description of Artificial Sequence: Synthetic coding sequence
atgtcgatagccctgaagcaagtgtttaataaggataagacttttcgccctaaacgaaagtttgaacccgggacccagcgctttgagctgcataagagggcccaggcttccctgaacagtggcgtggacctgaaagcagctgtccagctccccagcggcgaagaccagaacgattgggtagccgtccacgtcgtggacttcttcaatcgaataaacctcatctacggcaccatttgtgagttttgtactgaacggacttgcccggtgatgtctggagggccgaagtatgaataccgatggcaggacgacctgaaatacaagaagcccaccgcacttccggctccccagtatatgaaccttctcatggactggatcgaggtgcagatcaataatgaagaaattttcccaacttgcgtgggagtgccgttcccgaaaaattttctccagatctgcaagaagattctttgccggttatttcgtgtcttcgtgcacgtgtacatccatcactttgaccgggtgatcgttatgggggctgaggctcatgtaaatacttgctataagcatttttattactttgtcaccgagatgaacctgatcgataggaaagagctggaacccttgaaggagatgacgtctcgaatgtgtcattag

SEQ ID NO: 31331 - DNA, 807 bp, Artificial Sequence
  Description of Artificial Sequence: Synthetic coding sequence
atgaagagacggaacctgtttgctttggaaactggggtcccaccatggggcctcctgtgggtacgctccagacgggtgggtatggacgagatgacctttcacatatggtatccacaggtgcgtgccccgggccagcagccacaggcacagctggccatggctctgtgtctgaaacaagtgttcgccaaagataagacattccgaccacgaaagcggtttgagcccgggactcagcggttcgaattgtacaagaaagcacaggccagtctgaagtccggactggacctccgttccgtggtcagactgcccccaggcgaaaacatcgacgattggatagccgtgcacgtcgtggacttctttaatagaatcaatcttatctatggaaccatggctgagagatgctccgaaactagctgccccgtgatggctggcggccctcgctacgagtaccggtggcaggacgaacgccagtacagacggccagcaaagctgtctgcccctagatatatggcactgcttatggactggatcgaaggtttaatcaatgatgaggaggtatttccaactcgtgtcggggtacctttccccaaaaactttcagcaggtgtgcactaagattctgacccgcttgtttcgggtgttcgtccacgtatatatccaccattttgactctatcttgtccatgggtgctgaggctcatgtgaacacttgctacaagcacttctactactttatcagggaattcagtttggtggaccagagggagctagaaccactacgggagatgaccgagcggatctgccactag

SEQ ID NO: 31332 - DNA, 651 bp, Artificial Sequence
  Description of Artificial Sequence: Synthetic coding sequence
atggcgctttgcctaaaacaggttttcgctaaagataagacttttagaccccgcaagagattcgagcctggaacccagagatttgagctgtataagaaggcacaggcaagtctgaagtcaggtctggacttacgctccgtggtccgcctgccccccggagagaacatcgatgactggattgccgtgcacgtggtggacttcttcaacagaatcaacctgatttacgggaccatggcagaacgttgtagcgaaacgagctgccccgtgatggcaggagggccccggtatgagtatcgctggcaggacgaaaggcagtatagacgtcccgcgaagcttagtgctcccagatatatggccttgcttatggactggattgaggggttaattaacgatgaagaggtcttccctacccgcgttggagttccatttcccaaaaactttcaacaggtgtgtaccaaaatcttaacccgtctgttccgtgtattcgtccatgtgtacatccatcacttcgacagcattcttagcatgggcgcagaagcccacgttaatacatgctataagcatttctattactttattcgtgaattcagcctcgtggaccaacgcgaactggaacccctgagagaaatgacggaaaggatttgccactag

SEQ ID NO: 31333 - DNA, 720 bp, Artificial Sequence
  Description of Artificial Sequence: Synthetic coding sequence
atgcctctgtccctcgccgggtacccgcaggtgcgggcacctggccagcagccccaggcacagctcgcgatggctctctgcttgaaacaagtgttcgcgaaggacaagaccttccgcccccgaaaacgtttcgagccagggactcaacggtttgagctctacaagaaagctcaggcttccctcaagagcgggttagacctgaggtcggtcgtaagattacctcccggcgaaaatatcgatgattggatcgcagtgcatgttgtcgatttctttaacagaattaatctaatatacggaacaatggccgagcgctgttcagaaacgtcctgtcctgtcatggccgggggccctaggtacgagtaccgatggcaggacgagagacagtatcggcgccctgcgaaactgtctgccccaaggtatatggcacttcttatggactggatcgaaggcctaatcaacgacgaagaggtgttccctactcgcgttggcgttccttttccaaagaacttccaacaggtctgcacgaaaattcttactaggttgtttagggtgtttgttcacgtgtacattcatcatttcgactccattctcagcatgggagcagaggctcacgtaaatacctgttacaagcacttttactactttatccgcgaatttagcctggtggaccaaagggaactcgagccgctgcgcgagatgacggaacgcatctgccactag

SEQ ID NO: 31334 - DNA, 1959 bp, Artificial Sequence
  Description of Artificial Sequence: Synthetic coding sequence
atgcatcccgggggaggtccaagtagagcagagaggttagagctaggcctaggacgggagaggcctgccaaggcaatttttctgcacaggcggcctggcgaaggaggtggtcgtgaacggtgtctgcgctgtggccatgtgtgtgttcgcaggggaccaggccctcgggaggccgtgccatctggccgtcccaggccagacaccctcacacccccctgggtccgacagcgtgcagtgaccggaacattttgtgcaagttggacacccctgcgaaatcggagagcccagcggatggccaccgatatgcagagaaagcgctcttcggaatgcctggatggtactcttacgccaagcgacggccagtcaatggaaagggctgagtcgcccactccaggtatggcacagggcatggaaccaggagcagggcaggaaggcgccatgtttgtccatgctcgaagctacgaagatctcactgagagtgaggacggcgccgcttccggcgacagtcataaagaagggaccagagggcctcctccactcccaacagacatgaggcagattagccaggatttcagcgaattatctacacaactgactggtgtcgccagagacctgcaagaggagatgctgccagggtcgtcagaggattggctagaaccgccaggcgcagtcgggcggcctgccaccgagcccccgcgcgagggcactacagagggagacgaagaggatgctactgaggcttggcgtctgcaccaaaaacacgtgtttgttcttagcgaagccgggaaaccagtatattctaggtatggttcggaggaggccttgtctagcactatgggtgtgatggttgctctggtcagctttttggaggctgataagaatgctatcagaagcatccacgctgacggatataaagtagtgttcgttagacggtctccgctggtcctggtagcagtcgctcggactcgacaaagtgctcaggaactggcacaggaactgttgtacatctactatcaaatattatcactgctgaccggcgcgcagctttcccatatcttccagcagaaacagaattacgatcttcggaggctgttaagtgggtctgaaagaattactgacaatttgttgcagttaatggcccgggacccttcctttctgatgggcgccgcccgttgtctgccactggccgccgcagtgcgagatactgtctctgcaagcctgcaacaagcacgggcccgctcgctggtgttctcaatattgctcgcaaggaaccagctagtggccctggtgcgcaggaaagaccagtttctgcatcccattgatctgcacctgctgttcaacctaatctcttccagcagctccttcagggagggggaggcttggacacctgtgtgcctccctaagttcaacgccgctggattcttccacgctcatatcagctacctggaaccagacaccgatctgtgtctcctgttagtgtctactgacagagaggatttttttgccgtgtctgattgccgaagacgcttccaggagcgccttcgcaagcgcggggctcatttggccctgagagaggcgctacggacaccctactacagcgttgctcaggtgggcatccctgaccttcggcattttctctacaaatccaagtcaagcgggcttttcacgtctccagagatagaagccccttatacctcagaagaggaacaggagagattattaggtctgtatcagtatctgcactcccgagcacacaatgctagcagacctctgaagaccatttactacaccggaccaaacgagaacttgctggcctgggtgactggagcatttgagctctacatgtgctactctcctcttggaaccaaggcgtctgcggtgtctgctatccataagctgatgaggtggatacgcaaggaagaggaccggttattcatccttacaccactcacgtactag

SEQ ID NO: 31335 - DNA, 1473 bp, Artificial Sequence
  Description of Artificial Sequence: Synthetic coding sequence
atgcaccccggcggcggtcctagtagagccgagcgacttgagttgggcctgggccgagagaggcctgccaaggcaattttccttcacaggaggccaggcgagggaggcggccgcgagcgctgccttcggtgtgggcatgtgtgcgtaagaaggggacccgggccacgcgaggccgtcccctccggtaggcctcggcctgacacccttactccaccctgggtcagacagcgggcagtcacaggaacgttctgcgcaagttggacgcctctgcggaaccgcagggcacagcgcatggccaccgatatgcagagaaagcggagctccgagtgcctggacggcactttgaccccatccgacggccagagtatggagcgagcagagtcccctacacccgggatggctcaaggaatggaaccagacggatataaagtggtgtttgttaggaggtcgccactcgtgctggtggccgtggcccgaaccagacaatccgcccaggaacttgcacaagaactgctctatatctattaccagatcttgagcctcctgacaggggcgcaattgtctcatattttccaacagaagcagaattacgacctgagacgtctgctctcgggatcagaaaggatcaccgacaaccttctgcagctaatggcacgcgatcccagctttctcatgggagctgcacgctgtcttcctcttgcagccgctgtgagggacacagtatctgcttcactgcagcaggcaagagccaggagcctggtcttcagtattctgcttgcccgaaatcaactcgtggctttagtgcgccgtaaagaccaattccttcatcctatcgatctgcatcttcttttcaacctgataagctctagctcatccttcagagaaggggaggcatggactccagtctgcttgccaaagtttaatgcagccgggttcttccacgcacatatctcttatctggagcccgacacagatctctgtctgttgcttgtgagtaccgacagagaggacttctttgcagtgtctgattgtagaaggcgcttccaagaaaggctccggaaacgtggtgcccatcttgccctcagagaagctctgcggactccctattacagcgtcgcacaggtcggcataccagacttgcgccattttctatataagtctaagtccagtggcctctttacctctcccgagatcgaggccccttatacttccgaagaagagcaggagaggctccttggcttgtaccagtaccttcacagccgggctcacaatgcctcgcggcccctcaagaccatctactatacaggacccaatgaaaatctgctggcatgggttaccggtgcctttgagctgtacatgtgctatagccccctaggaaccaaggccagtgccgtgagcgcaatacacaagctcatgaggtggattagaaaggaagaggatagactgttcatcctgacacctcttacctactag

SEQ ID NO: 31336 - DNA, 2043 bp, Artificial Sequence
  Description of Artificial Sequence: Synthetic coding sequence
atggggtgcggaaccaaagaacccaagataacccagttatgtttggcagccattcaacgcctcatgtctcacgaggtggtttctgagacagccgccggtaacatcatcaacatgttgtggcagctgatggaaaacagcctggaggaacttaaactgctacaaacagtccttgtactcctgactacaaatacagttgttcacgacgaggctctttctaaggcaatcgtgttgtgctttcgattgcacttcacgaaggacaacatcaccaacaacacagcggccgctactgtacggcaagttgtgaccgtggtattcgagcggatggtggccgaggatgaaagacacagagacatcatcgagcagccagtacttgttcaaggaaatagcaacagaagatctgtgtctacactgaaaccttgtgcaaaggatgcttatatgctctttcaggacctgtgccagctagtcaacgccgacgccccctattggctggtcggcatgaccgaaatgactagaacgttcggcctagagctactggagtcagttctcaatgacttccctcaggtgttcttgcagcaccaggaattctcctttctgctgaaagaacgagtgtgtcccctggtgatcaaacttttctcccccaacatcaagttcaggcaggggagtagcacctccagctcacccgcacccgtggagaagccatacttccccatctgcatgcggctgctcagggtggtcagcgtcttaattaaacagttctattctcttcttgttactgaatgtgagattttcctcagcctcctggtgaagtttctcgacgccgataaaccccaatggctgcgagctgtagcagtagaaagcatccacagattctgtgtgcagcctcagctactgagatctttttgtcagagctacgatatgaagcagcactcaaccaaagtgtttagggacattgtgaacgccttaggatcattcatccaaagcctcttccttgtgccgcccactggcaatcctgcgacaagtaaccaggctggtaacaataatctcgggggctctgtttccgctccggccaacagcggaatggtgggtatcggcggtggagtgacgttactaccggccttcgaatatcggggcacgtggattcccattctgacaataaccgtgcaaggttcagcaaaagctacctatttggagatgctggacaaggttgaacctcctacaattcctgagggctacgcaatgtcagtggcatttcattgtttacttgatctggtccgtggaatcacatccatgatcgagggcgagttgggtgaactagagaccgagtgtcagaccacaacagaggaagggtcttcccccacacagagcaccgaacaacaggatctacagtccacatccgatcagatggacaaggaaattgtttcacgggccgtatgggaagagatggtgaacgcctgctggtgcggcctcctcgccgccctaagcctcctgctggacgcctcgacggatgaagcggcgaccgaaaatatccttaaggctgagttaacaatggccgctctctgtgggcggttgggcctggtgacctccagagacgcatttatcaccgccatctgtaaggggtccctgcctccccactatgctctcacagtcctgaacactacgaccgccgctaccctgtccaacaaatcctacagtgtccaggggcagtcagtcatgatgatatccccaagttctgaatcccatcaacaagtcgtcgcggtcggccaaccgcttgccgtccagcctcagggcacggttatgctgactagcaagaatattcagtgtatgagaacactacttaacctggctcattgccacggggctgttctaggaacatcgtggcagttagtgctggccacccttcaacacctggtttggatcctgggattgaaaccttcctctggtggcgccctgaagccagggcgcgcggtggaaggtccatccactgtaccctttaaggactttatgcaaccacccgcttcacgtgtgcagaatggagaaagctag

SEQ ID NO: 31337 - DNA, 5031 bp, Artificial Sequence
  Description of Artificial Sequence: Synthetic coding sequence
atgagcggcacctcctcacctgaggccgtgaagaaactgctggaaaacatgcagtctgacctccgggcgctgagccttgaatgcaagaagaaatttcccccagtcaaggaagcggcagaatctgggatcatcaaagtaaaaactattgcagcgcgcaacaccgagatactcgcagcgttaaaagagaacagctctgaagtggtgcagccgttcctcatgggttgtggcacaaaggaacccaagataacccaactctgtctggccgcaatccagaggctcatgagccatgaagtggtctctgaaacggctgctgggaatatcattaacatgctctggcagctcatggaaaatagcctggaagagctcaaactgctgcaaaccgtgctcgtgctcctaaccacaaatactgttgtgcatgacgaagcacttagcaaagctatcgtgctgtgcttccggctgcactttactaaggacaatataaccaacaacacagcggcagcaacagtacgccaggtggtcaccgtcgtgtttgaacgcatggttgcggaggatgagcgccatcgagacataattgagcaacccgtgctcgtccagggtaactcaaacagacgctccgtgtctaccttaaagccatgtgccaaggatgcatacatgctattccaggacctgtgtcagctggtgaatgccgatgccccttattggctggtgggcatgaccgagatgactcgcaccttcggattggaacttctggagagcgtcttgaacgacttccctcaggtcttcctccagcatcaagagttctcttttcttttaaaggaaagagtgtgtccgttagtcatcaagctattctctcccaacattaagttcaggcagggctcgagcacatctagtagcccagcacctgtggagaagccctattttccgatctgtatgaggctgttgcgggtggtcagcgttctgataaaacagttctacagtctgcttgtcaccgagtgtgagattttcctgtcgctgctcgtgaagttcctggatgccgataagccgcagtggttgcgcgcagtggcagtcgaaagcatacatagattctgtgtgcagccacagctgctgaggagtttctgccaaagctacgatatgaaacaacattccacgaaagttttccgggacattgtgaatgctctgggatcttttatccagtcgctgtttcttgtgcctccgactgggaatccggccacctctaaccaggccggcaataacaaccttggcgggtccgtctccgcacctgccaatagtggcatggttggcattggagggggggtcaccttgctgccagcttttgaatacagaggcacatggatccccatccttaccattaccgtccaaggctcggccaaagcaacctacctagagatgctggataaagttgaaccccccaccatcccagaaggttacgccatgtccgttgcatttcactgtctgctagaccttgtgagaggtatcacatcgatgattgaaggcgagctaggcgagcttgaaaccgagtgccagacaaccacagaggagggatcttctcccacacagtcgaccgaacagcaggacttacagtctacctctgaccagatggataaagaaatcgtgagtagagccgtatgggaggaaatggtgaacgcctgttggtgcgggttgctagccgccctttcgctccttctagacgcctcaacagatgaggctgcaaccgagaacattctgaaagccgaactgaccatggccgccctgtgcgggcggctgggccttgtaacttccagagacgcatttatcacagctatatgcaaaggatcactgcctcctcattacgcccttacagtcttgaatactacaaccgccgccactctcagcaacaagtcttattccgtccaggggcaatccgtgatgatgattagcccctcgtcggaatctcatcagcaggtggtcgctgtcgggcaaccactggccgtccaaccccaggggactgtaatgttgacctctaagaatatacagtgtatgaggaccctgctgaatctggctcattgccatggagcagtgctgggcactagctggcagctggtccttgctaccctgcaacacctggtgtggatcttgggccttaagccatccagcggcggagccttgaagcctgggcgggccgtggaggggccctctacagtgctgacaactgctgtcatgaccgacctgcccgtgatctctaacatcttgtccaggctcttcgagtcgagtcagtatcttgacgatgtaagtcttcaccatctaatcaacgctctgtgctccctctcccttgaggccatggacatggcatacggaaacaacaaagaaccttctttgtttgcggtcgccaagctgcttgagactggactggtcaacatgcacaggatcgaaatcctgtggcggcccctgaccgggcatctgctggaaaaagtgtgtcagcacccaaacagccggatgagggagtggggagctgaagctctgacttctctgattaaggcgggacttacattcaatcacgaccccccactgagtcagaaccagcggttacagttgctacttctgaatcccctgaaagaaatgtccaatattaatcatcctgacattcggttgaagcagttggagtgtgtgctgcagattctgcagtcgcagggagactcgctcggaccagggtggccactggtcttaggagtaatgggtgccatcaggaacgaccagggggaatcacttatcaggaccgccttccaatgcctccagctggtggtgactgattttcttcccacaatgccttgcacatgcctgcagatcgtggttgacgtcgcaggctcttttggtctccacaaccaggagctcaatatctcgctgacttcaatcggtctgctgtggaatatctccgattactttttccagcggggtgaaacaatcgagaaggagctcaacaaggaagaggccgcccagcagaaacaggccgaggagaagggcgtggtcctgaaccgcccattccatccagcgccaccattcgactgtttgtggctatgcctctacgcaaagctgggggagttgtgcgtcgatccccgacccgccgtcaggaagtcagctggccaaactctcttctctacaattggggctcatgggacattgcttcaacactctacatggcacacagtcatttggaaggtgcttttccatctgctggacagagtgcgagagtcttctacaacagccgataaagaaaagattgaatcaggaggaggtaatattctgattcaccatagtagggatactgcagagaaacagtgggccgaaacctgggtgttaactctggcaggagtcgcgcgaatcttcaatactcgccggtatcttttgcagccgctcggagacttcagtagagcatgggacgtcctgctggaccacatacagtccgcagccctctccaaaaataatgaagtctcccttgctgcacttaagagcttccaagaaatcctccagatcgtgtctccggtgcgcgattctgataaaccggagaccccacctgtagtgaacgtccccgtgcccgtgttaatcggtccgatctctggtatgtccaggccatttgtgcgtaccgacagcattggcgagaagttagggcggtactccagctctgaaccaccgatcgtgactgacgaactggaggacctgaacctttggtgggctgcttggaacacgtggtatcgcatcggaagtgagtctaccaaacccccaatcaccttcgataaactcaccttcatcccctctcagccatttctgactgctctgatccagattttcccggccctgtaccagcatattaagacagggttcaacatggacgacctgcagaagcttggggtgatcctgcactcagccatctcagtgcccatttcatcagatgctagccccttcatactaccctcttatacagaggccgtcttaacctcactgcaggaagctgtgcttactgccctcgacgtgctacagaaggctatatgcgttggccccgaaaacatgcagattatgtatcctgctatctttgatcagctgcttgcttttgtcgagtttagttgtaaaccaccgcagtacgggcagctagaaaccaaacatatcgccaacgccaagtacaatcagatccaattgttcgcacctgctgagtgggtcgccttaaattacgttcccttcgcggagaggtctctggaggtcgtggtcgatctgtaccagaaaaccgcttgtcataaggcagttgtgaatgagaaggtgttgcagaatatcattaagaccctccgtgtgcccctgagccttaagtatagctgtccctctgaatctacttggaagttagccgttagctcactcctccgcgtacttagcattggactgcccgtggccaggcaacacgcgtcttcaggtaaattcgattctatgtggcccgaactggccaatacatttgaggacttcttgttcacaaaatccataccgcctgataatttatccatccaggagtttcagcgcaatgaaaatatagatgtggaggtcgtccagcttatttccaatgagatcctgccctatgcgaacttcatccctaaagaattcgtgggacagatcatgaccatgctaaacaaggggtccatccactcccagtctagtagtttcacggaggccgaaatagatattcggcttcgagaagaattctccaagatgtgtttcgagaccctcctccaattctccttttcgaataaagtgactacacctcaggaaggatacatctccaggatggctttgtctgtgttgctgaaacggagtcaggacgtgcttcataggtacattgaggacgagcgcctgagtgggaagtgtccactccccagacaacaggtcaccgaaattattttcgtactcaaggcagtgagtactttgatagattctctgaagaagacacaaccggagaacgcctgcatttcccttttcggcattcctccctacttctag

SEQ ID NO: 31338 - DNA, 5154 bp, Artificial Sequence
  Description of Artificial Sequence: Synthetic coding sequence
atgtccgggaccagcagtcctgaagccgtcaaaaagctcctggaaaacatgcagtctgatcttagagccctgagcctcgagtgcaagaagaagttcccaccagttaaagaagctgccgaaagcggaatcatcaaggtgaaaacaatagctgcccgaaataccgagatactggctgcgcttaaggagaactcctccgaggtggtacaaccctttctgatgggctgcgggacaaaggagcccaagatcacccagttatgcctcgcagccatccagcggctgatgagtcacgaagtcgttagtgaaacagcagccgggaacatcatcaatatgttgtggcaactgatggaaaatagtcttgaggagttaaagctcctccagacagtgctggttctattgaccacaaacacggtggtgcatgacgaggccctcagcaaggccatcgtcctgtgtttcagactccactttacaaaagataacattacaaacaacacagcagccgccactgtgcgacaggttgtaacagttgtgtttgagcgaatggttgcggaagacgagaggcacagggacattattgagcaacctgtcctcgtgcagggcaattcaaacagacgcagcgtgtctactcttaagccctgcgccaaagatgcctacatgctgttccaggatctctgtcagctcgtgaatgcagacgcaccgtactggttggtcggaatgacagaaatgaccaggacgtttgggcttgagcttttggaatcggtactcaacgacttccctcaagttttcctgcagcaccaagaatttagttttctgctgaaagaaagagtgtgccccctggtgatcaagctgttcagtcctaatattaagtttagacaagggagtagtacttcttcctctccagcgcctgtcgaaaagccatacttccctatctgcatgcgtctgcttagggtagtcagcgtcctgataaagcagttctatagtctgctggtaacggagtgcgagatcttcctttccctgcttgtgaagttcctcgacgccgacaagcctcagtggctgagggccgtagccgttgagtcgatccacagattttgcgtgcagccccagctgctacggagcttttgccagagttacgacatgaagcagcactcaaccaaggtctttagagacatagtgaatgccttaggttcttttattcagagcctctttctcgtaccgcccacaggaaaccccgcaaccagtaatcaggcgggtaacaacaatttgggtgggtcagtgagcgcccccgccaacagcggaatggtaggaatcggagggggggtaactctgctcccagcttttgaatatcgaggcacctggatccccatacttacaatcaccgtgcagggttccgccaaagccacctacctggagatgctcgacaaagtcgaaccccctaccataccagagggctatgctatgagtgtggcttttcactgtctactcgacctggtgaggggtattacctcaatgatcgaaggggagctgggcgagctggaaaccgagtgccaaaccacaaccgaggagggctccagtcccacacagagtaccgaacagcaagacctacaaagcacgtcagatcagatggacaaggagattgtcagcagagctgtctgggaagaaatggttaacgcatgctggtgtggactcctcgctgcactgagcctactactcgacgcgtctacggatgaagccgcgacagagaatattctcaaggccgagttaacaatggcagcactgtgtggtaggttggggttagtgaccagcagagacgcattcattaccgctatctgcaaaggatcccttcccccgcattacgccctgacagtcctcaatacaactaccgctgccacattaagtaataaaagttatagtgtccagggccagagtgtgatgatgatctccccttcaagcgagagtcatcaacaggtggtagcagtgggacagccattggctgttcagccccaaggaaccgtgatgctgaccagcaaaaatatacaatgtatgcgcaccctgctgaatctcgctcactgccacggggctgtactgggaacaagctggcagttagtcctggccaccctgcaacatcttgtctggatccttggacttaagccatccagtggcggcgcccttaagccgggaagagccgttgagggtccctccaccgttttgaccaccgccgtcatgaccgatttgccagttatcagcaatatacttagtcgcctcttcgagtcatctcagtatctggatgatgtatcactccatcatctcatcaatgcactttgttctctttccctggaggctatggatatggcgtatggcaacaataaagaaccatccttgtttgctgttgccaaacttctggaaaccggcctggtgaatatgcaccggatagaaattctgtggagacccctgacggggcatcttctggaggtttgccaacatcccaattccagaatgagggagtggggggccgaggctctcaccagcctaatcaaggccggcctgactttcaaccacgaccccccactgagccagaaccagaggttacaactgctactgctgaaccctctgaaagagatgtctaatatcaaccaccccgatattaggctcaaacagttggaatgcgtcctgcaaattctccaatcccagggagattcgttagggccagggtggccgctggtgctgggggtgatgggtgccattcggaatgaccaaggagagtcgctgatacggaccgcttttcagtgccttcagctggtagttaccgactttttgccaactatgccctgcacatgcctgcagattgtggtcgacgtagcgggatccttcggactgcacaaccaggaactaaacatttccctgacatccatcgggttactatggaacattagcgattactttttccagcgaggtgaaaccatcgagaaagagctaaataaagaggaagccgcacagcaaaagcaggctgaagaaaagggggttgtgctgaatcgacctttccaccccgccccccctttcgattgtctctggttgtgtctttacgccaaactgggggagttatgtgtcgaccccagaccagccgttcggaaatctgcgggccagactttgtttagcactataggagctcatggcactcttctgcagcactctacttggcacacagtgatttggaaggtactgtttcatttgctggatagggttcgagaatctagcacaacggcagacaaggaaaagatcgaaagtggcggcggtaatattctgatacaccactccagagacactgccgaaaaacaatgggccgaaacgtgggtgctgacattggctggcgtggccaggatttttaacacacgtcgatatctccttcagccccttggagatttctcacgcgcatgggatgtgctcctggatcatatacagtctgctgcgttgtcaaagaacaacgaagtaagcctcgcagcccttaaaagcttccaagagatcctccagatcgtctcacccgtccgtgattccgacaagcccgaaacgccacccgttgtaaacgttcctgtccctgtgcttattggcccaatatcaggcatgtctaggccttttgtacggaccgatagcattggagagaagttggggaggtatagtagttcagagccgcctattgtcaccgacgaactcgaagatttgaatctatggtgggccgcgtggaacacttggtaccgcatagggtctgagagcactaagccccctattacattcgataagctaaccttcatccctagtcagccttttctgaccgcacttatccaaatcttccccgccttataccagcacatcaagaccgggttcaatatggacgacctccagaaacttggtgtcatcctgcactcagctatatctgtacctatatcctccgatgctagccctttcatccttccttcttacactgaagcagtgttgaccagtcttcaagaggccgtcttgacggcccttgatgtgctgcaaaaggcaatttgtgtcggcccggaaaacatgcagatcatgtatcccgcaatttttgatcaactgttggcctttgtcgaattttcatgcaaaccgccccagtacggccagttagagacgaaacacattgccaacgctaaatataatcagatccagctgttcgccccagccgaatgggtggctctgaactatgttccatttgcagaacggagtttggaagtggtcgtcgatctctaccagaaaacggcctgccacaaggccgtcgttaacgaaaaggtcctgcagaatatcataaaaacactcagggtgccgctttcactcaaatactcatgcccaagtgagtcaacttggaaactcgcggtaagctcactgctgcgtgtcttgagtattggactgcccgttgctaggcaacacgcaagttctgggaagtttgattctatgtggcccgaattagctaacacattcgaggacttcctcttcactaaaagcatccctcccgataatctgtccatccaagaatttcagaggaacgaaaacattgatgttgaagtggtgcaactgatctctaatgagattcttccctacgcaaatttcatcccgaaagaattcgtcggccagattatgacaatgctgaacaaaggatctatccatagtcagtcctcatcatttactgaagccgagattgatatccggctgcgcgaggagttctccaaaatgtgtttcgaaacactcctccagttctcttttagcaataaggtgaccacaccccaggaggggtatatctctcgtatggcattaagcgttctgcttaaaagatcccaggacgtgcttcatagatacatcgaggacgagaggctgagcggcaagtgtccactccctcgtcagcaagtgactgaaatcatcttcgtgctcaaggcggttagcactctcatcgacagcctcaagaaaacacagcccgaaaacgttgatggaaacacttgggctcaggtgatagctttatatccgacacttgtcgagtgcatcacctgttcctctagtgaagtgtgctccgctctgaaggaggccttagtgccttttaaggatttcatgcagcccccggcctcgcgagttcagaacggcgagtcctag

SEQ ID NO: 31339 - DNA, 5028 bp, Artificial Sequence
  Description of Artificial Sequence: Synthetic coding sequence
atgtctggcacctcaagtcctgaggctgtgaaaaaactgctggagaacatgcagtcggatctgcgcgctctgagcctggaatgtaaaaagaaattcccacccgtgaaggaagctgctgagagcgggattattaaagttaagactatagcggctcggaacaccgagatactagctgctctaaaggaaaactcctctgaggtggtacagcctttcctcatgggctgtggcaccaaagaacctaagatcacgcagctgtgcctggcagccatccaacgacttatgtcacatgaggtggtatccgagaccgcggcgggcaatattatcaacatgctctggcagcttatggaaaactccctggaggaacttaaattgcttcagacggtcttggtgctgcttacgacaaacactgtcgtgcacgacgaggccctttcaaaagccatagtcctctgctttcggttgcactttaccaaagacaacattactaacaatacggcagccgccacagttcgccaggtggtgaccgtagtcttcgaacgcatggttgctgaggatgaacggcaccgggatataatcgaacaacccgtcctggttcaaggtaatagcaacagacgatctgttagtaccctcaaaccgtgtgccaaggacgcttacatgctcttccaagacctctgccagctggtcaacgcagatgccccttactggttggtgggaatgaccgagatgacgcgcaccttcggcctggagctgctggagtcagtgctgaacgatttcccacaagtcttcctgcagcatcaggagttcagctttttgctgaaagaacgggtctgccctctcgtgattaaactgttcagccctaacattaagttccggcagggatcatccacaagtagcagccctgcacctgtagagaagccgtatttccccatctgtatgcgactgctgagggtcgtaagcgtgctgataaaacaattctactcacttcttgtcaccgagtgcgagatctttctcagtctgcttgtgaagttcctcgacgccgacaaaccacagtggctgagggccgttgccgttgaatcaatccataggttttgcgtgcagcctcagctgctaagaagcttctgccagtcttatgacatgaagcagcacagtacaaaggtgttccgtgacattgtgaacgctctgggctccttcatacagtcgcttttcttggtgccgcctacagggaaccccgcaacttctaaccaagcaggtaacaacaaccttgggggaagtgtgtccgcaccagccaattcagggatggtcgggatcggaggtggcgttacactcctgcccgcctttgagtataggggcacttggattccaatcctgacaatcaccgtgcagggaagcgccaaggcaacttacttggagatgctggataaggtggaaccccctaccatccccgagggatacgccatgagcgtcgcatttcactgcctgctggacctcgtgagggggatcaccagtatgattgaaggagagctgggagaactcgagaccgaatgtcagaccactactgaagaggggtcttcacccacccagagcactgaacagcaggatctccagtctacctcagaccagatggacaaagagatcgtgagtcgtgctgtgtgggaagaaatggtgaacgcctgctggtgcgggctgctggcagctctgtcactgttgctggatgcgagcaccgacgaggctgccaccgagaatattctgaaggcggaactcaccatggcagccctttgtgggcggctgggattggtcacctcaagagacgccttcataacagccatctgtaaggggagtctgccacctcattatgcactgacagtgctgaatacgacgacagctgctaccctatctaataagtcctactccgtgcagggacaaagtgtcatgatgatcagtccgagttccgagtcccaccaacaggtcgttgcggtggggcaacccctggcggtgcaacctcaaggcaccgtaatgctaaccagcaaaaacattcagtgcatgaggactctactgaacctcgcccactgtcatggggccgtcctgggaaccagttggcagttagtgttagccacgctccagcacctggtatggattcttggtctcaaaccttctagcgggggagcactaaagcctgggcgggccgttgagggcccgtccactgtgctgaccaccgccgttatgactgatcttcctgtgatctcgaatatcctgagtcggctctttgaaagctcccagtatctggacgacgttagtttgcaccacctcatcaatgctttgtgtagcctgtccctcgaggcaatggatatggcgtatggcaataacaaagagcccagtctttttgctgtggctaaactcttagagacaggcctcgtgaacatgcaccgaatcgaaatactttggcgaccgttgacaggccatctgctggaggtgtgtcagcatccgaactcccgcatgcgcgagtggggagctgaggccctgacttcccttatcaaggccgggctgactttcaatcatgacccccctctgtcacagaatcagagattgcagctgcttctgctcaatcccctcaaggagatgagtaatatcaatcatccagatatccggctaaaacaactggagtgtgttcttcagatccttcagagccagggcgattccctaggccctggctggccactggtgctgggtgttatgggcgcaattcgcaatgaccagggtgaatccctcattaggaccgcgttccagtgtctgcagcttgtcgtcacggacttcctccccaccatgccctgcacgtgtcttcagatcgtggttgacgtagctggtagttttggtctccacaatcaggagctgaatatctccttgacttcgattgggcttttgtggaatatctccgattacttcttccagcggggcgagacaatcgaaaaggaacttaataaggaggaagctgcacagcagaaacaggcggaagaaaagggggtggttctgaacaggccctttcatcccgcacctccatttgactgcctgtggctgtgtctctatgctaaactcggggaactgtgtgtcgacccaaggccagctgtccgcaaatccgccggacagactctgttcagtacgattggtgcacacggaacactgctgcagcatagcacatggcacacagtgatatggaaagttctgttccacctcctggaccgggtgcgagagagctctactacagccgacaaagaaaagatagagtctggaggtggcaacattcttattcaccactctcgagataccgcggaaaagcaatgggctgagacttgggtgctcacacttgcaggggttgcccgcatcttcaataccaggaggtacctactccagccactgggcgactttagccgagcttgggatgtgctcctcgaccacatccagtcagccgctctttctaaaaacaatgaggtgtcgctcgccgctctgaaaagcttccaggagattctccagatcgtgtcacctgtgcgcgactcagataagcctgagactccacccgtggtaaatgtacccgtccccgtcctgatcgggcccataagtgggatgagccgtccattcgtgcgcaccgatagcatcggcgaaaagctcgggaggtactctagcagcgaacctccaatcgtgaccgacgagcttgaggatttaaacctttggtgggccgcctggaatacctggtaccgtatcgggtcagagtcgaccaaacctcccattacatttgataaactgaccttcatccctagtcaaccatttttgacggccctgattcagattttccctgctttgtatcagcacattaagaccggattcaacatggacgacctccagaagttaggcgtgatcctgcactctgctattagcgtccctatttcaagcgatgcctccccattcatccttccttcctacactgaagccgttctgacctcactgcaggaggctgtcctcacagccctagatgtcctccagaaagcaatctgcgttgggcctgagaatatgcaaatcatgtatccagcaatcttcgatcagctgctcgcctttgtggaattctcttgcaaacctccacaatacgggcaactggaaacaaaacatatagcaaatgcaaagtataaccaaattcaactgttcgccccagctgagtgggtggctctcaactatgtgcctttcgcagaacgatccttggaagtggtggtcgacctctaccagaaaaccgcctgtcataaggccgtcgtgaatgagaaagtcctccagaacatcatcaagacactgcgggtgccgctgtcactgaagtattcttgtccgtctgaatctacctggaagctagccgtgagttcactgctgcgcgtcctctccatcgggttgcctgtagccagacaacacgcaagtagcggcaaattcgattctatgtggcctgaactggcgaataccttcgaggatttcctcttcacaaagtccatccctccggacaacctaagcattcaggagttccaacggaacgagaacatcgacgtagaggtagtccagctcatttctaatgagattctgccatacgccaacttcatcccaaaagagttcgttggacagattatgactatgttgaataaagggtccattcattcgcagtcaagctccttcacagaggctgagatcgatatccgactgcgtgaggagtttagcaaaatgtgttttgaaacactcctccagttttctttttccaacaaggtcaccaccccacaggaaggttatatctctcgtatggccctgtctgtgctgctaaagcggtcccaggacgtcctccaccggtacatcgaggatgagagactaagcggaaagtgccctctgccacgccagcaggtcaccgaaatcatctttgttctgaaggctgtgtccacactgatagatagcctgaaaaagactcagcccgaaaacgcttgcatatctctgttcggtattcccccttatttttag

SEQ ID NO: 31340 - DNA, 2703 bp, Artificial Sequence
  Description of Artificial Sequence: Synthetic coding sequence
atgttgttgtatcgtggcgcgccagccgggcccggtgctccaggctgcggcctggctaggcctggaggtggcccccaggctttcggcattcgactgagtaccatgtctccccgctaccttcagtctaatagcagctctcataccagaccattttccgcaattgctgagttgttggataacgctgtggatccggacgttagtgcgcgaacagtattcatcgatgtcgaagaggtgaagaataaatcctgtctgacgtttacagacgatggctgtgggatgactccccataagctccaccgaatgttgagcttcgggtttactgataaagtcatcaagaaatcccagtgtcccataggagttttcgggaatggtttcaagagcggtagtatgcgcttaggaaaggacgccctggtgttcacaaagaatgggggaaccttgaccgtaggacttctctctcaaacgtatctggaatgtgtgcaggcccaagccgtgatcgtccccatcgttccctttaaccagcaaaataagaaaatgataatcactgaggactctcttccttctctggaggcaattctcaattacagtatctttaatagagaaaacgaccttttggcacagtttgatgccatccctggtaaaaaaggcacaagggtcctcatctggaatatccggagaaacaagaatggaaagtccgaactggacttcgacaccgaccagtacgatattttagtttctgacttcgacacggaggagaaaatgaccggtggagttacgagcgaactaccagagacggagtactccctcagggccttctgcggtattctgtacatgaagccaagaatgaagatttttctaaggcagaagaaggttaccacccagatgattgccaaaagcctggccaatgtagaatatgatacttataagcccacctttactaacaagcaggttcggatcactttcggattttcctgtaaaaattcaaatcagtttggaatcatgatgtaccataacaaccggctgattaagtcattcgagaaagtcggctgtcaagtgaagccgactcggggagagggtgtgggcgttattggagtaatcgagtgtaatttcctcaaacctgcctacaacaaacaagactttgagtacaccaaggagtacaggttaactattaatgctctggcccagaagctgaacgcttattggaaggagaagacttcgcaggacaacttcgagacgtcaactgtggccaggcctatcccaaaggttcccgaccagacttgggtccagtgcgatgagtgcctgaaatggcgcaagcttcccggcaagattgacccctcgatgctgcccgcccggtggttctgttattataatagccacccaaaatatcgccggtgttccgtgcccgaagaacaagagcttactgatgaggatctctgtctatcaaaggccaagaaacaggaacagacggtcgaagaaaagaagaaaatgccgatggaaaatgaaaaccaccaggtctttagcaacccaccaaagatccttaccgtgcaggaaatggcgggtctgaataataaaaccatcggttacgaggggattcactcgccatcagtgctcccatccggtggcgaggaatctcggtcccctagtcttcagttgaagcctctggactcctctgtcctgcagtttagctctaagtacaagtggatcctcggagaggagcctgtagagaagaggcggcggttgcaaaacgagatgactacacccagtctggattactccatgccagctccatataggagggtcgaggcacctgtggcttaccctgaaggcgagaattcccacgataaatctagtagtgagaggtccaccccaccatacctttttcccgagtatcccgaggcctccaagaatacaggccagaaccgggaggtctctattctgtatcctggtgccaaagaccagagacaggggtcactgctgcccgaagaactggaggatcagatgccaagactcgtggcggaggaaagtaaccgcgggtcaaccaccattaacaaggaggaggttaacaagggccccttcgtggccgtggtgggggtggcgaaaggcgtgagggattctggggcaccaattcagctgatcccattcaacagagaggaactggccgaacggcgcaaggccgtagagtcttggaatccagtgccttattccgttgcctccgccgctatccccgccgctgcaatcggtgaaaaggcgcgggggtacgaagagagcgaaggacacaatacccctaaactgaagaaccagcgagaactggaggaactgaagcggaccactgagaaactggaaagagtcctagcagagcggaacctatttcaacagaaggtcgaagaactggagcaagagcggaatcactggcagagcgagtttaaaaaagtgcaacacgaacttgttatttactccacgcaggaggcggaaggcctctactggtcaaaaaagcatatgggataccgccaggcagagtttcagatacttaaagccgagttggaacggactaaggaggagaagcaggagctaaaagaaaagctgaaggagacagagacacatttagagatgctccagaaagcacaggggttcggcaaggcttatgccgcaacatatccgcgccagttatccccctacttctgccccccaagcctgggagcatcatag

SEQ ID NO: 31341 - DNA, 2814 bp, Artificial Sequence
  Description of Artificial Sequence: Synthetic coding sequence
atgttgctttatcgcggggccccagcaggccctggcgctccaggatgcggactcgcccgtcccgggggtgggcctcaggcattcggaattaggctgtctaccatgtctccgagatacctgcagtcaaacagcagctcccacaccaggcccttctctgcaattgccgagttgctggacaatgccgtggatcctgacgtcagcgcccgtacggtgttcattgacgtggaggaagtcaaaaacaaatcctgcctgacttttacagacgatgggtgcggaatgactcctcataagcttcatcgcatgctctcttttggttttacggataaggttattaagaaatcccagtgcccgataggtgttttcgggaacggtttcaagagcggctctatgagacttggtaaagacgcactggtgttcaccaaaaacgggggcacacttaccgttggcttgctgtcacaaacttacctagagtgcgttcaggcgcaggcagtcatcgtccccatcgtgccctttaatcagcaaaacaaaaagatgatcatcacagaggattcccttccctctctggaagcaatcctaaactattcaatattcaacagggagaatgacctgctggcgcagttcgatgccattcccggcaagaagggaacaagggtgctgatctggaatatccggcggaacaagaatgggaaaagcgaactggacttcgatactgatcagtacgacatattggtgagtgatttcgatacagaggaaaaaatgaccggtggcgtaaccagcgaattgcctgaaaccgagtatagcctgagggccttctgcggaattttgtatatgaagcctagaatgaagattttcctgcgccaaaaaaaagtgacaacacagatgatcgcaaagtcactcgctaacgtagaatacgacacctataaacccaccttcacaaataaacaggtacgcataacatttggcttcagttgtaagaactctaaccagtttgggataatgatgtatcataacaatcgtctgatcaagagcttcgagaaggtcggctgccaggtaaagcccaccaggggtgagggcgtcggcgtaatcggcgtgattgaatgcaacttcctcaaaccggcttataataagcaggattttgaatataccaaagagtatagactaaccattaacgctttagcccagaagcttaatgcttattggaaagaaaagacctcacaagacaatttcgaaacctccaccgtggccagacctatacctaaagtcccagaccagacttgggttcaatgtgacgaatgtcttaagtggaggaagctgccaggtaaaattgatccctctatgcttccagcgaggtggttttgttattacaacagccaccctaagtaccgacggtgttcagtgcctgaagaacaggagctcacggacgaagatctatgtctgtccaaggcgaagaaacaagaacagaccgtagaagaaaagaagaagatgcctatggagaacgaaaaccaccaagttttttctaaccctcctaagatcctcaccgtgcaggaaatggcgggactcaataataaaaccatcggatatgagggaatacattccccttcggtgctcccttccgggggcgaggaatcgaggtctccctcgctgcaactgaaacctttggactcctccgtcctccagttttcaagtaagtacaagtggatactcggagaggagccagtggaaaaacgaaggcggctgcagaatgagatgactacaccaagcctggactactctatgccagcaccatatcgccgtgtggaggcccccgttgcctatcctgagggagaaaacagtcacgataagtcaagtagtgagcggtcaactccaccttacttattccctgaatacccggaggcctcaaaaaatactggccagaacagggaagtgagcattctgtatcccggagccaaggatcagcggcaggggtccctactgcctgaagagttagaggaccagatgccacggctcgtggccgaggaatcaaacaggggcagcactacaatcaataaggaagaagtgaacaaaggacccttcgtcgctgtcgtcggggtagccaagggcgtgcgagattcaggagccccaattcagctgatcccttttaacagagaagaactcgccgagagacgtaaagcagtggaaagctggaacccggtcccctattccgtcgcttctgccgcaatccctgccgcggctatcggcgagaaagctagaggctatgaagagagcgagggccacaacaccccgaagctgaaaaatcagcgcgagttggaagagctgaagaggacaactgagaagcttgaaagggtgttggccgaacggaatctgttccagcagaaagttgaagaactggagcaggaaagaaaccattggcagagcgagttcaagaaagttcaacatgaactggtaatatattcaactcaggaggcagagggcctctactggagcaagaaacatatgggctacaggcaagcggagtttcagattctcaaagcggaactggaaaggacaaaggaggagaagcaggaactcaaggaaaaactgaaggaaacagagacgcacttggagatgctgcagaaggcacaagtttcatatagaactcctgagggagatgatttagaacgggccctagccaagctgacccgcctgcggatccatgtctcttacctccttacgagcgtgcttcctcacctggaactcagggagatcgggtacgactcagagcaggttgatggtatcctgtacactgtactggaagccaaccacatcctagattag

SEQ ID NO: 31342 - DNA, 1947 bp, Artificial Sequence
  Description of Artificial Sequence: Synthetic coding sequence
atgacggggggtgtgaccagtgagcttccagaaaccgaatacagcttacgggccttttgtggtatcctgtatatgaagcctcggatgaagatttttcttcgccagaagaaagtcaccacgcagatgatcgctaaatccctggcgaacgttgagtacgacacgtacaaaccaacattcactaataagcaggttcgaattacttttggcttcagttgtaagaatagtaatcagtttggcataatgatgtaccataacaatagactaatcaagtcttttgagaaagtgggatgtcaggtcaaacccacaaggggagagggtgtgggagtaatcggcgtcattgaatgcaatttcttaaagccagcttacaataagcaggactttgaatatactaaggaataccggttgactattaatgcgttagcccagaaactgaacgcatattggaaggaaaagacctcacaagacaactttgaaacaagcacagttgcccgccccatcccaaaggtccctgatcagacgtgggtgcagtgtgacgaatgtctcaagtggagaaaacttcctggcaaaatcgatccatcgatgctgcccgctcgttggttctgctactacaacagccatccgaaatatcggcgatgttctgttccagaggaacaggagctaaccgacgaggacttatgtctgagcaaggcgaagaagcaggaacagaccgtggaagagaagaagaagatgcccatggagaacgagaatcaccaggtgttcagcaacccccccaaaattctcacagtccaggaaatggccggactgaataacaagacaatcgggtacgaaggcatacactccccaagcgtgctacctagcggcggcgaagagtcccgaagtcccagcctccagctgaaaccattggactcgagcgtgttacagttctctagcaagtacaagtggatattaggagaggagccagtagaaaagcgaagacggctgcagaatgagatgactacccccagccttgattacagtatgcccgctccataccgacgcgtggaggccccggtggcatatcccgaaggcgagaattcccacgacaaaagctctagcgagagatcaactcctccctacctcttcccggagtaccctgaagccagcaagaataccggccagaatcgggaggtatccatcctgtatccaggcgccaaagaccaacggcagggatcactgctgccagaggaactggaggatcagatgccacgattagtggccgaggagtccaaccgcggttccaccactatcaataaggaggaagtgaacaaaggcccgttcgtagcggtggtgggtgttgcaaaaggggttagagattcaggcgccccaattcagctgattccattcaatcgggaggagttggccgagcgtaggaaagctgtagaaagctggaaccctgtaccatactctgtggcttctgcagccatcccggccgccgccatcggagagaaggctcgggggtacgaggaaagcgagggacacaacacacccaagctgaaaaatcagcgcgagcttgaggagctgaagcggactaccgagaagcttgaaagggtactggcagagagaaatctctttcagcagaaagttgaagagctcgaacaggaacgcaatcactggcagtccgaattcaagaaggttcagcacgaactggtaatttatagtactcaggaggcggaaggactgtattggagcaagaagcatatgggctataggcaggccgaattccagatcctaaaagctgagcttgaacgaacaaaggaggagaaacaggagctgaaggagaagcttaaggagactgaaactcacctggagatgcttcagaaggcccaagggttcggaaaggcctacgcagctacctacccaagacaattaagcccatatttctgtccgccttcactcggagcctcttag

SEQ ID NO: 31343 - DNA, 384 bp, Artificial Sequence
  Description of Artificial Sequence: Synthetic coding sequence
atgcgccccctggatatcgatgaggtggaggctcccgaagaggtggaggtcctggagcctgaagaggattttgagcaattcttacttccagttatcaatgagatgcgcgaggacattgcttctctgatccgtgagcacggacgcgcatatctccgcaccaggagcaaattgtgggagatggacaatatgcttatacaaattaaaacacaggtggaagccagcgaagaatctgcactgaatcatgtgcaacacccgagcggagaggccgacgaacgagtttccgaattgtgcgagaaggcagaggagaaggctaaggagatcgctaaaatggcagagatgctcgtggaacttgtatggcgcatcgagcggtcagagagtagttag

SEQ ID NO: 31344 - DNA, 471 bp, Artificial Sequence
  Description of Artificial Sequence: Synthetic coding sequence
atggctgctgcaggagaaggcacgccctcgtccaggggacctcgaagagatcctccccgccgacccccccggaacggacacggaaagctgctgttcaaagacggctcctactatgagggcgcatttgtggacggggagataacaggtgagggacgtagacattgggcatggagcggggacacgttttctgggcagttcgtgttgggcgagcctcaggggtatggcgtcatggaatataaagcggggggctgctatgaaggagaagtgtcccatggtatgagagaaggccacggatttctggtcgatcgcgatggccaagtatatcaaggttcctttcacgacaataaacgacatgggccagggcagatgctctttcaaaatggagacaagtacgacggcgattgggtgcgagacagacgccagggccatggtgtgttgcggtgtgccgacgggagtacatacaagttgtag

SEQ ID NO: 31345 - DNA, 1053 bp, Artificial Sequence
  Description of Artificial Sequence: Synthetic coding sequence
atggccgctgccggggaaggcacccccagtagccgcggtccaaggagggatccaccaagacgcccccccaggaacggatacggtgtctacgtctaccccaacagcttcttcagatatgagggcgaatggaaagctgggcgaaagcacggacatggcaaactgttgttcaaagacgggtcttactatgagggcgccttcgtggacggcgagatcactggcgaggggcgccgccactgggcttggtctggcgacacatttagtggtcaatttgtcctgggggaaccccaggggtatggcgtgatggaatacaaggctggcggttgttacgagggagaggtctcccatggaatgcgcgaaggacacgggttcctcgttgatagggatgggcaggtgtaccaaggcagcttccacgataacaagcgccatggccccggtcagatgttgtttcagaacggggacaaatacgacggtgactgggtgcgtgatcgccgacaaggtcacggggtcctccgttgtgccgacggcagtacctataaaggccagtggcattccgatgtcttctcaggcctgggaagcatggcacattgttccggcgtgacctattatggactgtggatcaatggccatcccgccgagcaggccacaagaattgtcatcctcggtcccgaggtgatggaagtagcccagggcagccccttttccgtcaacgtacaacttcttcaggaccacggcgagattgctaagagcgaatcaggccgggttctgcagatcagtgctggcgtgagatatgtacagctctcagcatacagcgaagtgaatttcttcaaagtggatagagacaaccaagagaccctgatccagacaccatttgggtttgagtgtataccatatcctgtcagtagtcccgcagccggtgttccgggaccaagggccgctaagggcggtgctgaggctgacgtccctctgccgaggggggacctcgagctgcatctaggggcactgcacgggcaggaggatacacccggcgggctactcggcagctctctcttttag

SEQ ID NO: 31346 - DNA, 1494 bp, Artificial Sequence
  Description of Artificial Sequence: Synthetic coding sequence
atggccgctgctggagaagggacgccatctagtagaggccccagaagagatccccctaggcggcccccaagaaatggctacggtgtctacgtttatcccaacagcttcttcagatatgagggagaatggaaggcaggcagaaagcacggccacgggaagctcctgtttaaggacggatcctactacgagggcgccttcgttgacggggagatcacaggcgagggcagacggcattgggcttggtctggtgacaccttcagtggccaatttgtcctgggagagccccaaggatatggcgtgatggaatacaaggccggcggttgttatgaaggggaggttagtcatggcatgcgcgaaggccacggcttcctggtggacagggacggacaggtttaccagggatccttccatgacaataaacgtcacggcccaggccagatgctgttccaaaacggagataagtatgatggggattgggtgagagatagaagacagggacacggggtcttgcgctgcgccgatggatccacctataaggggcagtggcactcggacgtattctccggcctgggtagtatggcccactgctcaggagttacatactacggcctctggatcaacggtcaccccgccgagcaggcaactcggatcgtgattctcgggcccgaggtgatggaggtggcgcagggaagcccctttagcgtcaacgtacagttgctgcaagaccacggcgagatagccaagtcggagagcggacgggtgctgcagatttctgccggagtgcggtacgtgcaactgagcgcgtactctgaggtgaatttctttaaggtggacagggataaccaagaaacgttgatccaaactccgtttggatttgaatgtatcccttaccccgtgtcctctcccgcggctggggttccggggcctagagccgcgaaggggggcgctgaggctgatgtacccctgcctcgcggcgacctggaattgcacttgggggccctgcatgggcaggaggatactcccggcgggctgcttgcacgcggtcatgccccgcactgcccaggtgcttgtcagcgggtggaacagggttgcgccgagtttacagacgtgctgttgggccccccccccccaggctatcatccttttcttttcttggactcactgcataagaaggcaggggggagatccagaggaggcctccaccctagaggtacgccccctactgctcaggagccacccggtgggtccagacccgaaggaagggcaacagaggagcaggctgccgctgcccatctgggagagtacgtcctcatgatccgtgatgtcaccacaccacccttcctaggcagacgcttgcctcccgctttcaaacaccttagagtggtcgccaagcgagcaggacagccccctcacgtcctggaggaggggcccgaggcatcaagtagttggcaagccgctcatagttgcacacccgagcctcccgcaccacggtag

SEQ ID NO: 31347 - DNA, 456 bp, Artificial Sequence
  Description of Artificial Sequence: Synthetic coding sequence
accgccacaaccaggctacctctgctgagggtagatagcgtccgcgtctcaccccgcaacggtgacaagtacgacggcgattgggtccgggatcgccgccaaggacacggcgttttgcggtgcgcagatggctccacatacaaaggtcagtggcatagcgacgtttttagcggcctcggctccatggctcattgctccggcgttacctattacggcttgtggatcaacggccatcctgccgagcaggctacgcggatcgtgatactaggacctgaggtgatggaggtggcccagggatcccccttcagcgtcaacgtgcaattattgcaggaccacggtgagattgccaagaacggcgtctcccttcttttgtctaggctagagtgttcgggtgctatgtcagctctgaggaacctgcggctcccacgttcaagcgacagcgcattagccagctag

SEQ ID NO: 31348 - DNA, 558 bp, Artificial Sequence
  Description of Artificial Sequence: Synthetic coding sequence
gtcaccggatcttgttacttaaagatggccgtgataaccaagggtcggttgtggacggagcgcagtagagagaaggcagccggcacgggtcccggacaggagacaccaagcttggattcgctgttttgggaaagcctcaaagcaactgcttcttggtccaccaagcccgccgatgtgatgaaagggaggagtcctactgcgtgcgggaaagatacaggcttttggtggacaggtatggataaatgtaccagggccccttcaatgactacgagaggaacagccttaggacggtgctcctttaggactgtcacatccaccactgcaactgggtcagggacaggtgtaagagatacgggttgctgtgcagccccaacagctcctcctactagctctgaccctcctatctacagtagaagaaactctaggcgacatcggctgctgccccggcaccacgaactgagagtgggggaggccccgccaggtgatctgttttcgttgtcaacagcaggagtcttttccgcgaatcgagttagctgcctggcggcaagtattccatag

SEQ ID NO: 31349 - DNA, 240 bp, Artificial Sequence
  Description of Artificial Sequence: Synthetic coding sequence
atgaatggattcgggcgactagagcatttctctggagccgtgtacgaaggtcagtttaaggacaatatgtttcacggccttgggacatatacctttccaaacggtgccaagtatactggcaatttcaatgaaaaccgagtcgagggagaaggggagtacacagatattcaaggattagagtggagcgggaactttcattttaccgcggccccagacttaaaacttaagctgcatatgtag

SEQ ID NO: 31350 - DNA, 240 bp, Artificial Sequence
  Description of Artificial Sequence: Synthetic coding sequence
atgaatggtttcggcagactggagcatttttctggagccgtctatgagggtcaatttaaggataacatgttccatggcctcggcacctacacttttcccaatggtgccaaatacacagggaatttcaacgaaaacagagtggagggggaaggagagtataccgacattcagggtctggagtggagcggaaacttccactttactgccgcaccagatctgaaactgaagctccacatgtag

SEQ ID NO: 31351 - DNA, 240 bp, Artificial Sequence
  Description of Artificial Sequence: Synthetic coding sequence
atgaatggctttgggaggctcgaacacttcagtggtgcagtctacgaagggcagttcaaggacaacatgttccacggcctgggaacttacactttcccgaatggagccaagtacacgggaaatttcaatgaaaaccgggtggaaggcgaaggggaatacacagatatccaagggcttgagtggtcggggaatttccatttcacagccgccccagatctcaaattgaagctgcacatgtag

SEQ ID NO: 31352 - DNA, 723 bp, Artificial Sequence
  Description of Artificial Sequence: Synthetic coding sequence
atgcctgtcagtaaatgtccaaagaaaagtgagagcctctggaaggggtgggatcggaaggcgcagcgaaacggcctaagaagccaggtatacgcggtcaatggtgattactacgtgggagaatggaaggacaatgtgaagcatggcaaaggcacacaggtgtggaagaagaagggggcaatctatgaaggtgattggaaattcggaaaacgggacggatatggaaccttgtctttacccgaccagcagactggcaagtgtcgtcgagtttattcaggctggtggaaaggtgacaagaagtctgggtacgggatccagtttttcggtccaaaggagtactacgagggggattggtgcggcagccagaggtcagggtggggccggatgtattactctaatggggatatttacgagggccagtgggagaatgacaaaccgaacggcgagggcatgctgcgtctgaagaatggaaaccgatacgaaggctgttgggagcgggggatgaagaacggtgccggccgcttttttcacctggatcatggtcagctatttgagggcttctgggttgataatatggccaagtgcggcaccatgattgatttcggtagggacgaagctcctgaacccacacagttccccatacctgaagttaagatcctggacccagacggcgtgctcgcagaggcactggctatgtttcgtaaaacagaggaaggtgattag

SEQ ID NO: 31353 - DNA, 441 bp, Artificial Sequence
  Description of Artificial Sequence: Synthetic coding sequence
atgactctgacaaaggggtcattcacctactcaagcggtgaagaatataggggcgaatggaaggagggcaggagacatggattcggacaactgatgttcgccgacggaggaacgtacctgggccactttgagaacggtttgttcaacggcttcggcgtcctcaccttttccgacgggtccagatacgaaggtgaatttgcccagggcaaattcaacggtgtcggtgtttttatacggtatgacaacatgaccttcgagggagaattcaaaaatggtcgggtggacgggtttgggctgctgacattccccgatggatcccatgggatccctagaaacgagggacttttcgagaataataagctcctgcggcgcgagaaatgctctgccattgtacagcgggcgcaaagcgcaagcaagagcgcccgcaatctcactgcttag

SEQ ID NO: 31354 - DNA, 615 bp, Artificial Sequence
  Description of Artificial Sequence: Synthetic coding sequence
atggcatggagtcgggcagggcccatgcggagcggcgttgctccagggtgtctgggaaatagtcagtgggcggccgggattgttcccagtgccgtcgctcaagacgggggagtgaagtggggtaatagatggtggcgttggcgtcgggcgcgatggcagccaggagcacaccaacggaaatcaccacgtcgatggaaccccgctagccgccgggacggtcatccagagagacccgcacccgggagacgccacgggttcgggcaattgatgtttgctgacggtggaacatatctcggccactttgaaaacggactcttcaacggtttcggagtgctgactttctccgatggaagccgctatgaaggggaatttgcccagggaaagttcaatggtgtaggggtcttcattagatacgacaacatgacatttgaaggcgaatttaaaaacggaagggtcgatgggttcgggctgcttacgtttccggacgggtcacacgggatccccaggaacgagggcttgtttgagaacaacaaactcctgcgcagagaaaagtgcagtgccatcgttcagcgcgcccagagtgccagcaaatccgctcgaaatttgacagcttag

SEQ ID NO: 31355 - DNA, 441 bp, Artificial Sequence
  Description of Artificial Sequence: Synthetic coding sequence
atgactctgaccaagggctctttcacatattcgtccggggaggaataccggggcgagtggaaggagggccggcgacacggcttcgggcaactaatgttcgccgacggagggacctacctgggccacttcgagaacggcctcttcaacggcttcggagtactgacattctcagatggatcccggtacgagggggagttcgctcaagggaaattcaacggggtgggggtgttcatccggtacgacaacatgactttcgaaggtgagtttaaaaatggcagggtcgacggattcgggcttctgacattcccagatggaagccacggcattcctcggaacgaaggactcttcgagaataataaactgttaaggcgcgagaaatgctcagccattgtccaaagagcccagtcagcttccaaaagtgcccgcaaccttactgcatag

SEQ ID NO: 31356 - DNA, 486 bp, Artificial Sequence
  Description of Artificial Sequence: Synthetic coding sequence
atggagtatactggcagcaagtacatcggagagtacgtggatggacggatggaaggaaaggccaagtacatcctcccgactgagaccatttatgtgggggagatgaaggatggaatgttccacggggaaggcactctctatttcccatccgggtctcaatacgacgccatttgggaaaacggattggctatcaaggggacatatacattttccgatggcctccactatgacgagaaaaattggcattattgcgatggctatgataggcggttctatacagaaatcttgaatggcctgaaaccagctggcatggcccagttgacaaacatggaccctcctagaaagattccaaagggctactatgattgcggagatggcttttataaccctgtcacaagggtggtaaaggattatcggaataggttcttgcgaaacgctgatgatgacgagcatgagtggatcacgcgcacttgtagaaagggttag

SEQ ID NO: 31357 - DNA, 333 bp, Artificial Sequence
  Description of Artificial Sequence: Synthetic coding sequence
atggaaggaaaagccaaatacattctgccaacagaaacaatttatgtgggcgagatgaaggatggcatgttccacggggagggtactttatattttccgtctgggtctcagtacgatgccatatgggaaaatggactggctataaaaggcacctatacgttttccgacggccttcattatgacgagaagaattggcactattgtgatgggtatgatagacgcttctataccgagattctgaacggccttaagcctgcaggaatggcacagctgacaaatatggaccccccccgaaagatccccaaaggttactacgattgtggtgatgggtag

SEQ ID NO: 31358 - DNA, 528 bp, Artificial Sequence
  Description of Artificial Sequence: Synthetic coding sequence
atggagtataccgggagcaagtatattggtgagtacgtcgacggccgcatggaggggaaggcaaaatacatcctcccgactgaaacaatttacgtcggagagatgaaggatgggatgtttcacggggagggtaccctctattttccaagcggatcacagtacgacgcaatttgggagaacggactagccattaagggcacatataccttctccgatggactgcattacgacgaaaagaattggcattactgcgacggctatgatagacggttctatacggagattttgaacgggctgaagcctgctgggatggcgcagctgacaaatatggatcctcctaggaagatccctaaagggtattatgattgtggagatggcttctacaacccagtaaccagggtagttaaagactataggaataggtttctgcgcaacgctgggcgcttcctgcctacgctccaacatgtcttttctagccccacatatgagtatgtccacctatacgtgcagatgtacgctcatacctag

SEQ ID NO: 31359 - DNA, 1416 bp, Artificial Sequence
  Description of Artificial Sequence: Synthetic coding sequence
atggccgcacccgagcctctcagccctgccggaggtgccggggaggaagctccagaagaagacgaagacgaagcagaagcagaggatccagagcgccctaatgccggggctggaggcggacggtctggaggcggcgggtcaagcgttagtggaggtggagggggtggaggagcgggcgcagggggctgcggcggccccgggggtgcactgacacggagagcagtgaccctccgggtgctgttgaaggacgctctgctcgaacccggggcaggggttttatctatctactacctgggcaagaaatttttgggcgacttgcaacctgacgggcgaattatgtggcaagagaccggacagacctttaatagtccctctgcctgggcaactcactgcaagaagcttgtgaaccccgccaaaaagtccggatgtgggtgggcctccgtaaagtataagggacaaaagttagataaatacaaggccacgtggcttcgtctgcatcagctccatacccccgctactgccgccgacgagtcacccgcatctgagggtgaggaagaagagctgttgatggaagaagaggaggaagatgtccttgctggcgttagtgccgaggacaaatctagacgacctctggggaagtccccaagtgaaccagcacaccccgaggctacaaccccaggcaaacgggtggattcgaagattagggtgccagtccgctattgcatgctgggctcccgggacctcgctcgcaacccacacacacttgtggaagttaccagctttgccgctattaacaaattccagccctttaatgtcgcagtgtcatccaacgtccttttcctgctggacttccatagccatcttacacgctccgaggtggtaggttacctgggcggacgctgggatgtaaactcgcaaatgcttacagtgctgagggccttcccttgtcggagtcggcttggagacgccgaaaccgccgcagccatagaagaggagatatatcagtccctctttcttcgcggtctctctcttgtaggttggtaccacagtcatcctcattccccggccctcccctcgctccaggacatcgatgctcaaatggattatcaactgagactgcaggggagttctaatgggttccaaccttgtctcgccctgttgtgtagtccatactacagtggcaaccctggaccggagagcaagatctctccattctgggttatgccacctccggagatgctattggtggaattttataaggggagtcccgatctggtgagactgcaagagccgtggtctcaggaacacacatacttagacaaattgaagatttccctggcttcacgtacaccaaaagatcaaagcctatgtcacgtacttgagcaggtgtgcggggtgctgaagcagggaagctag

SEQ ID NO: 31360 - DNA, 1356 bp, Artificial Sequence
  Description of Artificial Sequence: Synthetic coding sequence
atggccgccccagaacctctgtcacccgcagggggggcaggtgaggaagcgccagaggaggacgaggacgaggcagaagctgaagacccagaacgtccaaatgccggtgccggaggaggacgcagcggcggcgggggcagcagtgtgagtgggggtggcggcggaggcggtgctggcgcagggggttgcggcggtcctggcggagcacttactagaagggcagtcaccttaagagtgctcttgaaagatgcgcttctcgaaccgggtgcaggagttctcagcatttactatttgggcaagaaattcctaggcgaccttcagcctgatggcaggattatgtggcaggaaacaggccagactttcaactccccgtctgcttgggccacccactgcaaaaaactcgtaaatcccgccaagaaatccggatgcggctgggctagtgtcaaatacaagggccagaaattggacaaatacaaagcgacctggctgcggctccatcagcttcacacacccgccactgccgctgatgagtctcccgcaagcgaaggagaagaagaagagctgctcatggaagaggaggaggaggatgtgctggccggggtgtccgcggaggataagtcccgcagacctctgggaaagagcccctctgagccagcgcatcctgaagcgacaactcccggtaaaagggtggatagtaaaatccgcgttccagtgaggtactgcatgttggggtctagggacctggcccggaatcctcatacactggtggaggtcacttccttcgccgccatcaataagtttcagccttttaatgtggctgtgtctagcaatgtgctgttcctcctgatttaccagtctctcttcttaagagggttgtccctggtaggctggtatcacagccacccccactctcctgccctccctagtctgcaggatattgatgcgcagatggattatcaattacgcctgcagggctcttcgaacggatttcagccatgtctcgccctcttatgttccccttactacagcggaaaccccgggcccgagtcgaaaatttccccattttgggtaatgcctccccccgagcaacggcctagcgactacgggatcccgatggacgtagaaatggcatacgtgcaggatagtttccttaccaatgacatcctccacgaaatgatgcttctagtggagttctacaaaggatcgcccgatctggtcagattgcaggagccctggtctcaagagcatacttatctggataagctgaaaatctctctggcatcccgcactcctaaggatcagagcctatgtcacgtgctcgagcaggtttgtggagtgctgaagcagggctcttag

SEQ ID NO: 31361 - DNA, 1035 bp, Artificial Sequence
  Description of Artificial Sequence: Synthetic coding sequence
taagccagtatgctgcccgagcagctctacttcttgcagtcccctcccgaagaggaaccagaataccaccccgatgctagcgcccaggaacttaacgtgcgagaatcggacgtcagagtgtgcgatgaatccagctgcaaatatggaggggtgtgcaaagaagatggtgatggcctcaagtgcgcatgccagttccagtgtcacactaattacatccctgtgtgcggctctaacggggacacttatcaaaatgagtgcttcctgagacgggctgcctgcaaacatcaaaaggagataaccgtgatagctagagggccttgttatagtgacaacgggtccggatccggagagggggaagaagagggcagcggagcggaggttcatagaaaacacagcaaatgcggaccctgtaaatataaagcagaatgtgatgaagatgcagagaacgtcggatgtgtgtgtaatatcgattgcagtggttactcgtttaatcccgtgtgcgcttcagatgggtcctcttacaacaatccttgtttcgtcagggaggcctcatgtataaaacaggagcagatcgatatcaggcacctaggccactgcacagacacggacgacaccagtctgcttggaaagaaggatgatggactccagtacaggcccgatgtcaaggatgccagcgatcaacgtgaggatgtctatataggtaatcacatgccatgcccagagaacctaaacggatactgtatccacggtaagtgcgagttcatttattccacacagaaagcgtcatgtagatgtgagtctgggtacactgggcaacattgtgagaagacggattttagtattctctacgtcgtcccatcaaggcagaagctgactcacgtgttgatagcagccatcattggagctgtgcagatagccattatcgtagcgatcgtgatgtgtattactcggaaatgccccaaaaataatcgcgggcgacggcagaagcaaaacttgggacacttcactagtgacacctcgtcacggatggtgtag

SEQ ID NO: 31362 - DNA, 573 bp, Artificial Sequence
  Description of Artificial Sequence: Synthetic coding sequence
ggcagtttcgtgccagccgaagaggctgaaatcggggcagttgacgccatattcactcggatccatagctgtgagagcatttccctaggcctcagtaccttcatgatagacctgaatcaggtggcaaaagccgtgaacaatgctacggcccaatccctcgtacttatcgatgagttcggcaagggcactaatacagttgacggcctggctctgctggctgcagttctgagacactggttagctagaggccctacctgccctcacattttcgtagccactaactttctgagtctggttcagctgcagcttctgcctcagggtccccttgtccagtatctgacaatggagacatgcgaggacggcaatgatctcgtctttttctatcaggtaagcgacctaatccgctccggcaagcctatcaaaccagtgaaggacctcttgaagaagaatcagatggagaattgtcaaacactggtggataagttcatgaaactcgacttggaagatcccaacctcgatcttaatgtgttcatgtcgcaggaggttttgccagctgccacctctatcctgtag

SEQ ID NO: 31363 - DNA, 1146 bp, Artificial Sequence
  Description of Artificial Sequence: Synthetic coding sequence
atggccgcctttggtcgccaggtcttagattggcatcgcctgatccccctgacctgggcctgcatggcaaggcaaacaccacatctgggggagcagcggcggacaaccgcatccctactgaggaaactgacaactgcatcaaacggaggagtgatcgaggagctgtcatgtgtgcgcagcaataattatgtgcaggagcccgaatgtcggcgcaatttagtgcaatgtctcctcgagaaacaagggaccccagtcgttcaggggtctctcgagctggagcgagtgatgtcctccctgcttgatatgggtttcagcaatgcccacattaatgaactattatctgtacgaaggggagcttccctgcagcagctactggacattatttcagagtttatcctactaggcttaaaccccgagccagtttgcgtcgtgctgaagaagtccccgcagctgctaaagctgcccatcatgcagatgcgaaaaaggagctcctatcttcagaagcttggattgggcgaaggtaagctgaagagggtgttatactgctgtccggagatctttaccatgcggcaacaggacataaatgacaccgtccgcctcctgaaggaaaagtgtctgttcaccgtccaacaggttactaagattctccactcatgtccttctgtcctgagggaggacctcggccagctggaatacaagttccagtacgcttactttcgaatgggtataaaacaccctgacatagtgaaatcagagtacctgcagtattctctgaccaagattaaacagaggcatatctacctggagcgactggggaggtatcaaacccctgacaaaaagggtcagacccagatcccaaatcccctgctgaaggatatcctgcgggtgtctgaggcagagtttctggcaaggaccgcatgtactagtgtcgaggagttccaggtgtttaaaaaattactcgcccgcgaggaggaggagagtgaatcaagtacttctgacgataagagggcgagtctagatgaggatgaagacgacgacgatgaggaggataatgatgaagatgataatgacgaagatgacgacgatgaggacgatgacgaagcggaagataacgacgaagacgaagatgatgatgaggaggagtag

SEQ ID NO: 31364 - DNA, 75 bp, Artificial Sequence
  Description of Artificial Sequence: Synthetic coding sequence
atggctccaagaggcttctcttgcctcctgctcagcaccagcgaaatcgacctccccgtgaaacggaggacatag

SEQ ID NO: 31365 - DNA, 75 bp, Artificial Sequence
  Description of Artificial Sequence: Synthetic coding sequence
atgaccacaagaggcttctcctgtctgcttttgttaataagggaaattgatctctcagccaagaggcgcatctag

SEQ ID NO: 31366 - DNA, 75 bp, Artificial Sequence
  Description of Artificial Sequence: Synthetic coding sequence
atggcaacacgaaggttcagctgcctactgctgtcaacctcagaaattgacttgtctgtaaagcggcgcatttag

SEQ ID NO: 31367 - DNA, 87 bp, Artificial Sequence
  Description of Artificial Sequence: Synthetic coding sequence
atggccactcagggcttcagctgtctcttattgtcagtgtctgaaatcgatctgagtatgaagcgccagtacaaacagatccgatag

SEQ ID NO: 31368 - DNA, 75 bp, Artificial Sequence
  Description of Artificial Sequence: Synthetic coding sequence
atggctacacctgggttctcctgtctattgctgtcaacctctgagattgatctgccaatgaaacgaagggtttag

SEQ ID NO: 31369 - DNA, 75 bp, Artificial Sequence
  Description of Artificial Sequence: Synthetic coding sequence
atgactccaagaggctttagttgcttgctgctgccaacatccgagacggacctgcccgtgaagcggagaacctag

SEQ ID NO: 31370 - DNA, 75 bp, Artificial Sequence
  Description of Artificial Sequence: Synthetic coding sequence
atggccactggagggtttggctgcctgttgctacttatccgggaaatcgacctcagcgtgaagagacagatctag

SEQ ID NO: 31371 - DNA, 75 bp, Artificial Sequence
  Description of Artificial Sequence: Synthetic coding sequence
atggccccccgcggatttagttgtctgctactgtcaacgtccgaaattgacctgccagtgaagcgtagggcgtag

SEQ ID NO: 31372 - DNA, 75 bp, Artificial Sequence
  Description of Artificial Sequence: Synthetic coding sequence
atggcgaggagggggtttagctgtttgctcctttccaccacagctacagatttgcccgtgaaaaggcgaacatag

SEQ ID NO: 31373 - DNA, 3447 bp, Artificial Sequence
  Description of Artificial Sequence: Synthetic coding sequence
atgccactgtttaagaatacttctgtttctagtttatacagcgggtgcaggcttactctcctgcgaccagaaaaggacggcgcggccacccgggtcgacgccgtgtgtacacatcgacccgacccgaagtcccctggcctggaccgtgagcggctttactggaagctgtcacagctgacccacggaatcaccgaactcggaccttatacgcttgatcgacatagcctatacgtgaacggtttcacccaccagagctcaatgacgactacaaggactcctgatacctctacaatgcacctcgcaacctccagaaccccagcttccctttccggccctatgaccgccagcccccttttagttcttttcacaatcaacttcaccattaccaatctgcggtacgaagaaaacatgcaccacccggggtctcggaagtttaacactaccgaacgggttctgcaaggtctcctgaggccagtctttaagaacacatccgttgggccgctgtacagcggttgcagactcaccctcctgcgacccaaaaaggacggcgctgccactaaagttgatgcaatttgcacttacagacccgatcctaagtctccagggttagacagagaacagctatactgggaactatcgcagctcactcattcgatcactgagctaggcccttacactctggacagggattccctgtatgtcaatggtttcacgcaacggtcatccgtccctaccacaagcatccccgggacacctaccgtcgatcttggaacctccggtacccccgtgtccaagccaggtccaagtgccgcctcacccctcctagtgttgttcacgttaaatttcacaattaccaacctgcgttatgaggagaacatgcagcatccagggtctaggaaattcaataccacagagagggtgcttcagggcctactgcgcagcctattcaagagtacaagcgtgggccctctctacagcggatgtcgcttgaccctactgcggccggagaaggatggaactgccacaggagttgacgcaatttgcactcaccacccagatccgaagagcccccgattggatagagagcagctatattgggaactttctcagctgacgcataacatcaccgagttaggaccgtatgctcttgataacgacagcctgttcgtcaacggatttacacaccggagctcagtgagcactacgtctacaccgggtacacccactgtgtacttaggggcatccaaaactcccgcttccattttcggtccttcagccgcctcccaccttttgatcttgtttacattgaacttcacgattacaaatctgcggtatgaggaaaacatgtggcccggcagccgaaaattcaacactacagagagagttctccagggcctcttgcggccattgttcaagaacacgtccgtgggccccttgtatagtggatgccgcttgacccttcttaggccggagaaggacggggaagcaacaggagtggacgccatttgcacccaccggcccgatcccaccggcccaggcttagaccgggagcagctgtacctcgaattgagccaacttactcatagcattacagagctcggcccctacactttggaccgagacagcctgtacgtcaacgggttcactcacaggagcagcgttccaaccacatctacaggtgtggtgtcggaagaaccattcacactgaactttacgatcaataacctccggtatatggcggacatgggccaacccggaagtttgaaattcaacataacagacaacgttatgcaacatttattgagccccctgttccaaaggtcttcactaggagcacgttatacgggctgcagagtcatcgctctgagatcagtgaaaaacggagctgaaacccgggtggatctactgtgtacctatcttcaacccttgagcgggcctgggctcccaatcaaacaggtcttccatgagctgagccaacaaacgcacggcattaccagacttgggccgtactctctggataaagacagcctgtatctcaacggctacaacgagcccggccctgatgaacctcctaccactcccaaacccgccaccaccttcctcccaccactttccgaggccactactgccatgggctatcaccttaagacattgaccctcaacttcacaatctccaatctccagtatagcccagatatgggtaagggaagcgcgacatttaactcaacggagggcgtcctgcagcacctgctgcgccccctgttccagaagagttctatggggccattttatctcgggtgtcaactgatctctttgagacccgaaaaagatggggccgccaccggggtcgatactacctgtacttaccaccctgaccccgtaggaccggggttggacatccagcagctttattgggagctgagccagctgactcacggggtcacccagctgggtttctacgtgcttgaccgcgattccctcttcatcaatgggtatgcgccccaaaaccttagtattcgaggcgaataccagatcaacttccacatcgtgaattggaacctgagcaatcccgatcctaccagctccgaatatatcactctcctaagagatattcaggataaagtgaccaccctgtataagggcagtcagctccacgatactttccgcttctgccttgttaccaacttaaccatggattccgttcttgtcacagtgaaggcgctgttcagcagcaatcttgatcctagtttagtggaacaggtctttctggataagactctgaacgcaagctttcactggctggggagtacataccaactggttgacattcatgtaactgaaatggagagcagcgtctatcaacctacctctagtagttccacacaacacttctacctgaacttcacaatcacaaatctgccttacagccaagataaggctcagcctggcaccactaactatcagcgaaataagcgaaacattgaggatgctctgaatcagttattccggaactcttcgatcaagtcctacttttctgactgtcaagtgagtacattcaggtctgtgccgaatcgacaccataccggtgtggactccctctgtaatttctcccctttggccagacgggtcgatcgagtggccatctatgaggaatttctcagaatgactcgaaacggtacgcagctacagaacttcaccttagataggagctcagtgcttgtggacggatactccccaaataggaatgagcctttgacaggaaattctgacctgcccttctgggccgtgatcctgatcggactggccggtcttctcggagtcattacctgcctcatctgtggggtgctagtcacaacaagacggaggaagaaagagggtgaatacaacgtccagcagcaatgtcccgggtattatcagtctcacctggatcttgaagatctgcaatag

SEQ ID NO: 31374 - DNA, 750 bp, Artificial Sequence
  Description of Artificial Sequence: Synthetic coding sequence
atgaacagtcagcaaactccagtagggaccccgaaagataaacgcgttagtaacacccctctgcgcaccgtggacggctccccaatgatgaaggccatgtactcggtggagatcaccgttgagaaggacaaggtgacaggagaaacacgggttttaagctctacaaccctgctgccccggcagccgttgccacttggcatcaaggtgtatgaagacgagaccaaagtggtgcatgccgtggacggcaccgcggaaaacggaatccatcccctgtcctcctccgaagttgatgagctgatacacaaagcagacgaagtgacactctcagaggcaggttctacagctggggctgccgaaaccaggggtgccgtggagggggccgcacggacaaccccttcacggagagagataaccggcgtacaagcgcaaccgggggaggcaacatccggtcctccaggtattcagcctggccaggagccccctgtgacgatgatttttatggggtaccagaacgtcgaggacgaggccgagacaaagaaggtcttgggcctgcaggacaccatcacagccgagctggtcgtaatagaggacgcagccgagccaaaagagccggccccaccaaacgggtccgctgccgaaactgaggctgcatcacgggaggagaatcaagctgggccagaggccacgacatcagacccccaggatctggatatgaaaaaacaccggtgcaagtgctgctctataatgtag

SEQ ID NO: 31375 - DNA, 1344 bp, Artificial Sequence
  Description of Artificial Sequence: Synthetic coding sequence
accgcagctggcccccttttggttccatttactctgaatttcaccattacaaacctccaatatgaagaagacatgcaccaccccggatctcggaagttcaacacaactgagagggtgttgcagggccttttaggccccatgtttaaaaacacttccgttggcttactctactccgggtgtcgcttgaccctgctgcggcccgaaaaaaacggagccgcaactggcatggacgcaatctgtagccacaggctggacccaaaatcacccggactgaacagggaacagctctattgggagctcagccagttaacccacggcattaaagaactcggcccgtataccctcgatagaaatagcctctacgtgaacggttttacacatagaagcagtgttgctcctacctcaacccccggcacctcgaccgtggacctggggacatccggaacaccgtcttccctgccaagccctaccacagcagtccctctattagtgccattcaccctcaattttacaatcaccaatctgcagtatggggaggacatgcgccatcccggatcccggaagttcaataccacagagagagtgctgcaggggctgctcgggccgctgtttaaaaactctagtgtaggtccactgtatagcgggtgccgcttaatttccctcaggtctgaaaaagatggggccgcaactggagtggacgcgatttgcactcaccacctgaatccacaaagtccaggcctggaccgggagcagctttattggcaactatctcagatgactaatggcattaaagaactaggaccgtatactctagacaggaattcactatacgtcaacgggtttactcaccggtccagcggcctaaccacctccacaactggccctctgctggttcccttcactcttaacttcacaatcactaatctgcagtacgaagagaacatgggtcaccccggttctcgcaaatttaacattactgagtctgtgttacaaggcctgctgaagcctctgttcaagtcaacctccgtcggtcctctgtactctggctgcagactgaccctgctgagaccggagaaggatggtgtcgctacccgcgtcgacgcgatctgtacccaccggccagatccaaaaataccagggcttgataggcagcagctctattgggaactttcacagctcacccattctattaccgagctgggcccttacacccttgatcgggactctctgtacgtaaatggtttcacccaacggtcatccgtcccgacgacttctacgcctgggaccttcactgtgcagcccgagacgagtgaaactcccagctccctgccaggcccaacgtag

SEQ ID NO: 31376 - DNA, 5322 bp, Artificial Sequence
  Description of Artificial Sequence: Synthetic coding sequence
atgcggaggggcaacatatcccctgccttctggtttctgtggctgttactattcggactactgggaccatcttccgaaaacacaaccgccttcacaaagggatccgacacgactaccgcatccataacagggtcagagactacaatggcctccaccatggcctccacatcagccctgacaactgggtctaagataacgacagactctaccacgggttctgaaaccacgagtgctagtactatggcgagcacagccgcctttactaccgggtcagagaccaatacagcctctaccaccgactcaggcacaaccatcgcaagtactcgtactttcacaacgggatccgataccacgacaggctcaactgccgggtccgagactatcgtcgcttcaaccactgtgagcggcacaaccacgaccttcacaattgcttccacaacagtcccagagactacaatggcctcctctaccaccagcacagcaggttccgagaagaccatggcatcatccattatctcagagacaaccatggcctccaccaccgggtccgagacggcgacagtgtctaccacagggagtgaaactacgaccaccagcactgcctccagcgaagctacaaaagtctcgactacgggtagtgagactacaaccgccagcacagccggatcagagactacaaccacatcaacttcaatggcaggtagcgaagccaccaccacatccaccgctgattccaaggtgatcacggcaagttctatgtctagtgaaaccacggttgcgcccgcagcagggtctaacactaccacagcctcaacaaccgggtcagaaacaacaaccatccttatcaaggctagtgaaacgacaaccgcttccacagcaggaagcgagaccaccaccccttccccgaccggatctcagactacaatcgtttcaatcagtggctctgaaataaccacaacaagcacggcaggctctgaaaacactacagtctcctcagccgggtccggaaccacgactgcctcaatggcagggtctgagaccacagtgtccaccgctggttcagagacaacgacagtgtcgatcactggaacagaaacaaccatggtgagtgcaatggggtctgaaacgaccacaaacagtaccacgtcctcagaaacgaccgttacttccaccgccgggtctgagaccactaccgttagcactgtcggatccgaaactacgactgcatataccgcggatagcgaaacaactgctgcttctacaacaggctcagaaatgacaaccgtgttcaccgccggttctgaaactataacaccttccacagccggaagcgagaccacaactgtgtctactgccggctcggagaccacgacggtcagtacaaccggaagcgagacaaccaccgcttcgacggcccattctgaaaccacggctgccagtacaatgggaagtgagaccactaaggtctccaccgccggctcggagactacagtgtctactgcggggagcgaaacaaccgctgcttcaacagaggacagcgaaacaaacaccgcttttacggaagactctaagaccaccacagccagcaccaccggctttgagactacggccgcaagtactaccggcagcgagcccaccatggcatctaccatgggtagtgaaactacaatggcatccactataggacctgagacgaccaaggtgtcaacagcctcctctgaggttacaacagtctttgccgccgggtcagaaaccatcagagcttcgactgtcgggtctgagacgaccactgtctccacaacaggaagtgagactactactgcatccatcatgggctctgagacctcaactgatagcacaaccggtagcgagactaccactgcttcgacagagggctcagaaaccaccacagcttcgaccgaggggtctgaagcgacaaccgtcagcaccacagggagcgagacaaccacagtttctatcactgactccgagaccaccactacttgcactgaagggagtgaaatgaccgccgtgagtacaacagtattcgagacaaccacagcctctaccgaaggcagcgaaattactatcgcctctacgagcgactctgaaacaacaaccgcttccactgaaggcagtgaaactaccaccgtcacgaccgccggttctgaaaccaagacagcttacactacaggatctgaaacaaccactgcgagtaatactgggctggaaacaaccactgtgttcacgattggcagcgacactactacggcctccacagaggggtctgagaccaccgccgtctcagctacgggctctgagatgactaccgtgagcactgagggatctgaaaatacaacagtgtctacaaccggttccgagacaaccaccgtgtccacaaccgggctagagacaactactacatctaccgaaggttccgaaatgaccacagtatctacaacaggcgccgagacgacgacagattctactgaaggttccggaacgaccgctgcctccactgccggctccgagacaacgactgtctcgaccgctgacagtgaaaacaccactgccagcaccgccgactccgagactacaagtgctagcacaaccggaagcgagactacaacggcctccaccacaagttctgagactacaacggcatctacagagggatccgagactaccactgtgtccaccaccgatagcgagaccaccatggtgagcaccacggggtccgaaaggacaattacttctacagaaggcagcgagacgaccacagtgagcgcgacgggcagcgaaactacggtgagcaccgaaggctctggcaccaccaccgtgtcgataacgggttcggagacgacaaaggtgtcgacaaccggatctgaaaccaccacaacttctaccgagggttccgaaattacaacagcttctattacggggtcagagaccacaacggcctcgactgaaggatccgaaaccactacagccagtacagagggctcagagacaacatcagccagcacaacagggagcgagaccacaactgcatccacgacaagctctgagactactatggcgtcaatcatgggatcggaaactacaatggcttctaccataggatccgaaactactaaagtctctacagcgtcctccaaaatgacaacggtgtttactgaaaattctgagactacgatcgcttcaacgaccgccagcgaaacgacaactgtgagcacggctgggtccgagacaatcccggcttctactgccggatcagagacgaccactaccactagtaccgaaggatcagagactaccacagctagtacagagggttcagaaacgactaccgcatcgacagagtcatccgaaaccaccactgccaccaccatagggtctgagactacaactgcatccactgaaggctccgagacgactacgacatccacagaggggtccgaaaccaccactgcttccaccgaaggctccgaaataaccaccgtgagcaccacaggatcggagactaccacagcatcgacagaaggatccgagaccactacggcctctactgagggcagcgagcttaccaccgtctctacgacgggcagcgagaccatcactgtgtcagcagaaggaagtgagaccaccaccgtcaccacaatgggctcggagacgaccaccgcttccacggccggcagtgagaccactaccgtctcaactgccggatcagagaccacgactgcctccattgaaggaagtgagaccaccaccgttagcagtaccggatctgagaccactaccgtttctactaccggcacagaaacaaccatcactagcactgagggatccgagacaacaacagtcaccactgctggcagcgagacaaccgccgtctacaccactgggagtgagacgaccactactagcaccgagggaagcgagactacgaccgtcagcacaaccggcagcgaaacaacaactgcatccaccgcggatctcgaaaccacgacagtgagtacgagcgggtctgggaccacgaccgcttctaccgccggtagtgaaactacaactgtttacattacagggagtaagactaccacggcatcaacagagggatcagaggccacaactgtttcaactacctcttctgagacaaccaccgcgtcaactactggaagcgagatgacgactgtgttcacaaccgtgtccgaaactaccactgtgtctactataggctcagaagctacaacatctagcgcagctggctccgaggccacaacgacatcgactgaagggagcgaaactacgactgccagcaccgcaggatctgagaccacgacagccagcaccgcgggctccgagactaccaccgcctctacatcgggatccgagaccaacacggcttgtaccacaggaagtgagacatctactccatcgtcagccggctctgagacaaacaccgcgtttatcatcggcagcgaatccacaattgcaagcactgcaagcctggaacctacagcaacgagtcttactggaagcgaaaccactaccgtatccattactgcgagcggcgccaccgctgcgtctaccaccgtcagctcaactaccttcgtgctcactaaggctaccgacgtgagtatccagccgatcactaacacccccatgagcggaacaagaacaacaggtactcgactgactgcctcctcctcagtaacaatggccccaggtatggactttacggcgtcagctgcatcccataccgtgccaggtatcgtcctcaatacctctggactcggaacaagcactatgggggcctcaagcaccaccagcgctcacggtgtgagaaccaccactgggtccacgcgtgaacctacttcttcaacatttcaggaaaccgggcctgtaagcatggggactaataccgtttcaatgtctcacaccccaacaaatgtcatcaaacccagtggctacctccagccatgggctatcattctcatctctctggcggccgtcgtcgcggcagtgggactgagcgtcgggttgagtttctgtctgcgcaatctgtttttcccattaagatattgcggaatatattatccacatggacactcccacagcctggggttggacctgaacctcggactcgggtcgggcactttccactctttggggaacgctctcgtccacgggggggaactggagatggggcatggcggcacccatggcttcggttacggggtgggccacgggctgtctcatatacacggagacggttatggcgtgaatcatggaggtcactacggccacggagggggtcactag

SEQ ID NO: 31377 - DNA, 1701 bp, Artificial Sequence
  Description of Artificial Sequence: Synthetic coding sequence
atgaaaatgcagaaaggaaacgtgttgcttatgtttggccttctgctgcatttagaggcagccaccaattctaacgaaactagcacatcggcaaacactggttcatccgttattagttctggcgctagcactgccacaaattctgggtcctccgttacttcctccggcgtctcaactgccactatttcaggctccagtgtcacttcgaacggagtgagcatcgttacgaactctgaattccacaccacttcctcaggcatctcaacagccaccaacagcgagtttagcacggccagtagcggcattagcattgctactaactcagagtcgtcaaccacttctagtggtgccagcaccgccacgaatagcgaaagtagtacccctagttctggcgcatcaactgctacgaactcagacagtagcactacaagcagtggcgcgtcgacagccaccaacagcgacagctctaccacttcgagcgaggcctccaccgccactaattcggaatcttctaccacctccagtggggctagtacagctactaacagcgaatcctcaactgtgtctagcagagcctctaccgcaaccaattcagaatcttctaccacttcttccggggcctccactgcaacaaattctgagtctagaacaacaagcaatggagccgggactgccactaattctgaatccagtaccacatcctccggagcttcgacagccactaactctgagagcagtaccccatcctccggggcaggaaccgctactaactcagagagttcaacgacaagttctggagccggaaccgctacgaactctgaaagttctacagtttccagcgggatctctaccgtcacgaattctgaatcctccacacctagtagtggggcgaataccgctacaaatagcgaatcatctacgacatcatccggcgccaacactgctactaattcggacagctctactacctcctccggagcttccaccgccactaactccgagtcttccactacctcatctggggccagtacggccacaaacagcgagtcgagcaccacctctagcggcgccagtacagcaactaactccggctcctcaactacctccagtgggacatccacagcgacgaactcagagagcagtacagtgtcctcaggcgccagcaccgcaacaacgagtgagtcttctaccacgagcagcggggcatctaccgccacaaatagcgagtcctctaccgtgtcctctggtgcctcaactgcaacgaatagtgagtcaagtactacttccagcggggcaaacaccgccactaatagcggaagctctgtgacatctgccgggtccggaaccgccgctctcacaggcatgcacacgacaagccacagcgcttctaccgccgtgagtgaagccaagccaggaggctcgcttgttccctgggaaattttcctgataactctggtcagcgtggtggctgctgtaggactctttgcaggcctcttcttctgtgtaaggaactccctgtccctccggaatacgtttaatacggcagtctatcaccctcatggactgaaccatggcctcgggccagggccaggaggcaatcatggcgcaccccataggcctcgctggtctcctaactggttttggcgcagacccgtttcgtcaattgctatggaaatgtccggacgcaacagcggcccatag

SEQ ID NO: 31378 - DNA, 1701 bp, Artificial Sequence
  Description of Artificial Sequence: Synthetic coding sequence
atgaagatgcagaaagggaacgtcctgctcatgttcggcctcctcctccacctggaggcggcgacgaattccaatgagactagcacctctgccaataccgggtcctctgttatctcttccggcgcctccacagccaccaattctgggtcaagcgtcactagctcaggcgtcagcaccgccaccatctctgggagtagcgtgaccagcaacggtgttagcattgtcaccaatagcgagtttcacacgacatcatccgggatttccaccgcaactaatagtgaattcagtactgctagcagtggcatctcaatcgccacaaacagcgaatctagcaccactagctcaggggctagtaccgctactaactccgagagtagtactccaagctcaggggctagtaccgccacaaacagcgatagttcaaccacctcgagcggggcctcaaccgctacgaatagtgactctagtactacatccagcgaggcctccaccgctaccaacagtgagtcctcaacaacatcctcaggagcatctaccgctactaactccgagtcttccaccgtttcttcaagggcgtcaaccgctaccaactcagaaagcagcaccacctcctccggcgcttccaccgccaccaactctgagagtcgcaccacttcgaacggggccggcactgctacaaactctgagagttcaaccacaagttccggtgcttctacagcgaccaacagcgagtcctctacccccagttcaggagcagggaccgcgacaaatagtgagtcctcgaccaccagctcgggagcaggaacagcaactaatagcgaaagcagcactgtgagcagcggaatcagcactgtcaccaatagcgagagtagcaccccatccagcggagcgaacaccgctacgaacagcgagtctagcaccacgtccagtggagccaatacagctacaaacagtgactctagcactaccagcagcggagccagtaccgctaccaatagcgagagctcaacgacgagcagtggcgcttcgacagctacgaactccgagagctccaccacaagctccggcgccagcacagccacaaactccggctcatctaccacttcttcaggcaccagcacagccacaaacagcgagtctagtactgtttcctctggcgccagcaccgccaccacaagcgaatcatctacaacctctagtggtgcctctactgccactaatagcgagagtagtacagtgagttctggagcaagcaccgcaaccaactctgagagcagtactacaagttccggcgcgaatactgctacaaacagtggctcgagcgttacctctgcaggatccggcaccgccgcgcttaccggaatgcacacaacgagtcacagcgctagtaccgccgtgagcgaggccaaaccaggtggcagccttgtgccatgggaaatcttccttattacactggtgagcgtagtagctgcagtgggtctgttcgctggcttattcttttgcgtgaggaacagcctgagcctccgtaatacctttaacacagccgtctatcacccacacggactgaatcacggcctgggccctgggcctggggggaaccatggcgcgccccataggccaagatggtctccaaattggttctggaggcgaccggtctcttccattgcaatggagatgagtggacgaaattcaggcccttag

SEQ ID NO: 31379 - DNA, 1701 bp, Artificial Sequence
  Description of Artificial Sequence: Synthetic coding sequence
atgaagatgcagaagggcaacgtgcttttgatgttcggcttactcctgcatctggaggccgccaccaactccaacgaaaccagcaccagcgctaataccgggagctctgtcatatccagcggtgcaagtacagctaccaattccggtagttccgtgaccagctccggagtgtccactgccacgattagtggatccagcgtcaccagtaacggagtgtccattgtgactaactccgagtttcataccacctcctcagggatatccaccgcaactaactcggagttcagcacagccagctctgggatctcaatcgcaaccaattctgaatcctcaactacaagttctggcgcatctactgccaccaactctgagtcaagcacaccctcctctggcgcatcaaccgctacaaattcggactcgtcaactacttcatccggagctagtaccgctactaattctgacagcagcactacatcctcagaggcctccaccgccacaaattctgaaagcagtacaacgtcctcaggcgcaagtaccgctacaaactcagagtctagtactgtgagctctagagcttccaccgcgactaactccgagagctcaactacctcatcgggggctagtaccgccacaaattctgaaagccggactacgagcaatggcgcagggactgctacaaactctgagtcgtccacaacaagtagtggggcgagcactgccactaactcagaaagtagtacaccaagttccggggccggaaccgcgacaaattccgaatcatcaacaacctcatctggggcagggactgccactaactcagaaagctctaccgtgagctccgggataagtacggtcacaaatagcgaatcttccaccccatctagtggggcaaacacagcaactaactccgagtcatctactacgagctccggcgccaacaccgccaccaacagtgatagttcaaccaccagtagcggtgcctcaacagctaccaactctgagtcatccaccacatcatcaggagctagcacagccacaaactctgagtcgagcaccacctcctccggagcatccactgccaccaactcaggttcatcaacaactagctctgggactagcacagctacaaatagtgagtcttccacagtgtcaagcggggccagcacagcaaccaccagcgagtcctctacaacttctagcggtgcgagtaccgctacaaatagcgaatccagtacagtgagttcgggagctagcaccgcaaccaactccgagtcttccaccacttcctctggcgccaacactgccacaaattctggcagcagcgttacctccgcgggcagcggcacagctgctttaaccggaatgcacaccacaagtcacagtgcttctaccgctgtgtcagaagcgaaacctggaggttccctcgtgccatgggagatcttcctgattacactggtctctgtggtcgctgccgtgggcttattcgccgggttatttttttgcgtccgtaactctctgtcactgcgcaacacatttaatactgctgtgtatcacccccacggtctgaaccatggcctgggcccaggcccaggcggcaaccacggggccccacatcggcctagatggtctccaaactggttctggagaaggcccgtgtcaagcatcgccatggaaatgtccgggaggaactctggcccgtag

SEQ ID NO: 31380 - DNA, 1251 bp, Artificial Sequence
  Description of Artificial Sequence: Synthetic coding sequence
atgaagatgcagaaaggaaatgtcctactgatgttcgggctgctgttgcacctagaagcggcgaccaattccaatgaaacatctacatcagctaacacaggatctagcgttatcagctcgggggcttctacagctacaaattccggtagttccgttacttcatccggcgtatcgactgcaaccataagcggctcttccgtgacatccaatggtgtctcaatcgtgaccaactccgagtttcataccactagctcagggatctcaacagcaactaactccgaattcagtaccgcttccagcggtattagcatcgccaccaactctgagagctccactacatcctcgggcgccagtactgcaactaactctgagtcaagtaccccctcttcaggtgccagcacagctacaaatagtgactcgtccactacctcgagcggcgcgtctacagcaaccaactcagattcctcgaccacctcttctgaggcttctacagctacaaatagtgaatcgtccacaacctcctccggagcaagcactgccacaaactccgaaagctcaacaacctcgagcggcgcgagtactgccaccaatagcgagtcttctactacttcgagcggtgcaagcactgccaccaactctgggtcctctacaacaagttctggcactagcaccgccaccaattccgaatccagcacggtcagttccggggcttcgaccgcaacaacctctgagtcaagcaccacatccagcggcgcttctaccgctaccaactccgagtcttcaaccgtatcctctggtgccagcactgctaccaatagcgaatcttccacaaccagctctggagctaacacagctacgaatagcgggtcaagcgtgacaagcgccgggagcgggaccgctgcactcacaggaatgcacacgactagccacagtgcatctacagcagtgtcagaagccaagccaggcggcagcctggtgccatgggagatatttctgataactctcgtatccgtggtggcagcagtggggttattcgctggactcttcttttgtgtcaggaactctctctcccttaggaacacattcaacactgcagtttaccacccgcatgggctgaatcacggcctgggcccggggcctggaggtaatcatggggccccgcatcgcccgaggtggtctccgaattggttttggcgcagaccagtctccagcatcgcaatggagatgagtgggcgtaactctggtccatag

SEQ ID NO: 31381 - DNA, 1251 bp, Artificial Sequence
  Description of Artificial Sequence: Synthetic coding sequence
atgaagatgcaaaagggaaacgtactgcttatgtttggactgctgctgcatctagaggctgcaaccaactccaatgaaaccagtacgtcggctaataccggatcttccgtaatctccagtggcgcttctaccgcaactaattcggggtcatctgttacctcttccggcgtgagtacagccactatcagtggaagttctgtgacctcaaatggtgtaagcatcgtgaccaacagcgaatttcataccacttcttctggcatttccactgcaacgaatagcgagtttagcaccgcctcaagcggcatcagcatcgccacaaactctgagagcagtacgacgtccagtggagcttcgactgcgaccaactccgagtccagcacaccctcgtccggtgcatcaaccgccaccaactccgactctagtacaacttcttccggtgcttcaaccgcgaccaacagcgacagttcaactacatccagcgaggccagcactgccacgaactccgaatcatccaccacttccagcggggcttccactgctaccaacagcgaatccagtacgacaagcagcggcgcctccactgccacaaattccgagagtagcacaacatccagcggagctagcacagcgacaaacagtggcagctctaccacatcatccggcaccagcactgctaccaattctgaatccagcacggtctcaagcggcgcctctaccgccacaacatctgagtcttccactactagcagtggggcttcaactgctacaaatagcgaatcttctacagtgtcctccggggccagcacagcgacaaactcagaaagtagtaccacttcttcgggcgcgaacactgccaccaatagtggatcctcagtcacgtcagctggttcaggcacggctgctttaaccggtatgcacacaaccagccatagcgcctccacggcggtgagtgaggctaaacctggagggagtctagtcccctgggaaattttcttgattacactcgtcagcgtggtggctgctgtcggtctttttgcaggcctgtttttttgcgtgcgaaattccttgagtctgagaaacaccttcaacactgctgtgtatcacccccatgggctcaaccatgggctggggccaggaccaggcggtaatcatggagctccccatcggccacgttggtccccaaactggttttggcggcggccagtgagcagcattgcaatggagatgagcgggcgcaactctggcccctag

SEQ ID NO: 31382 - DNA, 1251 bp, Artificial Sequence
  Description of Artificial Sequence: Synthetic coding sequence
atgaagatgcagaaaggaaacgtactgcttatgtttgggcttttgttacatctggaggccgccacgaacagtaacgagaccagcacgtccgcaaatactggttctagcgtgatctctagtggggctagcaccgcgaccaacagcgggagcagcgtgacttcctctggtgtctccacggccactatcagtgggagttctgttacatctaacggcgtgagtattgtgacaaatagcgaatttcacacaacatccagtgggatcagcactgcaacaaacagtgagtttagtactgcctcctcaggcatttccattgccaccaactccgaaagttctacgacatcaagcggggccagcaccgcaacaaacagcgagtcctccaccccctccagcggcgcatcgacagccacgaactccgatagcagtaccacatcctccggggcgtccacagcaactaatagtgacagcagcactaccagctccgaggcctccaccgccaccaacagcgagtcctcaactacttcctccggagcatcgacggctactaactcagagtccagtacaacctcctctggagcatctaccgcaacaaattccgaaagcagcaccacttcatccggggcatctacagcaacaaattctggctcctccacgacctccagcggcacaagcacagccacaaattccgaatcatcaactgtcagttctggagccagtactgccacgactagcgaatcctctacaacatcctccggtgcatccactgccacaaactcagagtcaagcaccgtgtcaagcggagcttctactgctaccaactctgagtccagcactacctcaagcggcgctaacaccgccactaactcaggctcctcagttacctcagcaggcagcggcaccgcggctctgaccgggatgcacacaaccagccattccgcgtccaccgccgtatcagaggccaagcccggcggctctctcgtcccgtgggaaattttcttgataacccttgtgagcgtcgtcgccgctgtggggctctttgcagggcttttcttctgtgtccgcaattctctgagtctgcgaaacacttttaacacagcagtataccatccccatggcctaaaccacgggctgggccctgggccaggcgggaaccacggggcaccccaccgccccagatggtctcccaattggttttggaggaggcctgtctcctcaatagcgatggagatgtctgggcgtaacagcggaccatag

SEQ ID NO: 31383 - DNA, 471 bp, Artificial Sequence
  Description of Artificial Sequence: Synthetic coding sequence
acagcccagtcattagtgcttattgatgaatttggcaaggggaccaatacagtggatgggctcgcactgcttgcagctgtgcttcgacattggctcgcgagggggcccacgtgcccacacatttttgtcgcaacaaactttctcagtctcgtacagcttcaattattgcctcaggggccgctggtccagtacttggtttgcgaaggggtagccaaggcaagtcacgcatctcacacagctgctcaagccgggctccctgacaagctggttgccaggggcaaggaggtgtccgatttgatccgctcagggaagcccattaaacccgttaaggatctgctgaaaaagaaccaaatggaaaattgtcaaaccctggtagataagttcatgaaattggatttggaagatcccaatctggacctgaacgttttcatgtctcaagaagtcctgcccgcagctacatctatcctctag

SEQ ID NO: 31384 - DNA, 1206 bp, Artificial Sequence
  Description of Artificial Sequence: Synthetic coding sequence
atgtggccagttctgctcttcgtcttcctttcacagacagtgtatagcgcacttggactacgggacgcctgtcgctctttgccacagtccattcagttgttccgagacatagcccaagaattcagtgatgacttacaccatattgcaagcttaatcggaaaggtggttgacttcgaagggtccctggccgagaacaggtttaccgttctgcccaatattgaccctgaaatcgacgaaaaaaagcgacggctcatgggcctccccagctttctcactgaggtagcacgaaaggaactcgagaacctggactcacggatcccttcgtgtagcgtcatctacattccactcatcggattcctcctctccattcctagactgccctcaatggtggaggcatctgactttgagataaacggcctggatttcatgttcctgtcagaggagaagctgcattacagatcggcgaggaccaaagagctcgacgccttgctgggagatttacactgtgaaattagggatcaggaaacactcttgatgtatcaacttcagtgccaagtgctcgctagagccgctgtactgacaagagtgttggatctggcctcaaggctcgatgtactgctcgcactggcctcagcagccagggactacggatacagcagaccgcggtactcccctcaggtgctaggtgttcgaatccagaatggcagacaccctctcatggagctgtgtgccagaactttcgttcctaattccacggagtgcgggggagacaaaggccgcgtgaaggtcatcaccggacctaactccagcggcaagtccatctacctgaaacaggtgggcctgattacatttatggctctcgtagggtcttttgtaccagcagaggaagctgagatcggggcagtagatgctattttcacccgcatccattcctgcgagagtattagcctcggtctaagtaccttcatgatcgacctgaatcaggtggctaaagcagtgaacaacgctacagcccagagccttgtcctgatcgatgaattcggaaaaggtactaacactgtggatgggttagccctgctcgcagcagtgctacgacactggctggcaaggggcccaacctgcccccatatattcgtcgccacaaattttttgtccctggtgcagctgcagctgttgccacagggcccactggtccaatatctgtag

SEQ ID NO: 31385 - DNA, 1491 bp, Artificial Sequence
  Description of Artificial Sequence: Synthetic coding sequence
accgtgtactctgcgctgggcctgcgcgacgcatgcagatcacttccccaatctatccagctcttccgagatattgctcaagagtttagtgacgaccttcaccacatcgcctccctgattggcaaggtggtggattttgagggctcactagctgaaaaccgatttactgtcctccctaatattgaccccgagattgatgagaagaaacggaggctgatgggacttccatcctttctgacagaagtggccagaaaggagctggaaaacctggatagtaggataccgtcctgtagcgtgatctacatcccactgatagggttcttgctgagtattccgaggttgcctagcatggtggaggccagtgacttcgaaattaacgggctcgacttcatgttcctctctgaggaaaaactgcactatcggtccgcccgcaccaaagagttggatgccctgctgggagatctgcactgtgagatccgggaccaagagactctcttaatgtaccagctgcagtgtcaggtgctggctcgggcagcagttctgaccagggtgctcgatttggcctcacgactcgatgttctcctcgctttagcttctgctgcaagggactatggatactcacgtcctcgatattcaccacaagtgctgggagttagaatccagaacggtaggcaccctttgatggagctttgtgcccggactttcgtgcccaacagcaccgaatgcggcggggataagggccgggtgaaagtgataacgggcccaaattcctccggaaagtctatatacctcaagcaggtcggactgatcactttcatggctctggtcggctcctttgtacctgccgaagaagccgaaatcggcgcagtggacgcgatattcaccagaattcactcttgcgaatccatctctttgggactgagcaccttcatgatcgatttgaaccaagttgccaaagcagtcaataacgccaccgcacagtccctcgtgttaatcgacgagttcggaaagggaaccaatactgtggacgggttagccttgctggccgccgtcctcagacactggttagcgcgaggacccacctgccctcatatcttcgttgccaccaactttctgtctttggtgcagctgcagctcctgccccagggaccactagtgcagtatctgacgatggagacctgcgaagatgggaacgatctagtttttttttaccaggtctgcgagggagtcgcaaaagcaagtcatgcaagccacactgccgcacaggccggtctcccagataaactggtggcaagaggaaaggaagttagcgacctgatccgctcagggaaacccatcaaacctgtgaaggacttactgaagaaaaaccaaatggagaactgtcagaccttggtggataagtttatgaagctcgatcttgaagaccctaatcttgatctcaatgtgttcatgagccaggaggttctgcctgccgctacatccatactctag

SEQ ID NO: 31386 - DNA, 2187 bp, Artificial Sequence
  Description of Artificial Sequence: Synthetic coding sequence
atggcaagcctaggcgcaaaccccagaaggaccccacagggtcctcgtccaggggccgctagctccggattcccttctcctgctccagtgccaggaccgcgcgaggctgaagaagaggaagtggaagaggaggaggagctagcggaaatccacctgtgtgtcctatggaactcggggtacctgggcatcgcttactacgacactagtgattccaccatccactttatgcccgacgccccagaccacgagtcattgaagcttctccagagagtgttagatgagattaacccccagagcgtggtcaccagcgcgaaacaagacgaaaacatgacgcggttcctgggcaaacttgcgtctcaggaacacagagaacctaaacggcccgagattatatttctccctagcgttgactttggcctggagatatccaaacagaggctgctgtctggcaactattccttcattccagatgccatgacggctaccgagaaaattcttttcctcagcagcatcataccctttgattgcctcttgacagttcgggctctgggaggtctcttgaaattcttgggccgacggcggatcggggtggaactggaggactacaatgtctccgtcccgatccttgggtttaaaaagttcatgttgacacacctcgtgaacattgatcaagacacttattctgtcctgcagatcttcaaatcagaaagtcacccatctgtgtacaaggtagccagtggcctcaaggaggggctctctctgtttggaatcctgaacaggtgccactgcaagtggggcgaaaagctactgcgcctgtggtttacccgcccaactcacgatctcggggaactctcttcacggctggacgtgattcagtttttcctgcttcctcagaacctggatatggcgcagatgctgcatagactgctcgggcacataaaaaatgtgcccttaattctgaaaagaatgaaactgtcacacactaaggtgtccgattggcaggtgctctacaaaacagtgtactctgctcttgggctgcgcgatgcgtgtaggtcgctgccccagagcatccaactattcagggacatcgcccaggaattctccgacgacttacaccatattgccagtctcattgggaaagtggttgacttcgaaggctcactggccgaaaaccggtttacggtgttacccaatattgatcccgaaattgacgaaaaaaagcgtcggctcatgggcctccccagtttcctcaccgaggtggcgcggaaggagcttgagaacctcgattcccgcatcccttcttgttctgtgatctatattcctttgatcggattcctactgtccattccacggttaccatcaatggttgaggcttctgacttcgagatcaatgggctggactttatgtttctatcggaggagaaactgcactaccgctctgcgaggaccaaggagctggacgcgctcctgggggatctacattgtgagatccgcgatcaggagacacttctcatgtaccagctacagtgccaggtgttggctagagccgccgtactgaccagagtcctggaccttgcctcaagactggacgtgttgttagcattagccagtgccgccagggattacgggtattcgaggccacgctatagccctcaggtactgggcgtgcgtattcagaatgggcgacatcccctgatggagctgtgcgcacggaccttcgtccctaatagtactgagtgtggaggggataaaggccgcgttaaggtcatcacagggccaaactcgagcggcaaatctatctatctgaagcaggtgggcctcatcacattcatggccttggtggggtctttcgtgccggctgaggaagccgagattggcgccgtggacgcaatattcacaaggatccactcgtgcgagtccatttctctgggtcttagtacatttatgattgacctgaatcagcaggtcgccaaggccgtaaacaatgcgaccgcacagtccctagtgctaatcgatgagtttgggaagggtacgaacacagttgatgggctggcacttcttgctgctgttcttaggcactggctggctcggggtccgacctgtccccacatcttcgttgcaacaaatttcctgagtctcgtgcagctccagctgctcccacaaggaccacttgtgcagtacctgtag

SEQ ID NO: 31387 - DNA, 585 bp, Artificial Sequence
  Description of Artificial Sequence: Synthetic coding sequence
atggcctccctgggcgccaacccacgcaggacgccccagggtccacgaccaggagcggcttccagtggctttccctctcctgctccagtcccggggcctcgcgaggccgaggaagaagaggtcgaggaggaagaggagttggctgagattcatctttgcgttctgtggaacagcggatacctggggatagcatattatgataccagtgactccacgattcatttcatgccagacgcccccgatcatgaaagtctgaaactgttacagcgagttctcgacgaaatcaacccccagtcagttgtcacatccgccaaacaggacgaaaacatgacccgtttcctaggaaaactggccagtcaggagcaccgggagcctaagaggcccgagattattttcttaccaagtgttgattttggactggagatttcaaaacagcgactgctcagcggtaactacagctttatcccagatgcaatgacagctaccgaaaagatcttatttctgtccagcattatccctttcgattgcctgttgactgtgcgggccttgggtgggttgctgaagtttttaggacggcggagatag

SEQ ID NO: 31388 - DNA, 1002 bp, Artificial Sequence
  Description of Artificial Sequence: Synthetic coding sequence
aaaatcttgtttctgtcctctatcattccttttgattgcctgcttacagtacgggcactcggcggtcttctaaagtttctgggccgacgacgcatcggagttgagttagaggactataacgtgtcggtacccattttgggatttaaaaaattcatgctgacgcacctggtcaatattgaccaagacacctactctgtgctccaaatctttaaaagcgagtctcatccatcagtgtacaaagtagcatctggccttaaagaaggtttatctctgttcggaatcctgaacaggtgccactgcaagtggggcgagaagttgcttaggctgtggtttaccagaccaacccacgatttaggcgaactgtcgtcaagattggacgtaatccagttcttcctgctaccacaaaacttggacatggcccagatgctgcaccgcctcctgggacacatcaagaacgtgcctctaattctcaagcggatgaagttaagccacacaaaggtcagcgactggcaggtgctatacaaaaccgtatacagtgcgttaggactgcgggacgcttgccgaagtcttccccagagtatccagttgttcagggatatcgcccaagagtttagcgacgacctgcaccacattgccagccttattggcaaagtttatttgtccccccaggtggattttgaggggtccctggcagaaaaccgttttacagtacttcccaatatcgacccggaaattgatgaaaagaagagaagactaatgggtctgccatcttttttgaccgaggtggcacggaaggagctcgaaaacctcgactcacgcatcccttcctgtagcgtaatatatatccctctgattggtttcttgctgtcaattccacgactcccttctatggtagaggcttctgatttcgagattaacggtctggacttcatgttcctgtcagaggaaaaattacactataggtcggcaagaactaaagagctggacgctctcctcggttag

SEQ ID NO: 31389 - DNA, 471 bp, Artificial Sequence
  Description of Artificial Sequence: Synthetic coding sequence
acagcccagtctctggtcttgatcgatgagttcggtaaggggacaaatactgttgacggtctggccctcctggcagcagttttacgtcactggctggcaagaggaccgacttgtcctcacatctttgtggcgacaaacttcctgagcttggtgcagttgcagttgctgcctcagggaccacttgttcagtacctggtgtgcgagggcgtagcaaaagccagccatgcttcccacacagctgcccaggcaggcttgcccgacaagctggtagcccgaggtaaagaagtctccgacctcatccggagcgggaagcctataaagcccgttaaggatctattaaaaaagaaccagatggaaaattgccagactctggtggacaaatttatgaagctggacctcgaagaccctaacctagatctgaatgtgtttatgagccaagaagtattgccggcagcgacctcaattttgtag

SEQ ID NO: 31390 - DNA, 2184 bp, Artificial Sequence
  Description of Artificial Sequence: Synthetic coding sequence
atggccagcttgggagcaaatcctaggcgcacaccacaggggcctcgccccggagctgcctcgagcggctttcctagccctgccccagtacccgggccccgagaagccgaagaagaagaagtagaagaggaggaggaacttgcagaaattcatctttgcgtgctgtggaattcaggctatctcggaattgcatactacgatacttctgatagtaccatacacttcatgccagacgcaccagaccatgagagtctcaagttactccaacgagttctggatgagatcaatcctcagtcagtggtgaccagcgcgaagcaggacgaaaatatgactagatttctgggcaagctggcgagccaggagcacagagagccaaagcgtcctgagattatcttcctcccatctgttgacttcggacttgagatctccaaacaaagactgttaagcggaaactattctttcatacccgatgccatgaccgctaccgagaagatactgtttctctcctctatcattcctttcgactgcctcttgaccgttagagccctggggggtcttctcaaatttctcggacggcggcggattggggttgaattagaggattacaacgtgtcggtacctattcttggattcaagaaatttatgctgacacatttagtaaacattgatcaggacacatacagtgtcttgcagatttttaaaagtgagtcccacccatctgtttacaaagtggctagtggcctaaaagaaggtctctctttgttcggaattctcaatcgctgccattgtaaatggggtgagaagttgctgcggctgtggttcacaaggcccacacatgacctcggcgaactgagctcccgcctggatgtgatacagttttttctgctccctcaaaatttggacatggcacagatgctgcacagactcctcggacacattaaaaacgtgcctctgattctcaaacgaatgaagctgtcccatactaaggtgagcgattggcaggtactgtacaaaacagtgtacagcgctctcgggctccgggatgcttgtaggtccctgccacagtctatccagttgtttcgcgatattgctcaggaatttagtgatgacctccaccatatagcaagtctcattggcaaagttgttgatttcgaaggaagtctggcagagaaccgcttcactgtcctgcccaacatagacccagaaatagacgaaaagaaacggaggctcatgggactgccaagttttctcaccgaggtcgcccgcaaagaactcgagaacttagatagtagaatcccctcctgctccgttatatatatacctttaataggcttcttgttgtccatacccagactgcctagcatggtggaagccagcgattttgagattaatggcctagatttcatgttcctttccgaagagaagctgcattatcgcagcgctagaacaaaagagctggacgccctgttgggcgacctgcactgcgagatacgcgaccaggagacgctgctgatgtaccaacttcagtgtcaggtgctggctcgtgccgcggtcctgacgcgggttttggatctagcttcaagactggatgtgctgctggccctagcaagtgccgcccgcgattacggatacagcaggccacgatactcccctcaagttttgggggtgaggatacaaaatggtcgccatccacttatggaactgtgtgctcgtaccttcgtaccaaactcaaccgagtgcggcggggacaaagggcgcgtgaaggtgattaccgggcccaattccagtggtaaatccatttacctgaaacaagtaggcttgatcacctttatggcgctcgtgggcagttttgtgcccgccgaggaggctgagattggagccgtcgacgcgatttttacgcgaatccactcttgcgaaagcattagcctgggtctgagcacattcatgatcgaccttaaccaagtggcaaaggcggtaaacaacgccaccgcccagtcactggtgctcatagatgagttcggcaagggaaccaacactgtggacggcctggcgctcctggccgccgtactccggcactggctggctcgcgggcccacctgcccccatatctttgtggcaacgaattttttatccctcgtgcaattgcaactgctcccccagggcccactcgtccagtacctctag

SEQ ID NO: 31391 - DNA, 1527 bp, Artificial Sequence
  Description of Artificial Sequence: Synthetic coding sequence
atgtggcctgttctcctttttgtgtttttaagccagacagtgtactccgcgctcggcctgagagacgcatgccgcagcctgccccagagcatccagctttttagggacatcgcccaggagtttagcgatgatctgcatcatatcgcgtcactaattggcaaggtcgttgattttgagggatcactcgccgagaaccggttcacagtcctgcctaatattgacccagaaatcgatgaaaaaaaacggaggctgatgggcttgccgtcgtttttgaccgaagttgctcgtaaagaactcgagaaccttgatagtagaattccatcctgctctgtgatttacatacccctgatcggcttcctgctatcgatccccaggctcccaagcatggtcgaagcctcggattttgagattaatggcctcgacttcatgtttctcagtgaggaaaaactccattaccgcagtgccagaacgaaggaacttgatgcgctgctgggtgacctacactgcgagatacgcgaccaagagacgttattgatgtatcagttgcagtgccaagtgctcgctagagcagcagtactgacccgagtgctggacctggcctcccggctggacgtactcctggctctcgcgagcgctgcccgggactatggctactctcgccccaggtattctccccaggtgctaggtgttcggatccaaaatggccgtcaccctcttatggagctgtgcgcgagaacattcgtgccgaacagtacagagtgcggcggggataagggcagggtgaaggtaatcacaggtcccaactctagcggcaaatccatttacctgaaacaggtcggtctgatcactttcatggcactggtaggctcgttcgtcccggctgaggaagccgagatcggcgcagtcgatgccatcttcacccggattcactcctgcgagtcaatctccctggggctgtctaccttcatgattgatcttaaccaggtggcaaaggcagtcaataatgccacagcccagagcctggttctgattgacgaattcggtaagggaacaaacaccgtggatggcctcgcactgctggctgcagtgctacggcattggctcgccagaggtcctacgtgtccacacatcttcgtcgccacaaatttccttagtcttgtgcaactgcagctgcttccgcagggtcccctcgtgcagtatctgacaatggaaacatgtgaggacggaaacgatctggtgtttttctaccaggtttgtgaaggagtggccaaagcctcccatgcttcacatacagctgcccaggcgggtctaccagataaactagtggcgcggggcaaagaggtgtcagaccttattagaagtggaaaacctatcaaacctgtgaaagacctgctcaaaaagaaccagatggaaaactgccaaacgcttgtcgacaagttcatgaagcttgaccttgaggatccaaacctggacttgaatgtcttcatgtcccaagaggttctcccggcagccacatctatcctgtag

SEQ ID NO: 31392 - DNA, 408 bp, Artificial Sequence
  Description of Artificial Sequence: Synthetic coding sequence
ggctattctcgaccccggtatagtccacaggttctgggggtgcgcatccagaatggaagacatcctttgatggagctgtgcgcacgtacgttcgtgcctaattctacagaatgcggaggcgacaagggccgcgttaaggtgattaccggccccaacagttccggaaagtcgatatacctgaaacaggtggccaaggccgtgaataacgcaaccgcacagtctctggtgctgatagacgaatttggtaagggcacaaatacagtagacggtttggcactccttgctgcggtcttacgccactggctcgcacgcgggccaacatgccctcacattttcgtggctacaaattttcttagcctggtgcagctccagctgctaccccagggcccactggtgcagtatttgtag

SEQ ID NO: 31393 - DNA, 1494 bp, Artificial Sequence
  Description of Artificial Sequence: Synthetic coding sequence
accgtatattctgctcttggactccgcgatgcctgtcggagtttaccccaatcgatccagctcttcagagatatcgcccaagagttctcagatgatctgcaccatattgcatccctgatcggtaaagtggtcgattttgaggggtccctagctgagaatcggtttaccgtactacctaatattgatccagaaatagatgagaagaagcggaggctgatgggtctgccgtcatttctgaccgaggttgcgcgtaaggaacttgaaaatcttgactccaggattccaagttgttctgtgatctacattcctctgattgggtttctgctttccattccaaggctcccctcaatggttgaggcgtcagactttgagatcaacggcctggattttatgtttctgtccgaagaaaagctccattaccgaagcgctaggaccaaggaacttgacgcactgctcggtgatctacattgcgaaataagagatcaagagactttgctgatgtaccagttacaatgtcaggtacttgcacgcgctgccgtgttgacacgagtgctagatctcgctagtagactcgacgtcctgctggccctcgccagcgctgcccgcgactatggctactctcggccaagatactcaccacaggtccttggagtccgaatccagaacggacggcacccgttgatggaactgtgcgccagaacctttgttccaaactctactgagtgcggcggcgataagggaagagtcaaagtcataaccgggcctaattcctccggtaaatccatctatctgaaacaggtgggcttgatcaccttcatggccctagtcggctcttttgtgccggctgaagaggcagagatcggtgccgttgacgcgattttcaccagaatccatagctgtgaaagtataagcctgggattgagtaccttcatgatagacctgaatcagcaggtggctaaggccgtcaacaatgctacagcccagtccttggtgcttattgatgaatttgggaaggggacgaacacggtcgatggactagctctgctagcggccgtgctgcggcattggctggcacgtggtcccacatgtccacacatcttcgtggctaccaattttctgagtctggtgcagcttcagctgcttccccagggtccgttggtccagtacttgaccatggaaacttgcgaggacggaaatgatctagtgtttttctatcaggtttgcgaaggggtggccaaggccagccacgcaagtcacactgcggcacaagcaggcctgcctgacaagcttgtggcccgcgggaaagaggtcagcgatttgatcaggtcaggtaagcctattaagcctgtgaaagatttgctcaagaaaaatcagatggagaactgtcaaaccctggtagataagtttatgaagttagatttggaggacccaaatctggacctgaacgtgttcatgtcacaggaggtgctccctgccgccacttcaatcctgtag

SEQ ID NO: 31394 - DNA, 585 bp, Artificial Sequence
  Description of Artificial Sequence: Synthetic coding sequence
atggcctccctgggtgcaaatccccgcaggactccacaaggtcccaggcccggagcagcgagctcaggctttccatcccccgcccctgtaccaggacccagagaggccgaggaggaggaagtggaggaagaggaagagctggcagaaattcacctatgtgtgctttggaacagcggttatctggggatcgcttattatgatacaagtgacagtactattcactttatgcccgatgctccagatcatgagagcttgaagctgctgcagcgggtgttagacgagataaacccacaaagtgtggtgactagtgcgaagcaggacgaaaacatgacccgtttcctggggaagctcgcttcccaggagcacagggaacccaaaagaccagaaattatcttcctgccctccgtagatttcgggttggagatctctaagcagcggttactgtctggcaattactctttcatacccgacgccatgacagccacagaaaagattttatttctcagctccatcattccatttgattgcctacttaccgtgcgcgctctcgggggactgctcaaattcctggggcgcagacgttag

SEQ ID NO: 31395 - DNA, 1404 bp, Artificial Sequence
  Description of Artificial Sequence: Synthetic coding sequence
acagtctattccgcacttggcttgcgtgacgcatgccgctcgctgcctcagtctatccagttgtttagagacattgcccaggagttctccgatgacctgcaccatatagcctcccttattggtaaagtggtcgatttcgagggtagcctcgctgaaaatcgattcactgtcctgcctaacatcgaccccgagattgacgagaaaaagaggagacttatgggcctgcctagtttcttgaccgaggtggcccggaaggagcttgagaatcttgatagtcgaattccctcgtgtagtgtgatttacattcccttgataggcttcctcttgtctatacctcgcctgccctctatggtagaggcatccgatttcgagatcaatggcctcgactttatgttcctgagtgaggaaaagctacactatagatccgcccgaacaaaggagctggatgccctgctgggcgacttgcactgcgagatccgcgaccaagagaccctgctgatgtatcagctgcagtgccaagttctcgccagagccgccgtgctgacccgcgtgctggacctggctagcagattggatgtgctgctggctctagcctcagctgcccgagattatggatatagccggccaaggtacagtcctcaagtactaggggtgcgcatccagaacggccggcatcctctgatggagctgtgcgccaggaccttcgtaccaaactctacggagtgcggcggcgacaaaggcagagtgaaggtgattacaggccccaactcctccggtaagagtatctatctcaagcaagtgggtcttattacctttatggcgctcgtcggatctttcgtgcccgccgaggaggcagagataggcgctgttgacgcaatctttacccgcatccattcatgcgaatcaatttctctcgggctctccacattcatgatcgacctaaaccagcaagttgccaaagctgtgaacaatgccactgcacagtcccttgtcctgatcgatgaattcggaaaggggacaaacactgtcgacggcttggctcttctggctgccgtgctcagacattggctggccaggggccctacatgcccccacatcttcgtggcaacaaacttcttaagcctagtccagctacaactgttgccccaaggcccattagtgcagtacctgacgatggaaacttgcgaagacggcaacgatttggtcttcttttaccaggtttcagacctgatccgctcgggcaaacccattaagcctgttaaagatttgctcaaaaagaatcagatggagaattgtcagaccctcgtggataaattcatgaaactggacctggaggatcccaatctggatctgaatgtgttcatgagtcaagaagttctgcccgcagcaacctcaattctatag

SEQ ID NO: 31396 - DNA, 198 bp, Artificial Sequence
  Description of Artificial Sequence: Synthetic coding sequence
accgctcagtcactcgtcctcatagacgaattcggcaagggtaccaataccgtagatggattggctcttttggcagctgtgctgaggcactggctcgcccggggacctacttgcccccacatctttgtcgcgacgaacttcctgagtcttgtgcagctgcagctactgccacaggggcctctggttcagtacctgtag

SEQ ID NO: 31397 - DNA, 348 bp, Artificial Sequence
  Description of Artificial Sequence: Synthetic coding sequence
attgctcaggaatttagtgatgacctgcaccatattgcttctttaattggcaaggtcgtcgatttcgaaggatctctggctgaaaataggttcacagtgttacctaacattgaccctgaaatagatgaaaaaaagcgccgcttgatggggctcccatctttccttaccgaagtggccagaaaggagctggaaaatctcgactcaaggatcccctcttgctctgttatttatatacccctcattggctttttgttgtccatccccaggttgcccagcatggttgaagcatctgatttcgagatcaacggtttggacttcatggtccggccatctacgtctgtgcgctag

SEQ ID NO: 31398 - DNA, 1491 bp, Artificial Sequence
  Description of Artificial Sequence: Synthetic coding sequence
actgtgtactccgccctcggtctccgcgacgcgtgtcgatccctgccccagagcatccagctgttccgggatattgcacaggaattctctgacgatttacaccacattgcatcactgatcggcaaagtggtggactttgaagggtccctggccgaaaataggttcactgtcctccctaatattgatcccgaaatagatgaaaaaaagaggagattgatgggactaccatccttcctgaccgaagtagctagaaaggaactggagaacctcgacagccgaattcctagttgctcagtgatctatatcccacttatcgggttcttactatccattcccagactgccctctatggtggaggcgagcgactttgaaattaatggcttggattttatgttcctttccgaggaaaagctgcactataggtccgcccgtactaaggagcttgacgccctgctgggggacctgcattgtgaaatccgagaccaggaaaccctgttgatgtaccaactgcagtgtcaggtacttgctagagctgctgtgctcacacgggttcttgatttagctagcagactggacgtcctgcttgcccttgcctctgcggcaagagactatggatactccagacctagatactcaccccaggtgctcggcgtgcgaatccagaacggtaggcaccccctcatggaactctgtgcgaggacattcgtccctaacagcactgagtgcgggggggataaagggcgggttaaagtgataaccggccctaattcttccgggaaaagcatatatcttaagcaggtaggtttgataacttttatggccctcgtggggtcatttgtcccagcggaagaggccgagatcggcgccgttgacgctatctttacaaggatccatagttgtgaatctattagcctcggtctctcaacttttatgatagatctgaatcaggtcgccaaagcagtgaacaatgcaactgcgcagtctctggtgctgatagacgagttcggcaaaggtactaatactgttgacgggctcgctctgctcgctgctgtgctccgccattggctcgcacggggtccaacttgtccacatatttttgtcgcaactaatttcttatcactggttcagctgcaactccttccacagggccccctggtccagtacctaactatggaaacgtgcgaggatggaaatgatctggttttcttctaccaagtgtgcgaaggcgtggcaaaagccagccatgcctcacatacagctgctcaagctggcctgcccgacaaactggtagcccgcgggaaagaggtctccgacttaatcaggagcggcaaaccaatcaagcctgttaaagatcttcttaagaaaaaccagatggagaactgtcaaacgctcgtagataagttcatgaaattggatctcgaggaccccaatctagacctcaacgtgtttatgtctcaggaagtgttacctgctgcaacctccatactttag

SEQ ID NO: 31399 - DNA, 477 bp, Artificial Sequence
  Description of Artificial Sequence: Synthetic coding sequence
catgaatctctcaagctgctccaacgcgtgctggacgagatcaaccctcagagcgtcgtaacaagcgcaaaacaggatgagaacatgacacggttccttgggaagctggcatcccaggagcaccgcgaaccgaaacgccctgaaataatattccttccctccgtagactttggcctggaaatttcaaaacagagacttctcagcggcaactacagcttcattcctgacgctatgacagctaccgaaaagatactgtttctgtccagcatcattccatttgactgtctcctcacgatcccaagccaggtgcgagctttgggaggtcttctgaaatttctggggaggcgaaggataggggtagaattggaggattataatgtatctgtacccatcctgggtttcaaaaagttcatgctgacgcatctcgtgaacatcgaccaggacacatatagaaaccctcagcagatgcccctgtag

SEQ ID NO: 31400 - DNA, 477 bp, Artificial Sequence
  Description of Artificial Sequence: Synthetic coding sequence
acggtgtattccgctctaggtttgcgcgatgcctgtagatcgctcccgcagtccatacaactcttcagggatattgctcaggaattttctgatgacttgcatcacattgcctcccttattgggaaggtatacctgagtccacaggtggatttcgaaggctccttagccgagaaccggtttaccgtgctgccaaacatagaccctgagattgacgaaaagaaaaggcgactgatgggtcttccaagctttctgaccgaagtggcccggaaggaactggagaaccttgattctcgaatcccatcctgcagtgttatctatatccccttaatcggcttcctgctctctataccaaggctcccttctatggtagaagcctctgacttcgagattaatgggttggatttcatgttcctcagcgaagagaagttacattacaggtccgcccggactaaagaactggatgccctcctgggctag

SEQ ID NO: 31401 - DNA, 2238 bp, Artificial Sequence
  Description of Artificial Sequence: Synthetic coding sequence
atggcatctctaggcgccaaccctcgacggactccacaaggacctcgaccaggtgcagcctctagtggctttccctcccctgcccccgtacccggtcctcgggaggctgaagaggaggaagtcgaagaagaggaagaactggccgagatacacctgtgtgtgctgtggaattccggctatctgggcatcgcatattacgacacgagcgactccacgatccactttatgcctgacgcacccgatcacgagagcttaaaactgcttcaaagggtattagacgaaatcaacccacagagcgtagtaacctctgccaagcaagatgagaatatgacgaggtttctcggcaagttagctagtcaggagcaccgcgagcccaaacgcccagaaatcatctttcttccatcagtggattttggcttagaaatatcgaagcagcggctcctctccggaaattattcttttatccctgacgctatgaccgccacggagaaaatcctgtttctttcatccataataccttttgactgtttgctgacaccccctggtgatctgcgctttacacctatcccactgctgattccctcacaagttagagccctgggtgggctcctcaagttcctcggaaggaggaggataggcgtcgagctagaggactacaacgtgagtgtgccgattcttggattcaaaaaatttatgttgacccatctcgtgaacattgatcaagatacctactcggtgctgcagatcttcaagagtgaatcccacccaagcgtgtacaaagtagccagtggactaaaggagggcctgtccctgtttgggattctgaatagatgtcattgcaagtggggcgaaaaactcctgcgcctgtggttcacgcgaccgacccatgacttgggtgagctctccagcagactagatgttatccaattcttcctgctcccacagaatttggatatggctcagatgcttcatcgcctgctcgggcatatcaaaaatgtgcccctgattttaaagcggatgaagctttcacatacaaaggtttcagattggcaggttctctacaagactgtgtattcagccctcggtcttagggatgcgtgcaggagtcttccccagagcatccagttgttcagggacattgcccaggaattttcagacgacctacatcacatcgcttcgctgattgggaaagtggtggatttcgagggctctctcgctgaaaaccgtttcactgtcctcccaaacattgatcccgaaatcgacgagaagaagagacgtctgatgggtctgccctcgtttcttaccgaagtcgcgcgaaaagaattggaaaatctcgactctagaatcccatcctgctccgtcatctatatccccctgatcggatttctgctgagcatccccaggttaccatcaatggtagaggcttccgatttcgaaattaatggcctggacttcatgttcttgtccgaagagaagctacactatcggtctgccagaacgaaggagctggatgcgttgctgggggatctccactgcgaaatcagggatcaggagacactgctgatgtaccagctgcagtgtcaagtccttgcgcgtgccgcggtgttaacgcgcgtccttgatctggcatcacggctggacgtgctgctcgccttggcttccgctgcacgtgactatggttacagtcggccccgatatagcccgcaagtgctgggcgtccgtattcagaatggtcgccatcccctgatggaattatgcgcacgcacctttgtgccaaattcaaccgaatgtggtggggacaagggtcgcgttaaagttataacaggccctaattcatccggcaaaagtatttacctgaaacaggtcggcctcatcacctttatggccttagttgggagttttgttcctgccgaagaagccgagattggcgcagtcgatgcgatctttacacggattcactcttgcgaatcaatttctctggggctctccacctttatgatcgacctgaaccagcaggtagctaaggccgtcaataacgcgaccgcacagagcctggtcttgatagatgaattcggtaaggggacaaatacggtggatgggctagctctgctggccgcggtcctgagacattggttggcaagaggacccacttgcccgcatatctttgtggcaacgaatttcttatctctggtccagttgcaactgcttccccagggcccactggtgcaatatctgtag

SEQ ID NO: 31402 - DNA, 2184 bp, Artificial Sequence
  Description of Artificial Sequence: Synthetic coding sequence
atggccagtctcggtgcgaatcccaggcgcacaccacagggaccaaggcccggcgccgcctcaagcggtttcccaagcccagcccctgtgcctggaccgagagaggctgaagaagaggaggtggaggaggaggaagagttagccgagatccacctctgcgtgctgtggaactctgggtacttggggatcgcttattacgacacatccgattccacaatccactttatgccagatgcccctgatcacgagtcactgaaactgcttcagagagtgttggacgaaattaacccacagtctgttgtaaccagcgccaagcaggatgaaaacatgactagattccttggaaagctagccagtcaggaacaccgggagccaaagagacccgaaattattttccttcccagcgtggacttcggcctggagattagcaaacaacgcctgctttctgggaattactcattcattccagatgctatgactgccaccgagaaaattctgttcctgtcatctattattcccttcgactgccttctgaccgtgagggccctgggcggactgctcaagtttctcggccgccgcaggatcggtgttgagctcgaggattacaatgttagtgtgcccatcctggggttcaaaaagtttatgctcacacacctggtgaatatcgaccaagatacctattctgtgctgcaaatttttaagtccgaatcccacccttccgtctataaagtggccagtgggctgaaggagggactgagtcttttcgggattttaaaccgctgtcattgcaagtggggagaaaagttgttgcgtctttggttcacacggcccacccacgaccttggggagctcagcagtagactggacgtaatccagttttttctgcttccccagaatttggacatggcccagatgttgcataggttgctgggccacattaagaacgtgcccttaatccttaaaaggatgaagctctcacacaccaaagtgagtgattggcaagtcctttacaagacagtttactccgcgctgggccttagggacgcatgcagaagcctgccgcagtccatccagctgtttagggatattgcccaggaattcagcgacgatctccaccatatcgctagccttataggtaaggtggtcgacttcgaaggttcccttgccgaaaatcgctttaccgtcctgccaaacatagatccagaaatcgatgaaaagaaacgtaggctgatgggtctcccaagttttctcactgaggtcgccaggaaggaattggaaaatcttgacagtagaatcccttcctgctctgttatctacatccctctcattggattcttactgtccattccccgtttgccttcgatggtggaggcttccgacttcgagatcaacggcctcgacttcatgtttcttagcgaagagaagctccattaccgctccgctcgaactaaggagttggatgctcttttgggcgatctgcactgcgagattcgcgaccaagagacattgttaatgtaccaactgcaatgccaggtgctcgccagagccgcagttctcacaagagtgctcgatttagctagcaggcttgacgtgctccttgcccttgccagcgcggcccgggattatggctattcgcggcccagatattctccccaagttctcggggtgcgcattcagaacgggaggcaccctctcatggagttgtgtgccaggacgtttgttccaaatagtacagagtgcggaggcgacaaaggcagagtcaaagtgatcacaggccctaattccagcggtaagtccatctacctgaaacaggtggggctgattaccttcatggccttggtgggcagtttcgtacctgcggaagaagccgaaataggagccgttgatgctattttcactcggatacactcatgtgaaagtatctctctgggtctgagcacttttatgatcgacttgaaccaggtggctaaagcagttaataatgctacggctcagtcactcgtgcttattgacgaattcggtaaagggaccaacactgtggatggcctggctctgctggctgccgtcctcagacactggctcgcgcggggccctacttgtccccacatttttgtggctaccaattttctctcgttggtacagctccagctcttgccccagggcccgctcgttcagtatctctag

SEQ ID NO: 31403 - DNA, 1401 bp, Artificial Sequence
  Description of Artificial Sequence: Synthetic coding sequence
actgtctattcagcccttggactgagagatgcttgcagaagcctgccgcagagcattcaattgtttcgcgacattgctcaagaatttagcgacgacctgcatcacatcgccagtctgatagggaaagtggttgattttgaagggtcactcgccgaaaataggttcacagttctgccaaatatagatccggagattgatgagaagaagcgacgcctgatgggtttgccttcattcctgaccgaagtggcacgcaaggagcttgagaatcttgattccagaattccgtcttgttccgtaatttatatcccacttatcggcttcctgttgtccataccacgacttccatcaatggtggaagctagcgactttgagataaacggcctggactttatgttcctatctgaggagaagctgcactaccgttctgctcggaccaaggagctggacgctctgctaggagatttacactgcgagattagagaccaagaaacactgttaatgtaccagctacagtgccaagtcttggctagagccgctgttctaacacgggtgcttgacctggcctcacggctggacgtgctgttggccttagcatccgctgcccgtgactacgggtactcaagacccaggtattcacctcaggtcctaggggtgcgaattcagaacggacgccaccctctaatggaattgtgcgccaggacatttgttccaaattctactgagtgtgggggtgacaaaggcagagtcaaagtgataaccggacctaatagctccggtaaatctatttacttgaagcaggtcggactgattactttcatggcactggtgggttctttcgttcctgccgaagaggccgagataggagcagtggacgctatctttacccgcatccactcctgcgaaagcattagcctcgggctgagcaccttcatgatcgatctgaaccaagtggctaaagccgttaataatgcaactgcccagtctctggtgctgatagatgagtttggcaagggaactaacactgttgatggcctggcactgttggcagctgttctcagacattggctagccagaggccccacttgtcctcacattttcgtagccactaacttcctcagccttgtccaactccagctcctgccccaggggcccctggtccagtatctgaccatggagacctgcgaggatgggaatgatctggtgttcttttaccaggtgagcgatctcattcggtcgggaaagccaattaaaccagtcaaagatctattaaagaaaaaccagatggaaaattgccagaccttggtcgacaaattcatgaagctagaccttgaagaccctaatcttgacctgaatgtgttcatgagccaggaggtgcttcctgctgccacaagcatcctatag

SEQ ID NO: 31404 - DNA, 765 bp, Artificial Sequence
  Description of Artificial Sequence: Synthetic coding sequence
atggccagtcttggcgctaacccccgcagaacccctcagggaccgcgccctggcgctgcatctagtggctttccctcacctgctcccgtgcctggaccaagggaggcagaggaagaagaagtggaggaggaggaagaactcgccgagatccatctttgtgtgctctggaattcaggatacctggggatcgcatactacgacaccagtgatagtacaatccacttcatgcccgacgctccagaccatgaatccctcaagctgctgcagcgcgtattggatgaaatcaatccacagagcgtggtgaccagcgccaaacaggacgagaacatgacacggtttctgggtaagctcgcaagtcaagaacatagagaaccaaagcgacccgagatcattttcttgccatcagtggattttgggctggagattagcaagcagaggttgttgtccggcaactactcattcataccagatgcgatgactgcgactgaaaagatcctgtttctctcttcaattatcccctttgattgtctgctgacggtgagagcgttgggcggcctgttaaagttcctaggccgtcgcagaatcggcgttgagcttgaggactacaacgtgtccgttcccattctgggctttaagaagttcatgctcactcatctcgtgaacattgatcaggacacgtatcgcttagaatgcaatggtgcgatttccgcacaatgcaatctctgcttgctcggcagcagcgactcacccgcatctgcctcctag

SEQ ID NO: 31405 - DNA, 792 bp, Artificial Sequence
  Description of Artificial Sequence: Synthetic coding sequence
cactatcgttcagcacggaccaaggaactggacgccttacttggcgacctgcactgtgaaatcagagaccaagagacactccttatgtatcagctgcagtgtcaggtactagcacgcgcagcggtcctcacgcgcgtccttgaccttgcttcccgtctggacgtgctcctggcccttgcctctgctgcccgcgactacggatactctcgaccccgatattccccacaggtgttaggggtgcggatccaaaacggccggcaccccttgatggaactttgtgctagaactttcgtcccaaattctactgaatgcggaggcgacaagggacgggttaaggtaatcacaggcccaaattccagcgggaaatctatttatctgaagcaggtgggactgatcaccttcatggccctagtggggtcctttgtgccagcggaagaggcagaaatcggcgcggtggatgcgatatttacaaggattcactcttgcgaatccatttccttggggctctccacattcatgattgacctgaatcaagtggcgaaggccgttaataacgctactgcccagtctttagtcttaatcgacgagtttggcaagggtaccaacacagttgacgggctcgctctcttagcagccgtccttaggcactggctggcgcgaggtcccacttgtccacacattttcgtggcaaccaatttcctgagccttgtccaactccaactgctgccccaaggccctcttgtacagtacctcgactggccaagggtgtctggacaagagggcggtgactag

SEQ ID NO: 31406 - DNA, 480 bp, Artificial Sequence
  Description of Artificial Sequence: Synthetic coding sequence
atgcagaacaacgaaatcatcaagcccgccaagtactttagtgaactggaaaagagtatcctccttgcactggtggagaagtataaatacgtcctcgagtgtaagaaatcagacgcaagaactatcgccttgaagcagcgcacttggcaggcccttgcacatgagtataatagccagccttccgtgagcctgagagattttaagcaactaaagaagtgctgggagaatattaaggcacggactaaaaaaattatggctcacgagcggagggagaaggtcaaaagatcagtctctcccctcttgagtacacatgtccttggcaaggaaaaaatcgcgtctatgctgccagagcagctatacttccttcagagcccaccagaagaggagcccgaataccatccagacgcttctgcacaggtctttttccaggagcgcaagaggagccttgagttatcgattatcttgagcggtacctggtag

SEQ ID NO: 31407 - DNA, 924 bp, Artificial Sequence
  Description of Artificial Sequence: Synthetic coding sequence
atgggatcaaccatggaacctcctggcggcgcttacctccatctcggagccgtcacctcgccagtggggacagcccgcgtgctccaactggccttcggctgtactacattctctcttgtggcccatcggggagggtttgccggggtgcagggaaccttctgcatggccgcctgggggttctgtttcgccgttagtgcactagtggtagcttgtgagttcacgaggctccatggctgtctgcgcctttcatggggcaactttacagcagcgttcgccatgctcgccacgctgctctgtgccacagccgcagtgctgtatccgttgtacttcgctcgtagagaatgctctcctgagccagctggctgtgccgcccgagatttccggctcgcagcctcagtgtttgctggcctgctgttcctggcttacgcagtggaggttgcattaacgcgggcaagaccgggacaggtgtcctcatacatggccacggtcagcggcttgctaaaaattgtccaggccttcgtggcttgcataatcttcggggccctggtgcatgactctagatacggcaggtacgttgctacccagtggtgcgtggctgtgtatagtttatgcttcttggccacggtggccgtggtggcgctgtccgtgatgggccacacaggcgggcttggctgcccttttgacaggttggtggtggtgtataccttcttggctgtcttactttatttgagcgctgctgtcatctggcccgtcttttgtttcgatcccaaatacggggagcctaaacggccgccaaactgcgccagggggagctgtccatgggactctcagctggtggtggcaatatttacatatgtgaatttactgctttatgtggtggacttagcttatagccagaggatcagatttgtacctagcctgtag

SEQ ID NO: 31408 - DNA, 924 bp, Artificial Sequence
  Description of Artificial Sequence: Synthetic coding sequence
atgggtagcaccatggaaccaccagggggcgcctatctccatttgggcgctgtgacatcccccgtcggcacggccagggtgctccagttggcgtttggatgcactactttcagtctggtggcccatcgcggtggtttcgccggagttcagggtaccttctgcatggccgcctggggattttgctttgccgttagcgctttggttgtggcttgcgagttcaccagactgcacgggtgcttacggttgtcgtggggaaacttcaccgcggcattcgccatgctcgccacccttctgtgcgccaccgctgccgttttatacccgctgtactttgctagacgggagtgtagccccgaacccgctggatgtgccgctagggactttaggctggctgctagcgtattcgccggcttgttatttctagcctacgccgtcgaggtcgccctgactcgagcgcggccagggcaagtgagctcttatatggcaaccgtgtcgggcctcctcaaaatcgtgcaggcctttgtcgcctgcataatttttggagccctggtgcacgatagcagatacggcaggtatgtagccacccagtggtgtgtcgctgtgtactccctctgtttcctcgctaccgttgcggtagtcgcccttagcgtgatgggacataccgggggcctggggtgtccttttgatcgcctcgtggtcgtgtatacctttctcgccgtgttactctacttatccgcagctgtgatctggccagtgttttgctttgacccaaagtacggcgaacctaagcgcccgccgaactgcgccagagggtcatgtccttgggactcgcagttggtggtcgctatttttacttatgtcaacctgttgctgtatgtggtcgatctggcctacagccagaggatacgtttcgtgccatccctctag

SEQ ID NO: 31409 - DNA, 759 bp, Artificial Sequence
  Description of Artificial Sequence: Synthetic coding sequence
atgtggcgcgctcccgaagcagccctgagacccgaggtgtccttggagaggaggggccctgaaatgaagcccgcggtagatgagatgtttcccgagggagcaggcccgtacgtcgaccttgacgaagtcgcccgggcgagacgcgagtccccgtcagcgggcggatcaaccgggctcctcatggatctggccgccaacgagaaagctgtgcatgcagacttttttaatgactttgaagacttattcgacgacgatgacattcactcctctggtttgccaagaacctcacagcagtcgtccatggtgccagctctccagagggggcagtccgagcatggggttaggggaaaagccgccgagcggcccgtggtttcagaagagaggtgcgaactgaatggacgggaggtggccgccctggaccgagcctttgggagcacggggcatggccagggtgccgaagcactgatgtttacaaggtgtcgggaacatcctctgtgcgggacaaataaagctaccagtgaaggcaaaatggggacaggtcgactcaggaatagcctccgcaagaaccagtctaagtggctcgggtcctatttggaggtcctaagaacaacccgctcgaggagagaggtttcagaagattctaccatatccgtatccactcactggagggggaaatgtttcaaaagcgatgaaacgccaagtgtcgcaggcggcgaggagggcaagaagactacgcaaccgtgcattgatgtgcggtag

SEQ ID NO: 31410 - DNA, 237 bp, Artificial Sequence
  Description of Artificial Sequence: Synthetic coding sequence
atgtggagggccccagaggcggcactgagacctgaggttagcctcgaacgaagaggccccgaaatgaagcctgcagttgatgagatgttcccagagggcgctggcccgtacgtggatctagacgaggcaggcggaagcacaggcctgctgatggatctcgcggcaaacgaaaaagcagtgcacgccgatttcttcaatgatttcgaagaccttttcgatgacgatgatatccagtag

SEQ ID NO: 31411 - DNA, 3645 bp, Artificial Sequence
  Description of Artificial Sequence: Synthetic coding sequence
atgaccctcccacactcactcggcggcgccggtgacccacgcccgccacaagcgatggaggtgcatcgactcgagcatcgccaggaggaggagcagaaggaggaacgccagcattctttaaggatgggcagtagcgtgagaagacgaaccttccggagtagcgaggaagagcacgagtttagcgccgccgattatgccctggccgccgccctcgcattgactgcgagtagcgaactaagctgggaagcgcaattaaggcggcagacatccgctgtggagctggaggagcggggccaaaaaagggtaggattcgggaatgactgggagaggactgagatcgcatttctgcagacacaccggctgctccgccaaagaagagactggaaaacgctgagacggcggactgaggaaaaggttcaggaagccaaagagttaagagagttatgctatggtcgcggcccgtggttttggattccactgcggtcgcacgcagtatgggagcatactaccgtgttgctcacatgtacagtacaggcctcacctccaccccaggtgacttggtataagaacgatacgaggatcgatccccgcttgttccgtgccgggaagtatcgaataacaaacaattatggcctcctgagtctcgaaattcggagatgcgcaatagaggacagcgctacttacaccgtacgcgttaagaatgcccatgggcaggcatccagttttgccaaggtgctcgtccggacttacctgggaaaggatgcagggtttgattccgagatctttaagagaagtaccttcggcccctccgtcgagtttacaagcgtactcaagcccgttttcgctcgtgagaaggaaccattctctctctcctgcctgttttcagaggacgtcctagacgcggagagcatccagtggtttcgtgatggatccctgctgaggagctcaaggcgcagaaaaattctgtacactgatcggcaggccagtctcaaggtttcttgcacatataaggaggacgaagggctgtacatggtccgagtgccctcccccttcggtcctcgggaacaatcgacttatgtactcgtgcgcgacgcggaggcagagaaccccggggcccccggatctcccttgaatgttcgatgtctggacgtgaacagagattgccttatccttacctgggcccccccgagtgataccaggggcaaccctattacagcctacaccatcgaacggtgccagggtgaatctggcgaatggatcgcatgtcatgaagccccaggcggaacctgtcgttgtccaattcagggtctggtagaaggacagtcttatcgctttagagtcagggcaatctcccgggttgggtcttcagtgccatccaaggcttcggagttggtggtcatgggggaccatgacgctgcacgacgcaaaactgagatcccgttcgacctcggtaataaaattacaatttctaccgatgcgttcgaagacaccgtgaccatcccctcgcctccaactaatgttcacgccagcgagatcagagaagcttacgtggtattagcctgggaggagccatctccccgtgatagggctcccctcacttattctcttgagaagtccgtaatcggtagcggcacctgggaggctatctctagcgaatcacctgtccggtccccgcggttcgccgtattggatcttgagaagaaaaagtcctatgttttccgcgtgcgagcgatgaatcagtacggcctgtctgatccttccgagccttctgagcccatcgcccttcgcgggccacccgccacattgcccccacctgcgcaggtgcaggccttcagagacacgcaaacatccgtctccctgacatgggaccccgtaaaggatcccgagctgctgggctattacatatactctcgtaaagtgggcacttctgagtggcagaccgtgaataataaacctatccaggggactcgcttcacggtgccaggacttcgaactggaaaggagtatgaattctgcgtgcgatccgtgagtgaggccggagtcggcgagagtagcgccgcaacagagcccatcagggtgaagcaggctcttgctaccccatccgcgccttatgggttcgccttacttaattgcggcaaaaatgagatggttattggttggaaaccacctaagagaaggggaggcggtaaaattctcgggtattttctagatcaacacgactccgaggagttggactggcatgccgtgaaccagcaacctattcccactcgcgtgtgcaaagtgtccgacctgcacgagggacacttctatgagtttagagccagagctgccaactgggcaggcgttggagagctgagcgccccatcaagtctcttcgaatgtaaagagtggaccatgccccaacctggacccccctatgatgttagagcatccgaggtgagagccacatccttagtcctccaatgggagccccctttgtacatgggggctggcccggtgactggataccacgtgagctttcaggaagaaggctctgaacagtggaaacccgtgacaccgggcccaatcagcggtacgcacctgagggtgtccgatctgcagccaggtaagagctatgtgtttcaggtgcaggccatgaatagtgcaggattgggtcagccaagcatgccaaccgatcccgtactgctggaagataagccaggcgctcacgaaattgaagtcggtgtggacgaagagggattcatttatctagccttcgaggctccagaggcaccagatagcagcgagtttcagtggtccaaagactacaaaggtccattagacccccagcgcgtcaaaatcgaggacaaagtcaataaatccaaggtgatcttgaaagaaccaggtcttgaagatctgggcacctacagtgtcatcgtgaccgacgccgacgaggacataagcgcctcacatacactgacggaagaagagcttgaaaagctgaagaagctgtctcacgagatcagaaacccagtgataaaattaatctctggctggaatattgatattcttgagcgaggcgaggttagactttggctggaggtggagaaactcagccctgcggcagagctgcacctgattttcaataataaggagattttcagctcgcccaatcgaaagatcaattttgacagggaaaagggattagtcgaggtcatcatccaaaatctgtccgaagaagacaaggggtcctacactgcacaactgcaggatggcaaggctaagaaccagattacattgacgcttgtggatgatgatttcgataagctgctgcgaaaggcggatgcgaaacgtcgggactggaagagaaaacaggggccgtattttgagcggccactgcagtggaaggttaccgaagattgccaggtacagctaacctgtaaggcatctgtgacaaatacaaaaaaagagacgcgattccagtggttctttcaacgtgccgagatgcctgatgggcaatacgatcctgaaaccgggaccgggctgctgtgcattgaagaggcatcagtggccccggcctctggattaactttttcctttggttgtaagcccggcagggccaagtcaagtggactcggcgttcgcgccggtcccaggctgggctag

SEQ ID NO: 31412 - DNA, 4323 bp, Artificial Sequence
  Description of Artificial Sequence: Synthetic coding sequence
atgacgctcccgcactcactggggggcgccggggaccctagaccgcctcaggccatggaagtgcatagactggaacatagacaggaggaggagcagaaggaagagcgtcagcactcccttagaatgggatcttctgttcgcaggcggactttccgctcctccagtgaagaagaacacgaattcagcgctgcagattatgccctggctgccgccttggcgctgaccgccagttcagagttgagttgggaagcgcaactgcggcgacagacttctgccgttgaactggaagagcgcggacagaaaagagtaggatttggtaatgattgggagcgcacagaaatcgcgtttttgcagacacacagactgctccggcagcgccgcgattggaaaactctgaggaggaggaccgaagagaaggtgcaagaagctaaagaactgcgcgagttgtgttatggccgagggccatggttttggattcccctgcgctcacatgcagtatgggaacacacgacagtgctgttgacatgtaccgtgcaagcatcgccccctccccaagtgacttggtataaaaacgatacccgtattgacccaaggctgtttagggccgggaaatacagaatcaccaataattacggcctgctctccctggagattcggcgctgtgccatcgaggatagtgcgacatatacggtgcgcgtcaagaacgcccacggtcaagctagttcttttgccaaggtccttgtccgcacatatttaggcaaggatgcgggttttgacagcgagatctttaagcgcagcacattcggcccatctgtggagtttactagcgtgcttaagcccgtcttcgccagggagaaggagcctttcagcttgtcatgtcttttcagtgaggatgtgctcgatgccgagtctattcagtggtttagagatggatctctcctgcggagttcgaggcgccgcaagatcctgtataccgatcggcaggcatccctaaaggtgtcgtgtacctacaaggaggacgaagggctgtacatggtccgggttcccagcccgttcggaccacgggaacagtcaacttacgtgctggtgagggatgccgaggcagagaatcctggggctccaggcagccccttaaatgtccgatgtttagacgtcaatagggactgtctgatccttacatgggccccaccctccgatacccggggtaatccaatcacggcttataccatagagcgttgtcaaggagaaagtggagaatggatcgcttgccatgaggcccccgggggtacatgccggtgtccaatccagggcttagtggaaggacagtcctaccgcttccgtgtccgtgctatctcgagggtgggcagcagtgttcccagcaaggcttccgagctcgtagtgatgggcgatcacgacgctgctcgccggaaaactgagatcccattcgatctgggaaataagatcacaattagcaccgacgcctttgaggacaccgtaacaattccttcacctccgacaaacgtccacgcgagcgagatccgagaagcttacgtcgtgcttgcctgggaagaaccctctccccgcgacagagctcccttgacatactcactggaaaagtctgtcatcggaagcggaacctgggaagccatcagctccgaatctcctgtgcggagtcccaggtttgccgtcctagatctcgaaaagaagaagtcctacgtgttccgtgttcgtgcgatgaaccagtacggcttgagcgatccatctgaaccctccgagcccattgcccttagaggcccccccgcgacacttccccctcctgcccaggtgcaggccttccgggacacacagacctctgtgagcctgacttgggatcctgtgaaggacccagagttgttggggtactacatctactcaagaaaggtgggaacttctgaatggcagactgttaataataaacccatacaggggacccggttcaccgtcccgggcctgcggactggaaaggagtacgaattctgcgtgagaagtgtcagcgaggcaggcgtcggcgagtcatcagccgcaactgaacccatcagggtcaaacaagcactcgcaacacctagtgccccttatggctttgcgttactaaactgtggcaaaaatgagatggtgatcggctggaaaccgcccaaacgaaggggaggaggcaagattctcgggtacttccttgatcagcacgattccgaagagttagattggcacgctgtgaaccagcagcccatccccactcgggtttgcaaagttagtgacttgcacgaaggccacttctatgagttccgtgctagagctgccaattgggcgggggtgggcgaactttcggccccgtccagcttgttcgagtgcaaggagtggactatgcctcagcccggcccaccttatgacgtgagagcttcggaagtcagggcaacctcacttgtgctgcagtgggaacccccactctacatgggggctggaccagttacagggtaccacgtcagcttccaggaagagggtagcgaacaatggaagcccgtaaccccgggacctatcagtggcactcatctgagggtctctgacttacaaccgggaaagtcatacgtcttccaggtgcaagcaatgaactctgccggcctgggacagccctctatgcctactgatccagtgctcctggaggacaaacctggggctcacgaaatcgaagttggagttgatgaggaaggcttcatatatttagccttcgaggctcccgaggctccagattcctcggagttccagtggagtaaagactacaaaggtccactggacccccagcgagtcaagattgaggacaaggtgaacaaatccaaagtgatcctgaaggagcccgggttagaggatcttgggacatacagcgtcatcgtcaccgatgccgacgaagacatctctgcgtcccacacactgacggaggaggagctcgagaaacttaaaaagctcagtcatgagatcaggaatccagtgatcaaactcataagcgggtggaacattgatatcctggaacgtggggaagtgagactctggctggaggtcgagaagctctcacctgctgcagaactccacttaatcttcaataacaaggagattttctcgtcacccaataggaagatcaactttgatcgtgaaaagggcctggtggaggtgataatccagaatctcagcgaagaagataagggctcctataccgcgcaactgcaggatggcaaagcaaagaatcaaataaccctcactctggtcgatgacgatttcgacaagctcctcaggaaagcggacgctaagcgccgagattggaaaaggaaacaggggaccggtccatattttgagcggcctttgcagtggaaagtcacggaagattgtcaagtgcaattaacctgcaaagtgacaaacacgaagaaagaaacacgctttcagtggttcttccagagagccgaaatgcccgacggacagtatgatccggagacaggtacaggtctgctctgtatcgaagagcttagtaagaaagataaaggaatttacagagccatggtgtcggacgacagaggtgaggatgatacgatcctggatttgacaggtgacgccctcgatgccatcttcacagagctaggccgaatcggtgcgctgagcgctactcccctgaaaatccagggcactgaggaaggaatcaggattttttccaaagtaaaatactataacgtcgagtacatgaaaacaacatggtttcacaaggacaagcgcctggagtcaggggatagaattaggaccggcaccaccctcgacgagatctggcttcatattcttgaccctaaggacagcgataaggggaaatacaccctcgagattgccgctggtaaagaggttagacagctatccacagatttatccgggcaggcctttgaggacgccatggccgaacatcaaagactcaagaccctcgcaataatcgagaaaaaccgggccaaggtagtgcgtggactcccggatgtcgccaccattatggaggataagacactctgtcttacatgtatcgtgtcaggtgacccaacacccgagatatcctggctgaaaaacgatcagcctgtcacttttcttgaccgctataggatggaggtgcgaggaacagaagtgacgatcaccatcgaaaaggtcaattccgaggactcaggacgttatggcgtcttcgtgaaaaataagtatgggagtgagacagggcaggtgaccatctctgtttttaagcatggcgacgagccgaaggagttaaagtctatgtag

SEQ ID NO: 31413 - DNA, 993 bp, Artificial Sequence
  Description of Artificial Sequence: Synthetic coding sequence
atggacatttccaaaaaaaatcgcgttagacagggtagccgaggtaggggcaagaccatttccaagaatagcgagtctagaggacagcaaaggcgccatatggtcactaacactaagaaggagacacggtttcaatggttcttccagagagccgagatgcctgacggtcaatatgaccctgaaactgggactggcttgctctgcatcgaggaactgtccaaaaaggacaaggggatataccgcgccatggtcagcgatgataggggggaagacgacacaatactggatctcaccggggatgcactggacgccattttcacggagttgggtagaattggagctctgtcagctacaccactgaagatccagggtactgaggagggcattcggatcttttctaaggtcaagtactataacgtggaatatatgaagactacctggtttcacaaagataagcggctggaaagcggagacagaatacggactgggacaactcttgatgaaatctggctgcacatcctagacccaaaagacagcgataagggcaaatatacgcttgagatagccgccggaaaagaagtgagacagctcagcactgatctcagcggacaggccttcgaagacgctatggctgagcatcagcgactaaagaccctcgccattatagaaaagaatagggccaaggtggtgagagggctgcccgacgtagcgacaattatggaggacaagacactctgtctcacatgtatagtgtccggcgacccgactccggagatcagctggcttaagaacgaccagcctgtgacattcctggacaggtaccgtatggaggtcagggggactgaagtaacgatcacaatcgagaaggtaaactctgaggacagtggcaggtatggagtcttcgtcaaaaacaaatatggttctgagaccgggcaggtcactatcagcgtatttaagcacggcgacgagcccaaggagctgaagtccatgtag

SEQ ID NO: 31414 - DNA, 4314 bp, Artificial Sequence
  Description of Artificial Sequence: Synthetic coding sequence
atgacgttaccacactccttgggaggagctggcgatccacggccacctcaggcaatggaagtacaccggctagaacacaggcaggaggaagagcagaaagaggaaagacagcacagtctcagaatgggcagcagtgtgagacgccggacatttagatccagcgaggaggaacacgagttttccgcagcagattatgctttggccgccgccctggcactcaccgcctccagcgagcttagctgggaggcccagttgcggcggcagacgagcgctgtcgaactggaggagcggggtcaaaaaagggttggctttggcaacgattgggagaggaccgagattgctttcctgcagacacacaggctccttagacagcggcgagattggaaaactcttagacggagaactgaagagaaggtgcaggaggccaaggaattgagagagctctgttacggacgcggcccttggttttggatacccctccggagccatgccgtgtgggaacacaccaccgtgcttcttacgtgcaccgtgcaagcctctcctccgccacaagtcacctggtacaagaatgatactcgcatagatccgagactatttagagccggcaaatatcggatcaccaacaactacggcttactctctctagaaatcagacgctgtgctattgaagattccgcgacctacaccgtgcgtgttaagaatgcccatgggcaggccagttcttttgcaaaagtgctcgtccgcacttatctcggcaaggatgccggctttgatagtgagatctttaagaggtccactttcgggccttctgtggagtttacctctgtgctcaagcccgtgttcgcccgcgaaaaagagcccttcagcctttcatgcctgtttagtgaggatgtcctggatgctgagtccattcaatggttccgagatgggtctttactgcgctcgtcgagacggcgaaaaatcctatatacggaccggcaggctagtctgaaggtgagctgtacatacaaagaagatgagggtctgtatatggtgcgggtgccatctccatttgggcctagggaacagagcacatacgtactggtgcgcgatgccgaggccgagaatcccggagcccccggatcacccctgaatgtgaggtgcctggacgttaaccgggactgtctgatccttacttgggcccctcctagcgataccagagggaacccaataaccgcttatacaatagaacgctgccagggcgagtccggagaatggatagcctgtcatgaggctcccggcgggacctgccgttgccctatacagggtctggtagaaggccagagttaccggtttcgcgtaagggccatcagtcgagtgggaagttcggtcccctccaaagccagcgaactggtggtgatgggtgatcatgatgctgcccggagaaaaaccgagataccattcgacctgggcaataagatcaccatttccaccgatgccttcgaagatacggtgacgattccctcacccccaacaaacgtgcacgcatcagagatccgcgaggcctacgtggtgctcgcttgggaagagccgtccccccgagatcgtgctcctctaacctattccttggagaaaagtgtgatcgggtccggcacttgggaggccatcagctccgaatctccggtgcgctcaccccgctttgctgtgcttgatcttgagaaaaagaaatcctatgtgttccgggtgcgtgcgatgaaccagtatggcctctccgatccaagtgaacccagcgaacccatcgcactgcggggccctccagctacgttgccacctcctgcgcaagttcaggcctttcgcgacacccagactagcgtgagtcttacctgggatccagtgaaggatccagagttactgggttattatatttattctcggaaggtaggcacctccgaatggcagacagtgaataacaaacccattcaaggcaccaggtttactgtgcctggactcagaacaggcaaagagtacgagttctgcgtccggtctgtatcagaggcaggagtcggagagagctccgccgccactgaacccatccgcgtcaaacaggcactggccacccctagcgccccctatggcttcgcattactgaactgtggcaaaaatgagatggtcataggctggaagccccctaaacggcgcggcggcggcaagattctgggctatttcctggaccagcatgatagtgaagagttagactggcacgcggttaaccagcagccgattcctactcgtgtgtgcaaggtgagtgacttgcacgagggtcacttttatgagttccgggcgcgagccgccaactgggcgggggtcggggaattatcagccccctcctctctgttcgaatgcaaggaatggaccatgccacagcccgggcccccctacgacgttcgggcatccgaagtgagagctacctccctcgtgctccagtgggaacctccgctgtacatgggggccggtcctgttacgggataccacgtcagtttccaagaagaggggagcgaacagtggaaaccagtgactccggggcccatcagcggtacacacctgagagtttctgacctgcagcccggcaagtcttacgtctttcaagttcaggcaatgaactccgcaggacttggtcagccaagcatgcctactgaccctgttcttctcgaggacaaaccaggagcacacgagatcgaagttggtgtggacgaagagggattcatttatttggctttcgaagcccccgaggctccggactccagtgaatttcagtggagcaaggattataaagggcccctggacccgcagcgggtgaagatagaggataaggtgaataagtctaaggtcattttaaaggagcccgggctggaggacctcggcacttattcagttattgtgactgacgccgacgaagacataagcgccagtcataccttgaccgaggaggaactcgaaaagctgaagaaattatcccatgaaatacgcaacccagtgatcaagctgatttccgggtggaatattgatattctggagcggggggaagtgaggctgtggttggaggtcgagaagctgagcccagcggctgagctgcacttgatatttaataacaaggagatcttttcatctcccaatcgcaaaatcaattttgacagggaaaaagggcttgttgaagtgattattcagaacctgtcggaagaggacaagggctcctacacagcccagctccaggatgggaaggcaaaaaatcagattactctcaccctagtcgacgatgatttcgataaactgctgcgcaaggcagatgctaaaagacgagactggaaaagaaagcagggtccatattttgagagacctttacaatggaaagtcacagaagattgtcaggtgcagctcacatgcaaggtgaccaacaccaagaaggaaactcgtttccagtggttcttccaaagggcggagatgccagacggccagtacgacccagaaactggaacaggactcctgtgtatagaggagctatccaagaaggacaaaggaatctatagagccatggtgtctgatgatcgcggagaggacgacactattctggacctgactggcgatgcactcgatgctatattcacagagcttgggagaattggggccctttctgctacacctttgaaaattcaaggtacagaagagggcatcagaattttcagcaaagtcaagtattacaacgtagagtatatgaaaactacatggttccataaagacaagcggctcgaatcaggagacagaatcaggactgggaccaccctagacgaaatctggcttcacatcctggatcccaaagattcggacaaaggcaagtatacactcgaaatagccgcaggtaaggaagtcaggcagctgtctacagacttatcaggccaggcttttgaagacgctatggctgaacaccagcgcttgaagactctagccataatcgagaagaaccgggctaaggtggtgcgaggactgccagacgtggctaccatcatggaagacaaaactctctgcctgacatgcatcgtgtcaggagatcctacccctgaaatctcctggcttaagaacgaccagccagtgacatttttggaccgctatcgtatggaagtcaggggcacggaagtgacgatcactatcgagaaagtcaattccgaagacagcggcaggtatggggtttttgtgaagaacaaatatggcagcgaaactggccaggtgaccatttctgtcttcaaacacggggacgagccaaaagaactgaaatccatgtag

SEQ ID NO: 31415 - DNA, 996 bp, Artificial Sequence
  Description of Artificial Sequence: Synthetic coding sequence
atggatatcagtaagaagaatcgggtcagacaaggtagcagaggccgcggaaaaacaatcagtaagaactctgagtcccgcggacagcagcgacgtcacatggtgactaacaccaaaaaggagacccggtttcagtggttttttcaacgggccgaaatgcctgatgggcaatacgaccctgagaccgggaccggacttctctgcattgaagaagccagtctgagcaaaaaggataagggcatctatcgggccatggtgtctgatgacaggggtgaggacgacacgatattggatttgactggagatgccctggatgctatcttcaccgagttaggccgtatcggcgctctttcggcaactccgctgaaaattcagggaactgaggaaggcatcaggattttcagtaaggtcaaatactataatgttgaatacatgaaaactacatggttccacaaggataaacgactggaatcaggcgatcggattcggaccgggactacgttggacgagatctggctgcatatcctcgatcccaaggacagcgataaaggcaagtacacactggagattgcggcaggcaaggaggttcggcagctatcaaccgacctctctggccaggctttcgaggatgctatggccgagcaccagcgcctaaaatttctttatatttcacaataccgcgctaaagtggttaggggtctgcctgacgtcgctaccatcatggaagacaagacgctgtgcctcacttgcatcgtgtctggggaccctacacctgaaattagctggctcaaaaatgaccagcccgtgaccttcctggaccgctatcgtatggaagtgcggggcactgaagttactattaccatcgaaaaagtgaactctgaggactccgggcgctatggggtgttcgtgaagaataaatacggttcagaaaccggtcaggtcaccatctctgtattcaagcatggcgacgaaccaaaggagttgaaatctatgtag

SEQ ID NO: 31416 - DNA, 1065 bp, Artificial Sequence
  Description of Artificial Sequence: Synthetic coding sequence
atggaggccgctactgctccagaagtggctgccggaagcaagctgaaggttaaagaggcttctccagctgacgcggaacctccacaagcctctccaggacagggtgcgggttctccgacccctcagctcctcccaccaatcgaggagcacccaaagatttggctgcctagggccctgcgacagacttatatcagaaaggttggcgatacagtcaatctactgatcccttttcagggcaaacctaaacctcaggctatctggactcacgatggctgcgccctagacacacgtagagtctcagtgaggaatggcgagcaggacagcatccttttcattagagaggctcagcgcgctgattccggcaggtatcagctgagggttcagctcggcggactggaagccacagccacgatagacattctcgtcattgaacgtccaggtccaccacagtccatcaagctggtcgacgtctggggcttctctgccacattagagtggacccctccacaggatacaggaaacacagccctgctcgggtatacagttcaaaaggccgataccaagtccggtctttggttcaccgttttggaacactatcaccggacaagttgcatcgtcagcgatctcattatcggtaattcatatgcttttagggtcttcgctgagaaccagtgtgggctctcagagaccgcccctatcacaaccgatctagcccacattcagaaggcggcaacagtgtacaagaccaagggttttgctcagcgggacttctcagaagctccgaaatttacacagcctctggctgactgcactaccgtcaccggctacaatacccagttgttttgctgtgtgcgtgcaagcccaaggcccaagatcatatggttgaagaacaagatggatattcagggcaaccccaaatacagggctttgactcatcttggcatctgcagcttagagataaggaagcccggccccttcgacggtggcatttacacttgtaaggctgtaaatcctctgggagaagcttccgtcgactgccgagtggacgttaaggttccaaactag

SEQ ID NO: 31417 - DNA, 1464 bp, Artificial Sequence
  Description of Artificial Sequence: Synthetic coding sequence
atgcaggagttcgctaggcgctattttcgccggagccaggcgctcctagggcagaccgacgggggcgctgccggcaaagacaccgacagccttgtgcaatataccaaagcccctatccaggagagccttctgagcctcagtgatgacgtcagcaagctcgccgtggcttcttttctagcactgatgagattcatgggagaccagtccaaacccagagggaaggacgagatggacttgctgtacgagttgttaaaactgtgccagcaggagaaactgagagatgagatctattgtcaggtcataaagcaggtcactgggcacccccgacccgagcactgtaccaggggctggtcctttctgagcttactgacaggattttttcctccctcgacaagactcatgccctacttaacaaagtttctgcaggacagcgggccctcacaggagctggcccgatccagtcaggagcaccttcaaaggaccgtgaagtatggcggacggagacgaatgcccccaccaggggagatgaaagcttttctgaaaggccaggccatccgactgcttcttatccatctccctgggggcgtggattatcgcacgaacatccaaaccttcacagtcgcggcggaggtacaggaagagctatgcaggcaaatgggaattactgaaccacaggaggtccaagagttcgcacttttcctgataaaagagaagtcccaactggtccgcccgctgcagcccgcagaatatctcaattccgtggtggtcgatcaggatgtctctctgcatagcagaagactgcactgggagacacccctccatttcgataattctacttacattagcacccactacagccaagtactgtgggattatctccaggggaaactgcctgtgagtgccaaggccgatgcacaactcgctcgcctggccgcgttgcaacatctgagtaaagcgaataggaacactccctcaggccaggatttgctggcttacgttcctaaacagctgcaaaggcaagtcaacacagctagcattaaaaatctaatgggacaagagctgcggcggctagaaggccactcgccgcaggaagcacagatatcattcattgaagcaatgtcacagctgcccctgtttggctacaccgtgtatggagtgctcagggtgtctatgcaggccctctccggcccaactctgcttggcctgaaccgccagcacctgatcttaatggatccttcctcccagagcttgtactgccggatcgctttaaagtccctgcagcgcctgcacctgctctcccccctggaagagaaaggccctcctgggttggaagtgaattacggctcggcagacaatccacagacaatctggtttgaactgccccaggcacaggagttgctctacacaaccgtctttctcattgactccagtgcgtcctgtaccgagtggcctagcattaactag

SEQ ID NO: 31418 - DNA, 1998 bp, Artificial Sequence
  Description of Artificial Sequence: Synthetic coding sequence
atggacaggcccgctgccgccgcagctgccggatgtgaagggggaggaggaccgaaccccggcccggccggggggaggcgcccacctagagccgcgggcggcgccacagccggaagcaggcagccctctgtggaaactctggattctcccacaggatcccacgtcgagtggtgcaagcaactgatcgccgccacaatatcttctcaaatctccggatccgtcacctctgagaacgtatcgagggactataaggcactgcgcgacggaaataaactagcccagatggaggaggcaccattgttccccggggaatcaatcaaagctattgtgaaggatgttatgtatatttgtccgttcatgggagcagtgtcaggcactctcaccgtgactgacttcaaattgtattttaaaaacgtggaacgggatccacattttatactcgatgtcccgctaggggtgatatcgcgggtagagaaaattggcgcacaaagccatggcgacaatagttgcgggattgaaatagtctgcaaggatatgcgcaatctgcgactggcatacaaacaggaggagcaaagcaaactaggtattttcgaaaatctgaacaagcatgcatttcctctttctaatggccaggccctctttgcattttcctacaaggagaaattccctatcaatggctggaaagtgtacgaccccgtctctgaatataagcgtcaggggctgcctaatgagtcatggaagatctctaagattaacagtaattacgagttctgcgacacctaccctgccatcattgtcgtgccgacttccgtcaaagacgacgatctatccaaggtcgctgcttttcgcgctaaaggcagagtcccagtccttagttggattcaccccgagtcacaagccaccattacacggtgcagccaaccactggttggccctaacgataaaaggtgtaaagaagacgagaaatacctgcagactatcatggatgccaatgcgcaatcccataagctaattatctttgatgctaggcagaattcggtcgcagacactaataagaccaaaggaggcggctacgaaagtgagagcgcatatcccaacgcagaacttgtgtttctcgagattcataatattcatgtgatgcgtgagtccttacgaaagctgaaagaaattgtgtatccctctatcgacgaggcccggtggctctccaacgtggacggcacacactggctcgagtacatcagaatgcttttagccggcgcagtccgcatagctgataagatcgagtctggtaagacgagcgtggtcgtccattgcagcgatgggtgggacagaacagcacagctcactagtctcgccatgctgatgctcgacagctactatcgaacgatcaaggggtttgaaaccctcgtggaaaaggaatggataagcttcgggcaccggttcgccctcagggtagggcacggcaacgacaatcatgccgatgccgatcgaagccccatttttctgcagttcgtagattgcgtttggcagatgacgcggcagttcccgtccgcattcgagttcaacgaactgttcctgatcacaatcctcgatcatctgtattcttgtttattcggcaccttcctctgtaactgcgagcagcagaggttcaaggaggacgtatacacaaaaaccataagcctttggtcatatatcaactctcagttggacgagttcagcaacccattctttgtgaattacgagaaccatgttctttatcccgtcgcatctttatcccacttggagctgtgggtgaactattatgtgcgatggaaccccagaatgcgcccgcagatgccaattcaccaaaatttgaaggaattgctggccgtgagggccgagctgcagaagagagtagagggactgcagagagaggtggctacaagggcagtgtccagttccagcgaaagaggctcttccccgtcacactcggccacgtcagtacatacttcggtctag

SEQ ID NO: 31419 - DNA, 819 bp, Artificial Sequence
  Description of Artificial Sequence: Synthetic coding sequence
atgatcagtacctgccttccagagtatattgtggtcccttcatccctggctgaccaagatctgaaaatcttttcccacagctttgtaggtcggagaatgccgctctggtgttggagccattcaaatggctcagcgcttgtgagaatggcactcattaaagacgtcctccagcagcgcaaaatcgaccaacgcatctgcaatgctatcacaaaaagccacccgcagcgcagtgatgtgtacaagtctgacctcgacaagacacttcctaacatccaggaagtacaggcggcgttcgtcaagctgaaacagctgtgcgtgaacgaaccttttgaggagaccgaagaaaagtggttgtcttctcttgagaatactcgctggttggaatatgtgcgtgctttcttgaagcatagtgccgaactcgtctatatgctggagagtaagcacctgtccgttgttcttcaggaagaagaaggcagggatctgagttgctgcgtagccagcctggtgcaagtgatgctcgatccttactttagaactatcactggatttcagtccctcatccagaaggagtgggtaatggcaggctaccagtttctagataggtgcaatcatttgaagaggtctgagaaggagtcacccttgttccttctgttcctggacgcgacctggcagctcctggagcagtatccagctgccttcgaattcagtgaaacatacctggcggtattatatgactcaacgaggattagtctctttggaacctttctgttcaattccccacaccagcgtgtgaaacagagcacggtttggttactgtag

SEQ ID NO: 31420 - DNA, 1371 bp, Artificial Sequence
  Description of Artificial Sequence: Synthetic coding sequence
atgccgcttcagaagttccactaccgcaatctgttgctgggtgaacatgacgtgcctctcacgtgtatcgagcaaattgttaccgtgaatgatcataagagaaaacaaaaggtgctgggccccaatcagaaattaaaatttaaccccactgagttgatcatctactgtaaggacttcagaatagtaaggtttagattcgacgagtcagggccagagtctgccaagaaagtgtgcctcgctatagcgcactactcgcagccaactgatctgcagctgctcttcgcgttcgaatacgtcgggaagaaataccacaactctgctaacaagattaacggtataccttcaggtgacggaggagggggggggggtggaggcaatggcgcgggaggtggctcgagtcaaaagacaccactgtttgagacctacagcgactgggatagagaaatcaagagaaccggagcgtccggatggcgggtgtgcagcatcaacgagggatatatgatatccacctgccttccagaatacatagttgtcccttcttccctggcagaccaggacctcaagatttttagccactcgttcgtaggcaggaggatgcccctctggtgctggagtcattcaaacgggtccgccctggtcagaatggccctgatcaaggacgtcttacagcagcggaagatcgaccagagaatatgcaatgcaatcactaagagtcatccccagagaagcgacgtctataaatctgacctcgataaaactctgccaaatatccaggaagtgcaggcagctttcgttaagttaaaacagttgtgcgtaaacgagccattcgaggaaacagaagagaagtggttatcttcgctggagaatacaagatggctggagtacgtgcgcgccttcctgaagcacagtgctgagctggtatatatgctggagtccaagcatttatctgttgtgctccaggaagaggaagggagagacctcagttgttgcgtcgcctcccttgttcaggttatgctggacccttatttcagaacgattactggatttcagtcgctgattcagaaagaatgggtgatggctggttaccagttcttggatagatgtaaccaccttaagcgatcggagaaagagagccccctttttttgctgtttcttgatgctacttggcaactcctggagcaataccccgccgcattcgaattctcagagacttacctggccgtcttatacgattcaacccggatatccttgtttggcacttttttgttcaactctcctcaccagcgggtgaagcagtccactgataagaagctttataagaccaggcttttcagttttactagcttgaagtttctggtgaccatccactag

SEQ ID NO: 31421 - DNA, 657 bp, Artificial Sequence
  Description of Artificial Sequence: Synthetic coding sequence
atgttcagcctgaagccccccaaaccaacttttcgcagctacctactgcctcctccccagacagacgacaagattaacagcgagccaaaaattaagaaacttgagcctgtgctgttgcccggagaaatcgtagtcaatgaggtcaatttcgtgagaaagtgcattgcgactgacacatctcagtacgatctttggggtaaacttatttgctccaattttaaaattagttttattacagatgacccaatgcctctacaaaaattccactatcggaatctgctgctgggagaacacgacgttccactgacatgtatcgagcagatagttacggtcaatgaccataaacggaagcagaaggtccttggcccaaatcagaaacttaaattcaatccaaccgaactcattatttattgtaaagatttcaggattgtgcggttccgatttgacgaatccggccccgaatccgccaagaagcaaaccaagcttatggaatttcctcaggagatggaggaggaagaagaagaagaagtcatggagctcgtggtggccgccgcccgcaagctccactccctcaaactgacccgcatcggtacagagaagagccgaggccaagtcttaccaggtggcgaatttgtcctgctcactagagtgacgtag

SEQ ID NO: 31422 - DNA, 2334 bp, Artificial Sequence
  Description of Artificial Sequence: Synthetic coding sequence
atgttctctcttaaaccccccaagcccacttttcgctcctatttgttacccccccctcagacagatgacaagataaactccgagcccaagattaaaaaacttgagcctgttttattgcctggcgaaatcgttgtaaacgaggtgaacttcgttaggaagtgcatcgctaccgacacgtcccagtacgatctgtggggcaagttgatctgcagcaattttaagatctcctttatcacagacgatccgatgccactacagaaattccactataggaatctgttgctgggcgaacatgatgtgcccctcacctgtatcgagcagatagtgactgttaacgatcacaaacggaagcaaaaggtcctgggcccaaaccaaaagctgaagttcaatccaaccgagttgattatttactgcaaggacttccgtattgtcaggttcagattcgacgagagcggccctgaatccgcaaaaaaggtgtgcttggccatagcccattacagccagcctacagatctacagctccttttcgccttcgagtatgtaggcaagaagtatcacaatagtgctaataaaataaacgggataccgagcggtgatggaggaggtggaggtggcggggggaacggggccggagggggaagctctcagaagacgccactgtttgaaacatatagcgattgggaccgggagattaaacgaaccggtgcgtccggctggcgggtgtgctccattaatgagggatatatgataagcacttgtttgcctgagtatatcgtggttcctagctctctcgcagatcaggacctgaagatcttctcacacagcttcgtgggaagacggatgccattgtggtgttggtctcacagtaacggaagcgcccttgtacgcatggcattgattaaggacgtgctgcagcagcggaaaattgatcagcgaatctgcaacgcaatcaccaagagccatcctcagaggtcagatgtctacaaatcggacctggacaagactctgcccaacatacaggaggtgcaggcagcctttgtgaaacttaagcagctctgtgttaacgaaccattcgaggagacggaagaaaaatggctctcaagtctggaaaacaccagatggctggagtatgtgcgtgcctttctgaagcacagcgctgagctggtgtatatgctggagtcgaaacacctcagcgtcgtactgcaggaagaagaggggagggacctgtcctgctgtgtggcctctttagtgcaggtaatgttggacccctatttccgcacaatcaccggcttccaaagcctaatacagaaggaatgggtgatggcgggataccagttcctcgatcgctgcaaccatttgaaaagatccgaaaaagagagcccactcttcttgctttttcttgacgccacttggcagttgctggagcagtaccctgccgcctttgaattcagcgagacctacctggctgtgctgtacgacagcacccgtataagtctgttcggaactttcctgttcaactcacctcatcaacgggtgaaacagtccacggaattcgcaatttctaaaaatattcagctgggagacgagaagggcctgaagttcccgtcagtatgggattggagtctccagttcaccgcaaaggaccggaccctgtttcacaatccattttacatcggcaaaagcaccccatgcattcagaatggctcagtgaagagtttcaagagaacaaaaaaaagttattcctcaactttgcgagggatgcctagcgcactcaaaaacggcattattagcgaccaggaactcctgcctcggagaaactccctgattcttaaaccaaagccggaccccgcccagcaaacggatagccagaattctgataccgaacagtattttcgcgagtggttttccaaacctgccaacctacacggagttatcctgcctagagtctcaggcacccacattaagctgtggaagttatgttacttccggtgggtccccgaggctcaaatttctttgggtggatccataactgcatttcacaaactgagcttgttagctgacgaggtggacgtgctgtcacgcatgctcaggcagcagcgatcgggcccactagaagcctgctatggcgagctgggacagtcacggatgtacttcaacgcttctgggccacaccatacagacactagtgggaccccagagtttttaagctccagttttcccttctcacctgtaggaaacctgtgccggagaagtattctcgggaccccactgagtaagtttcttagcggcgctaagatctggctgagcactgagacgctcgccaatgaggactag

SEQ ID NO: 31423 - DNA, 819 bp, Artificial Sequence
  Description of Artificial Sequence: Synthetic coding sequence
atgtggtggggtggaaggggacagtctttcaatattgctccccagaaggaagaacctgaaatgggctccgtgcaggaaaaccgaatgcctgagcctcgcagccggcaacctagctcatgtctggcctctcggtgcctacccggcgagcagattctggcctgggccccaggcgtccggaaagggctggaacctgagttgagtggaaccctcatctgcactaacttcagggtgacattccagccctgcggttggcagtggaaccaggataccccgttaaattctgaatatgacttcgcacttgttaatatcggacgcctggaggctgtgtcgggactgagtcgcgtccaattgctgcgaccgggctctcttcacaagtttatcccagaggagatacttattcatggacgggacttcaggctcctgagggtgggctttgaagctggggggctggaaccgcaagcctttcaagtgacaatggcaatcgtccaggcacgcgcccagtctaaccaggcacagcagtattcagggatcactctgtctaaagccggacagggcagcggaagccgcaagcccccgatcccactgatggagaccgccgaggactgggagacagagcggaagaagcaggcagcccgtgggtggagagttagtacagtcaatgaacgattcgatgtggccacccgactccgctgttttagttcctcgcttatcgtgtccggcagcagtagtagttcctttcaactaattcttaactccctcagtttctcttttctcctattcatgacagtgtctggcttccttaccccgcttccatcgtag

SEQ ID NO: 31424 - DNA, 1923 bp, Artificial Sequence
  Description of Artificial Sequence: Synthetic coding sequence
atgcctccaagggttacattccaaccttgtggctggcagtggaaccaggatactcctctcaactccgaatatgattttgcgttggttaatattggacggctcgaggccgtgagtggtctgtctcgggtgcagctcctcagacctggttcactccataaatttatcccagaggagatattaatccatggccgcgactttaggttgctgagagtcgggttcgaggctggcgggctggagccccaagcatttcaggtgaccatggccatcgtccaggcccgggcccagagcaatcaagcacagcagtattccggaattacactctctaaagcgggacaaggaagcggatccagaaaacctcccataccactcatggaaaccgcagaagactgggagacagaacgaaagaaacaagctgcccgaggttggcgcgtgagcaccgttaacgaacggttcgacgtcgcaacatcacttccacgatacttctgggtgccaaaccggattctggattccgaagtgagaagagcattcggacatttccaccaagggcgcggaccgcgtctgtcgtggcaccatccaggcggcagtgatcttttgcgatgtgggggcttctacaccgcctccgatcccaacaaggaggacatcagggccgttgaactgatgctccaggccggacatagcgatgtggtgctggtcgacacaatggatgagctgccaagccttgccgacgtgcaacttgcacacctgcgcctgcgcgccctttgcctaccagattcatccgtggccgaagacaaatggctgagtgccctggaagggactcgatggctggattatgtgagggcttgtctacgaaaagcctccgacatctctgttctcgtcacctctcgggtgcgctctgtaattctgcaagagaggggggatcgggatctgaacggcctgctctcttcactcgtccagctgttgtccgctcccgaggctagaacactcttcggttttcagagccttgtgcaaagagaatgggtggcggctggtcatccatttctaacacgactgggcgggacgggggcatctgaagaggcccctgtgtttctgctgttcctggactgtgtgtggcagcttctccagcagtttcccgccgatttcgaatttagcgagttctttctgctggcacttcatgactctgtgcgggtgccagacactctgacgtttctgaggaacactccctgggagagaggaaaacaatcaggccaactcaattcttacactcaggtgtatacccccggatattcccagccacccgctggcaacagcttcaacctccagctgtcagtttgggactgggatctacgttactccaatgctcaaattttgcaattccagaaccccggctacgaccccgagcactgccctgattcatggctgcctcggccacagccatcatttatggtgccaggacctccctcaagcgtttggctttttagccggggcgccctcacacccctgaaccagctgtgcccatggagagactctccctcacttctggccgtgtctagccgatggctgccacggcccgctatctcttcagaatctctggccgatcaggagtggggcctcccttctcactggggggcatgtccgctgccacctgggctgttgctgccaggctacctcgggccacagattcggttgtggcgaagatgctatctgagaggcaggccagaagtccagatgggcctgagcgctcccaccatatccggcctgcaggacgagctgagtcacttacaggagctgctccggaaatggacgccacggattagtccagaagatcatagcaagaaacgcgacccacatacaattcttaacccgaccgagattgccggaattctgaaaggtcagagtcatcctttttggattacacggtgttag

SEQ ID NO: 31425 - DNA, 765 bp, Artificial Sequence
  Description of Artificial Sequence: Synthetic coding sequence
atggctatcgtgcaggcccgtgcacaaagcaaccaggctcaacagtatagtggaatcacactgagcaaggccggccaggggagcggaagtagaaaaccaccaatcccgttgatggagacggctgaggactgggagacagaaaggaaaaaacaggcagcccggggctggcgggtctcaaccgtaaacgagcgcttcgacgttgcgacaagtctaccccggtacttctgggtgccgaacagaatcctggatagcgaggtgaggagagcatttggacactttcaccagggtcggggccccaggctttcatggcatcacccaggtggttccgacctgcttagatgtgggggtttttatacagcgtccgatccgaataaagaagacattagggccgttgaactgatgctacaagccggtcattctgatgtggtgttagttgataccatggatgagctcccctcactggccgatgtgcagctcgcccacctacgcctcagagctttgtgcctgccagactccagcgtcgctgaagacaagtggctgagtgcactggagggcacacggtggcttgattatgtgagagcttgcctccgaaaagcttccgatatttcagttctggttacttcccgagtccgtagcgtgatcttgcaagctgcgttttcacctaggtcccctaacacggtctggctccccatcacctcgacagctcgggtggggggaagctggacaagtctgcccgactcagcatggggtaattggggccaatag

SEQ ID NO: 31426 - DNA, 1065 bp, Artificial Sequence
  Description of Artificial Sequence: Synthetic coding sequence
atgcccgaaccccgcagtcggcagccatcatcctgtctggcaagccggtgcttgcccggcgagcagatcctggcttgggctccaggagtacgcaaaggcctcgagccggagctctccggaacgctcatctgtactaatttccgcgtcacttttcaaccgtgcggttggcagtggaaccaggatacccccctgaactcagagtacgatttcgccctggtaaacatcggaagacttgaggctgtcagcggactgagccgcgtccagctgctccgacctggatcattgcacaagttcatccctgaagaaatccttatccacggccgagacttcaggctactgcgggtgggcttcgaagcgggtggcctggaacctcaggccttccaggttaccatggctatcgtacaggcccgcgcccagtctaatcaagcacagcagtacagcgggatcacactctctaaggctgggcagggctcgggatcccgcaaaccaccaattcccctgatggagaccgcagaggattgggagactgagagaaaaaaacaggctgcgaggggttggcgggtgagtaccgtcaatgagcgtttcgacgttgctacctcacttccgcgctatttttgggtgcccaaccggattctcgacagcgaagtgaggagagcattcggacatttccaccaagggcgggggccacgcttgtcctggcaccaccccgggggtagcgatctgttacggtgtggaggcttttatactgcctcggatccgaataaagaggatattcgggccgtcgagctaatgttacaagccggacactctgacgtggttttggtggacacaatggatgagttgcctagtctagctgatgtgcaactggcccacctcaggctcagagcattgtgtctcccagattcttccgttgccgaagacaagtggcttagcgccttagaaggtactcggtggctcgactacgtgagggcttgcctgaggaaggcttcagacataagcgtgctagttacaagcagagtgcgctcagtcattctccagggctccggagtctccccactgccatag

SEQ ID NO: 31427 - DNA, 2130 bp, Artificial Sequence
  Description of Artificial Sequence: Synthetic coding sequence
atgtggtggggaggaaggggacagagcttcaacattgccccgcagaaggaagaacctgagatgggctctgtccaggaaaacagaatgcccgagccccgtagcaggcagccttcatcctgcctcgccagccgctgcctgcccggcgaacagatactagcctgggcaccgggcgttcggaaggggctcgaacctgaactctcagggactctaatctgcacgaactttagggtcacctttcagccttgtgggtggcagtggaaccaggacacccccctgaactcagagtatgatttcgccctcgtgaacattggccggctggaggcagtgtctggcctcagtcgggtacagctgcttcggccagggagcttgcacaagtttataccagaagaaattctgattcatggcagggactttcgcctgctgcgggtaggtttcgaagccgggggactagagcctcaggcattccaggttactatggctatcgttcaagcgcgagcgcaatccaaccaggctcagcagtatagcggcatcacgctctccaaagccggccagggttccggatctcggaagccccctattccactgatggagaccgctgaggactgggagactgagagaaagaaacaagcggctaggggctggcgggtgagcaccgtaaacgaaaggtttgacgttgccacgtccctgcccaggtatttttgggtgcccaatagaatccttgactcggaggtgcggcgtgcctttggtcattttcatcaaggacgcggtccccggctgtcctggcaccacccaggcggctcggatctgctcaggtgcgggggtttttacacagcttccgatcctaacaaagaggacatcagagcggtggagctcatgctgcaggctggacacagcgacgtcgttctcgtagacaccatggacgagctgccaagccttgcggacgtacagctcgcacatctgagattgcgtgccctgtgcctccccgattcttcagtggcggaggacaagtggctcagcgctctggaaggaactcgctggctcgactatgtgcgggcgtgccttaggaaagcttcagatattagcgtactagtaacctccagagtccgttcggtaattcttcaggagaggggggaccgagatttgaacggccttctcagctctcttgtacagttgctgtcagcgcctgaagcaaggaccctctttggctttcagagtctagtgcagcgggaatgggtggcagcgggccacccatttctcacccggttgggaggtactggagctagtgaagaagcccctgttttcctcctgtttctggactgtgtatggcagctgctgcagcagtttcctgctgacttcgaattttctgagttttttcttctggccctgcatgattcagtgagagtgccggatacattaacgtttttaagaaacaccccctgggagaggggcaagcagtccggacagctgaactcctatacccaggtgtacactcccgggtacagccagccacctgccggcaacagtttcaacctgcagttaagtgtctgggactgggatctacggtacagcaacgcacagatcttacagtttcagaatccaggctacgacccagaacactgtcccgactcgtggctcccacgccctcaaccctcctttatggtgccaggtcctccaagtagcgtgtggttgttttcacggggcgcactgacacccctgaaccagctttgcccatggcgcgatagtccgtccctgctggctgttagcagtcgctggctgccacgcccagcaatatcatccgagagcctcgctgaccaggagtggggactgccatcccattggggggcttgcccgttgccccctggtctcctcttaccagggtacttgggtccacagatcaggctctggcgaagatgttacctccggggccgccccgaagttcaaatgggcctctctgcgcccaccatctccggactgcaagacgaactttctcaccttcaggagctcctccgcaaatggaccccccggattagccccgaagaccacagtaagaagcgggatcctcatactatccttaatcccacagagattgccggaatcttaaagggccgcgcagaaggcgatcttggttag

SEQ ID NO: 31428 - DNA, 663 bp, Artificial Sequence
  Description of Artificial Sequence: Synthetic coding sequence
atgaatataagaaacgctaggccagaagacctgatgaacatgcagcactgtaatttgctctgcctccccgagaactaccagatgaagtactacttctaccacggcctgagttggccccaactgagctacatagccgaagatgagaatggcaagatagtcgggtatgtgctcgcaaagatggaggaggacccagatgatgtcccccacggccatataacgtcgctggctgttaaaagatcacaccgaagattgggcctggcacagaagcttatggaccaggcctcgagagccatgattgagaactttaatgccaaatacgtgtccctgcatgtccgcaaaagaatctcagaggtggagcctaaatattatgccgatggagaggatgcctacgccatgaaacgggacctgacacagatggccgacgagcttaggcgccacctcgaactgaaggaaaaaggaaggcacgtggtgcttggggccatcgagaacaaggtcgaaagtaaagggaactctcccccttcatcaggagaggcctgccgggaggaaaagggactcgccgctgaagactcaggaggcgacagcaaggatctgagtgaggtctccgagaccaccgagagcaccgacgtcaaggactcgtccgaagcatctgattctgcatcctag

SEQ ID NO: 31429 - DNA, 708 bp, Artificial Sequence
  Description of Artificial Sequence: Synthetic coding sequence
atgaacatacgtaacgcgagacctgaggatctgatgaacatgcagcactgcaacctcctatgtctgccagaaaattaccagatgaaatattacttctatcatggacttagttggccgcaactcagttacatcgccgaggacgagaatgggaaaatagtcggctatgtattggcaaagatggaagaggatccagatgacgtcccccacggccacattacctcgctcgccgtcaagcggagccatagacgtctgggtcttgcacagaagttgatggatcaggcctctcgggcgatgatagagaactttaacgccaagtatgtgagcctgcacgtcagaaagagtaatagagctgccttacacctgtatagtaacacattaaactttcagatctcagaagtcgagcctaagtattatgctgacggggaggatgcttatgcaatgaaaagagacctgacccagatggccgatgaattacgtcgtcacctggaactcaaggaaaagggtcgacacgtggtcctgggggccattgaaaataaggtcgaatctaaaggcaattcaccaccctcatctggtgaagcatgcagagaggagaaagggcttgccgccgaggactccggcggggacagtaaggatctgtccgaggtctccgagacaactgaaagtacggatgtcaaggactcttccgaggcgtccgatagcgcatcctag

SEQ ID NO: 31430 - DNA, 714 bp, Artificial Sequence
  Description of Artificial Sequence: Synthetic coding sequence
atggggcgaaaaagctccaaggccaaggaaaagaagcagaagcgcctagaagaacgagctgccatggatgccgtgtgcgctaaggtcgacgcagccaatagactcggcgaccccctggaggctttccctgtcttcaagaagtacgaccgtaatggtttaaacgtttctatagaatgtaagagggtctctggcctcgagccagccactgtcgactgggcttttgacctgactaaaactaacatgcagacaatgtacgagcagtccgagtggggctggaaggatagggagaaacgggaggagatgactgacgaccgagcctggtatctgatcgcttgggagaactctagcgtgcccgtcgcgttctcccactttagatttgatgttgagtgtggggacgaagttctgtattgttacgaggtacaattggagagtaaagtacgtagaaaaggcctgggcaaattcctcatacaaatcctgcaactgatggcgaattctacccagatgaaaaaagtgatgttaacagtctttaagcataaccacggcgcctatcagttcttccgagaagccctgcagtttgaaatcgatgacagctctccaagcatgagcggctgctgcggagaggattgcagctacgagattctgtcgaggaggacgaagtttggggacagccaccactctcacgctggcgggcattgcggaggatgctgccattag

SEQ ID NO: 31431 - DNA, 594 bp, Artificial Sequence
  Description of Artificial Sequence: Synthetic coding sequence
atgcctttcgtgcccaagtggacactgcctaccggactgaacgttagcatcgaatgcaagcgggtctccggcttggaacccgccacagtggactgggcattcgacctgactaagaccaacatgcagactatgtacgagcagagtgaatggggctggaaagaccgcgaaaaaagagaggagatgacagacgatcgcgcatggtacctgattgcttgggagaacagcagtgtaccagtggcctttagtcacttcagatttgatgttgagtgcggtgatgaggttctgtattgctatgaggttcagcttgagagcaaagtccgaaggaagggcttaggcaagtttctgattcagatacttcaacttatggcgaatagtacccagatgaaaaaagtaatgctaactgtcttcaagcataaccacggggcctaccagttctttagagaagcccttcaattcgaaatcgatgatagttcccccagcatgagcgggtgttgtggagaagactgcagctatgagatcttatccaggcgtactaagttcggggattcccaccactcccatgcaggggggcattgtggcggctgctgtcattag

SEQ ID NO: 31432 - DNA, 645 bp, Artificial Sequence
  Description of Artificial Sequence: Synthetic coding sequence
atgtctgacctcgaagacgacgaaaccccccagttatcagcacatgccctggcagcgttgcaggaattttacgccgaacaaaagcaacagatcgagcccggtgaagacgataaatataacattgggatcattgaggagaactggcaactttcacaattctggtattcccaggagacagcacttcaactcgcacaggaggctatcgcggccgtcggggagggcggtcggattgcatgcgtatccgccccgtccgtgtatcagaagttaagagaactctgcagagaaaacttctccatctacatctttgagtacgataaacgcttcgccatgtatggcgaagagtttatcttctacgattataacaatccactggacctgccagagagaatcgctgctcactccttcgatatcgtgattgccgatccaccatatctgagtgaggagtgcctacgcaagacctcagagactgttaaatatctgacacgtggcaagattctgctgtgcaccggcgctattatggaggaacaggccgccgagcttctcggcgtgaagatgtgcacttttgtgccacgacataccagaaaccttgctaacgagttccgatgctacgtgaactacgactctgggctcgactgtggcatatag

SEQ ID NO: 31433 - DNA, 645 bp, Artificial Sequence
  Description of Artificial Sequence: Synthetic coding sequence
atgtcggacttggaggacgacgagacgccacaactttctgcacacgccctggcagctcttcaggaattctacgctgaacaaaagcaacagatcgaacctggagaagacgataaatataatatcggtatcattgaagagaactggcagcttagtcagttttggtattctcaggaaacagctctccagctcgcgcaagaagcaatcgctgctgtgggtgagggcgggagaatcgcatgcgtatcagctccttcagtgtaccagaagctgcgggagctctgtcgagagaattttagtatttacatttttgaatacgataaacgatttgcaatgtacggtgaagagtttattttctacgactacaataatcctttagatctgcccgagaggatcgccgcccactcctttgatattgtgatagcggacccgccatacctatctgaggaatgcctcagaaaaaccagcgaaacagtgaaatatttgacccgcggcaagattttattatgtaccggcgctataatggaagaacaagccgctgagctactcggcgtgaagatgtgcaccttcgtcccccgacataccaggaacctggctaacgagttccggtgctacgttaactacgactctggcctggattgcggaatctag

SEQ ID NO: 31434 - DNA, 1110 bp, Artificial Sequence
  Description of Artificial Sequence: Synthetic coding sequence
atgaagctcgaagcgtcatgcggaaccgcgacgtccgaagtgccaaagcccgagaaaaagaccgcgcgggatgcggaaccttcttctgaaacacggcctcaggaggtagaggccgaacctcgaagcgggtccggtcccgaggcagaagccgagcctttggacttcgtcgtggccactgagagggagttcgaagaggtgctggcaatcagcggaggaatctatgggggcttggactatctaccctcacggtaccactcttggctgcgcgaccccgatcggactgtcgtgctcgcaaagcgcaatgggggcgtgattgccctggaaagtgtgaacgtgatagacgccggcgagactgtcctggtggaggggctgagggtggcaccctgggagcgggggaagggcgtggccggccttctgcaaagattctgctcacagctagtcaagaggcagcaccctggtgtgaaggttgcccgcctcacacgggacgatcagttaggacccagggaactaaagaaatatcgactaattactaagcaaggtatcctgctagtgagatttaacgcctccgccctgctggcaggcctgggagcacggctggccgcactgcgcactagtggtactttcagccccctgcccactgaagctgttagtgaggccggaggtgatgtggcgaggctgctgctctccccctcagttcagcgtgacgtcctgccaggcggcacaatcatccaagattggcaaccataccggcccagtgaatcgaatcttagacttctggccgctaagggtctggaatggcgcgttgattcccgggccagacctcgggtcttaacactctgcactaggccgtttccaatcccccacgggggagatggcacctggcgttatctcaacatcgacgcctttggtagtgatggcgcccaggttcaaagtcagctgctgtggcatctccaacggcaagcccccagacttgtgggtctgaacgtcatgtgtcagctttttctggagcctcaactctggagccaacttgccgacttctgccaggtgggtcttggcctggagctggtgaaaggctatacagaacagtatctattggaggccgacatctag

SEQ ID NO: 31435 - DNA, 471 bp, Artificial Sequence
  Description of Artificial Sequence: Synthetic coding sequence
atgaaattggaggcttcttgcggaacagcaacatccgaagttccgaagcccgagaagaagaccgcgcgggacgcagagccatcatcagagaccaggccccaggaagtggaagcagagccgagaagtggaagtggccccgaggccgaggccgagccactcgactttgtggtggcaacggaaagggaattcgaagaggtcctagctatatccggcggaatctacggaggcttggattacctcccctcccggtatcactcttggttgagagatcccgaccggactgtagtcctggccaaacgaaatggaggagtcattgctttagagagtgtaaatgtgattgacgccggtgaaacggtccttgtggaaggcctgcgagtcgcaccatgggaaagaggcaagggagttgcaggtctgcttcaaaggttctgctcccagcttgttaagcggcagcaccccggcgtgaaagtttag

SEQ ID NO: 31436 - DNA, 1110 bp, Artificial Sequence
  Description of Artificial Sequence: Synthetic coding sequence
atgaaactggaggcatcctgcggaaccgcaacctcagaggtccccaaaccggaaaagaagactgctcgggatgccgagccgagtagtgagaccaggccacaggaggtggaggctgagccgcgttcaggcagcgggccagaagccgaggcggaaccactagatttcgtagtggctaccgaaagagaattcgaggaggtgctcgctatctcaggcggtatttatggaggattagattatctgccatccaggtatcacagctggctgcgagatcctgaccggacggtggtgttagccaagcgaaatggcggggttattgctctggagagtgtaaacgtgattgacgccggcgaaaccgtgctggtggaggggctcagggttgccccttgggagcgtgggaagggcgtggcaggactgttacagcgattctgtagccaactggtgaaaagacaacatcctggagttaaagtggcccgcctaaccagagatgatcaactcggacctagagagcttaagaaatatcgactcattaccaaacaaggaattctgctggtaaggtttaatgcaagcgcattactggccggcctgggcgcgaggttagccgccctgagaacctccggaacctttagccccctacccacagaggccgtgtccgaggctggtggggacgtagcaagactgctgctgagcccttccgtgcagcgcgatgtgctgcctgggggcaccattattcaggactggcagccctatcgcccatccgaatccaacctgcggcttttagccgccaaggggctcgaatggcgcgtggatagtagggcccgcccacgggttctgactttatgtactcgacctttcccgattcctcacgggggagatggaacgtggagatacttgaacatcgacgcatttggttctgacggggcacaggtccagagtcaactactttggcatttgcagcgacaggctcctcgactggttgggttaaacgtgatgtgtcagctgttcttggaaccacagctgtggtcgcagctcgccgatttctgccaggttgggctcggccttgagctggtgaaggggtacacagagcagtatctgttggaagctgacatttag

SEQ ID NO: 31437 - DNA, 861 bp, Artificial Sequence
  Description of Artificial Sequence: Synthetic coding sequence
atggaattgatcctcagtacttcccccgccgaattgacactcgatcccgcgtgccagccgaagcttcctctggattccacgtgccagcctgaaatgacgtttaatcctggcccgaccgaactcacactcgatcccgaacatcagccggaagaaactcccgctcctagcctagcagaactgacactggaaccagtgcacagacgcccagagctcctggatgcctgcgcggacttgatcaacgatcagtggcccaggtctagaacaagtaggttacattccctcggccagtcgtcagacgcgtttcccttatgcttaatgcttctgagcccccacccaaccctggaggccgcccctgtggttgtgggacacgccagactgagcagagtcctgaatcaaccacagagcttgctcgtggagacagtggtggttgctcgggccctaagaggccggggcttcggccgccggcttatggaagggctagaagtatttgcgcgagccaggggcttcaggaaactgcatctgaccacccacgatcaggtgcacttctacacgcacctgggctaccaactaggggagcccgtacagggcctggtgtttacaagtagaaggctgcctgccaccctcctgaacgccttccccacagcccccagtcccagaccgcctcgtaaagcgcccaacttgaccgcccaggctgctccgagggggcccaagggcccaccgttaccccccccaccgcctctgcccgagtgtctgaccatcagtccaccagtgccatcaggcccgccatccaaatcactcctggagacccagtaccagaatgtccgtggcagacccatcttttggatggaaaaagatatttag

SEQ ID NO: 31438 - DNA, 861 bp, Artificial Sequence
  Description of Artificial Sequence: Synthetic coding sequence
atggagttgatactgtccacatcgccagctgagcttacgctggatcccgcctgccagcccaagctgcccctggactctacatgccagccagagatgacctttaatccaggccctaccgaactgacattggatcctgagcaccagcccgaggaaacgcctgcgcctagcctggcagaactgacactcgagcccgttcacagaagaccagaacttcttgacgcgtgtgccgacctcattaacgatcagtggccaaggagtaggacaagtcggctgcactcgctggggcagagttcggacgctttccctctctgcctcatgctgctgagccctcaccctacccttgaggctgctccagtggtagtgggccacgcacgcctatccagagtcctcaaccagccacagtccttgctggtggaaaccgtggtggtggcacgggcacttcgtgggcggggctttggccgtcgcctgatggaaggattggaggtgtttgctagggccagagggttccgtaagctccacctgacaacccacgatcaggtgcatttttatacacatcttggttaccaactgggagagcccgttcagggtctggtgttcacttctcgtagattgcctgccaccctgctgaatgctttcccaaccgcaccaagcccccggcccccacgcaaggcacctaatctgactgctcaggccgctccacggggcccgaagggcccgccactgccccctccacctcccctgcctgaatgtctcactatatcccccccggtgccgtctgggcccccttcaaagagcctgctcgagacccaataccagaatgtacgcggtcgacctattttttggatggagaaggatatatag

SEQ ID NO: 31439 - DNA, 624 bp, Artificial Sequence
  Description of Artificial Sequence: Synthetic coding sequence
atgcggttaaaccagaataccttactgctgggtaaaaaggttgtgctggtcccttatacaagcgagcatgttcccagtaggtaccacgagtggatgaaaagcgaagaactgcagagactcactgcgtctgaacctctgacgcttgagcaagagtacgcgatgcaatgcagctggcaagaggacgccgacaagtgcacgtttatcgtgctcgacgctgaaaaatggcaggctcaaccaggggcaactgaggagagttgtatggtaggggatgtgaacctgttcctgaccgatctggaggacctgactctaggcgagattgaagttatgatcgccgagccatcctgcagaggcaagggcctgggcaccgaggctgtcctagcaatgctcagttacggcgtgacaactctgggcctgaccaagttcgaggccaaaattggccagggcaacgagccctccattagaatgtttcagaaacttcacttcgagcaggttgccacgtcgtccgtatttcaagaggtgaccctgcgcttgaccgtgagcgagagtgagcaccagtggctgctggaacagaccagccatgtggaagagaagccttatagggacggctctgccgaaccttgctag

SEQ ID NO: 31440 - DNA, 4290 bp, Artificial Sequence
  Description of Artificial Sequence: Synthetic coding sequence
atggactcacagttccatatggcaggagaagcctcacagtcctggctaaaggcaaaggagaaacaacggggcacatcctacatggtggcagttatcgaatgggagatcgaacgctccctgttgtcaagcgaagatagagagcagggagccaccgtatttttgcgggagatccaagatctgcacaaacatatccttgaggattgtgccctgcgtatggttgatcgtctggctgacggttgtttagacgccgacgcacaaaacctgctctccagcctgaaatcgcatataacagacatgcaccctggcgtgctcaagacccacaggctgccctggagcagggaccttgtgaacccgaagaacaaaacacatgcctgttacctcaaggagctgggagaacagttcgttgttcgcgccaaccatcaggtgttgactagactcagagaactggatactgcgggacaagagcttgcatggctctaccaggaaatcaggcaccatttgtggcaaagctcagaggtcatccagaccttttgtggcagacaggaattgctggcgcgcctgggacagcagcttcgccatgacgattcaaaacaacataccccactcgtcctgtttggccccccaggcattgggaaaacagctctgatgtgtaaactggctgagcagatgccacgactgctaggccataagactgtcactgtactccggctattgggaacgtcacagatgtctagcgatgcccggggtttgctgaagtccatctgttttcaggtgtgcctggcgtatggtttgcctctcccaccagctcaagtgctggacgcccatactcgagtggtccagtttttccatacgcttctacataccgtgtcatgccgtaactttgaatctctcgtgctcctcctggatgctatggacgacttagactctgtccggcatgcaaggcgagtcccttggctgcccctcaattgtccccccagggtccacctcatcctcagtgcatgttcaggcgcactgggcgtgctggataccctccagcgggttctgttagatccggaggcctactgggaggtaaaacccctgtcggggaaccagggacaacaaatgatccagctcctgctagccgcagcacgacgcacactgtcccctgtgcataccgacctgttgtgggcaagtctccctgagtgtggcaacccaggtcgattgaggctagcattcgaagaagctcgtaaatgggcttcctttactgtcccagtgcctttggcaacaacagccgaggaggccacgcaccaattatgtacaagactcgagcagacacacggccaactgcttgtggctcatgtgttgggctacatcgtatcttcacggcacggcttaagtgaagcggagcttaaggacgtgttaagtctcgatgatgaggttcttcaagatgtgtatcgcgattggacccccccctcaaaggagcttctccgattcccgcctttgctgtgggtgcggttaagacgcgacctcggctactacctggcccgccggcccgtggacggattcacccttttagccattgcccatcgccagctggtggaagtagtgagggaacgctacctgtctggcagtgagcgcgcaaaacgacatggagtattggctgacttctttagtggcacatggtcccaaggtaccaagaaattaatcactctgcctttggtgggaaaacctctgaaccttgaccgtaaggtggccccacagccactttggttcagccataccgttgccaacctaaggaagcttaaagagctcccgtaccacctgctgcacagtggaaggctggaggaactaaaacaggaagtgttgggctcaatgtcttggatcagttgtcgcggtattagtggtggcatcgaagacctcctcgatgacttcgacctctgtgccccgcatctggattcacccgaggtgggccttgtcagagaggcgttgcagctctgccgcccggccgtcgagctgcgaggaatggagaggtccctcctgtatactgagctgctggccagactgcatttcttcgccacttcccatcccgcactcgtgggccagttgtgtcagcaggcccagtcttggttccagctgtgcgcgcatccagtcctggtccccctcggagggttcctccagcccccagggggaccactgagagcaaccttgtcgggttgccataagggaattacggccatggcttggggggttgaagaaaaactgctcgtcattggcacccaggacgggataatggccgtgtgggacatggaagagcaacatgtgatccatatgttaacaggtcataccggggaagtgaggtgcgtgaagatatttgctaaggggaccctggcaaactccgcctccaaggattacacactgcacctttggaatcttctgtccggccaagaaaagtttacgatctgggatgggggttcgaaaaatcccgccgagccacagatttggaaccttcacgtcgacgaggcacacaaggtggtgtatagcgccagcggcagcaagattaacgcctggaatttggagaccgccgaacccgtctttcacatactaggcgacgccagtgacccctggatgtgtatggccgttctagccagccaggcaacattattgaccgtctcaagagacggagtcgtgagcttatggtcatcggccacaggcaagcttcagggaaaacagcacatgtcaagtataaaagaagagacgccaacgtgtgctgtgtctgttcagaaacagggaaagctcgtcacaggcttcagcaacggtagcatttccttggtctctagcaagggggacagactcctggaaaaactgccggatgctgtgcggttcctggttgtgtccgaggatgagagcctgctagctgctggattcggaagaagtgttagaatcttcctggccgatagtagggggttccgccggttcatggcaatggacctggagcacgaggatatggtggagacggccgtgttcggtacagagaacaatctcatcataacaggctccttggatgccttgatccaggtttggagcctgtccgagcagggaactctgctcgacattctggaaggtgttggtgcccccgtttcactcttggccagaggtggcgccctcgtggccagtgcttccccccagagttcatcgttcaaggtgtgggatctttcagatgcccataggagccgcgttcccgcgccctttctcgaccggacaggtcttaccgctgtcagccataatgggtcctatgtctacttccccaagatcggggacaaaaataaagtgaccatatgggatctggcagaaggggaggaacaggactccctggatacgtccagtgaaattcggtgccttgaagtcgccgagcagcgtaaacttttgttcactggactggttagtggtgtggtactggtgtttccactcaactctcgacaggacgtaatttgcattcctcctcccgaagcacggaaagccattaactgtatgagtctgtctaagtgcgaggacaggctggcaatcgcctatgacaacatcgttctcgttttagacatcaccagtggcgacccctgtcctgtaatcgacgggccacggtacaccttttatacccaactccctgagacactgagctctgttgccattctgaccgattacagggtggtatattcaatgacaaatggtgatctgtttttatatgagtgtgcaacatcgaaggcgtttcctctagagacacaccgcagtagagtagcgtgtgtggaagtgagccacaaggagcaattggtagtcagcgggtcagaggatgccctgctgtgcctatgggatctacaggcaagaaagtggaaattcgagatgtcatacactagttcatattgcagaggggtgcagtgtgcgtgctttagcaaagatgacaaatacgtatatgttggactgaaggaccggtccattcttgtgtggagcgtgctagacggcacactgctgacggttcagttcgttcatgccgtcgttaaccggattatccctaccacctccggttttattgcgcccacgcgccacggatacctgatcagagaaaatttccaatgtctgagcgccaaagcctcaccgcaggatcccctgaagaattttaaaaaagctatgtggatggtgaagtcacggcagagagaggagctggtcgccgctgctggcgcgccgcaggacctcgaaagtgagtctgcgcaggggaacgagaccaaatccaataagtgtagccaggtttgtctcattgtgtag

SEQ ID NO: 31441 - DNA, 4299 bp, Artificial Sequence
  Description of Artificial Sequence: Synthetic coding sequence
atgcaaaggggcaagccttgtagagccctgcctacacttaagtgtcagactttttgtcagcgacatggtctcatgtttgaagtcgtcgatctccggtggggcatccggaatatagaagcaactgaccacctgactacggaactctgtctggaggaggtggatcggtgctggaaaacaagcattggacctgccttcgtagccctcatcggggaccagtacggcccttgccttatcccctcccggattgacgaaaaggagtgggaggtcttacgggatcacctgacggcccgcccaagcgatctggaactggtagcacgatacttccagagagacgagaacgcttttccacccacctatgtcttgcaagccccagggactggggaggcctgcgaacctgaagaagcaacccttacctccgttctgcgctccggcgcccaggaggctcgccgcttaggactgatcacacaggaacagtggcagcactaccaccgtagcgtcatcgagtgggagatcgagcggtcattacttagcagcgaggaccgcgagcagggtgctaccgtttttttgagggagatccaagatctacataaacatattctcgaggattgcgcattgagaatggtggaccgcttggcggacggctgtctcgatgccgatgcccaaaacctcttgtcgtctctgaagtcccatattaccgacatgcaccctggcgtccttaagacacacagacttccttggtcccgggaccttgtgaaccccaagaataagacacatgcttgctatcttaaggagctgggagagcagtttgtggtccgggctaaccaccaggttctcactcggctcagggagctggatactgctggtcaggagttagcatggctctaccaggagatccgacaccacctttggcagtcatccgaggttattcaaaccttttgtggtaggcaagagttgctggcacgacttggccaacagctacgccacgacgatagtaagcaacacacacccctcgtactcttcgggcccccagggattggcaagacagccctgatgtgcaagctggccgaacagatgccacgcctcctaggccataagaccgtcactgtgctgcgcctgctcgggactagccagatgtcaagtgacgcaaggggattgctaaagtcgatctgcttccaggtctgcctggcatacgggttgcccctcccaccggcgcaggtactcgatgcacacaccagagtcgtgcagttttttcacactttactgcacacagtgtcttgccgaaacttcgaaagcctcgtgttactgctggatgcaatggatgacttggactcagtaaggcacgcaaggcgtgttccatggctgcctttgaattgcccccctagggtgcacctgattttatccgcatgttcgggagccctgggagtattggataccttgcagagggtgttactggatcccgaagcttattgggaagtaaaacccttgagtggtaaccaaggacagcaaatgatacagctgctgttggcagccgctcgacgcacattgagtcccgtgcataccgacctcctgtgggcgtcattacctgagtgcggcaaccccgggcgcttgagactagctttcgaagaggcccggaaatgggcttctttcaccgtacctgttccgctggccacaacggccgaagaggctactcatcagttgtgcacaagactggagcagacccatggacagctcctggttgcccatgtccttggatacattgtgtcttcacgccacggcctgagcgaggcagaactgaaggatgttctgtccttagatgacgaggtactgcaggacgtctaccgcgactggacaccaccaagcaaggaactgctgcggtttcctcccctgctttgggtgcggctaaggagggatctgggatactatttagctcggcgaccagtggacggttttaccttgctcgctattgctcatcggcagctggtagaggtggtcagagaacgatacctatctgggtccgagcgagctaagcgccatggagtcctcgccgacttcttttccggcacctggtctcaaggcacaaagaaactgatcacactcccactcgtgggtaaacccctgaacttggatcgcaaggttgccccacagccactgtggttttcccacactgtagcaaatctcagaaaacttaaagaactgccataccatttgctgcactccggcagattggaagagctcaaacaggaggtacttgggagcatgagttggattagttgcaggggcatttccgggggcatcgaagacttgttagacgatttcgatctttgtgctcctcatctcgatagtcccgaggtggggctggtccgggaagcattgcagctctgcagaccagctgtggagctccggggtatggagcgcagcttgctctatacggaattattggcgagactgcacttcttcgctactagccacccagcattggtcggccaactgtgtcagcaggcccagtcttggttccagctgtgtgcacaccccgtcctagttccactgggagggttcctacaacctcctggtgggccactgcgcgccactttatcaggctgtcacaagggcattaccgccatggcatggggcgtggaggaaaaactactcgttatcggtacccaggatggaatcatggccgtgtgggacatggaagaacagcacgtgatacacatgcttactggtcatacgggtgaagtaagatgcgtgaaaatattcgccaaggggacactggctaacagtgcatctaaagactatactctgcatttgtggaacctgctgtccggccaggagaaatttaccatttgggatgggggctctaagaatccagctgaacctcaaatctggaatctccacgtggatgaggctcacaaggtcgtgtattctgctagtggctctaaaattaatgcttggaatctcgagactgccgagcctgtgttccacatcctgggagatgcttctgatccgtggatgtgcatggctgtacttgctagccaggctacactcctgacagttagcagagacggggtggtgagcttgtggtcctctgccactggtaaattgcagggtaagcagcacatgagcagcataaaggaagaaactcccacctgcgccgttagtgttcagaagcaggggaaacttgttaccgggttttcaaacggttccattagcctcgtcagtagcaaaggagataggcttcttgaaaagctacctgacgcggtgaggtttctggttgtcagcgaggatgaatcactgctggcagccggcttcggtcggtcagtgaggattttcctggccgattcgaggggcttccggcggtttatggctatggatctagagcacgaggatatggtcgaaacagccgtcttcggtacagaaaacaacctgatcattactggctccctggacgccctgatccaagtgtggtcactttcggagcagggaaccttgctcgacatactggagggcgttggagcccctgtctcactactcgctcgcggcggcgccctggttgcctccgcatcaccacagtcttcctcgttcaaagtgtgggacctaagcgatgctcacaggtcccgcgtgccggctcccttcttggacaggacgggacttaccgctgttagccacaacgggagttatgtgtacttcccaaaaatcggcgacaaaaacaaagtcacaatctgggacctggccgaaggagaggaacaggatagtctggacacctctagcgaaattcgctgcctcgaggtggcggaacagagaaagctgctcttcaccggcttggtgtcaggcgtggtccttgtcttccccttgaacagcagacaggatgtgatctgcatcccaccacctgaagcaagaaaggctattaattgtatgagtctgtcaaagtgtgaagatcgcctggccattgcctacgacaatatcgtgttagtgctggatatcacttcaggagatccttgcccagtcattgatggccccaggtacacattctacacccagctccctgagactttgtcatcagtcgcaattcttactgactatagagtggtgtattcaatgaccaatggtgacttgttcttatacgaatgtgcgaccagcaaagctttccctctggaaacccaccgctccagagtagcttgcgtggaggtgtctcataaagagcaattggttgtgtccggctcagaagacgcactactgtgcctttgggacctgcaggctaggaaatggaagtttgagatgtcctataccgccccctgctag

SEQ ID NO: 31442 - DNA, 4290 bp, Artificial Sequence
  Description of Artificial Sequence: Synthetic coding sequence
atggattcacagttccacatggcaggagaggcatcacagagctggttgaaagctaaggagaagcagcgggggacatcttatatggtggcagttatcgaatgggaaattgaaagatctctgctcagcagtgaggatcgtgagcagggggctactgtcttcttgagagaaatccaggatctgcacaaacatatcctcgaggattgtgcactgaggatggttgacagactcgcggacgggtgccttgacgcagacgcccagaacctgctgtcttccctaaaatctcacattacggatatgcatccgggggtgctcaagacacacaggctaccttggagtagagatcttgtcaatcctaagaataagacccacgcatgctatctgaaggaactgggggagcagtttgtggtgagagctaaccaccaagtcttaacaaggcttcgggagctggacacagccgggcaggaattggcctggctgtaccaggagattagacaccacctgtggcagtcttccgaggtcattcaaaccttttgtggcagacaagagctgcttgctcgcctcggacagcagctacggcacgacgatagtaagcagcacacccccctggtcctctttggccctcctgggattggaaagaccgcgctgatgtgtaaattagcagagcagatgcccagactgctgggccataagacagtgaccgtcctgcggcttttggggacctctcaaatgtcctccgatgcccgtggcctcttaaagtccatttgctttcaggtatgtctggcctacggacttcccttgcccccagcacaagtgcttgacgcccatactcgagttgtccagttctttcacacgctgctccatactgtatcctgtcggaactttgagagtctcgtgttgctgctggatgcaatggacgacctggatagcgtcaggcacgctagacgtgttccatggctccccctgaactgtcctcctagagtgcatttgattttatctgcttgttctggggcacttggggtcctggacactctgcagcgagtcttgctcgacccggaagcatactgggaggttaagccattatccgggaaccaaggtcagcagatgattcagctgcttcttgccgcggctcggcgaactttgtccccagtgcacactgatttgctgtgggcttccctgcctgaatgcgggaatcctggccggctgaggctggcgtttgaggaggcccgaaaatgggcaagctttactgtgcctgtcccactggccaccaccgccgaggaagcgacacaccagttgtgcaccagactcgagcaaacccacgggcagcttctggtggcacatgttttgggttacatagtctctagccgccacggattatcagaagccgaactgaaagacgtgctgtccttggatgacgaggtcttgcaagacgtgtacagggattggactccaccctccaaggagctcctcaggttcccgccactcttgtgggtgcgactaaggagagacctcggctactacctggcgagaaggcctgtcgacgggttcacactgctggctatcgcccaccgacagctcgttgaagttgtgcgcgagagatacctgtcagggtcagagcgcgcaaaaagacacggcgtgctcgccgactttttttccgggacatggagtcagggaaccaagaagttaatcacgctcccactcgtgggaaagcctctcaaccttgataggaaagtggcacctcagcctttgtggttctcccacaccgtggccaatttacggaaattaaaggagctgccttaccaccttctccattctggacgccttgaagagcttaagcaggaggtgctgggtagcatgagttggattagctgtcggggaatctccggaggaattgaggacctgctcgatgatttcgatctgtgtgcacctcaccttgatagtccggaagtcgggctagtaagagaggcactgcagctttgccgccctgccgtggagctgcgtggaatggaacgcagcttattgtataccgagttacttgcaaggcttcacttcttcgctaccagccacccagcactggttggacagctgtgtcaacaggcacagtcctggttccagctctgcgctcatcccgtgctcgtgcctcttggaggctttctgcagcctcccgggggacccctgcgcgctactttgagcggttgtcacaaagggattaccgcaatggcctggggcgtggaagaaaaacttcttgtaataggcacccaggacggtattatggcagtatgggacatggaagaacagcatgtgatccacatgctgactgggcacactggtgaagtgagatgcgtgaaaatcttcgccaagggcaccctggccaactctgcatctaaggactacacattacatctgtggaatttactgtctggccaagaaaaattcacaatctgggacggtggctcaaaaaacccagctgagccccagatctggaatctgcatgtagacgaggctcataaagtggtctactctgcgagtggatcaaagattaatgcctggaacttagagactgctgagcccgttttccatatcttaggagatgccagcgacccttggatgtgtatggctgtcctcgcttctcaggccactctactcactgtgagccgcgatggagtggtctctctgtggagctctgccactggcaaacttcaaggtaaacaacatatgtcatcaatcaaagaggagacccccacttgtgcagtgtccgtgcagaagcaaggcaagctggtgacagggttctccaatggaagcatttctttggtgtcatcaaagggagatcgcttgctggagaagctcccagacgccgtgcgttttctggtagtctccgaggacgaatctctcttggcagcggggttcggtcgctcggtaaggatcttcctggccgacagtcggggatttcggcgcttcatggccatggatctcgagcacgaagacatggttgagactgcagtattcggtaccgaaaacaacttaatcatcaccgggtctctggatgcgcttatccaagtctggtccctctctgaacagggcaccctgttggatattctcgagggcgtgggggcaccggtgtccctgctcgccagaggaggagctttggtagccagcgctagcccgcagagtagcagcttcaaagtctgggacctgtctgatgctcaccgttcccgggtgcctgcccctttccttgaccggaccggtctgactgccgtgtcccacaatggctcgtatgtgtatttccccaaaattggagataagaataaggtaaccatctgggatctggccgagggcgaggagcaagacagcctggacacttctagcgagatcaggtgtttagaagtggccgaacagcgaaagttgttgttcacgggactggtttccggcgtcgtgctcgtgttccccctcaatagtaggcaggacgtgatctgtattcctccccccgaggcacgaaaggcaatcaactgtatgtcgctgagcaaatgcgaggaccggctcgcgatagcctatgacaatatcgttctggttttagatattacatcaggagatccctgtcccgtgattgacggtccgaggtacacattctacacacagttgcccgagacactaagcagcgtcgctatcctcaccgactacagagtggtgtattcaatgaccaatggcgacctctttctatatgagtgcgccactagcaaagccttccctctggagacgcaccgttcaagagtagcgtgcgtcgaggtttcacacaaggagcagctggttgtgagtgggtccgaggatgctctgctgtgtctgtgggacttgcaggcacgcaagtggaaattcgagatgtcctacacctcttcctattgtcggggcgtgcaatgcgcttgcttctccaaggacgacaagtacgtctacgtcggcttaaaggataggagtattctggtttggagtgtcctggacggtacccttctgaccgtacaattcgtgcatgccgtggtcaacaggataatcccaactacatccgggtttattgcccccaccaggcacgggtacttgatccgtgagaattttcagtgcctttctgcaaaggccagcccccaggacccgttaaagaattttaagaaggccatgtggatggttaagagtcggcagagggaggaactggtggctgccgctggagccccacaagatctggaatctgagagcgcacaaggtaacgaaactaagtccaacaaatgcagccaggtgtgccttattgtatag

SEQ ID NO: 31443 - DNA, 4077 bp, Artificial Sequence
  Description of Artificial Sequence: Synthetic coding sequence
atggttgatcggctcgctgatggctgcctagatgcagatgcccagaacctcctaagctccctgaagtcccatattacggacatgcatcctggggtattgaagacccaccggcttccctggagcagagacttagtcaacccaaaaaacaagacccacgcctgctacctgaaggagctgggcgagcaattcgtggtccgggctaaccaccaagtattaacaaggctgcgggagcttgatactgctggtcaggagctggcatggctttaccaggagatccgccatcatctgtggcaatcaagtgaggttatacaaactttctgtgggcgccaggagcttcttgcccggttaggtcagcagttgcgccatgacgacagtaaacaacacacccctctggtgctgttcgggccacctggcattggcaaaaccgctctgatgtgcaaattggcagaacagatgcctaggctcctcggccacaagactgtcaccgtgctacggctgcttggcacctcgcagatgagcagcgacgcccgcggacttcttaagtctatctgctttcaagtgtgtctggcttatggactgcccctgccgcccgctcaggtactcgacgcccacaccagggtggtgcagtttttccatacactgctgcacactgtgtcctgtcgcaacttcgagagcctggtgttactgttggacgcaatggatgatctcgatagcgtacgacatgcaaggcgagtcccttggctgcccctgaactgcccacctcgggttcacctgattctctcagcatgctctggcgctctcggcgtgttagataccctgcaaagggtgctactggatccggaggcgtattgggaggtaaagcccctgagtggcaaccaaggtcaacagatgatccagctcctcctggccgcagcgaggcgcaccctgtctcccgtccacactgatttgctttgggcctcactgccggagtgtggtaaccctgggaggctccggttggcttttgaagaggcgcgtaaatgggccagcttcactgtgcctgtgcccttggctacaacagctgaagaagcaacgcatcagttatgcaccagattagagcagacccatggtcagctgctggtggcgcacgtgctcgggtatatagtgtcttccaggcatgggttatccgaggccgaattgaaagacgtactatcactggatgatgaagtgcttcaagatgtgtaccgagactggaccccacctagtaaggagctgctccgtttcccccctttgctgtgggttcgcttacgtagagatttaggatactatctcgctcggcggcctgttgatggatttacgctgctggctattgcacatcggcagctggttgaggtggtgcgggaaagatacctaagcggaagcgaacgggctaaaaggcatggtgtgcttgccgactttttttctggcacatggtcccaggggaccaaaaagctcatcacattgcctctggtgggaaagccgcttaacttagatcggaaagtggcaccccagccactttggttttctcacacagtggccaatctcaggaagctcaaagaattgccttaccacctgctccattctgggagattggaagagcttaaacaagaggtgcttgggtcaatgagttggatctcgtgccgcgggatatccgggggaattgaggacctccttgatgatttcgatttgtgtgccccacatctggactcgcctgaagtgggtttggtgcgcgaagcgttacaattatgccgacctgccgtggagctgcgcggcatggagcggtctctgctgtacaccgaattgttggcacggctgcacttcttcgcgacctcacaccctgcccttgtggggcagctgtgtcaacaagcccagagttggttccagctgtgtgctcatcccgtgctggtcccattaggcggattcctgcagcctcccgggggccctctgcgcgcaaccctctcagggtgccacaagggaatcacggccatggcctggggcgttgaggagaagttgcttgtgatcggcacccaggatggtatcatggccgtgtgggatatggaggagcagcatgtcatccatatgcttacaggccatacgggggaggtgaggtgtgttaagatctttgcaaaagggacactggctaacagtgcaagcaaggactacacactgcatttgtggaacctactgtctggccaggaaaagtttacaatttgggacggcgggtctaaaaatcccgccgaacctcaaatttggaatttgcacgtggatgaggctcacaaggtggtctactccgctagcggctctaaaatcaacgcctggaatctagaaacagcagaacctgtctttcatatccttggagacgcctctgacccttggatgtgtatggccgtgctggccagtcaggctactctgctaacagtgagccgcgatggagtggtgagtctctggtccagtgcgactggcaagctgcagggaaaacaacacatgtcttctatcaaagaggagactccaacttgcgcggtgtcagtacagaaacaggggaaacttgtaacgggatttagcaacggatctatctcattggtgtcatcgaaaggagaccgactcctagaaaagctgccggatgccgttaggtttctagttgtgagcgaggacgaaagccttctggccgccggtttcggcagaagtgtgcgcattttcctggccgactctcggggttttcgacgatttatggccatggatctcgagcacgaggatatggtggagaccgcggtcttcggtaccgagaataatctgataatcacggggtcgctggatgccttgattcaggtttggtctctctccgagcaagggacattgcttgacatactcgaaggagtcggtgcaccagtgtctttgttagctcggggaggggctctcgtggctagcgctagtcctcagtcttcttccttcaaagtatgggacctgtcagacgcacacaggtctcgagtgcctgcaccctttctggacaggaccggtttgacagccgttagtcacaacgggtcgtacgtgtattttcctaagatcggcgacaagaacaaagtcaccatttgggaccttgcagaaggggaggagcaagattccttggacacgtctagtgaaatccgttgtctggaggttgccgaacagcgtaaactgttatttaccggtctggtatcaggagttgtcctggttttcccattgaacagtcgacaagatgtaatctgcatcccccctcccgaggctcggaaagctattaactgtatgagcttgagcaaatgcgaagatcgactggccatagcttatgataatatagtcctcgttctagacattacaagtggcgatccttgccctgttatcgacggtccccgctataccttttacacacagctgcctgagaccctttcgtctgtggccatactaacagattacagggtcgtttacagcatgacaaatggcgacctgtttctgtacgaatgcgctacctccaaagctttccctctggagacacaccgatcaagagtggcttgcgtcgaagtgagccacaaggaacagctggttgtgtccggttcagaggacgcactcctctgcctgtgggacctccaggctcgaaagtggaaattcgagatgtcctacaccagttcttactgccgcggcgtgcagtgtgcctgcttctcaaaggatgacaaatacgtgtacgtcggcctgaaggaccggtccatcttggtttggtcagttctggatggaacactcctgacagtgcaatttgtgcatgccgttgttaataggatcatccctactacgagtggctttatagctcccacacgccacggatatctgatcagagaaaattttcaatgtctgagcgctaaagcttcccctcaggatccactaaagaattttaagaaagcaatgtggatggttaagtctagacagagagaggagctcgtggccgccgccggagccccccaggatctcgaatcagagagcgcccaaggcaatgagacaaagtccaacaaatgtagtcaggtatgcttaatcgtctag

SEQ ID NO: 31444 - DNA, 4299 bp, Artificial Sequence
  Description of Artificial Sequence: Synthetic coding sequence
atgcagcgaggaaagccgtgtcgcgctctgcctacattgaagtgccaaacgttctgccagaggcacggtctaatgttcgaggtagtagatctgcggtggggcatcaggaatatcgaggcaactgatcacttgacgacagaactgtgcctggaggaagtcgacaggtgttggaagacctctattggacccgcctttgtggctcttataggggaccagtacggtccttgcttaatacctagcagaatagacgaaaaggaatgggaggtgctgagagatcacctcactgcacgtccatccgatctggaactggtggctcgttatttccagcgagatgaaaacgctttcccccctacctacgtactgcaggcacctggaacgggtgaggcttgtgaaccagaggaagccacattgactagcgtgttgcggtcaggagcccaggaggcgcggaggttgggcctgattactcaggagcagtggcaacattaccatcgctcagtcatcgaatgggagattgaacgttctctcctgtcctccgaagatagggagcagggcgcaactgttttcctgcgggagatccaggatctccacaaacacatcttggaggactgtgccctgcgtatggtggaccggcttgctgacggttgtctggatgccgatgcccaaaaccttctgagctcccttaaatcgcacatcactgatatgcaccccggagttctgaaaactcacagactgccctggtcacgcgacctggttaacccaaagaataagacccacgcatgctatttgaaagagctcggcgaacagtttgtggtgagagctaaccaccaagtcctgaccagactcagggagctcgatacagccggacaggaacttgcttggttgtaccaggaaataaggcaccacctctggcagtcctctgaagttattcagaccttctgtggaagacaggagctcctagcccgattgggccaacaactccgccacgatgacagtaagcagcataccccactggttttatttggccccccagggataggcaagaccgcgctcatgtgcaaactcgctgaacagatgccccggctgctggggcacaaaaccgtgacagtcctgagactgctaggaaccagccagatgtcgtccgatgcaagaggcttgcttaagtccatttgcttccaggtatgtctggcctatgggctccctcttccgcccgcgcaggtgcttgacgctcacacgcgggtagtccagttctttcacaccttgttgcacacggtctcttgcagaaatttcgagtctctagtgttgctacttgacgccatggatgatctggattcagtgcgccacgcccgacgtgtgccttggctgccgctcaactgcccaccaagggtgcatctgatcttgtccgcatgttccggcgccttaggagtactggatactcttcaaagggtgttgctagacccggaagcatattgggaggtgaagcctctgagtggaaatcaggggcagcaaatgatccagctgctactggctgccgcacggaggactctgtctcccgtgcatactgacctactctgggcatccctgccagagtgcggcaatcccggcaggcttagacttgctttcgaggaggcaaggaaatgggctagcttcacggtgcccgtacctttggccaccaccgccgaagaagcaacgcatcagctatgcacccgcttagaacagacgcacgggcagctgctcgtcgcccacgtgctcggttacatagtgagcagcaggcacgggctgagtgaggctgagctcaaagacgtcctgagcctggacgatgaggtcttgcaagatgtgtaccgggactggactccccctagcaaagagttgctccggtttcccccgctcctatgggtgcgcctgcgacgagatctgggctattacctagctcgcagacctgttgacgggttcacactgctggcaatagcccacaggcagctcgtagaggtagtgagggagcgatacctgtctggaagtgaacgggctaaaagacacggggtgcttgcggattttttctctgggacctggtcccaagggacaaagaaactcatcacactgcctttggtcgggaagcctttgaacctggatcggaaagtggccccacaacccctgtggtttagtcacacagtcgctaatctgcgcaagctgaaggagttaccataccacctgttgcatagcggacggttagaggagcttaaacaggaggtgttaggttccatgtcatggatctcctgccgaggtatcagcggtggtatcgaggaccttcttgacgatttcgatctatgtgcacctcacctcgatagtcccgaggtaggcctggtgcgggaggcgctccagctgtgtagaccagctgtcgagttaagaggcatggagcgtagtcttctgtacactgagctgctcgcgcgtttgcattttttcgctacttctcatccagctctcgtcggacagctctgccagcaggcccaaagttggttccagctttgcgcgcaccccgtacttgtccctctaggaggttttctccaaccccctggggggcccctccgcgccacgctaagtggctgccataaaggcatcaccgcaatggcatggggagtggaggaaaaactccttgtgattgggacacaggatggcataatggcagtgtgggatatggaggaacaacacgttatccacatgctgacaggccacactggggaggtgagatgcgtaaaaattttcgccaaggggacactggcaaattcagcctccaaagactatacactgcacctctggaatctgctgtccggtcaggagaagttcacaatttgggatggggggagtaagaaccctgcagaacctcagatatggaatctgcatgtggatgaagcccacaaggtggtgtactcagccagcggttccaagattaacgcctggaacctggaaacagcggaaccggtgtttcatattctcggggacgcaagtgatccatggatgtgcatggccgtgctcgcttcccaggccaccctgctcaccgtgtctcgtgacggggtagtttcgctgtggtcatccgctaccgggaaactgcaggggaaacagcatatgtcctccatcaaggaggagacaccgacatgtgcagtgtctgttcagaagcagggtaaattggtgacgggcttctcgaatggatccatctccctggtgagtagcaaaggcgatcggctcctggaaaaactgcctgacgctgtcagattcctggttgtgagtgaggacgagtctctgctggctgccggtttcggacgaagtgtgcggatttttttagcagattcccggggcttcaggagattcatggctatggacttggagcacgaagacatggtagagactgctgtctttggaacagagaacaacctcattatcacaggatcattagatgccctcattcaagtgtggtctttgtcagagcagggtacgctgctggacatcctggagggtgtaggagctccggttagtctgctggcccgaggtggggccttggttgcctctgccagtcctcagtcttctagtttcaaggtctgggatctgtccgacgcgcatcgctcccgcgtacccgccccgttcctggaccggacaggcctcacagccgtcagccacaatggttcttatgtgtactttccaaaaataggcgataaaaataaggtgaccatctgggatcttgccgagggggaggaacaggactcactggacacttccagcgaaattcgctgcctggaggtagccgagcagagaaagttgctgtttactgggctagtctcgggagtggtgttagtgtttccactgaactccaggcaagacgtcatttgcattcccccacccgaggcgaggaaggcgatcaattgcatgtccttgtcgaaatgtgaagatagactggccatcgcttatgataatatagtgctagtgctggacatcacttccggagacccatgtccggtgattgacggccccagatacacattctatacacagctccctgagaccctttcatccgtcgcgatcttaacagactaccgcgtcgtctactcaatgaccaatggagacctgtttctctatgaatgcgcaacaagcaaagcttttcccttggaaacccataggagtagagttgcctgcgttgaggtgagtcataaagagcagttagtcgtctcaggcagtgaagacgctctgctctgcttatgggatttacaggcccgcaaatggaagttcgaaatgagctatacagctccctgctag

SEQ ID NO: 31445 - DNA, 1182 bp, Artificial Sequence
  Description of Artificial Sequence: Synthetic coding sequence
atggatgaaaacgagagtaatcaatccctcatgacttccagccagtatcctaaagaagcggtgcggaagcgtcagaactcagccaggaacagcggagcttctgacagttcccggttcagcaggaagtctttcaaattggactatcgactagaggaggatgtgaccaaatccaaaaagggaaaggatgggaggtttgtaaacccttggccaacgtggaaaaatccttctataccaaatgtgctgcgctggctgatcatggaaaaggatcacagttctgtgccttccagcaaggaggagctcgataaagaattacctgtcttaaaaccttattttatcaccaatccagaggaagctggagtacgtgaggccggactgagagtcacttggctcgggcatgcaaccgtaatggtagaaatggacgaactgatattccttactgaccctattttttcctcccgcgccagtcccagtcaatatatgggtccaaaaaggttcaggaggtccccttgcacaatctccgagctgccacctattgacgctgtactgatttctcacaatcactacgaccaccttgactacaatagtgttatagcacttaacgaacggttcggcaatgaactcagatggtttgttccattagggttgctggactggatgcagaaatgcggatgcgagaatgtcatcgaacttgactggtgggaagagaactgtgttcctggtcatgacaaggtcacctttgtcttcactccatcccagcactggtgtaaacgaactttgatggacgacaataaggtcctgtgggggtcttggagcgtccttgggccttggaaccgtttttttttcgccggggacaccggctattgccctgctttcgaagagatcggaaagcgcttcggaccatttgaccttgcagctattccaatcggggcatacgaaccaagatggtttatgaaataccaacacgttgatcctgaggaagctgtacggattcacacagacgtgcaaacaaagaagagcatggctatccattggggcacctttgcccttgccaatgagcactacctggaacccccagtcaaattgaacgaggcactagaacgatacggactgaatgctgaggatttttttgtcctgaaacatggcgagagccgttaccttaacaatgacgatgagaatttttag

SEQ ID NO: 31446 - DNA, 483 bp, Artificial Sequence
  Description of Artificial Sequence: Synthetic coding sequence
atggtggcaaacctctctaggggccccgagcctccttttttcaaacaactgattgtgcccctgattccttccatcgtggatcgggccccaaaaggtaggaccttcggcgatgttctgcaacccgccaagcctgagtaccgcgtgggagaggtcgccgaagttattttcgtaggagctaatcctaagaattccgtgcagaatcagacccaccagacctttctgaccgtagaaaagtacgaagcaacttcgacaagctggcagatcgtctgtaatgatgcgtcctgggagaccagattctactggcataagggactgcttgggctgagtaatgctaccgtcgagtggcacatacccgacacagctcaaccagggatttataggattcgctacttcggacataatcgcaaacaggacatccttaaacctgctgtcatcctgtcttttgaaggcacatcaccggcttttgaggtggtaaccatttag

SEQ ID NO: 31447 - DNA, 498 bp, Artificial Sequence
  Description of Artificial Sequence: Synthetic coding sequence
atgaggcagcatagacagtttatggataggacccattacctgctgactttcagtagctcagagacattgttgagactgttactgcgcatcgtggatagagcgcccaagggcaggacttttggcgatgtactacaacccgcaaagccagaatatagggttggggaggtggccgaggtgatctttgtcggcgcaaaccctaaaaatagtgtccagaaccagacccatcagacgttcctcactgttgagaagtacgaagcaacatctacctcttggcaaattgtgtgcaacgacgcgagctgggaaacgagattctactggcataaaggtcttcttgggctctctaacgcgactgtggaatggcacattccggatactgcccaacctggaatctaccgcattcgctatttcggtcataatcgaaagcaagacatacttaaacctgcagtcatactgtcctttgagggtacttcacctgcattcgaggtcgtcacaatatag

SEQ ID NO: 31448 - DNA, 483 bp, Artificial Sequence
  Description of Artificial Sequence: Synthetic coding sequence
atggtggccaatctaagtcgagggccggaaccaccattctttaaacagctgatcgtccccctgatcccgtctattgtggacagagcaccaaagggacggacctttggggacgttctgcaaccagctaagcccgagtatcgcgtgggagaagtagccgaggtgatttttgtgggcgccaaccctaagaatagcgttcagaatcaaacccatcagaccttcttgacagtggaaaagtacgaagcaacatccactagttggcagatcgtgtgcaatgatgcttcttgggagacccggttctactggcacaagggtttacttggcttgtccaatgctactgtggagtggcacatccctgacacggcgcagcctggcatctaccgcatacgttattttgggcacaaccggaaacaggatatcctaaagccagctgtcattctgtccttcgaaggcacgagtccagcttttgaggtggtcactatttag

SEQ ID NO: 31449 - DNA, 1122 bp, Artificial Sequence
  Description of Artificial Sequence: Synthetic coding sequence
atggagcctgctgtttccgagcccatgcgagatcaggtcgcccgaactcacctgactgaggatacaccgaaagtgaacgcagacatcgaaaaagtgaaccagaatcaggcaaagcgctgcaccgtcatcgggggctctggtttcttaggacagcacatggtggaacaactccttgcccgcggatacgcagtgaacgtttttgatatccagcagggtttcgacaacccacaggtcaggttttttctgggggatctgtgtagtcggcaggatttgtacccagctttaaaaggagtcaacacagtgttccattgcgcttcgcctcctccgagctccaacaacaaagaactgttttaccgcgtgaattatataggaacaaagaatgtaattgaaacctgtaaggaggccggcgtgcagaaactgatcttaacctcgtcagcatctgttatcttcgaaggcgtggacataaaaaatggcacagaggacctgccctatgcaatgaaaccaatcgattattacaccgaaacaaagatccttcaggagagggctgtcctaggcgcaaacgatcccgaaaagaactttctgaccactgccatcaggccccatgggatcttcggcccaagggaccctcagttagtccctattctcatcgaagcagccaggaatggcaagatgaagtttgtcatagggaatggcaaaaatctggtcgacttcaccttcgtcgaaaacgttgtccatggtcacatactggccgcagagcagctaagccgcgatagtaccctggggggcaaagcattccacatcacaaatgatgagcccatccctttctggactttccttagtcgcatccttactggtctaaattatgaagcccctaagtatcacatcccatattgggtggcctactatttggcgctgctgctgagcttattggtaatggtgatcagtccagtcatccaattgcaaccgacctttacaccaatgcgcgtggcactggcaggaaccttccactactacagctgcgagagagcaaaaaaggccatgggataccagcccctcgtcactatggatgacgcgatggagagaactgtccaatccttccggcacctcaggagggtcaagtag

SEQ ID NO: 31450 - DNA, 1122 bp, Artificial Sequence
  Description of Artificial Sequence: Synthetic coding sequence
atggagccggctgtatccgagcctatgagggatcaggtcgcccgcacccacttaacggaggatacacctaaggtgaatgctgatatcgagaaagtgaaccagaaccaggcaaaaaggtgcaccgtgatcggagggagtggttttctgggacagcacatggtggagcagctactcgctaggggatacgcggtcaacgttttcgacattcaacagggctttgataatccacaggtgcgctttttcctgggggacctgtgctcacgacaggacctataccccgcgctcaaaggtgtgaacacagtgtttcactgcgcctcccctccccctagcagcaacaacaaggagctgttctaccgcgtgaactacataggcaccaagaatgtcatcgagacctgtaaggaggccggggtgcagaaactgatacttacttcttctgccagcgtgatcttcgaaggagttgacattaaaaacggcacagaagatctcccatacgcgatgaagcccatcgactattacaccgagaccaaaattctgcaagagagagcagtgctgggcgctaatgaccctgaaaaaaattttcttacaaccgcaataaggccacatgggattttcggcccaagagatccccagcttgtgccaatccttatagaggccgctcggaatggaaagatgaagttcgtgattgggaacggcaaaaacttggtggacttcaccttcgtggagaacgttgtccacggccacattcttgcggctgaacagcttagcagagactcaaccctgggcgggaaagctttccacatcaccaacgatgagccaattccattctggacttttctgagtcggatccttactgggttgaattacgaggcccctaagtaccacattccatattgggtagcatattatctggccttgctgctgtctctgctggtgatggttatctctcctgtgatccaacttcaaccaaccttcacgcccatgagggtagccctggccggtacgttccactattatagctgcgagagagctaaaaaggctatggggtaccaacccctggtcacaatggacgacgccatggaacggacagttcagtcatttcgtcatctcagacgagtaaagtag

SEQ ID NO: 31451 - DNA, 264 bp, Artificial Sequence
  Description of Artificial Sequence: Synthetic coding sequence
atggcaggagcttccctcggggctaggttttacagacagatcaaaagacatcccggtatcattcctatgattggcctaatttgcctcggcatgggatccgccgccctgtatttactcaggcttgcattgaggtcgcccgatgtctgctgggaccgcaaaaataatccagaaccctggaatcgcctgtcccccaatgaccaatacaagtttttagcggtgtcgaccgattataaaaagctaaagaaggacagaccagatttctag

SEQ ID NO: 31452 - DNA, 264 bp, Artificial Sequence
  Description of Artificial Sequence: Synthetic coding sequence
atggccggcgcaagcctgggagcacgtttttatcggcaaatcaagcgtcacccagggatcattcctatgatcggcctcatctgcctcggcatggggtctgccgcgctgtatttactgcgactcgcgctgagaagccccgatgtgtgttgggatagaaaaaataacccagagccgtggaatcgtttgagtcccaatgatcaatacaaattcctggctgtcagcactgattataaaaaactcaagaaggacagacccgacttctag

SEQ ID NO: 31453 - DNA, 387 bp, Artificial Sequence
  Description of Artificial Sequence: Synthetic coding sequence
atgacaggctacactcccgacgaaaaacttagactgcagcagcttcgcgagctgcgaagacgctggctgaaagatcaggaactgtctccgcgggaaccagtgctgcctccacagaaaatgggtccaatggagaaattctggaacaaattcctggagaataaatcgccatggcggaaaatggttcatggcgtctacaagaaatccatcttcgtttttactcacgttttggtccccgtctggattatacactattacatgaaatatcatgtgagtgagaagccttatggaatcgtggaaaagaagagtaggatctttcccggtgacactatactggagacaggtgaagtcattccacctatgaaggagttcccagatcagcaccattag

SEQ ID NO: 31454 - DNA, 753 bp, Artificial Sequence
  Description of Artificial Sequence: Synthetic coding sequence
atggatatgctgcaagatctagaaagccttcagtttgaatatggggtgccagaggaggatcgaatctggctttacctgcagggtaggtccagagggcttatgatcgaagcctgtgctcatgccacatttttctgcaagttactctataaccttcgagcctctctgaataagaatcagtcatcccgtcatttaagcattggttctctgaactctgcaacgcctgaagagttcaaggttgggattatcggaggcggtcaccttggaaaacagctggctggcactctcttgcagctaggtccaatacccgcagaaagcctccgcattagcacacgccgcccggaaaccctcggggagttacagaagcttggcatcaaatgtttttatcataacgctgacctcgttagctgggcagatgtgatatttctgtgctgtctcccctcccaactgccaaacatctgcgtggagatttatacctccctggaaaaggcctcgattgtgtattctttcgtggcggcaatccccctccccaggctgaaattacttctcaaccacactaacatccttcgacctcagtaccaatacgacgaggacagtgtgagcgtgtggggagctaataaaggcgtgattgctgcactgcaagatcctacgattctgcaggcaacttgcccctatagtccagcaggtcacgggagcacgtatttctggcattcctttgagaactacttccccgtggggccgctgctgtcctattag

SEQ ID NO: 31455 - DNA, 1080 bp, Artificial Sequence
  Description of Artificial Sequence: Synthetic coding sequence
atggacatgttgcaggacctggaatccctccagtttgaatatggggttcccgaggaggaccgcatttggctctatttgcaagggaggagcagggggctgatgatagaagcctgtgctcatgctactttcttctgcaagcttctttacaacctccgcgcgtccctgaacaagaatcagtcttcaagacatctctctatcggctctctgaattctgcgacacccgaggaattcaaagtcgggattataggtggggggcacctgggaaaacagctcgctggcacactgttgcagctgggtcctattccggccgagtctttacgaatttcaacccgtcggccagagaccctcggggaactgcaaaaactcggcattaagtgcttctaccataacgccgatctcgtcagctgggcagacgtgattttcctctgttgtcttccctctcagctccctaacatctgtgtggaaatttacactagtttggagaaggccagcatagtttactccttcgtggccgccattcccctacctagactgaaactgctgcttaaccatacaaatatcctgaggccacagtatcagtatgatgaggatagtgtcagcgtctggggcgccaacaagggtgtgatcgcagcgcttcaggatcccactatcctccaggccacttgcccctattcacccgcaggcgggattatattgaacatcaagtggctggagggcgttttctatgctgccctcaatatctgtacagccaggaacatggctcacagtcaggttctgcagctgttgtcagagctgtttctgagtgtgcacttcgaagactgtggcaaagacaccgcgagctgtcctaaactgcagttgacagatttcgtttcaaaggcttacgggaaaaacctctctcaggaaagaccttttccatggtttgacctcacggcagtacagctcaaagaaacacccttttcacagcacctatcatcttcccccgtgctacaggatcatctcactcatctgtattgcgcctctttcggaatctctctgactaaggaacagcccgtcatcagcacgggatttccatcccagtag

SEQ ID NO: 31456 - DNA, 672 bp, Artificial Sequence
  Description of Artificial Sequence: Synthetic coding sequence
atggacatgctgcaagacctcgagtccctgcagtttgagtacggtgtgccggaagaggacagaatttggctctatctccaggggcgtagccgtggtttgatgattgaggcttgcgcccatgccacatttttctgcaaactgctctacaacctacgggcatccttgaataagaatcagagtagtcgtcacctatccatcggatcactcaattctgctacccccgaggaatttaaagttggaattatagggggtgggcacctcggtaagcaactggccggcactctgctgcaactgggacctatcccagctgagtctctgcgcatttccacccgcaggccagaaacgcttggagaacttcagaagttgggcattaaatgtttctatcataatgccgacttggtgtcttgggcagatgtgatctttctatgctgcctcccttcccagttacctaacatctgtgttgaaatttatacatccctcgagaaggcaagcatagtgtacagctttgtggcagccattcctctcccgcgtctgaaattactcttaaaccacaccaatattcttcgtccacagtaccagtatgacgaggattcggttagtgtctggggagccaataagggagttatcgccgcgttgcaggatcctaccatcctgcaggccacttgcccatag

SEQ ID NO: 31457 - DNA, 699 bp, Artificial Sequence
  Description of Artificial Sequence: Synthetic coding sequence
atggatctgccaattcaggacagccacgacagttccacttcacccaaggggaaacagcctactaccgccgagaaatctgctacaaaaaaggaggacaaagtgccagtgaagaagcaaaagacccgaacagtgtttagttcaactcagctctgcgtcctgaatgatcgtttccagcgacagaaatatctgagtttacagcagatgcaggaattgtcgaacatactcaatttgtcgtataaacaagtaaaaacgtggtttcagaaccagcgcatgaaaagcaaacggtggcagaaaaacaattggctgaagaattctaacggcgtcacacaaggatgcctggtgaatcccacaggtaatttgcccatgtggagtaaccagacttggaacaactccacatggtctaaccaaacacagaacattcagtcatggtctaaccattcctggaatacccagacttggtgcactcagtcttggaacaaccaggcttggaacagtccattctataactgtggcgaagagtcccttcaatcatgcatgcaatttcagccgaattctcctgcctccgatctggaagcagccttggaagcggccggggagggacttaatgtaattcagcaaactacacgttacttcaacaccccccagaccatggatctttttctcaactattccatgaacatgcagccagaggatgtttag

SEQ ID NO: 31458 - DNA, 912 bp, Artificial Sequence
  Description of Artificial Sequence: Synthetic coding sequence
atgtccagtactctgcccgcactgttgtgcgttggcttgtgtctcagtcaaaggatttccgctcagcaacagactctccccaagccctttatctgggccgagcctcattttatggtgcccaaggagaagcaagtcactatctgctgccaaggcaattacggtgcggtggagtaccagttgcatttcgaggggagcctcttcgctgtggaccgccctaaacccccagagcgcattaacaaggtaaagttttacatccccgacatgaactcaagaatggccggtcagtacagctgtatatatcgcgtgggggaactttggagcgagccctccaatctgctggacctcgttgtgacagaaatgtatgatactcctacactttcggtgcaccccggacctgaggtgatttccggagagaaggtgacattttattgccggctggacaccgccacaagtatgtttcttctcctcaaggagggtagatcatctcacgtgcaacgcggctatggcaaagtacaagctgagtttccgctgggtcccgtaaccacagctcacaggggaacgtaccggtgctttggttcctacaataaccacgcctggagttttcctagcgagccagtgaagctcttggtgactggcgatattgagaacacaagtctggctcccgaagaccccacatttcccgacacctggggcacatatctgctgaccacagaaactggactccaaaaggaccacgctctgtgggatcacaccgcccagaatctgcttcgtatgggtctagcctttctcgtcctcgtcgctctcgtctggttcctggtagaagactggctctcccgaaaacgcacacgggagcgggcatcccgagcttctacttgggaaggccggcggcggttgaatacccagactctgtag

SEQ ID NO: 31459 - DNA, 912 bp, Artificial Sequence
  Description of Artificial Sequence: Synthetic coding sequence
atgtctagtacgctccccgccttgctgtgcgtgggcctgtgcctctcccaaagaatctcagctcaacagcaaaccctgcccaaaccttttatttgggcagagccccattttatggtgccgaaggaaaaacaagtgacaatttgttgccagggcaattatggcgcggtcgagtaccagcttcattttgagggaagtctctttgctgtcgaccgccccaaacctcccgagaggatcaacaaggtgaagttttatatcccagacatgaatagtaggatggccggacaatactcctgtatttacagagtgggggaactgtggtccgagcccagtaatctgcttgatttggtcgtgaccgaaatgtacgatacccccaccctcagtgtgcaccccggcccagaggtcattagtggcgagaaggtcacattctattgtaggctcgatacagccacgagtatgttcctgttgctaaaagaagggagatcgagccacgtgcagcgtgggtacggcaaggtccaagcagaatttcctttgggtcccgtgaccacggcccatcgtggaacctaccggtgttttggttcgtacaacaaccatgcctggagcttcccttccgagccggtgaagctgctcgtgacgggcgacatcgaaaacaccagcttggcgcctgaggatccaacttttcccgacacctggggaacctacctcctcacgacagagactgggctgcagaaagaccatgccctctgggaccatactgcacagaatttgctccgcatgggtctggcattcctcgtgttggtggcactcgtgtggttcctggtggaagattggctgagcaggaaacggacccgggagcgggcaagcagggccagcacctgggagggccgcagacggctcaatacccagaccctttag

SEQ ID NO: 31460 - DNA, 912 bp, Artificial Sequence
  Description of Artificial Sequence: Synthetic coding sequence
atgagctccacccttccggccctgctctgcgtgggcctgtgtctttcgcagcgcattagcgcacagcagcagaccctccctaagcccttcatctgggcggagccacacttcatggttccgaaagagaaacaggttaccatctgctgtcagggcaattacggagccgtagagtaccaacttcatttcgaaggaagcctattcgccgtggaccggcccaaaccgcccgaacgaatcaataaagtcaaattctatatcccagacatgaattcgaggatggctggacagtactcatgtatctaccgagtcggcgagctctggtcagaaccctccaatctgctggacttagtggttaccgagatgtacgatactcctacacttagcgtgcatcctggcccagaagtgatatccggtgagaaagtaaccttttattgccgccttgatacggctacgagcatgttcctcctccttaaagaaggcaggtcttcacacgtccagcgaggttatggtaaggtgcaggctgaattccctctcggacccgtaaccacagcacaccgcggtacctatcgctgctttggctcctataataatcacgcatggtctttcccctccgagccagttaagctcctggtgacaggtgacatcgagaatacatccctggctcccgaggatcccacttttccagacacctggggcacttacctgttgacaaccgagaccggactacagaaagatcacgccttatgggaccacacggcccagaaccttctgcgtatggggcttgcattcctggtgttggtggccctcgtgtggttcttggtggaagattggctgtcccgcaaacggactcgggaacgcgccagtcgggcatctacctgggagggacgccggcgattgaatacgcagactctgtag

SEQ ID NO: 31461 - DNA, 912 bp, Artificial Sequence
  Description of Artificial Sequence: Synthetic coding sequence
atgtctagtaccctcccggctctcctgtgcgtgggactgtgtctgagccagcgaattagcgctcagcagcagacactcccgaagcccttcatatgggctgaacctcacttcatggtccctaaagaaaagcaggtgactatttgctgtcaggggaattatggagccgttgaatatcagctacacttcgaggggtcactgttcgcggtcgatcgtccaaagccccccgagagaattaataaggtgaagttttatattccagacatgaattctcggatggccggccagtattcatgtatttatagggtgggggagctctggagcgagccttctaacctcctcgacctagtcgtcacagagatgtatgacactccaacactctccgtccacccgggcccagaagtgatttctggtgagaaggtgacattttattgccggttggatactgctacctccatgttcttgcttttgaaagaaggccggtcttcgcacgtccagcgtggctacggaaaggtgcaagccgagttccccctgggccctgtgactacggcacaccgcggaacttaccgttgcttcggcagctataataaccatgcatggagctttccttcggaaccagtgaaactgcttgtgacgggtgacattgagaacacatccttggcacccgaagatccaacattccccgatacatgggggacatatctcctgacaactgagacaggccttcagaaagatcacgccctatgggaccacacggcacagaatctgctgcgcatggggctggctttcttggtcctcgtcgctctcgtctggtttctcgtggaagattggctgtcacggaagcggacccgagagcgggcatctcgtgcctccacgtgggagggccggcggcgccttaatacacagaccctgtag

SEQ ID NO: 31462 - DNA, 912 bp, Artificial Sequence
  Description of Artificial Sequence: Synthetic coding sequence
atgtccagcaccctgccggcactgttatgtgtgggattgtgtctgagtcaacgcatctctgcccagcaacaaaccctgccaaagcctttcatctgggccgaaccacacttcatggtgccaaaggaaaagcaggttaccatctgctgtcagggcaactatggagcggtcgagtatcagcttcattttgagggatcactgttcgcagttgatcgcccaaaacctccagaaaggattaacaaagtgaagttctacatcccagatatgaattcccgcatggcaggacaatattcttgtatttatagagttggagaactgtggtctgaaccatctaatctgctggatctcgtggtgaccgagatgtacgacacacctaccctgtctgttcaccctgggccggaagtgatcagcggggagaaagttacgttttactgccgtttagacaccgctacgtccatgtttctactgctgaaggagggcaggagctctcacgtacagcgcggttacggcaaggtccaggccgagtttccactgggcccagtgacgactgctcatcggggcacgtaccgttgtttcggctcgtacaacaaccacgcttggtcgttcccgagtgaaccagtcaaactgctcgttacaggcgatatcgaaaatacaagtctggcccccgaagacccaaccttcccggatacttggggtacctatctgttaacaactgaaaccggattacagaaagaccacgccttgtgggaccacaccgcacaaaacctgttacggatgggtttggctttcctggtgcttgtcgcccttgtatggtttcttgtcgaagactggctttcccggaagcgtaccagggagagggcgagtagggcgagtacatgggagggcaggcggcggctcaatacccaaacactctag

SEQ ID NO: 31463 - DNA, 912 bp, Artificial Sequence
  Description of Artificial Sequence: Synthetic coding sequence
atgtccagcacactgccggcccttctatgcgtcggattgtgcctaagccaaagaattagcgcgcagcaacagacgctgcccaagccatttatatgggctgagcctcattttatggtccccaaagaaaagcaagtcaccatctgctgccaaggcaattacggggccgtggagtatcagctgcactttgaaggatctctgtttgccgtcgacaggcccaagcctccagaacgcattaacaaagtgaaattctacatcccagacatgaacagcaggatggcaggtcaatattcctgtatctacagggttggcgaactctggtctgaaccctccaacctactcgatctggtggtaacagaaatgtatgacacaccgaccctgtccgttcatcctggtccggaggtcatatcaggcgagaaggtcaccttctactgccggctcgataccgccacatctatgtttctactgctaaaggaaggtcggagcagtcacgtgcagcgagggtatggaaaggtgcaggctgagtttcccttgggcccagtgactaccgcccataggggtacttatcgttgctttgggagttacaacaaccatgcgtggagttttccttccgagcctgtcaagctgctggtgacaggcgatatcgagaacacgtctcttgccccagaagacccgactttcccggatacgtggggaacctacctccttactacagagacgggcctgcagaaggatcacgctttgtgggaccacacggcccagaatttactgaggatggggcttgcgtttctcgtgctggtggccctagtctggttcctggtggaggattggctttcacgtaaacggactcgcgaacgggcctccagggcgagcacatgggagggccggagacgtcttaatacacaaacgctgtag

SEQ ID NO: 31464 - DNA, 912 bp, Artificial Sequence
  Description of Artificial Sequence: Synthetic coding sequence
atgagttccacactgccagccttactttgcgtcggcttgtgcctgagtcaaagaatctccgctcagcaacagaccttgccaaagccatttatatgggctgaaccacatttcatggtgcctaaggaaaaacaggtcactatttgctgccagggcaactatggtgcagtcgaataccagctgcactttgagggttcgctgttcgccgttgaccggcctaagccacccgaaaggatcaacaaagttaagttttatattccagatatgaattctaggatggctgggcagtacagctgcatctacagggtgggagaactttggtccgaaccttctaatctcctggacttggtggtgactgaaatgtatgacacacctacacttagcgttcatcccggccctgaggtcatctctggggaaaaggtcacattttactgtcgtctcgacacagccacgtctatgttcttgctgttgaaagagggccgtagctctcacgtccagagagggtacggaaaagtgcaggccgagttcccgttaggccccgttaccaccgcccatagggggacttataggtgcttcgggagctacaataaccacgcttggtccttcccctccgagcctgtcaagcttcttgtgacgggggatatcgagaatacctctttggctcccgaggaccctacgttccccgatacatgggggacctatctgctcacaactgaaacgggccttcagaaggaccatgccctgtgggatcataccgcgcagaaccttctgagaatgggactggcctttctggtgctagtggctttggtgtggttcctcgtagaggattggcttagtcgaaagcgtacacgtgaacgtgcctcgcgcgctagtacctgggaagggagaaggcggctcaatacacagactctgtag

SEQ ID NO: 31465 - DNA, 912 bp, Artificial Sequence
  Description of Artificial Sequence: Synthetic coding sequence
atgtcatctacattacccgccctactctgtgtggggctgtgcctgtcccagagaatctcggcccagcaacagacgctcccaaagcctttcatctgggcagaacctcattttatggtgcccaaagaaaaacaggtgactatttgttgccagggtaattacggcgcagtggaataccagctccacttcgaggggtcacttttcgcagtggaccgaccaaaaccacctgagagaatcaacaaagtgaagttctacatacccgacatgaactctcgcatggcaggtcagtatagctgcatttaccgggttggagaattatggagtgagcccagtaacctgctggacctggtagtcaccgaaatgtacgatactccgaccctgtccgtgcaccccggccccgaggtgatttccggcgagaaagtgactttctattgtcgcctcgatacagctaccagcatgttcctgctcctcaaagagggacggagttcccacgtccaaagaggatacggcaaggtccaagccgaattccctctcggccctgtgacgactgcccatcggggtacctatagatgttttggttcctataataaccatgcttggtctttcccaagcgagcccgtgaaactactggtcacgggagatatcgaaaatacttcactcgcaccagaggaccccactttcccggatacctggggcacatatctgctgaccacggaaactggtctccagaaagaccatgccttgtgggatcatactgcccagaacctgctgcgcatggggttggcttttttagttctagtggccctagtgtggtttctcgtggaggactggttatcccggaagagaacgagagagcgggcctccagagcaagcacatgggaagggaggagaaggttgaatacacagacgctttag

SEQ ID NO: 31466 - DNA, 5730 bp, Artificial Sequence
  Description of Artificial Sequence: Synthetic coding sequence
atggaagggaagcgtcagctggagaaacgcgattttgggaagcgactatcactcgacagcagcttggtcgagtacatggattctaataagtacatcgagcacctgctgacccagcttgaggaacagcatcgctctctctggcgcgaaaagctggccgtggccagactgcagcgagaagtagcacagcgaactagcgaaggagctatgcacgaaaaactgattcatgaactggaggaagaacgacatttgcgcctgcaatccgagaagagactgcaggaggtcacactggaaagcgagaggaatcgcatccaaatgcggtcactccagcagcaattcagccgcatggaggagaccgtcaggaacctgcttcaaagccagggatctccagaacagaagaaagaggagacagtcaacattatggtctaccaagaaaagctgtctgaggaggagagaaagcacaaggaagcactggaagatctacatatggtcgtcgatgaagattctcggtctgaatcttctagtactgatgaggggaaagaaaaaaccaaactgctgttagagcgactcaaagcactagaggccgaaaacagcgccctagcgctggagaatgagaaccagagagaacagtatgaacggtgcctggatgaagtggctaatcaggtcgtacaagccctactcacacagaaagacctgagggaggagtgtgtcaagctgaagacccgggtgtttgaccttgagcagcaaaaccggacattgagcatcctgttccaacaacgggtccgcccgaccagtgacctgctcctgcagaaattgcatagccgactgctagacctcagcagcggagatcttttgagtgaggtggagcgcaatcgttcactgacacagagccgaacagacgccgaagtacacgaacatcaacttaatactaagtctgcccttaagtgcccggggctgggagctgtcatacccggccacctgtgccccagaaatagctactcctcaagttcagaattatcactgagctctacttgctccgagtacagctcgggatcatcatatacctggcatgacggcaagaatctaaggaagcggcaaagttcccagaattgggacaagagattgagcatcgacagctccctgccatctggctttgccagcccaaccaacgaactgcctccaactagaattaaggagagccacatcctggaagggctgaggaagctgcagaaacgaaaggttcttttagaaccgccctcagtgataaccaaatggggttacaaggactgtatgaattccaatgagggcatctacagccctgggattaaaagctcctctctaaaggaatatcctccttgtaagacggctgacctcggatccccctgtaaggagccccacaagactttcgtgtatgacttggacagccatgtggatgctgatgacgatcctagcacactggccctgctgcaggcagttcctaaccagagctgccgcccgcatggctccaagttgacccacagtgtgtccgatagcctatttggctgggaaaccaaccgcaagcatttccttgaaggcacaagctctgtataccctaaggagaggcctgagaaactcacgtcctgcgcctcaagctgcccattggaaatgaaactgtgcccttcagtgcagacaccacaagttcaaagggagagaggcccacagggccagggacatggccggatggctctcaatctacagctgagcgacaccgatgacaacgagacttttgatgagttacatatcgagagctcagacgagaaatctcccagcgacgtgtcattggcagctgacaccgataaaagtgtggagaacctcgacgtcctggttgggttcggcaaaagcctttgcgggagtccggaagaggaggaaaaacaggtcccaattccgagcgagacacgccccaaaacctttagttttattaagcaacagcgcgtagtaaaacgtacatcttcggaagagtgtgtgacggtgatctttgatgccgaagatggagagccgatagagttcagtagtcaccagacaggtgtcgtaacagtcacccgaaacgaaatctctatcaactctacacctgccggccctaaggccgaacacacggagcttctgccccagggaattgcctgcctgcagccacgagctgcagcccgggactacaccttctttaagcgatctgaagaagacactgaaaaaaatatcccgaaagataatgttgacaatgtgccacgagtgtcaacagaaagtttctcatcacgcacagtcacacagaatccacagcaacagaaattggtgaagcccactcataatattagctgtcaaagtaatagtcgctcatccgcccccatgggaatctaccagaaacagaatctcacaaaaattcctccgcgaggtaagtcgagtccccaaaagtcaaaacttatggagcctgaagctactactctgcttccgagtagtgggctggtcacactggaaaagagccccgcactcgcacctggtaagctctcgcggtttatgaagaccgaatccagtggaccattgtttgagctgagatctgatcctcacattcccaagcactccgctcagttaccacattctagccgcatgccaagtcggcgcgactgggtccaatgcccaaagtcacaaactccaggttccaggtcccggcccgcgatcgagagtagcgactcaggggagcctccgacccgtgatgaacactgcggtagcgggcccgaggccggagtgaagtctccctccccaccaccacctcctgggaggtctgtctctctgctcgcccggccatcctacgattactcaccagcaccttcatctaccaagtctgaaacacgagtccctagtgaaacagctcgtactccatttaagtcgcctcttctgaagggtatttcggctcccgtgattagctccaatcctgccacaacagaagttcagaggaagaagcccagtgtggctttcaagaaacctatcttcacacacccaatgccatcacccgaggccgtgatccagacccgctgccctgcacacgctccaagcagttcttttacagtcatggccctcggtcccccgaaagtgagccctaagagaggtgtccccaagacctcgcctcgccaaactttaggaacaccccagagggacattggacttcaaacccctcggatatccccctctactcacgagccacttgagatgacgtctagcaaatccgtatcccctgggcggaagggtcagctcaacgattcagcctccactccccccaagccgtcctttctgggtgtcaatgagagtccgtctagtcaggttagcagctccagctcctcttcgagcccagccaaaagccataattcacctcatggctgtcagtccgcccatgagaaggggctgaaaacccgattacccgtcggattgaaagtgcttatgaaatccccccaacttctccgcaagtcttcaaccgtgccgggcaagcacgagaaggattcactgaacgaagcttccaagtcgtccgtggcggtcaataaatcaaaacctgaggactccaagaaccctgcatcaatggagataacggcaggcgaaaggaacgtgacactgcctgatagtcaggcccaggggagcttggctgatggtctcccgctggagaccgcattgcaggaacccttggaaagcagcatccccggaagtgacggcagagatggcgtcgacaataggtcaatgagacgctctttgtctagcagtaaaccacacctgaagcctgcgctcggtatgaacggggccaaggcccgctcacacagtttctcgacccatagcggggacaagccttccacccctccaattgagggcagtggcaaagtccgcactcagattatcactaacactgctgagagggggaactctctgaccagacaaaactcctcaaccgagagttcccccaataaggctccctctgccccaatgcttgaatcgctccctagcgtgggaagaccgtcaggccaccccagcagcgggaaaggctcgctggggtcttctggatctttttcctcacagcacggcagtccaagtaagctaccgcttcgtataccccctaagagtgaaggactgctcatacctcccggaaaggaggatcagcaagcctttacccagggtgagtgtcctagcgccaatgtggcggtgctgggagaaccaggttctgacaggagatcatgtccccccaccccaacggattgtcctgaagcgttgcagtcgccggggcggacccaacatcctagtacctttgagaccagcagcactagcaaattggagacttcggggaggcatcccgatgcgagtgctacagcaaccgatgctgttagctctgaggctcccctgagccctactatcgaagagaaggttatgctgtgtatccaagagaatgtcgagaaggggcaggttcagaccaagcctacatctgtggaagcgaaacagaagcctggcccatctttcgcttcttggtttggcttcaggaagagcagactccccgctctgtcctcccggaagatggatattagcaaaacgaaagtggaaaaaaaagacgctaaagtgctcggcttcggtaataggcagctcaaatcggaacgcaagaaggaaaagaagaaaccagaactgcaatgtgaaacagagaatgaacttataaaagatactaagagtgccgacaatcctgacggagggctccagagtaagaacaatcgtaggaccccacaggatatatacaatcagcttaaaatcgagcctcgaaaccgacactcgcctgtcgcttgctcgaccaaagacactttcatgacagagttgctgaaccgagtggataagaaagccgccccacagactgaatctggatcttccaatgcttcctgccggaacgtgctgaaaggcagcagccaggggagctgcctgatcgggagttcaatttctacgcagggcaaccacaagaaaaacatgaaaatcaaggccgacatggaggtcccaaaggactcacttgtgaaagaggcaaacgagaatctgcaggaagatgaagatgacgccgttgcggactcagtgttccagtcacacatcattgaatccaactgtcagatgagaaccctcgactcaggaatcggtacttttcccctgcccgacagcggcaatagaagtaccgggcgatatctgtgccagcctgattcacccgaggacgctgaacccctgctgcccttgcagagtgccttgtctgctgtctcctccatgagagcccagacgctggagcgcgaggtgccaagtagtaccgacgggcagcggccagctgatagcgcaattgtgcatagcacctcggatccaatcatgaccgctcggggcatgaggcctttgcagtccagattgcccaagcctgcttcctcagggaaggtttcgtcacagaaacaaaatgaggccgaaccacgtccccagacatgttcgtcattcggctacgcggaagaccccatggctagccagccactgcctgattggggatccgaggtggccgctacagggactcaggacaaggccccccgcatgtgcacctactctgcatccgggggctcgaacagcgacagtgatctggattacggagacaacggttttggcgctggaaggggacagctggtcaaggccctgaagagcgcggccccagaaatagaaaccacctag

SEQ ID NO: 31467 - DNA, 210 bp, Artificial Sequence
  Description of Artificial Sequence: Synthetic coding sequence
atggaaggcaagaggcagctggagaagcgagattttggcaaaagactgtccctagatagctctctcgttgaatacatggattcgaataagtacatcgagcacctgttgacacagttggaggagcaacataggagcctgtggcgggagaaacttgccgtcgcacgtctccagagagaagtggcacagcggacgagtgaaggagcgatgtag

SEQ ID NO: 31468 - DNA, 1773 bp, Artificial Sequence
  Description of Artificial Sequence: Synthetic coding sequence
atggaggggaagaggcagctcgaaaaacgagactttgggaagcgcctttcgctggattctagccttgtggaatatatggactcaaacaagtacatagagcatctgctgacgcagctcgaggaacagcacaggtctctgtggcgtgagaaattggccgtggctcgcctgcagcgtgaggtagctcagcggacttcggaaggcgccatgcacgagaagctcatccatgaactcgaggaagagaggcacctgcgcctgcagtccgagaagcgcttacaggaggtgactctggaatctgagcggaaccggatacaaatgcggtcccttcaacaacaattctcccgaatggaagaaacagtgcgaaacttgcttcaatcccaaggctcccccgaacagaaaaaggaagagacagtgaacattatggtataccaagaaaagttgagtgaagaggaaaggaaacacaaggaggccctggaggacctgcatatggtggtggacgaggactcccgcagcgagtcatcttctaccgacgagggaaaggaaaaaactaaactattgctcgagagacttaaagcactcgaggctgaaaactccgcgttggctctcgagaacgaaaaccagcgggaacagtatgagaggtgtttagacgaggtggctaatcaagtggttcaggctcttctgacccaaaaggatctgagggaggaatgtgtaaagctgaagacacgagtattcgacctggagcagcagaacagaaccctttcaatcctgtttcagcagagagtgcgccctactagcgacttgctgttacagaagctccattcgcgattgttagatctatcatctggtgatctgctgtctgaagttgagagaaatagatcattgacgcaatcgaggacagacgccgaagtgcacgagcaccagctgaacaccaaaagtgccttaaaatgtcctgggctcggcgctgtgatcccgggacacctttgcccgcgcaatagctatagcagctcttctgagctaagtctgtcttcgacctgctcagagtactctagtggcagctcttacacatggcacgatggcaagaacttgcggaagcgagttaaagaggccaacgagaacctccaggaggacgaggacgacgcagtagctgacagtgtttttcagtctcacatcatcgagagcaattgccagatgcgtacgcttgatagcgggatagggaccttcccgttacccgatagcggcaaccgctctaccggacgttatttatgtcaacccgatagccctgaagacgccgagccccttctgcctctacaaagcgccctaagcgccgtttcaagtatgcgtgctcagacccttgaaagagaggttccttcaagcactgacgggcagaggcccgcagactctgcgatcgtccacagcactagcgaccccataatgacagccagaggaatgaggccactgcagagcagattgcctaagccagctagttcaggaaaagtgtcgtcccaaaaacagaacgaggcagagccaaggccacagacctgcagtagtttcggctatgctgaggatcctatggcatcccagccacttcccgattgggggtctgaggtggccgcaaccggaacccaggacaaggcacctcggatgtgcacatattcagcctctggtgggagcaatagcgactcagatctggactacggtgacaatggcttcggtgctgggaggggacagctggttaaagctctgaagagcgccgccccggagatcgaaaccacatag

SEQ ID NO: 31469 - DNA, 1773 bp, Artificial Sequence
  Description of Artificial Sequence: Synthetic coding sequence
atggaaggcaagaggcagttggagaaacgcgatttcgggaaacgcctgtccctggactcgagccttgtggaatacatggactccaacaagtatatcgagcatctgcttactcagctagaggagcaacacaggagcctctggcgcgagaagttagctgtcgccagactgcagagagaggtggcccagaggacctctgaaggcgctatgcatgaaaaactaattcatgagcttgaggaggagagacaccttcgcctgcagtctgaaaaacggctgcaggaagtcactctagaatctgagagaaaccgtattcagatgcgctccttacagcagcagttctctcgaatggaagagaccgtgaggaatctgctgcagtcacagggctcaccagagcagaaaaaggaagagactgtcaatatcatggtctaccaagaaaaactcagcgaggaggagaggaaacacaaggaagctttagaagatctgcacatggtcgtggacgaagattccagaagcgagagttcaagtacagacgagggcaaggaaaagaccaaactgcttcttgagaggctgaaggccttggaggcagagaatagcgccctagcactggagaatgagaatcagagggaacagtatgaacgctgtctggacgaagtggctaaccaggttgtccaggccctcttgacccagaaagatctgcgggaagagtgcgtcaagcttaagactagagtgtttgatctagagcagcagaatcgcacattgtctattcttttccaacaaagggtgaggcccacatctgacctgttgctgcagaaattgcactctagactactggacttatcaagcggagacttacttagcgaagtggagaggaaccggagcctgacacagagccgaaccgacgcagaggttcatgagcatcagctcaacactaagagcgctttaaagtgcccaggtcttggcgccgtcataccaggacatctgtgtcccagaaactcttacagttcttcttcagaattgtcacttagctctacgtgcagtgaatattcatccgggtcttcctatacatggcacgatgggaaaaacctcagaaagcgagtcaaagaggccaacgagaacctgcaggaagacgaggatgacgccgtggccgacagcgtattccagtcacacatcattgagtctaactgccagatgaggacactagatagtggaattggcacctttcctttgccggatagcggcaatcgatccaccggacggtatctctgtcagccagattcccccgaagatgccgaaccgctgctcccactgcagtctgcactttccgccgtgtcgtctatgcgggctcagacactcgagagagaagtccccagctccaccgatgggcaacgtcctgctgattccgctatagtgcacagtacatcagaccccattatgactgccagggggatgaggcctctgcaatctaggctgcccaagcctgcatcatctggaaaggtttcatcccagaagcagaacgaggcagagccaagaccccagacctgtagttccttcggatacgcggaagatcccatggcctcccaacctctaccagactgggggtctgaagtcgcagcaactggcacacaggacaaggcgccaagaatgtgtacatattctgcatccggggggagtaatagcgacagcgacctggattatggtgataacggcttcggcgccggaagggggcaactagtcaaagccttaaaaagcgcagccccggagattgagactacgtag

SEQ ID NO: 31470 - DNA, 5730 bp, Artificial Sequence
  Description of Artificial Sequence: Synthetic coding sequence
atggagggtaaaaggcagctcgagaagagggatttcggcaagcgcctctcactggactccagcctggtggaatacatggactcaaacaaatacatcgaacacctgctgacccagttggaggagcaacacagatccctgtggcgtgagaagcttgctgtggcccggctccagcgggaggtagctcagaggacgtctgaaggcgcgatgcatgaaaagctgatccatgagctggaagaggaacggcacctgcgactgcaaagtgagaagaggctacaggaggtaacactcgagtctgagaggaaccgaatccagatgaggtcattgcagcaacagttctcccgcatggaagagaccgtgcgcaacctactgcagtcccagggtagccccgagcaaaagaaggaggagaccgtgaatatcatggtctatcaagaaaagctatctgaagaggaacggaagcacaaggaggctctggaagatctccatatggtagtggacgaagatagtagatcagagtcctcctcaacagacgagggcaaagaaaagactaaattgttgctcgagcgcctcaaggcactcgaagcagaaaactccgcactcgccctggagaatgagaaccagagagagcaatacgagcgctgtctcgatgaggtggcgaaccaggtcgtgcaggccctgttgacacagaaggaccttcgggaggaatgtgtgaagctgaaaactcgcgtcttcgatctggagcagcagaacagaaccctgtctattctgtttcagcaaagagtcaggcctacaagcgatctacttctccaaaagcttcactctcggctcttagatctgtcatctggcgacctgttatctgaggtagagcgcaatcgtagcctgacccagtcacggacagatgccgaggttcacgaacatcaactgaacacgaagtcagcactcaagtgccccgggctgggcgccgtaattcccggccacttgtgcccacggaactcatactcctcatcctcagagctctccctcagctcgacctgttctgagtatagtagcggttcaagttatacatggcacgatggtaaaaacctgcgtaagcggcagtcaagccagaattgggataagcgcctgtcaatcgattcgtccctccctagcggatttgcttcacccacaaatgagcttcccccaactaggataaaggagagccatatcctggagggactgcgtaagctgcagaaacggaaagtcctgcttgaaccccctagcgtcataacaaaatggggctacaaggattgtatgaacagcaacgaagggatctactccccagggattaagtccagctccctgaaagaatatcccccttgcaaaacggcagacctgggatctccttgcaaggagccccataaaacattcgtctacgacctcgactctcatgtcgacgccgacgacgatccaagtaccctggcactccttcaggccgtaccaaatcagagctgtcgtcctcatggatccaaactgacccacagcgtgagcgactccctgttcggttgggagaccaataggaagcactttttggaagggacgtccagcgtatatccaaaggagcgccccgaaaagctcaccagctgtgcaagctcttgtcccttagagatgaaactgtgtcctagcgtgcaaacaccacaagttcagcgcgaaaggggacctcaaggccagggccacggtagaatggcactgaatttgcagctttcagataccgacgataatgaaacttttgacgagcttcacatagagagctctgatgaaaagtcacccagcgacgtatcgctggccgcggatactgacaagtctgtggagaatttggatgtgctggttggcttcggcaagtctctctgtggatctccagaagaggaggagaagcaggtccccattcctagcgagacccgtcctaagaccttttcctttattaaacagcagcgtgtggtgaaaagaacctcctccgaagagtgcgtcactgtgatttttgacgccgaggatggggaaccaatcgagttctcgagccaccagacaggggtggttactgtcaccagaaacgagatctccataaattcaactcccgctggccctaaggcagaacacactgagctcctgccccaagggatcgcctgtctccaaccgagggccgccgcccgcgactacactttctttaaaaggtccgaggaagataccgagaaaaacattcccaaggataatgtggacaatgttcctcgcgtcagtaccgaaagtttctccagtcggacagtgactcagaatccacaacagcagaagttggtcaaacctacccataacatttcctgtcagagcaactcgaggagcagtgcccctatgggtatttatcagaagcaaaacctgaccaaaattcctccccggggaaagagcagccctcaaaagagcaaattgatggaaccagaggcaactaccctgctcccctcaagtggcctcgttacactggagaaatcgcccgccctggctccgggtaagctgtctagattcatgaagacagaatcctcaggtccactctttgagctacggagtgaccctcacattcctaagcactctgctcagctgccacattcttctcgcatgccatccagacgggattgggtccagtgtcccaaatcccaaactcccggttctcgcagtagacctgcgatcgaaagttcggactcaggtgaacctcccacacgcgatgaacactgtggatccgggccggaggcaggggtcaagtctcccagccctccacctccgcccggcaggtccgttagcttgctagcaagaccctcgtacgattacagccccgcaccgagtagcaccaagagcgaaacccgcgtgccctccgaaaccgcccgaacccccttcaaatctcctctacttaagggaatttcggcccctgtgatatccagcaatccagcaacaaccgaagtccagcggaagaagccatccgtcgccttcaagaagcctatcttcacgcatcccatgccttctcccgaagccgtgatccaaacacgttgcccggctcatgctccatcttcttccttcaccgtgatggctctcggcccccccaaggtgtctcctaaacggggagtcccaaagaccagtcccaggcagactctggggacccctcagagagatatcggactgcagacaccacggatttccccttccacccacgaaccattagagatgacatcttctaagtccgtaagcccgggcagaaaagggcaactgaacgatagcgccagcacaccccccaaaccaagcttcctgggggttaatgaatctccctcatcgcaagtgagcagcagctcttctagctcatcacccgcaaaatcccacaacagcccccatggatgccaatccgcacacgaaaaaggactcaagacccggcttccagtggggttaaaagtgttgatgaagtctccccaactgcttcgcaagagctccactgtacccggaaaacacgagaaggacagcctcaatgaggcatcaaagtcttctgtggctgtgaacaaaagcaaacctgaggattccaagaaccctgcgtctatggaaataaccgccggcgagcgcaatgtaacccttcctgattcacaggcccaggggagtttagccgacggacttcccctggaaactgccctgcaggagccgctggaatcttcaataccaggttctgatggccgggatggagtggacaaccgcagcatgaggcgcagtctgtcttcctctaagccacacctgaaaccggctttgggaatgaatggagctaaggcccgctcccactcgttctctacccacagcggcgataagccgtccactccacccatcgaggggtcaggcaaagtgaggacccagatcattactaacactgcagaaagggggaattccctgacgcgccaaaactctagtacagaatccagtcccaataaggccccttcagccccaatgctagagtcactcccttccgtgggtaggccatccggacatccgtcctctggcaaaggttccctcggcagttcaggttcttttagttcacaacacggctcaccctctaaactccccctccgtattccaccaaagtccgaaggcctgctcattcctcccgggaaggaggaccagcaggcatttacccagggtgaatgcccctccgcgaacgtggctgtccttggggaaccaggctccgaccgacgctcttgcccccccaccccaaccgattgtcctgaagcgttgcagtcaccaggcaggacacagcatccctcaacctttgaaacctcatccacaagtaaactggagacttccggccgtcacccggatgcgtctgctactgccacggacgccgtcagtagtgaggctccactgtcccctaccatcgaagaaaaggttatgctttgcatccaggagaatgtagagaaagggcaggttcaaaccaaaccaacctctgtcgaagccaaacaaaagcctggtcccagcttcgcctcatggttcggtttcagaaaatcaaggctgcctgcactctcgagccgaaagatggacataagtaaaacaaaggtggaaaaaaaagacgctaaagtgttgggattcggtaataggcaactgaagtccgaacgaaaaaaagaaaagaaaaagcccgagctacagtgcgaaaccgaaaacgagctcattaaagatactaaaagcgcagacaatcctgacggaggactgcagtcaaaaaataatcgccggaccccccaagacatctataatcagctcaaaatagagccacgcaaccggcactctcccgtcgcatgcagcaccaaagacacctttatgacagaactgctgaaccgcgtcgataagaaagccgccccacagactgaatcaggatcgagtaatgcaagctgcaggaatgtcctgaagggttcaagtcagggcagttgcctgatcggcagtagtatcagtacacaaggcaaccataaaaagaatatgaaaattaaggcagatatggaagtacctaaagattccctcgtgaaggaggctaacgagaatttgcaggaggacgaggatgacgccgtggcagatagtgtattccaatctcacattatcgaatcgaactgccagatgcgcaccctggactctggcatcggcactttccccttaccggacagcggcaatcgatctaccgggagatacctctgccagcccgattccccagaggatgctgagccattgctacctctgcagtctgccctgtccgctgtgtcgtcaatgcgagctcagacactcgaaagggaggtaccatcaagcactgatggacaaaggccagcagatagcgccatcgtacactccacctccgaccctataatgacggccagaggcatgaggccgctgcagtcgcggctgccaaagcccgcctcctcggggaaagtgtctagtcagaaacaaaacgaggcggagccgcggcctcagacttgcagttcttttgggtatgccgaggaccccatggcatctcagcccttacctgattggggttcggaagtggcggctacaggtacccaggataaggctccacgcatgtgcacatacagcgcctctggtggcagcaactccgatagtgatcttgactatggcgacaatggttttggagccggacgcggccagcttgttaaggctctgaagagcgcggccccagagatcgaaaccacatag

SEQ ID NO: 31471 - DNA, 1773 bp, Artificial Sequence
  Description of Artificial Sequence: Synthetic coding sequence
atggaggggaagcggcagctggagaagagagactttggtaagcgtctgtcgctggactcatcccttgtcgagtatatggacagcaacaagtatattgagcatctcctcacacagttggaggagcagcacaggtccctgtggagagaaaagcttgccgttgcccggctacaaagagaagtcgctcagaggacatctgaaggggccatgcacgagaagctcatccatgagctggaggaggagagacaccttcgattgcaatcagaaaaaagattgcaggaagtcactctcgagtcggagaggaataggattcagatgaggagtcttcagcagcagttctccagaatggaggagacggtccgtaacttgttacagtcgcaagggagcccagagcagaaaaaggaggaaaccgtgaatatcatggtgtaccaagaaaagctgtctgaggaggaacgcaagcataaagaggcactagaggatctgcatatggttgttgatgaggattctaggtctgagtcttcttcgacggatgaaggcaaggaaaaaaccaaactcttactagaaagactgaaagcactagaggctgaaaactctgccctggccctggagaacgagaatcagcgtgagcaatacgagaggtgcctggatgaggttgctaaccaagtagttcaggccctgctgacccagaaggatctccgagaagaatgcgttaagctgaagacgagggtgttcgatttagagcagcagaaccggaccctgagcattcttttccaacaaagggttcgcccaacatcggatttgttgctgcaaaagttacactcgagactactggatcttagcagcggtgacttgctctccgaggtggagcgcaacaggtctttgacacagagccggacggatgcggaggtccacgagcatcagcttaatacaaagtcggccctgaaatgccccggtctcggagccgttattccaggacacctctgcccccgcaattcgtatagctcaagctccgaactctcattgtccagcacttgcagcgagtactccagcggcagcagctacacttggcacgatggaaagaatctgagaaaacgcgttaaggaagccaacgagaatctccaagaggatgaggatgatgctgtcgcagacagcgtgttccagtcgcacattatcgagagcaattgtcaaatgcggacacttgactccgggattggcacattcccgctgcccgacagcggcaaccgctcgacaggtcgctacttatgccaaccagacagtcccgaagatgcggaaccacttctgcccctgcagagcgccttatcagccgtatcatccatgcgcgcgcaaactctggaacgggaggtgccaagcagcactgacgggcagaggccagccgatagcgcaattgtgcattctacatccgatcctattatgaccgctcgcggcatgcgtccgctccaaagtagactgcccaagccggccagctcaggcaaggtctctagtcagaagcaaaacgaggcagaaccccgtccacaaacatgctcttccttcggatacgccgaggatcctatggctagccagcccctgcccgactggggttccgaggtggccgccacaggaacgcaggacaaagcacctcggatgtgcacttattctgcgtcaggaggatctaacagcgacagcgatctggactacggcgataacggattcggggccgggcgtggccagctcgtaaaggcgctgaaatctgccgctcctgaaatgccgattacatag

SEQ ID NO: 31472 - DNA, 537 bp, Artificial Sequence
  Description of Artificial Sequence: Synthetic coding sequence
atggactccaacaagtatatagaacacttgctaacacagctcgaggagcaacataggtcactgtggcgcgagaagctggccgtggctcgacttcagagagaggttgcccagcgaacatcagagggcgctatgcacgaaaagctcatccacgagctagaagaggaaaggcatcttcgtttgcaatcagagaaacgcctgcaggaggtcactctggaaagcgagcggaatagaatacagatgcggagcttgcagcagcagttttctcgaatggaggagacagtgagaaacctactgcagagccaggggtctcctgagcagaaaaaggaagagacagtgaatatcatggtgtaccaggagaagttaagtgaagaggaaaggaaacataaagaagccctggaggacctacatatggtagtggacgaagactctagatccgagtcatcgagcactgacgaagggaaagagaaaacaaagctgctgctggagaggctcaaggccttagagaggaatggatggaactggcaccccgtgagctag

SEQ ID NO: 31473 - DNA, 4005 bp, Artificial Sequence
  Description of Artificial Sequence: Synthetic coding sequence
atgtccgaagcgatggatcagccggccgggggaccaggaaatcccaggcccggagagggagatgacggctccatggagccaggtacgtgtcaggagctgctccatcgcctgagggaactcgaagctgaaaactcagccttagctcaagctaacgaaaatcagcgggagacttatgaaagatgcctagatgaggttgcaaaccatgtagtgcaagcactgctgaatcaaaaagatctaagggaggagtgcataaagctgaagaaaagggtcttcgacctggagaggcagaaccagatgctgagcgccctctttcagcaaaagctccagttgactacgggttccctgcctcagatcccgctcactcctctgcagcccccttcggagccccccgcaagtccctccctgagttctaccgagggccccgctgctcccctgcccctggggcactgcgcaggccagcgggaagtgtgttgggagcaacagctgcggcctggaggccctggtccgcccgccgccccgccccccgcactggacgcgttgtctccattccttcgtaagaaagcgcaaatattagaggtgttacgggctttggaggagaccgaccccctgctgctgtgcagccccgccacaccctggcgacctcccggacagggacccggctctccggaacctatcaacggagagttatgtggccccccgcagccggagccttctccgtgggcgccatgtctgctgctcggtcctggcaatctcgggggacttctgcattgggagcgtcttctggggggcctgggcggggaggaagataccgggagaccatggggaccctctcggggccccccccaggcccagggaacatcctccggcccaaactgcgcaccgggctctagttcatccagctctagcgacgaagcaggagacccgaacgaggcacccagccctgatactttattaggagcactcgctagacggcaactgaaccttggacagctcctggaggacacagagtcatacttgcaggctttcctcgccggggcggcaggcccactgaacggggaccacccgggaccaggccagagtagcagtcccgaccaggcccctcctcaattgagcaagtccaagggactccctaaaagcgcatggggcggcgggacgccagaagctcacagacccgggtttggggcgacgtcagaaggccagggaccccttccttttctctctatgtttatgggcgctggagatgcccctttaggatctcgtcctggccatcctcatagtagtagtcaggtaaagtcaaaactacaaattggcccccccagtccaggggaagcccaggggccactgttaccgagtcccgccagggggttgaagtttcttaaactgccccccacatcagaaaagtccccctcccctggcgggccccagttgagcccgcaactccctaggaactcccgcatcccgtgcaggaacagtggcagtgacggcagcccaagcccactgctagcccgtagaggcctagggggcggagagttgagtcccgagggagcgcagggactgcccacctctccgtcaccctgttacactactcctgattccacacagttgaggcccccccagagcgcattgtcaaccacgttgtcaccgggtccagttgtgtccccctgctatgagaatatcctggatctcagcagatctacttttaggggcccttcacccgaacccccaccctcccctcttcaagtacctacatacccacagctcaccctggaggtgcctcaggcgcccgaagtgctccggtcccctggcgttcctccatcgccctgtttgcccgaatcctatccatatggctccccccaggagaagagcctggacaaggcaggtagtgagtctccacaccctggtcggcgtactccaggtaattctagcaagaaacccagccaaggctccggtagaaggcccggagatcccgggagcacccccctgcgagaccgcttggctgctctgggaaaactgaagacggggcccgagggagcccttggctccgagaaaaacggtgtgcctgcaagaccaggaaccgagaagactcgcggaccaggcaagagcggagagtccgctggcgatatggtgccttccatccaccggccactggagcagcttgaagccaaaggagggatccggggcgccgtggccttgggtacaaatagtctaaagcagcaggaacctggcttgatgggagaccccggggctagggtgtattcatctcattccatgggggccagggtggacctcgaaccagtgagcccccggtcttgtctcaccaaggtagaacttgccaaaagcaggctcgccggcgctttgtgccctcaagttcctcgcacccccgccaaggttccaacgtcggcgcctagtttaggaaaaccgaataaaagtccacacagctcgcctaccaagcttccttcaaagtcccccacaaaggtggttcctcggcccggcgccccgctggtgactaaagagagcccaaagcccgataagggcaaaggccctccctgggccgattgtgggtctaccactgcccagtcaacacccttagtcccgggcccaacagatccttcccagggaccggagggtctcgcccctcatagcgccatcgaagagaaggtgatgaagggaatcgaggagaatgtgctgcggctccaaggccaggaaagagcgccaggagctgaggtcaagcacaggaacacctcctccatagcctcctggtttgggctgaagaagtccaagctccctgctcttaatcgccgcaccgaagccacaaagaataaggagggcgctggtggcggctcacctctgaggcgcgaggtcaaaatggaagcgcgaaaactcgaagcagaaagccttaatatcagcaagctgatggcaaaggccgaagacttacgacgggccttggaagaggaaaaagcctatcttagcagccgggccaggccacggcccggagggccagctcccggaccaaacacaggcctaggccaggtgcaaggacagctggccggcatgtaccaaggagctgatacatttatgcagcagctcctaaaccgcgtggacggaaaggagctgccatcaaagtcctggcgggaaccgaaacctgaatacggtgatttccagcctgttagcagcgatccaaaatccccatggcccgcatgcggtcctcgaaatggcctggtagggccactgcagggctgtggcaagccccctggcaaaccttcctccgaacccggccggcgcgaggaaatgcccagtgaagactctctcgcagagccggtgcctacgtcccatttcactgcatgcgggagtttgaccaggacacttgactccggcattggcacatttccacctccggatcacggatccagcggtacccccagcaaaaatttgccaaaaacaaagccgcctagactggaccctccaccaggggtgccaccggctaggccacccccacttaccaaagttccacggcgggctcacaccctggagagagaagtgccagggattgaggaactcctggttagcggacggcacccttcaatgccggcattccccgctctgctgccagctgccccaggccatcgggggcacgaaacatgccctgacgacccttgtgaggaccctggacctacaccaccagtgcagcttgctaaaaattggacttttccgaatacaagagcagctggttcctccagtgatccccttatgtgccctccccgtcagctagaagggctgccgcggactccaatggctttgcctgttgaccggaagcgaagccaggaaccatccaggccaagccctaccccccagggacctccgttcggtggctcgcggacacctagcacttcagacatggctgaggagggaagagtcgcatctggcggcccaccgggtctggaaacctctgagtcactctctgactcgctctacgactcactctcaagctgtggatcccaggggtag

SEQ ID NO: 31474 - DNA, 3927 bp, Artificial Sequence
  Description of Artificial Sequence: Synthetic coding sequence
atggatcagcccgctgggggaccaggaaaccccaggcccggcgagggggacgatggatctatggaacccgggacatgccaagagctcctgcacagactgcgggagctagaggcagagaactctgctcttgcccaggccaatgaaaatcagcgagaaacttacgagcggtgcctggacgaggtcgcaaaccacgtggtacaagcccttctcaatcagaaggacctcagggaagaatgcatcaagctgaagaagcgagtgttcgaccttgagcgccagaaccaaatgttaagcgccctatttcagcagaagctgcagctgactactgggtccctaccacagattcccttgactcctctgcagccccccagcgagccaccagccagtccgagccttagtagtaccgagggaccagcggcccctctgccactggggcactgtgccgggcagagggaagtgtgctgggagcaacagctgcgaccgggcggacccggcccccccgctgcacctccccccgccctggacgctctgtctccttttctcagaaaaaaagctcagatccttgaagtgttgcgggccctggaagagaccgatccactactcctgtgctctccagcaacaccatggcggccacccggacagggcccaggaagccccgagccgatcaacggagagttgtgcggtccccctcaacccgaaccctccccctgggccccatgtctgctgctaggccccgggaatcttgggggtctccttcattgggagaggctattagggggcctgggcggggaagaggacactggcagaccctggggtccttccagagggcccccacaggcccagggaacctcttccggtcccaattgtgcaccaggctcttccagttcttccagcagcgacgaggcgggcgaccctaacgaagcacctagtccagacacgctgttaggggcgctcgcacggcgccagctgaatctaggccagctgttggaagacacggagtcatacttacaggcattccttgccggtgctgctggacccctgaatggcgaccatcccggccccggacaatcgtcctcacccgaccaggccccaccgcagctgtctaagagcaaggggctacctaagagcgcatggggaggcggaactccagaggcccaccggcccggttttggcgcaactagcgagggtcaggggcctctccctttcttatctatgtttatgggggccggggacgcacctctgggcagccgtccaggacatccacacagctctagtcaggtgaaatccaaactgcaaatcgggccaccttccccaggcgaggctcaggggccactcttgccttcccctgctaggggtctgaaattcctgaagttgcctcctaccagtgagaagagccctagccctggcggaccgcagctttccccacagttacctagaaatagccggattccctgtcgtaacagcggatccgacggcagcccctcccctctgctcgcccggcggggactggggggaggagagctgtccccggagggtgctcagggattacctacctctcctagtccttgctatacaaccccggattcaacacagctgcgccctcctcagagcgcgctgagcacaacgctgtcccctggacccgtggtatcaccttgctacgaaaacattttagatttgagcagaagtacctttagagggccgagtcctgagcccccaccttctcctctccaggtgccaacctatccccaactcacactggaagtgcctcaggctccagaagtactcaggtcaccaggcgtacccccgtccccctgtctgcctgagagctacccttatgggtctccgcaggagaaaagcctggacaaggctgggagcgaatccccacatccagggagaaggacaccagggaacagctccaagaaaccgtctcagggaagcggacggcgcccaggagaccctgggtctacacccttgagagacaggctggccgctctggggaagttaaagacaggcccagaaggcgctctcggaagcgagaagaacggagtcccagcaagaccgggcactgaaaaaactaggggacccgggaagtcaggagaaagtgctggtgatatggttccctccatacaccgacctctggaacagttggaggccaaaggggggattagaggagctgtagcactcggtactaactcacttaagcagcaggaaccaggccttatgggggaccctggcgctcgggtgtattctagccatagcatgggagctagagtcgatctcgaacccgtgtcacctcggtcttgcctgacaaaagtacctacatctgcacccagtctgggtaaaccgaataaatccccgcatagctcacctaccaagctcccatcaaagagcccaaccaaggtcgtcccacgccccggtgccccattggttactaaggagagccctaagccagataagggcaaggggcccccatgggccgactgcggcagcacaaccgcccagagtacccccctcgttcctggccctactgacccgtcacagggtcctgagggtctcgcccctcactctgcgatcgaagaaaaggtgatgaaaggtatcgaagaaaacgtgcttcggcttcaaggccaggagagagcgccaggagccgaggtcaagcatagaaataccagctcaatagcttcgtggtttggcctcaagaaatcaaagcttcccgccttgaatcgaaggactgaggccaccaagaataaggagggcgccggggggggcagcccccttcgacgcgaggtgaagatggaggcacggaaattggaggcagaaagtctgaacatctcaaagctgatggccaaggcggaggacctacggcgcgcacttgaggaggaaaaagcatatctgtcctcacgggcacggccccgacctggtgggcccgcgcccggacccaataccggtctaggtcaggtgcaaggacagttggctggaatgtaccagggagccgacaccttcatgcagcagttgttgaacagggtggatggcaaggaactcccttctaagagctggcgcgagcccaaaccagaatacggggacttccagcccgtgtcctctgatcccaagtcaccttggcctgcctgcggccctcgaaatggtctggtaggacctttacaggggtgtggcaaacctcccggcaagccttcttcagaacctggacggcgggaggagatgcccagtgaggattcgctcgcggaacccgtgccaacatctcactttaccgcctgcggctctctcaccagaacgttagatagtggcattggcacctttccccctccggaccacggctcttcagggactccaagcaaaaatttgcctaaaactaagccaccaaggctcgacccccccccgggagttccccctgcgaggcctccaccattgaccaaggtgccgcgaagagcacacaccttggaaagagaggtgccaggaattgaagaactgctcgtctctggaagacatcccagtatgcccgccttccctgcgctcttacctgccgccccagggcaccggggacacgaaacgtgtccagatgatccatgcgaggatcctggccctacccctcccgtccagctggcaaagaactggacctttccaaatacgcgtgccgctgggtcctcgtctgatccactgatgtgcccccccagacaactggagggtctcccccgcacccctatggccttaccggttgatagaaagcgcagtcaagaaccatcccggccttctcctactccccaagggccacctttcggtgggtcccgcacgccctcgacaagcgacatggctgaggaagggcgggtcgcttccggcggacctcctggactcgagacgtccgaaagcctgtcggatagtctctacgatagcctgtcttcttgcggcagccaaggctag

SEQ ID NO: 31475 - DNA, 1116 bp, Artificial Sequence
  Description of Artificial Sequence: Synthetic coding sequence
atggccggtctgcaagaactgcgattccctgaggagaagccacttcttcgaggccaggacgcgaccgagctcgagtctagtgatgccttcctgttggcagcggatacagactggaaggaacacgatatagagacaccctacggcctactacatgtggtaatacgcgggtctccgaagggtaacagaccagccattctgacctatcacgatgtcggactgaatcacaaactatgcttcaacacgtttttcaatttcgaggacatgcaggagataactaaacatttcgtggtgtgccacgtggatgcacccggccagcaggtgggcgccagccagtttccgcagggataccagttcccatcaatggaacagcttgcagcaatgctgccctccgtggtgcagcatttcgggttcaaatacgttataggaataggtgtcggcgctggtgcatatgtgctggctaaattcgcattgatcttcccagacctagttgagggtctggtgctcgtcaatattgacccaaatgggaaagggtggattgattgggctgcaactaagctcagcgggctcaccagcaccttaccagacactgttctgtctcatcttttctctcaggaggaactggttaataacacagaactggtccaatcttatagacaacaaatcggcaatgtggtgaatcaggcaaacctacagctcttctggaatatgtataactcccgaagagacctggacattaataggcctggcacagtgcccaacgccaaaacacttcgctgccctgtgatgctggtagttggcgacaacgccccagcagaagatggggtggtcgaatgtaattctaagctcgacccaaccaccacaaccttcctcaaaatggctgactcaggcggtttaccccaggtgacacaacctgggaagctcaccgaggccttcaaatactttcttcaaggtatgggctacatgccctctgcctcaatgacaaggctagcacgatcgcgaaccgcctccctcacaagcgcctccagcgtggatggatccaggccgcaggcatgtactcacagcgagagctcagaaggcctcggacaggtgaaccacaccatggaggtgtcatgctag

SEQ ID NO: 31476 - DNA, 1110 bp, Artificial Sequence
  Description of Artificial Sequence: Synthetic coding sequence
atgccggagtgttgggacggtgtcggcgagggcaacgcaggcgcagtgaagctcgcaggactcggcgaccccagatggtcccctggccatctgctgtcgccaggacaccaggaacacgatattgagaccccgtatggcctgttacatgttgtgattagaggatcccctaagggcaacaggccagcgattcttacataccatgacgtgggactgaatcataaattatgctttaatactttcttcaatttcgaggacatgcaggagatcacaaaacattttgtcgtatgccatgtggacgcacctggccagcaggtaggcgcgagtcagtttccacagggataccagtttccatctatggaacagttggccgccatgcttccatccgtggtgcagcacttcggattcaagtacgttattggtattggcgtgggggcaggggcctatgtgctggctaagtttgccttaattttccctgatctcgtcgagggactcgtgcttgtcaacattgacccaaatggcaaaggctggattgattgggctgcgacaaaactctcggggctgacctccacactgcctgatacagtgctgagtcacttattttcccaggaagaacttgtgaataacactgaattggtacaaagttatcgccaacagatcggcaacgtggtgaatcaggctaacctgcagcttttttggaatatgtataacagcagaagagatttagatattaaccggcctgggactgtgccaaatgcaaaaaccctaagatgtccagttatgctggtggtgggggacaatgcgcctgccgaggatggcgtggtcgaatgtaattcaaagttggatcctaccacgactactttcttaaaaatggccgacagcggaggcttgccacaagtgactcagccaggcaaactgaccgaggccttcaagtactttcttcagggtatgggatacatgccctccgccagcatgaccagactggcgcgcagccggaccgcatctcttacgagcgcctcctcagtggatggatcacgcccgcaggcctgtacccacagcgaaagctctgaagggctgggccaggtaaaccacaccatggaggtgtcctgttag

SEQ ID NO: 31477 - DNA, 1116 bp, Artificial Sequence
  Description of Artificial Sequence: Synthetic coding sequence
atggcaggcctgcaggagctccgattccctgaagagaagccattgctccgcggacaggatgcaacagagctggaaagctccgacgcattcctgctcgcggctgacaccgattggaaagagcatgacattgagacgccatatgggctactgcatgtggtgatccggggcagccctaagggcaataggcccgctatcctgacatatcatgatgtgggtttaaatcataagctctgctttaataccttcttcaacttcgaagatatgcaagaaattacaaagcactttgtggtgtgccatgtggatgctcctggccaacaagtaggcgcctcccagttcccccaggggtatcagttcccaagcatggaacaactggctgcaatgttaccctccgtcgttcagcatttcggcttcaaatacgtaattggcatcggggtgggggcaggggcatatgtgcttgcaaaattcgccctgatttttcccgacctggttgaggggctagtcctggtcaatattgacccaaatggcaaggggtggatcgattgggccgccacaaaacttagcgggctgacgagcaccctgccggacacagtgttatcacacctgttttcccaggaagaactggtgaataataccgaactcgtacagtcatatcgtcaacagataggcaacgtggtgaatcaggctaacctccagctgttctggaacatgtacaattcccgccgtgatcttgacatcaacaggcctggcacggtgccgaatgccaagacccttaggtgccctgtcatgcttgtcgtcggcgacaacgcgccagctgaagatggcgttgtggaatgcaatagcaagttagaccccaccaccactacgttcttgaagatggctgacagcgggggtttaccccaggtgacccagcctggaaagctaacagaggcgtttaagtacttcttgcagggcatgggctacatgccatctgcaagcatgacacgtctcgcgcgcagccggactgcatctttgacctccgcctcttcagtggatggctccagaccacaggcatgcactcactcagagagcagcgagggcctggggcaggtgaaccatacaatggaggtatcttgctag

SEQ ID NO: 31478 - DNA, 1176 bp, Artificial Sequence
  Description of Artificial Sequence: Synthetic coding sequence
atgaaagtgctgggtcatagactcgagctgctgaccgggctcttgctccatgacgtcaccatggcaggcctgcaggagttacgctttcctgaggaaaagccattgttgcgggggcaagacgcaacagagctggagagtagcgacgccttcttattagccgcagatacagactggaaggaacatgatatcgaaaccccatatgggttgctgcacgtggtgattaggggctctccaaagggcaacagaccggccatcctgacatatcacgacgtgggcctgaatcataagctctgtttcaacaccttcttcaactttgaggatatgcaagagattactaaacattttgtggtttgccatgtcgacgcccccgggcagcaggtcggtgctagccaatttcctcaggggtaccagtttccatcaatggaacaactggcagcaatgctgcccagcgtcgtgcaacacttcggatttaaatacgttattggaatcggcgtgggcgctggagcctacgtgcttgctaagtttgccctcatctttccagacctggtggaagggctcgtgctggtgaacatcgacccaaatggcaaaggctggatcgactgggccgcaaccaaactcagtggcctaacatccaccctgccggatacggtgctaagccatctcttctctcaggaggagttggtcaataatacagagttagtgcagtcctacagacagcaaatagggaatgttgtgaatcaggcaaatctccagttgttctggaatatgtacaattcgcggcgagacctggacatcaaccgccccggcaccgtacccaacgcgaagacactgcggtgtcccgtgatgctggtggtgggcgacaatgccccagccgaggacggggtggtcgagtgtaacagtaaacttgatccaacgacgacgacattcctgaagatggccgactcgggaggtctgcctcaagtaacccagcccggcaagctgaccgaggcctttaaatattttctgcaggggatgggctatatgccttcggcgtctatgacccgactggcgcggtcacggaccgcgtcattaacaagcgctagttcagtggacgggtcccggccacaggcttgcacccattccgagtcatcggagggcctgggacaggtaaaccacactatggaggtcagttgctag

SEQ ID NO: 31479 - DNA, 894 bp, Artificial Sequence
  Description of Artificial Sequence: Synthetic coding sequence
atgcaggagataacgaaacacttcgttgtttgtcatgtcgatgctccgggccagcaggtgggagctagccaatttccacagggctaccaattccccagcatggagcaactagccgctatgcttcccagcgtggtccaacacttcggcttcaagtacgttatcggaataggggttggcgccggagcttatgtgctggcaaagttcgctttgatctttcctgacctcgtcgaaggcctggtgctggtaaacattgaccctaatggcaaaggctggatcgattgggccgccactaagctgtccgggctgacatcaaccttgcccgacacggtgctctcccatctctttagtcaggaagagctagtgaacaacacagagctggtccagagttaccggcaacagatcggtaatgtcgtgaaccaggctaacctgcagctgttttggaacatgtacaattctcgcagagatctggatatcaaccggcctgggacggtaccgaatgctaagacactccgatgtccagtcatgttggtggtgggtgataatgctccagccgaagacggcgtggtggagtgcaactctaagctcgatcctaccacaaccacgttcttaaaaatggcggactccggcggcctgccacaggtgacccagccggggaagctgactgaggctttcaaatattttctgcagggcatgggatacatcgcttacctgaaggaccgtcgactgtcagggggagcagtgccctctgcttccatgactcgcctggccagatctcgcacagcttctctcacttctgcttccagtgtggatggatccagaccccaggcctgcactcactccgagagttcagagggcctgggccaggtcaatcacacaatggaagtgtcttgctag

SEQ ID NO: 31480 - DNA, 1020 bp, Artificial Sequence
  Description of Artificial Sequence: Synthetic coding sequence
atgccagagtgttgggacggcgagcacgacatcgagacaccctacgggttactgcacgtggtgattagggggtcacccaagggcaacagacctgccattctgacctaccacgacgtggggctgaaccataaattatgtttcaacacgtttttcaattttgaggacatgcaagaaataacaaagcattttgtcgtgtgtcacgtcgacgcccccggccagcaagtcggcgcctcgcagtttccacaaggttaccagttcccttcgatggagcagctggcggcgatgttgccgtcagtcgtgcagcattttggattcaagtacgtgatcggaatcggcgtaggtgctggcgcctacgtcctcgctaagtttgcattgatctttcccgacttggtagaggggttggtcttggtgaatattgacccgaatgggaaggggtggattgattgggctgccactaaactctccggactcacgtcaacccttcccgataccgtgctttcacaccttttctcccaggaggagctggtgaacaacaccgaattagtccagtcctatagacagcaaatcggaaatgtcgtgaatcaggccaacctgcagctgttttggaacatgtacaactcccgtcgggatctggacatcaataggccagggacagtccctaatgctaagacactccggtgtcctgtgatgctcgtggtcggggacaatgctcccgcagaggacggggttgtcgagtgcaattccaaactagaccctaccacaacgacctttctcaagatggctgattcgggaggcctcccgcaggtcacacaaccaggaaagctgacagaggcatttaaatactttttgcaagggatggggtacatgccttcggcaagcatgactcggcttgctcggagtcggaccgcaagtctgacttctgcctcctctgtggacggctcaaggccccaggcttgtacacactctgagagctccgagggcctgggccaagtcaatcataccatggaggtaagctgttag

SEQ ID NO: 31481 - DNA, 1059 bp, Artificial Sequence
  Description of Artificial Sequence: Synthetic coding sequence
atgcccgagtgctgggacggggaacacgacatcgaaactccttacggactgcttcacgtagtgatcagaggcagccccaaaggaaaccgccctgccattctcacttatcacgatgttggtcttaatcataagctatgctttaatacgttttttaacttcgaggacatgcaagagataaccaaacactttgtagtatgccacgttgacgcacccgggcaacaggttggcgcctcacagtttccacagggctatcagttcccctccatggagcagctcgcagccatgctgccttctgtagttcagcacttcggctttaagtatgtcattgggatcggcgttggtgccggggcctatgtgctcgcaaagttcgccttaatctttccagacctggtagagggactggtccttgtcaatattgacccaaacggcaaggggtggattgattgggcagcgacaaagctttccgggcttacaagtacactgccggacactgtgctttcccaccttttttcacaggaagagctcgtgaataataccgaacttgtgcagagctaccgccagcagatagggaacgtggtgaaccaggccaacctgcaactattctggaacatgtataatagccggagggatctcgatataaataggccggggactgtgcctaacgcaaaaacactgaggtgcccggtaatgttggttgtcggcgataacgcaccagcggaagatggcgtggttgaatgcaactcaaagctcgatcccacaacaaccactttcctgaaaatggctgattcaggcggcttgccccaagtcactcaacctggcaaactgactgaagctttcaagtatttcctacaggggatgggctacatcgcctatctgaaagataggcgtctgtctggcggagctgtgccctccgcctctatgactaggttggctcgcagcagaacggcctctttaacatcagcaagtagcgttgacggcagtcggcctcaggcctgtacccactctgaatcgagcgaaggcttgggtcaggtgaatcataccatggaagtgagttgctag

SEQ ID NO: 31482 - DNA, 345 bp, Artificial Sequence
  Description of Artificial Sequence: Synthetic coding sequence
atgatcgctcgccgcaatccagagccccttaggttcctgcccgatgaagcgcggtcactgccacctcctaaattgactgacccccgcttgctctatatcggcttcctgggatactgttcgggacttatcgataacctcatacgccggagacctatcgccacagccggtctacataggcaacttctctacattaccgcattctttttcgcgggatattacttggttaagagggaagactatctgtacgccgttcgggacagggaaatgtttggctatatgaagctgcatccagaggacttcccggaggaggatgtgtattgctgcggggccgagaggcgggggtag

SEQ ID NO: 31483 - DNA, 732 bp, Artificial Sequence
  Description of Artificial Sequence: Synthetic coding sequence
atggaggactcctttctgcagtctttcggacgactttctttacaaccacagcagcagcagcagcgacagcgaccaccacgacccccaccccgagggaccccaccccgcagacactccttcagaaagcacttgtacctcctgcgaggcttgcccggctctggaaaaacaacgctggctcggcaattgcaacacgactttccgcgggccctaatattcagtaccgacgactttttcttccgggaagacggcgcatacgagttcaatcccgactttcttgaagaggcccatgagtggaatcaaaaacgcgcaagaaaggccatgcgaaacggcattagtccgatcataattgataacacaaatctgcatgcctgggagatgaaaccttacgcagtcatggcgttggagaacaactatgaggttatttttcgcgagcccgacacccgttggaagttcaacgttcaggagctggcacgccggaatattcacggagtgtctagggagaaaattcacagaatgaaggagaggtacgaacacgacgtcaccttccattccgtgctccatgcagagaagcccagtaggatgaatcgcaaccaggaccggaacaatgccctgccatctaataatgcccgatactggaactcctacaccgaattccccaaccgcagggctcacggaggcttcacaaatgagtccagctaccaccgacgtggcggttgtcaccatgggtattag

SEQ ID NO: 31484 - DNA, 414 bp, Artificial Sequence
  Description of Artificial Sequence: Synthetic coding sequence
atgcggaacggtatctctccaattatcattgataataccaatctgcatgcatgggagatgaaaccatatgctgtgatggccctcgaaaacaattacgaagtaatattccgtgaaccagatacacgatggaagtttaatgtgcaggaactagcccgccgcaacatccatggagttagccgtgagaaaattcaccgtatgaaagaacgctatgagcacgatgttacattccactctgtgcttcacgctgagaagccaagtaggatgaaccgtaaccaggatcgaaataatgcccttcccagcaacaacgcacggtattggaactcatacaccgaatttcccaatcgacgggcacatggggggttcaccaacgaatccagctaccatcgccgtggcggctgccaccacggttactag

SEQ ID NO: 31485 - DNA, 522 bp, Artificial Sequence
  Description of Artificial Sequence: Synthetic coding sequence
atggaagatagtttcttacagtctttcgggcgcctctcattgcagccacagcagcaacagcagcggcagcgtccacctcggccgcctccaagagggactcctccgcggaggcacagctttcgaaagcatctctatcttttgagaggattacccggctccggtaaaaccacactggcgaggcaactgcagcacgatttccctcgcgcccttatcttcagcacagatgattttttctttagggaggatggtgcctatgagtttaaccctgatttcctggaagaggcacacgaatggaaccagaaaagagctaggaaagccatgcgcaacggcatatctccaattattatcgataacactaacctgcatgcgtgggagatgaaaccgtatgctgtgatggtgttccagaccgagcagaagaacctttttcggcttgaaatggatatggtggtgttccgccccgaaatgaagaaacacagctggtgcctaaagcggaagaatcccccaaatgaaagaacagtgtag

SEQ ID NO: 31486 - DNA, 1752 bp, Artificial Sequence
  Description of Artificial Sequence: Synthetic coding sequence
atgtcttatggcgagatcgagggcaagtttctgggcccccgcgaggaagtgacttctgagccacgctgtaaaaaactgaagtctaccactgaaagttacgtgttccacaaccattcgaatgccgactttcaccgtatccaggagaaaacagggaacgactgggtaccggtgactatcatcgatgtgaggggacactcctacctgcaagaaaacaagataaaaacgactgatctccataggcccctccatgatgaaatgcccggcaaccgccctgatgtgattgagagcatcgatagccaggtcctgcaagaggctaggcctcctctggttagcgcagacgacgaaatttatagtacatcgaaagccttcatcggtccaatatataaacctccagaaaaaaagaagaggaacgagggacggaacgaagctcacgtgctgaacggcataaacgatcgtggaggccaaaaggagaagcaaaaattcaattctgaaaagagtgagatcgataacgagctctttcaattttataaggaaattgaggaactggaaaaagagaaagatggcttcgagaattcttgtaaggaaagcgagccgagccaggagcaattcgtacctttctatgagggtcacaacaatggcctgcttaagcccgacgaggagaagaaggacctctccaataaggcgatgccatcccactgtgattaccagcaaaacctcggcaatgagcccgataagtatccttgcaatggacaggtgattcccactttctgcgacaccagtttcaccagcttccgcccagagtggcagtctgtttacccatttattgtgccatacggtccccctttgccgagtctgaactatcatttgaatattcagcggttcagtggccctcctaaccctccaagtaatatcttccaggcccaagacgatagccagatccaaaatggctattacgtcaacaattgtcacgtcaattggaattgcatgacgttcgaccaaaacaacgagtatactgattgtagcgaaaaccggtcgtccgtccacccgagcggcaatggctgctccatgcaggaccgatacgtttccaatgggttctgcgaagtgcgagaaagatgctggaaggatcactgtatggacaagcataatggcactgatcgcttcgtgaaccagcagtttcaagaagagaagttaaacaaactgcaaaagctgttgatcttgctgaggggcctgcctggtagcggcaagacaacactaagccgcatcttgttaggtcagaacagagatggcattgtattctccacagacgattactttcatcatcaggacgggtataggtataacgtaaatcaactcggggatgcccatgactggaaccagaatagggcaaagcaggccattgatcagggccggagccctgtaatcatagacaatacaaatatacaggcctgggaaatgaaaccttacgtggaggtggccataggaaaaggatatcgggtagagttccatgagcctgaaacttggtggaagtttgatcccgaggaactcgaaaagaggaacaaacatggtgtgtcccgaaaaaagatcgcacagatgcttgatcgatacgagtatcagatgtcgataagcatcgtgatgaatagcgttgaaccttcccacaaaagcacccagcggcctccacccccccaaggcagacagaggtggggcggtagcctagggagccacaatagggtctgcgtgactaataaccactag

SEQ ID NO: 31487 - DNA, 2214 bp, Artificial Sequence
  Description of Artificial Sequence: Synthetic coding sequence
atggccctgtgtagtgccctgatgactatatttacaattaagatgggtacagctaagcaggccatagaccagggtcggtcgcctgtaattatcgacaacacaaacattcaggcttgggagatgaaaccctatgttgaggtggctattgggaagggatatcgagtggagtttcatgaacccgagacatggtggaagttcgatcccgaggagttggagaaacgcaataaacacggggtaagccgaaagaagattgcgcagatgctagacaggtacgaataccagatgagtatttctatcgtgatgaacagcgttgagccgagccacaaatcgactcagagaccccccccaccgcaggggaggcagagagagcgagtgctcaagaagactggacaccgactctctaaaacaaagcagaagaggaataggaaacggaataagaaacagaactcgcaaaacagaatcatggaagaaaactccctggagttcctatcagatcttaccccaggggatcaggacccgagccaatctgaggaagaagatatagaaaagacaaggcgggaatctgagtacccgttcatcgatggcttgcaaaacgaggtcggggacttcgtgaccgggtacaaggaaaagcgatggaagaataaggaccccaaagatagctttcagaatgtgatgagcatcgtggagttggataacacgccaaagaactacctgtcaaaggaaggcgacaacctatttgtgagtctgctgctccggccaaatgaaatctctgtcacatgtccaattctgacccagaacctctcttgtgttaccaccgacgattgttccggcatgaaggtggagaagcacataagaaaccggcacaccatcgcacttgacacccaggatctcagtgcagaaacaagctgtctctttatgaaaaaacgtgagatagtcgataagaatctttctcacgagcccattttatgtcaccagcatggtatcaggatgagtgataaagtgctgcgcgaggagcaagtgtacacaacaaagattaaccactgggccttctttaccacaaacctgtcagatgaggatctacaacttggctctgacagacaaccctacttcgggagttggcccgccggccctcataaatttatctgcgaacagagacctaagaaggaccgggcatgtaagctagcgggacccgatagccggggccagtggatacagatgattttcacctccgttgcagcatctgaacctgggaacaaccctgaaatcctgaccgataagttgttgattggtaacgaagatttcagcccacccccggagaccatggatagcttcattgagactaaccttttcagatcttgtttaccacagcctgatatcccgaagaacgcactcgaatccactaagaacaagaagaggaggaagaaaaggatctttaacctggttcctaacttcgacctcctggggcagagcagaatcggggtgaaagagagggaaaagtgcgacttgctgactaaaaaccacggcctgaagatcacgttaggtgaggagaaggacagaatatcggagaggaactccgaagaagaaaacaaacagaagcttatgacattcgaccatcatcctctgtggttttatctcgacattatcaaggcgacccctctgaatatcgacggacagcgctattcacattgcctctcattcaacagactccgttgttccgcaagtctgtataaaaactatatcccgagcttcgtgttgcacaacctcagttccatatggaaaccatcattcacgaacaagaagctgttcctgacttttgagagccagactcgagtgggcaataaacttaatgacgccggctttatctcacctgaaatcttacactcacatcccgacactagctgttcactgggcgtaacctcagattttcatttcctaaatgagagatttgatcgtaagttgaaacgctgggaagagccgaaagagctgcctgcggaggactcccaggacttgacttctactgactacaggtccctggaactgccactaagtcaaggtttcgcatttcagcttgtgaagctgttcggaagcccaggcgtgcccatggagagtctgctaccggatgactatgtcgtccctttggactggaaaactctgaagatgatatatcttcagtggaaaatgtctgtcgagaagagacagaagaaaattggctag

SEQ ID NO: 31488 - DNA, 2259 bp, Artificial Sequence
  Description of Artificial Sequence: Synthetic coding sequence
atgtcctacggcgaaatagaagagttctgcctggtgcgaattgttatggcgctgtgcagcgccctcatgacgatcttcaccatcaagatgggtacagcgaagcaagccatagaccagggtagatcccctgttatcatcgataatactaacattcaggcttgggaaatgaagccctatgtggaggttgccatcgggaaaggctacagagtcgaattccacgagcccgagacgtggtggaaatttgacccagaagagctggaaaaaagaaataagcatggagtgtccaggaagaagattgcccagatgttggatagatacgaatatcagatgtcaatctccattgttatgaactcagtggaaccttcccataagagcacacagaggcctccccctccgcagggaagacagagagagcgggtgctgaagaagaccgggcaccgcctgtcaaagactaagcaaaagaggaatcggaagcggaacaaaaagcaaaattcccagaatcgcatcatggaggagaattcacttgaatttctgagcgacctgacaccgggtgatcaggatccctcccagagcgaggaggaagacattgagaagacccgccgggaatccgaatatccctttatagacgggctgcagaacgaagtgggtgacttcgtaaccggatataaagagaagcgctggaaaaacaaggacccaaaggactccttccagaacgtcatgtctatcgtagagctggacaacacacccaaaaactatctctcaaaggagggggacaatctgttcgtatccttactgctccgtccaaatgaaatttcagtgacttgccctattctgacacagaacctgtcgtgcgttaccacggatgactgttccggcatgaaggttgagaagcacatacgcaatagacacactatcgccttagatacacaggacttatcagcagagaccagctgtctttttatgaaaaaacgggagatagttgataagaatttgtcccacgagcctatcttgtgtcaccagcatggaatccggatgagtgacaaggtgctgagggaagaacaggtctatacgaccaaaattaatcactgggccttcttcaccacaaatttgtctgatgaggatctgcagctcgggtctgaccgacaaccctatttcggcagctggcccgccggtcctcacaagtttatttgtgaacaaagacctaagaaggaccgggcatgtaaactggctggccctgattcgaggggccagtggattcagatgattttcacctccgttgccgcatcagagcccggcaataaccctgaaatcttgaccgataagctgctgattggaaatgaggacttcagcccgcctcctgagactatggattcttttatcgagactaacctgtttcggagctgcctcccacaacccgacattccaaagaacgcactggagtcgactaagaacaaaaagcgacgcaaaaaaaggatctttaatctagtgcctaatttcgatctcttaggtcagtctcgcattggggtgaaagagagagagaagtgcgatctcttgaccaagaaccacgggctgaagataacactgggagaggagaaagataggatttctgaacgtaactcagaagaggagaacaaacagaagctgatgacatttgaccaccatcctctgtggttctatctcgatatcatcaaagctacacccttgaatattgacggtcagaggtactcccattgcctgagtttcaatagactaaggtgtagcgcatcactgtataaaaattatattcccagtttcgtgctccacaacctgtcatctatatggaagccatcctttaccaataagaagttgttcctgactttcgagtcccagactcgggtggggaacaagcttaacgatgcaggcttcatcagtcctgagatcttgcatagccacccagacacaagctgctcattgggcgtgacaagcgactttcatttccttaatgaacgattcgatcgcaaactaaaaaggtgggaggagcccaaggagctgcccgctgaagatagccaggatctgacgagcacagattatcgtagccttgagctgcctctgagtcaaggttttgctttccagctcgtgaagttgttcgggagtccgggagtgccgatggagtcgctactacccgatgactatgttgtgccactggactggaagaccttaaagatgatttacctccagtggaagatgtccgtggagaagcggcagaagaaaatcggatag

SEQ ID NO: 31489 - DNA, 513 bp, Artificial Sequence
  Description of Artificial Sequence: Synthetic coding sequence
atgctaatcaaggttaagaccctgacagggaaagaaatcgagatcgacatagaaccgacagacaaggtggagcgtattaaagaaagggtagaggagaaagaggggataccaccacagcaacagcggttgatttattccggtaagcagattgacggaacagtccgggatcgaagaggccaggatgtgcgcctctatcctgaagttcctgaagtgctgaagagactgcagtctctgggcgtgccaggagctgcagctagccgcacatccgaaattgaaggtgcaaatcagctgctggagttgttcgatctatttcggtacttcgtgcaccgggagatctaccctgggtccaagataacacactttgaaagactgcagcagaagacaggcatcccctttagtcaaatgatattctttgatgatgagaggcgcaacatagttgatgtctccaagctcggagtgacatgtatccacattcaaaacggcatgaatctgcaaaccttgtcccagggctag

SEQ ID NO: 31490 - DNA, 339 bp, Artificial Sequence
  Description of Artificial Sequence: Synthetic coding sequence
atgtggaagggtgggcggtctcatccctttttgccctgttcatctcgccgggccggatccggcggccagcttgacagcattttacctcatcaaagccctgcctggggaccctggggctgcaaagatttatcgtctggcgtgccatctttcttgacctcttctattctctggaagagtgctgttttcgctgaagacaacggcctgaagatccacttatgcagttacaaaagagacgacctcgtgttgttctacgattgcactagctttgtcctgacatttggcccgtccccgtggtttctgactcagggctttctgaatcctctcgagtttagcgcctag

SEQ ID NO: 31491 - DNA, 2577 bp, Artificial Sequence
  Description of Artificial Sequence: Synthetic coding sequence
atgctacagactaaggacctcatttggacgctgtttttcctggggacagctgtctctctgcaagttgatattgtgccttcccagggcgagatcagtgtcggggaaagcaaattcttcctctgtcaggtggcgggtgatgccaaggataaggatatttcctggttttcccccaacggagaaaaactaactcctaaccagcagaggatctctgttgtttggaacgacgatagctcctccaccttgacaatctataacgctaatattgatgacgccggaatttacaagtgtgttgtgaccggcgaggatgggagcgaaagcgaagccaccgtgaacgtgaaaattttccagaagctcatgttcaagaacgctcccacaccacaggagttcagggaaggcgaagacgctgtgatcgtgtgcgatgtggtgagctcgctgcccccaactatcatctggaagcacaaagggcgcgatgtcatactgaaaaaagatgtcaggtttattgtcttaagtaataattatctgcagattcgagggatcaaaaagactgacgagggtacatatagatgcgagggacggatcttagccagaggcgaaatcaactttaaggacatccaggtaatagttaacgtcccgcctacaatccaggctcgccagaacatcgtgaatgccacagctaatttggggcagagtgtcaccttagtctgcgacgccgagggatttccggagcccactatgtcctggaccaaagacggggaacagatcgagcaagaagaagatgacgagaaatacattttctcagatgacagcagccagctgaccattaagaaagtcgataaaaatgacgaggctgagtatatctgtatcgccgagaacaaggccggggagcaggatgcgacaattcacctgaaagtgtttgccaagccaaaaattacttatgtggagaaccagacagcgatggaactggaagagcaagtgacgctgacatgcgaagcatctggagacccaatcccttcaattacatggcgcacttctactaggaacataagttcagaagagaaggcttcctggactcgacccgaaaaacaggagacactcgacgggcatatggtggtgcgctctcacgcacgagtgtctagtctgaccctaaagtctatacagtatacagacgccggggaatacatctgtacagcatctaacacaatcggtcaggattcccagagtatgtacctagaagttcagtacgcaccgaagctccaaggacccgtggcagtgtatacttgggagggtaaccaggtgaacattacgtgtgaagttttcgcataccctagtgccaccatatcctggtttagagacggccagctcctccccagtagcaattactctaacattaagatctacaataccccatccgctagctaccttgaagtcacaccagacagcgagaacgatttcggcaactacaactgcacagccgttaatagaattggacaagaatccctggaattcatcttggtacaagccgacactccatccagcccttcaattgatcaggtcgaaccgtattccagtaccgctcaggtgcagtttgatgagcccgaggcgaccgggggcgtgcccattctcaaatacaaagcagagtggagggcggtgggagaagaggtgtggcactcaaaatggtacgacgcgaaggaggcctccatggagggcatcgtaactattgtgggactgaagccagaaaccacctatgcagtcaggctggccgccctgaatggtaagggcctgggcgagattagcgcggcaagcgagtttaagacacaacccgtccagggtgagccctctgctcctaagcttgaggggcagatgggagaggatggaaactccattaaggtcaacctcataaaacaagatgacggcggatctccgatacgccactatctggtcagatatagggccctgagcagcgaatggaagcctgagattcggctaccaagcgggtctgaccacgtcatgctcaagtctctcgattggaacgcagagtatgaggtgtatgtcgttgccgagaaccagcagggtaaaagcaaggcagcacattttgtgtttagaacctctgcgcaacccaccgctatccccgcgaacggtagtccgacctcaggcttgtcaactggagcaattgtggggattctgatcgtgatcttcgtgctcctcctagtggtcgtagatattacctgttattttctgaataagtgcggtctgtttatgtgcattgctgtgaatttgtgtggcaaggccggccctggcgccaaaggtaaggatatggaagaagggaaggctgccttcagtaaggacgagtccaaggagccaattgtggaagtgagaactgaggaagagcgcacacccaatcatgatggcggaaagcatacagagcccaatgagaccacaccacttacagaacccgaaaaggggcctgtcgaggctaagcctgagtgtcaggaaactgaaaccaagcccgctcccgccgaagtgaaaaccgtcccgaacgacgctacgcagactaaggagaatgaaagtaaagcatag

SEQ ID NO: 31492 - DNA, 2181 bp, Artificial Sequence
  Description of Artificial Sequence: Synthetic coding sequence
atgctacagaccaaggacctgatttggactctgttcttcctgggaacagcagtgtcactgcaggtagacatcgttcctagtcagggcgagataagcgtgggcgagtcgaaattctttctctgtcaggtggcaggcgatgcgaaagataaggatatatcctggttctcaccgaatggcgagaaactgactccaaaccagcagagaatcagcgttgtgtggaacgacgactcctcctccacccttacaatctacaatgctaatatcgacgatgccgggatctacaagtgcgtggttactggggaagatggatcagaatctgaggccactgtgaacgtgaaaatttttcagaaattgatgttcaagaatgcaccaactcctcaggagtttcgcgaaggcgaggacgccgtgatcgtttgtgacgtggtctcttccttgccgcccaccatcatctggaagcacaaaggtcgcgacgttattctgaagaaagacgttcggttcattgtgctgtctaacaattacttacagattcgcggaatcaagaagacagacgaaggcacctaccgatgcgagggacgcatcctggcccggggagaaatcaactttaaagacatacaggtaatcgttaacgtcccgcccaccattcaggccagacaaaacattgttaacgctactgctaatcttggccagtccgttactctggtgtgtgacgcagagggatttcccgagcctaccatgtcttggacaaaggatggagaacagatcgaacaggaagaagacgatgagaaatatatctttagcgacgattcttctcagctgacaattaaaaaagttgacaagaacgatgaggcagagtatatctgtatcgcagaaaacaaagcgggcgagcaggatgctacaatccatttgaaagtgtttgcaaaaccaaagattacctatgttgaaaaccaaactgcgatggaactagaggagcaggtcactttaacctgcgaggcatcaggagaccccatccctagcatcacttggaggacttctacccggaacatctcttccgaagaaaaaacgctggacggacacatggtcgtccggtcccacgcaagggtttcttctctgactctgaaaagtatccagtatacagacgctggggagtacatttgtacagcctccaacaccatcggacaggatagccagtccatgtacttggaggttcaatacgctcccaagctgcagggtccagtcgcggtgtacacttgggaagggaaccaggtcaatatcacttgtgaggtgttcgcttacccttcagccactatttcatggtttcgggatggacagctgctgccaagtagcaattactctaatataaaaatctacaacacaccaagtgccagctacttagaagtgacgccagacagtgagaatgattttggaaattacaactgcacagccgttaatagaattgggcaggaatccctggaattcattctggtgcaggcagacactccatccagcccgtccatagaccaggttgaaccgtactcatcaactgctcaggtgcagtttgatgagccagaggcaacgggcggagtgcccatactcaagtacaaggcagaatggcgtgctgtaggtgaggaggtatggcattccaagtggtatgatgccaaagaagccagcatggaaggtattgtgaccatcgtagggctgaagcctgaaactacttatgccgtgagactggccgccctaaacggtaagggacttggggagatcagcgctgcgtctgagttcaaaacacagccagttcagggagagcctagcgctccaaaactggagggccagatgggggaggatgggaacagcatcaaggtgaatctgatcaagcaggatgacggaggctctccaatacgtcattatctggtgcggtacagggccctgagttctgagtggaaacctgagattagactgccgtctggctctgatcatgtgatgctgaagagccttgactggaatgcggagtacgaagtctacgtcgtcgctgagaaccaacaaggaaaatccaaagccgctcatttcgtgtttaggacgagtgcccagccgacggccattcccgccacactgggcggcaattctgcctcttatacgttcgtctcattgctgtttagcgctgtcacgcttcttctgttgtgctag

SEQ ID NO: 31493 - DNA, 2286 bp, Artificial Sequence
  Description of Artificial Sequence: Synthetic coding sequence
atgctgcaaacaaaggacctcatatggaccctgtttttcctgggcaccgctgtcagtctgcaggtggatatcgtgccaagccagggtgaaatctccgtgggggaaagtaagttcttcctgtgccaggttgccggggacgcaaaggataaggatatttcctggttttctcccaacggcgagaagttgactccgaaccagcaacgcattagtgtggtgtggaacgacgactccagttccaccctcactatctacaacgccaatattgacgacgcaggcatttacaaatgcgtggtgaccggagaggatggctctgagtcagaagccactgtgaatgtcaaaatcttccagaagttgatgttcaaaaatgcacccaccccgcaagagttccgagaaggagaggatgctgttatcgtttgcgatgtcgtgagctctctcccgccaaccatcatatggaagcacaaagggcgtgacgtcatccttaaaaaggacgttcggtttatagtcttgtctaataactacctgcagattcgcgggatcaaaaaaactgacgagggtacatacagatgtgaaggcaggatccttgctaggggcgaaatcaactttaaggatatccaggtcatagtgaacgtgcccccaactatccaggcccggcagaacatcgtgaatgccacggccaatctcggtcagagtgttactctggtgtgtgatgcagaaggctttcccgagcctacaatgtcttggaccaaagacggagagcagattgagcaggaggaagatgacgagaagtacatattttcagatgacagtagtcagctgacgattaaaaaggtggataagaatgacgaagcagaatacatctgtatcgcggaaaataaggcgggggaacaggacgcgaccatccacctgaaggttttcgccaaacctaagattacttacgtcgagaaccagactgcaatggaattggaggagcaagtgactttgacctgtgaagcttcaggtgacccaatcccctcaattacatggcgaacttcaacgcggaacatctccagtgaggaaaagaccctggacggccacatggtggtgcggtcccatgctagagtgtcaagccttacattgaagagcatccaatatactgacgccggagagtatatctgtacagctagcaacactataggccaggactcacagagcatgtacctcgaggtgcagtatgctccaaaactgcaggggccagttgctgtgtatacatgggaagggaatcaagtgaacattacatgtgaggtattcgcctatccaagtgccacgatcagttggttcagggacggccagttgctgccctcgagcaactactctaacataaagatttataacaccccttcagctagttacctggaagttacaccagacagcgagaacgacttcgggaattataattgtacagccgttaatcggataggacaggaatctctggaattcattctggtgcaggccgatactcccagctcaccatccatcgaccaagtggagccttatagttccaccgcccaggtccaattcgatgaacctgaagcaacaggtggagtgcctatactcaagtacaaagccgagtggcgcgccgtgggtgaggaggtgtggcattctaagtggtacgatgcgaaggaggcttccatggaaggaatagtgactattgtcggcctgaaaccagagaccacctatgccgttcgcttagcggcactgaacggtaagggcctcggcgaaattagtgcagctagtgaattcaagacacaaccagttcactcccctccgcctcccgccagtgcctcatcctccaccccagtgcccctctctcctcctgatactacctggcccctgcctgctctcgcaacaaccgaaccagcaaaaggcgagccctccgcgcccaaactggaagggcagatgggtgaagacggcaactcaatcaaggttaatttgatcaaacaagatgacggcggttcaccaattagacactatctcgtgagataccgggcgttgtcttctgagtggaaacccgagattcgattgccatcagggtctgaccacgtgatgcttaagagtctggattggaacgccgagtatgaagtatatgtggtggccgaaaaccagcagggtaagagcaaggcggcccacttcgtgttccgcactagtgcccagcctacagccattcccgccaccttggggggtaacagtgcatcatatacatttgtctcactgctctttagtgccgtgactctgctgctgttgtgttag

SEQ ID NO: 31494 - DNA, 1668 bp, Artificial Sequence
  Description of Artificial Sequence: Synthetic coding sequence
atgggcaatactgtgcatagaaccctacctgatccgtccccccccgctagactcctagcgacccgcccctgttgcgggcctggacccgagcggcggccagtgctcggtgaggccccccggttccacgctcaggctaagggcaagaatgtgcgtctggacggccactcacggcgcgccactcgaaggaatagtttttgtaacggagtgacctttacacagcgtcctatacgtctgtatgagcaggtccggctgcggcttgtcgctgtgcggcctggatggtctggggccttgagattcggatttactgcccatgacccctctttgatgtctgctcaggacataccaaagtatgcttgcccagacttggtcacccggcccgggtattgggcaaaggcgttgcctgagaacttagccctcagagacactgtgctggcgtactgggctgacagacatggacgtgtgttttattccgtcaatgatggcgaacccgtgttgttccattgcggggtagccgtgggcggtcccttgtgggcgctgattgatgtatacggtatcactgatgaagtccagttactagaatctgctttcgctgacaccctcacccccgctcggctaagccaggctcgctttagtgcctgcctgcctccatcctctcatgacgcagcgaatttcgacaataacgagctggaaaataatcaggtggtcgctaagctgggccaccttgccctcggaagggcccccggccccccccctgccgatgctgccgccgccgccatcccatgcggaccccgagagaggcccaggccagcaagttcccctgctctcctcgaggctgaccttaggttccatgctacccgaggcccagacgtctctttgagcgccgatcgcaaagtggcctgtgcacctaggcccgacgggggtagaacactggtgttttccgagaggcccctgcggccaggcgaatcactgttcgtggaagttgggagacccggtttagctgcacccggggcacttgcctttgggattaccagttgtgatcccggtgtgctgcgcccgaatgagctccccgcagatcctgacgctctcttggaccgaaaagagtactgggtagtggcacgggcagggcccgtacctagcggcggtgatgctttatcattcacactgagaccgggaggagatgttctcctaggtatcaatggtagaccgcgaggccggctcttatgtgtggataccactcaggctctgtgggctttcttcgccgtccgcggaggcgtagccgggcagctccgactgctggggaccctgcagtcatctcccgccactaccaccccttccggatctctaagcggctcgcaagatgactctgactctgatatgacattttctgtaaaccagtcaagctccgcaagtgaaagttcccttgttacggccccttcaagccccctttcacctcccgtctcaccagtgttctccccacctgagcctgcaggaattaagaacggagagtgcactgtctgcttcgacggcgaggtggatacggtcatctacacttgtgggcacatgtgcttgtgtcactcctgtggactgcggctgaaacggcaggcaagggcatgctgccctatctgtcgaaggccgattaaggatgtcatcaaaatatatcgcccatag

SEQ ID NO: 31495 - DNA, 4683 bp, Artificial Sequence
  Description of Artificial Sequence: Synthetic coding sequence
atggctgcgggaagtgggggctctggcgggagtggcggaggccctggtcctggccctggcggaggaggaggcccaagtgggtctggatcggggccagggtctaatgggggactagggtctgggggcgagctgcatcctcgtacaggcagattagtgtctcttagcgcttgtggacgcacggcgagaaggcaacagcccggccaggaatttaaccacggtttggtgttatcacgcgaacccctacgggacggtcgcgtattcactgttcgcatcgaccggaaggtgaacagctggagtggaagtatcgaaatcggggttactgcgttagatcctagcgtactggattttccttcatctgcaacggggctgaaggggggatcctgggtggtgtctggatgtagcgtcttgcgcgacggtcgatctgttctagaagagtacggacaagacttggatcaactgggcgaaggcgacagggttggagtcgagcgcacagtcgctggtgagctacgtttatgggtaaatggtcgtgattgcggggttgcagctacaggcctccccccacgcgtctgggctgtggtagatctgtacggtaaatgtactcagatcactgtgctgcctccagaacccgggttcagccctccaacccccattcctactcctccactggagccactcgcgccgactgaagattccgccctggccgaacaagggacatctgcagatgaggcctttatggtctctccggcacaggcacgtcccgagactttcccgaactccttagagagccacaatgacttcgccaacatggagctgtcagaagtggtctcaaatacaattttaagtgcctacaatggcggtcttctcaacgtgaatctttcctctcctcccgctggggagggactaggatccagcggtgctgcaacctcgcccatccttacctccaatgacgcattgctgtttcatgagaagtgcggcaccctgatcaaactatcaaacaacaacaagaccgcagaacggcggagacctctcgacgagttcaataatggagtcgtgatgacaaatcgtcctctgagggataacgaaatgttcgagatacgcatcgataagctggtggacaaatggagtggttcaatagaaatcggggtgactacgcataatccaaacagtttggagtaccccgctacaatgactaacctgcaaagcggtactattatgatgtctggctgcggtatcctgactaacggcaagggcacccgcagggaatattgtgagttcagcttagacgaattacaggaaggcgaccatattggtctcacccgcaaatcaaatagcgcactccactttttcatcaatggcattgaccagggagtggcaacacccctgacaccgccagtggtgtacggggttgtggacctgtatgggatggccgtgaaggttaccattgtacataacaacaatcattctgatcgtctccgcagaaacaatgctattcttcgggccctgagtcctgaaggagccctgagaagagccgcccctgccgcgcaagcagagcccgaacgacttctctttcatccaaattgtggtcagaaggccgctataacccatgagggacgaactgctctccggccacacgccacggacgatttcaaccacggggttgtcctgtcctccagggctctgagggacggtgaggtgttccaggtcaggattgataagatggttgacaaatgggcaggaagtattgaaattggtgtcacaacccataatcccgcgtatctgcagttgccttcaacaatgacgaatctgaggtccggcacctggatgatgacagggaacggggttatgcataatggcaccaccatcctggacgagtatggccacaatctggacagactcaaggccggggacactgtgggcgttgtgcggagggaggatggcaccctgcacttcttcgttaacggaatgacccagggccctgccgcatggaacgtgcccccgggggtgtatgcagtggtggatctgtacggacaagcggcccaggccacgattgttgacgacgtggaggtggcccctgtccccgagccactccccgagggtaataatcaggtttcgcctagtagcccaagttccggcgccggcggttctgacctcaggttccaccagctgcatggaagtaatgctgtgattaccaacggcgggcgcactgcgctgaggcacaattgtaggagcgaattcaacgatgccattgtaatatccaaccgagctctgcgcgacggtgaactctttgagatcgtgatccaaaagatggtggatcggtggtctggttccattgaagccggcgtgacagcaataagacctgaagatttggaattcccgaacactatgacagacattgactacgacacctggatgctcagcggcaccgccataatgcaggatggcaataccatgaggaacaattacggctgcgacttggatgcactgggcaccggagccaggattggcatgatgcggaccgctaagggggacttacattactttatcaatggtcaggaccagggcgccgcgtgttccgggctcccacctgaagtgtacgccgtggttgatttgtatgggcagtgtgtgcaggtttccattaccaacgctacggggcctatggataattccttagccacatcaaatacagctaccgagaaatctttcccactacactcacctgttgctggagtggcacacaggttccatagcacctgcgggaagaatgtaactctggaagaggacggtacacgcgccgttcgagccgcggggtacgctcatggcctcgttttttctactaaagagctgcgggcagaggaagtgtttgaggttaaggtggaggaacttgatgaaaagtgggcagggtcgttgcgcttgggactaacaactctggctcctggcgagatgggacctggagccggaggggggggccccggcctaccaccgtccctccctgagctccgaacaaagacaacttggatggtttcctcatgcgaggtgagaagagacgggcaactgcaaaggatgaactatggccggaacctggagaggctgggggtgggctcccgtgtgggtgttcgtcgcggagccgatgacaccatgcacatcctagttgacggggaggacatgggcccagctgccactggtattgccaaaaatgtgtgggcagtgctggacctctacggcccagttcgaggagtgtccatcgtgagctctacacggttggaggaaagcgagggaacgcagcctccttcgccgtccagtgacacaggtagcgaaggtgaggaggacgatgagggcgaagaacacggattagggggtcaaaacgaagttggcatcatcccaactaccctggaattcttggagaaccacggtaagaacattttgctgagtaacggtaataggacggcaacacgagtcgcctcttataaccagggcatagtcgtcattaaccagccactcgtccctcagctgctcgttcaggtgaggatcgacttcctcaaccgccagtggacgagtagtctcgtcctcggagtgataacctgtgccccggagcggttaaactttcccgcatcagcttgcgctctgaaacgcgctgcatggttgctaagaggaagaggggtgttccacaacggcctgaagatatgcgagaaattcggccccaacctagacacttgccccgagggtaccatattagggctacgactagattcctccggaggactccacctccacgtgaacggcgtggatcagggggtggcagtgccggacgtcccccaaccttgccacgcactggtggacttatacggccagtgcgagcaggtgacgattgttaaccccgaacctggcgccgcttcgggtaagtcagctgggacccagggtgatatggaaaaggcggacatggtcgacggaataaaggagtcagtttgttggggccctccaccggctgcaagccccctcaagtcgtgcgaataccacgcattgtgtagtcgcttccaggaactgctgctgttgcccgaagattattttatgccaccccccaaacggagtctgtgctattgtgaaagctgtcgtaagttgagaggggatgaagcacatagacgcaggggggaaccacccagagagtatgctttgccattcgggtggtgtaggtttaacctgcgcgttaatcctcgcttggaggccggcactttgaccaagaaatggcatatggcctaccacggttcaaacgtcgccgcagtgagaagggtcctcgaccgtggcgaactgggtgcaggcaccgcaagtattctcagttgccgtccactcaaaggggagcccggcgtgggctttgaagaaccgggcgagaactgcgcacctcccagggaggagcagcctccgcccgtgctgctgtccccttccctccagtacgcaggtgctgaaaccctcgcttctaaagtgcagttccgggatcccaagtcacagcgaacacatcaggcccaggtggcttttcaggtctgcgtcaggcctggatcctataccccaggtccaccatctgctgctctcggagaacctcctgatccccacttttctcccgccgagctggaatgggtgactaaggagaaaggtgccacattgctttgcgccctgctggttagagtcgagtag

SEQ ID NO: 31496 - DNA, 4689 bp, Artificial Sequence
  Description of Artificial Sequence: Synthetic coding sequence
atggccgccggaagtggcggctctggcggcagtggaggcggacctgggcccggacctgggggagggggtggcccaagcggctcaggttcaggaccgggttcgaacggcgggctggggtccgggggagagcttcacccacgcacaggtaggctggtcagcctgagcgcttgcggaaggactgcaagacgccagcagccagggcaagaattcaatcacggattggtgctaagccgtgaacccctgcgggacggtagggtgtttacagtccggatcgaccggaaggtaaatagttggagtgggtccatagaaatcggggtgacagcgctggatccctctgtgctcgactttcccagttccgcaactggtctgaaagggggaagctgggtagttagcggttgcagtgtactgagagacgggaggagtgtgcttgaggagtacggccaagacctcgatcagcttggagaaggagacagggtaggtgtggaacgcacagtggcaggggagttacgtctgtgggtgaacggtcgcgattgcggagtggccgccacaggcttgccaccaagagtctgggctgtagtagacttgtacggcaaatgcacacagatcacggttctccccccagagcccggtttctctccccctacgccaattcctacgccgccgctggaacccttggcacccaccgaggatagcgccctcgccgagcagggtacaagcgcggacgaagctttcatggtatcacccgctcaagcccgacctgagactttccctaattcactcgaaagccacaacgacttcgccaatatggagctgtccgaggttgtgtccaatacaatactaagtgcttacaatggaggcctactgaacgtcaatctgtcaagcccacctgccggagaaggcctaggctccagcggcgccgctacctcccccattcttactagtaatgacgcgcttctgttccacgagaaatgcggcacccttatcaagcttagcaataataacaaaaccgctgaaagacggcgcccactggatgaatttaacaatggggtcgtcatgacgaacaggcccctgagggataacgaaatgtttgagattcgcatcgacaagctggtggacaaatggtctggttctattgagatcggagttacaacacacaatccaaactccctggagtaccctgccaccatgaccaacctgcagagtggaaccattatgatgagcggctgtggtatactcacaaacggtaagggcacacggcgtgaatactgcgagttcagcctggacgagctgcaagaaggggatcatatcggcttgacacggaaaagtaattccgccttgcatttctttattaacggcatagaccaaggggtcgcgacaccgcttacaccgccagtggtctacggcgtggtagatctgtacggcatggctgtaaaagtgacaatcgtacacaataataaccattcagatcgtctgcgaagaaacaacgcaatattgagggccctctcgccggaaggagcccttcgacgggccgcacctgcagcccaggcggagccggaaaggctgctgtttcacccgaactgcgggcagaaggccgcaattacacatgagggaagaacggccttgcgcccgcacgcaacagacgactttaatcacggggtggtactctcttccagggcgctcagggatggtgaagtgtttcaggtgcgtatagacaagatggtggataagtgggccggtagcattgaaatcggagtcacaacacataatcccgcgtacctacagctccctagcactatgaccaacttaaggagcggcacatggatgatgacgggaaatggggtgatgcataacgggacaacaatcttagacgagtatggccacaatcttgatagactcaaggccggagatacagttggtgtcgtccggcgcgaagacggaacactccatttctttgtgaatgggatgacccaaggcccagccgcctggaatgtgcccccaggggtatacgccgttgtcgatctgtacgggcaagccgctcaggcaaccatcgtagacgatgtggaggtcgcacctgttccagagccgctgcctgagggcaacaaccaagtgagtccaagctcaccctctagcggggcaggtggctccgaccttcggttccaccagctgcatggctccaacgcagtcatcaccaacgggggaagaaccgctctgcgtcacaactgccggagcgaatttaacgacgcgatcgtcatcagtaatagagccttgcgggacggggaactgttcgagatcgtgatacaaaagatggtggacaggtggagcggaagcattgaggccggggtgaccgcgattagaccagaggacctggaatttcctaacacaatgaccgatatcgattatgacacctggatgctctccgggacagcaattatgcaggacggcaatacgatgagaaataattatggctgtgatcttgacgcgctgggcacgggcgcccgcataggcatgatgagaacagctaagggcgacctgcactatttcattaacggccaagatcagggtgccgcgtgttctgggcttcctccaggcaaggaagtctacgccgtagtggatttatacgggcagtgtgttcaggtgagcattaccaacgcgactgggcccatggacaacagcctggctacttccaacactgccactgaaaaatccttcccacttcattctccagtggcaggggtggcacacagattccattcaacctgcggaaagaatgtgacccttgaggaggacggaacccgcgccgtgcgggcagcgggctacgcccatggcctggtgttcagcaccaaagagctccgcgccgaggaggtgtttgaggtgaaagtggaggaactggacgaaaaatgggccgggagtctgcgccttggcctgactacccttgctcccggtgagatgggccctggagctggtggaggagggcccgggctgcccccatccctccctgagttgaggacaaagaccacatggatggtctctagctgtgaggttcggagggatggccagctgcagcgcatgaactatggtaggaacctggaaaggctcggagtgggctctcgagtgggggttagaaggggtgcagatgacactatgcatatcctggttgacggggaggatatggggcccgccgctaccggtattgccaagaacgtgtgggcggtgctggacttatacgggcccgttaggggggtcagcattgtgtccagtacacgtttagaggagagtgaaggcacccaaccacccagtccgtctagcgacacagggtcagaaggagaagaagatgatgaaggagaagagcacgggctgggagggcaaaacgaggtgggtatcatacctacaacactggagtttctcgagaatcacggtaagaatatattgctgagcaacggtaacagaaccgcgactagagtggcctcttacaatcaaggcatcgtggtgatcaaccagcctctggttccacagctattggtacaggtgcggatcgatttcctgaaccgccagtggacttcaagcttggtattgggagtgatcacctgcgctccagaacgcctgaacttcccagccagtgcttgcgccttgaagcgggcagcatggctcctgcgaggcagaggggttttccacaatgggttaaagatatgcgagaaatttggaccaaatttggatacctgtccagaagggaccatcttgggcctccgcctggacagctctggtggcttgcacctacacgtaaacggtgttgatcagggcgtggccgtgcccgatgtgcctcagccatgccatgctctggtggacttatacggtcaatgcgagcaagtgacaattgtgaatcctgaaccgggggctgcctctggtaagtccgctgggacccagggggatatggagaaagcagacatggtggacgggatcaaggaatctgtgtgctggggtcctccccctgctgcttctcctctcaaatcttgcgaataccacgcactttgtagtcgctttcaggagctgcttttgctgccagaggactacttcatgccgcctccgaagaggtcactgtgctactgtgaatcatgccggaagcttaggggcgacgaggctcatcgcaggcggggtgagcctccccgcgagtatgccctgccttttgggtggtgcaggttcaatctgagagttaaccctcgactggaagccgggacgttgacgaaaaaatggcacatggcatatcatggctcaaacgtcgctgcggtgaggagggtcctcgatagaggcgagctcggggccggaaccgcttcgatactgtcctgccgcccactcaaaggcgagccaggggtcggctttgaggagcccggagagaactgcgcaccccccagagaagagcagcctccacccgtgctgctgtcccccagtctacagtatgctggcgctgagacccttgccagcaaggttcagtttagagatccaaagtcgcagcgcactcaccaggcccaggtggcgttccaggtgtgcgtaaggccaggctcatataccccgggacccccttctgccgctcttggagagccaccggatccacatttcagtcctgcagaactggagtgggtaaccaaggagaagggtgccacccttctgtgcgctctgctagtccgtgtcgagtag

SEQ ID NO: 31497 - DNA, 2760 bp, Artificial Sequence
  Description of Artificial Sequence: Synthetic coding sequence
atggtcaaacagaataacatcatccccggggagacccagattcttctgcgatttacaggatgggaatcgaaggtcaacgctaagaaacagcttccagtgggcatcaagtgcgagcccatggaccaggttccagactctacttcctcagcgacaaacgtgtccatggtggtgagcgccggaccttggtcctctgaaaaagctgaaatgaacatcctggagattaatgagaaactccgtccgcagcttgcagaaaataagcagcagttcagaaatctcaaagagcggtgcttcctgactcagttggccggcttcctggccaacagacagaagaaatacaaatacgaagaatgtaaagacctgattaagtttatgcttagaaacgaaagacagtttaaggaggagaagctggctgagcagcttaagcaggcagaagagctgaggcaatacaaagtcttggttcattctcaggaacgagagctcacacaattgcgggagaagctgagggaaggtagagacgcctcaagatcccttaatgagcatctgcaagctctcctcacccctgatgaacccgataaaagtcaggggcaggacttgcaggaacaactggctgagggttgccgactggctcagcatttagtgcagaaattgagccccgaaaatgatgaagacgaggacgaggatgtgcaggtagaagaagatgaaaaggtgctggagtctagtgccccgagggaagtacagaaagctgaagagagcaaggttcccgaagattccttggaggagtgtgccataacttgcagcaattctcatgggccttgtgatagtatccagcctcacaagaacattaagattacattcgaagaagacaaagtgaactcctccctggtagttgacagagagagctctcatgacggatgtcaggacgcgctgaacatactgcccgttcctggtcctaccagttccgctaccaatgttagtatggtggtgtctgccgggccattgtccagcgagaaagcagagatgaatatcctggagattaacgagaagctgtgtcctcaattggccgaaaaaaagcagcagttccgctctcttaaagaaaaatgctttgtcactcaggtggcttgctttctggccaaacagcagaacaagtacaagtacgaggagtgtaaggatctgataaaatcaatgctgagaaacgaacggcagttcaaggaagaaaagttagcagagcagctgaaacaagctgaggaactgcggcagtacaaggtgttggtgcatagccaggaaagagaactgacgcagcttagggaaaagttacgggaaggccgagatgcatctcgatctctgaacgaacacctgcaggcattgttgactcccgacgagcccgataagagtcagggacaggatcttcaggagcagctagcagagggctgtcggctggcccagcacctagttcagaaactgagcccagagaatgataatgacgacgacgaagatgtccaagtcgaagtggccgagaaggtacagaaatctagtagcccaagggaaatgcagaaggcagaggagaaggaagtcccagaggatagcctagaggaatgtgccattacttgctccaacagccatggaccctatgacagcaaccagccacaccgtaagacaaagataacctttgaggaagataaggtagacagcactcttatcggatcttcatctcacgtcgaatgggaggacgccgtgcacattatacctgagaacgagagcgatgacgaagaggaggaggaaaaaggccctgtgagccctcgcaacctgcaggagtccgaagaagaagaagtgccccaggaaagctgggatgagggctatagcacactatctatccctccagaaaggctggcttcttaccagagttacagcagcacatttcattccctggaggaacagcaggtgtgtatggccgttgacatagggcggcacagatgggatcaggtaaaaaaagaggaccaggaagctactggccccagactttctagggagctgttagacgaaaaagaaccagaggtccttcaggattcgctcgatcgttgttacagcaccccctccgtgtatctagggttaaccgactcctgtcaaccttatcggagtgctttctacgtccttgagcagcagaggatagggctggccgtggatatggacgagatagaaaagtaccaagaagtggaggaggaccaggacccaagctgtcctcgcctctccagggaacttttggcagaaaaggagccagaggtgttgcaggattccctcgataggtgttattccactcctagtggctacctggaattaccagatctgggacagccataccgaagcgctgtgtactcgctcgaggagcagtatctcggactcgcactcgatgtggaccgaatcaagaaagatcaggaagaggaagaggaccaggggcctccctgtccacgcctcagcagagagctcctggaggttgtggaacccgaagttttacaagactcactggacgtgatccaattacttccggttgtactgaactccctcacacccgcctcgccaaccgaagtgccatttatgcactggagaaagaacatgctggccttcctgctgacttgggaaaaactcaaacggagaggccggggtcggaaagaaggggaggaggatcaaaggcgtaaagaagagggtgaagaaaagaaaggcaaaaagattaaaacacatcacgcacctggcagcgctgcatgttag

SEQ ID NO: 31498 - DNA, 2373 bp, Artificial Sequence
  Description of Artificial Sequence: Synthetic coding sequence
atgttctccaatagcacagggagactacctggccagccgacacaagaaatacagcagtataaagtgctagtgcactctcaagaacgcgagcttacacaattgagggaaaagctgcgggagggtagagacgccagtagatcactcaacgaacaccttcaagcccttttaactcccgacgagccagacaagagtcagggtcaggacctgcaagagcagctggcagaggggtgtcgtttggcacaacacttggtacaaaagctgtccccagagaatgatgaggatgaggacgaagatgtccaggttgaggaggacgaaaaggttttagagtcttcagcaccacgggaggtccaaaaagccgaggagagcaaggtccctgaggatagtctggaagagtgcgccatcacatgttcaaattctcacggaccttgcgactccattcaacctcacaaaaacatcaagatcacttttgaagaagacaaggtgaatagcagtttagtggtggaccgagagagctctcacgacgggtgccaagatgcactgaacattctgccagttcctggccccacctcctctgcgaccaacgtgagtatggtagtgtccgcaggcccactgagcagcgaaaaggccgaaatgaacattttagagattaacgaaaagctgtgtccacaacttgcagagaaaaaacagcagtttagaagtctcaaggagaagtgcttcgtgactcaagtggcttgtttcttggccaaacagcagaataagtataagtacgaggaatgtaaggacctgatcaagtccatgctgaggaacgagcgacagttcaaggaggagaagttggctgagcagctgaagcaagccgaagagctacggcagtacaaagtgctggtgcactcacaggagcgggagttgactcagctcagagagaagctccgggaagggcgggacgcctcaaggagtctgaatgaacacttgcaggcgctgctgactcccgatgagccagataaatcccagggccaggacttgcaggagcagttagcagaagggtgtcgattggcacaacatctagtgcagaaactaagtccagaaaacgacaacgacgacgacgaagatgtgcaggtcgaagtggcggagaaagtgcagaaaagctcctctcccagagaaatgcagaaagcagaagaaaaagaggtgccagaagactccttggaagaatgcgccatcacctgttccaactcccatggaccctacgacagtaatcagccacatcgtaaaacaaaaattacattcgaggaagacaaggtagactccaccctgatagggtcctcatctcacgtcgagtgggaagacgcggtccacatcatccctgagaacgaatctgatgacgaagaggaagaggaaaaggggccagtttctcccaggaatcttcaggaaagtgaggaggaggaagtgcctcaggaatcatgggatgagggctactctaccctgtccataccccctgaacgacttgcctcctaccagtcctacagtagtacattccatagcctcgaggagcaacaggtctgtatggccgtagacattggtagacaccgctgggaccaggtgaaaaaagaagatcaggaagcaaccggtccacggcttagcagagagctgctagatgagaaggaacccgaagttctgcaggacagtctagatcgctgctactctacacccagtgtatacttgggactgacggatagttgccagccttaccgctctgcgttctatgttctggagcaacaacgtatcggcctggcggtcgatatggacgagattgaaaaatatcaggaggtggaagaggaccaggacccttcatgtccacgcctctcacgcgaactgctggcggaaaaggagcccgaggttctgcaagactcgctggacagatgttactcgacccccagcggctatctcgaactccctgatctaggtcagccttaccgctcggccgtatattccctggaggagcagtatctcggccttgcactggacgttgatcgcatcaagaaagatcaggaggaagaagaggaccagggcccgccttgcccaaggttgtcaagggagctgctggaggtagtggagcctgaggttctgcaggacagcctggatgtgattcagctattgcctgtcgtgttaaactcactgaccccagcctcaccgactgaagttcccttcatgcattggcggaagaatatgctagcctttttgctgacatgggagaaacttaagagacgcggccgggggaggaaggagggggaagaggatcagcgtagaaaagaggagggggaggagaaaaaaggtaaaaaaatcaagacccatcacgcacctggctccgctgcttgctag

SEQ ID NO: 31499 - DNA, 1101 bp, Artificial Sequence
  Description of Artificial Sequence: Synthetic coding sequence
ctggcaagttatcaatcttacagttccacctttcactcgttggaagagcagcaggtgtgcatggccgtggatataggacgacaccggtgggaccaggtcaagaaggaggatcaggaagctactggcccgaggctcagtcgcgaactcttagatgaaaaagaacccgaggtcctccaagactctcttgataggtgttactccactccctccgtgtacctgggccttacagactcttgtcagccctaccgctccgcgttttatgttctcgaacagcagagaatcgggcttgccgttgatatggatgaaatagaaaagtaccaggaggttgaagaagaccaggatccctcttgcccaaggctgagccgggaacttctggccgaaaaggaaccggaggtattgcaggattcacttgaccgttgctactcaactccgagtggttacctcgagcttcccgacctggggcagccatatcggagcgccgtatactccctggaggaacagtatctcggcttggccctggacgtcgacaggattaagaaggaccaggaagaggaagaagatcaggggcccccatgccctaggctttccagggaactgctcgaggtggtggagcccgaggtacttcaggactctctgtgctatagcactccatcatcatgccttgagcagcctgactcttgtcaaccatatggcagtagcttttatgctctcgaagaaaagcacgtgggcttctctctcgatgttggcgaaatagagaaaaaaggcaaaggtaagaaaaggcgcggccgaagatccaaaaaaaagaggaggcgggggagaaaagagggggaggaagatcaaaacccaccatgcccaagactttcttcagttctcatggaagtcgaagtgcccgaggttttacaggacagtctggatagatactattctaccccttccatgtatttcgaactgcccgactcatttcaacattaccgatccgtgttttattctttcgaagagcagcatatttcttttgctctcgacatggacaaccgttttttcaccctgaccgtgcgatctctacatctggtgtttcagatgggagtaatatttccccaatag

SEQ ID NO: 31500 - DNA, 2517 bp, Artificial Sequence
  Description of Artificial Sequence: Synthetic coding sequence
atggttgtgagtgccggaccgtggtcgagcgagaaggcagagatgaacattctcgagataaacgagaagctcagaccccaactggcagagaacaagcagcagtttcggaacttgaaggagaggtgctttctcacccagctggctggctttttggccaaccgccataaaaaatataagtatgaagaatgcaaggacctgattaagttcatgttacgcaatgagcgccaattcaaggaggaaaagctggccgagcagctgaaacaggccgaagaattacgccagtacaaggttctagtacacagtcaggagcgggagctgacacaactccgagagaagctgagggagggaagagacgcatcgcggagccttaacgagcacctgcaagcccttctcactccagatgagcccgataaaagtcagggccaggaccttcaggagcagctcgccgaggggtgtagactagcccagcacctcgtacagaaactgagccctgagaacgatgaggatgaggacgaagacgtgcaggtggaagaagacgagaaggtcttagagtcatcggcaccccgcgaggttcaaaaggcggaagaatctaaagtgcccgaagactcactggaggagtgtgcgatcacatgctccaatagccacggcccttgtgattccattcaaccccataaaaacattaaaataaccttcgaagaggacaaagtaaatagcagcttggtggtggatcgcgagagttcccacgacgggtgtcaggatgctctgaacattctaccagtgcccggcccgactagttcggcaactaatgtgtcaatggtagtttcagctggtcccctatcatcagagaaagctgagatgaacattttggagatcaatgagaagctttgcccccagctggcggaaaaaaagcagcaattcagatctttgaaggaaaagtgctttgttactcaggtagcctgcttcctggccaaacagcagaataagtacaaatacgaagagtgcaaggacttgattaagtcgatgttacgcaacgagcgtcaattcaaagaagagaagctcgctgagcagctgaagcaggcggaggaactgcgacaatacaaggtgctggtccattctcaggagagggagctgacccagctgagggagaagttgcgcgaaggacgcgacgcgagtaggtctctaaacgaacacctccaggccctgctgacacctgatgaaccagataagagccaaggtcaagatttgcaagagcagttggccgaggggtgtcgccttgcccaacatctggtccagaaactatcacccgagaatgacaacgatgacgacgaagacgttcaggttgaggttgctgaaaaggtccagaagagcagttccccacgggagatgcagaaggcagaagagaaagaggttcctgaggactccctcgaggaatgcgccatcacctgcagcaactcccatggtccctacgattccaatcagcctcaccgcaaacctaaaagccatctcagaaagactaaatccactcagttgtctctagcccaccccctaatgctaaacggcagaatgctgtatacactcagccagaagatgaaggtcatgatgaggaaacgaaagaagaaggggcaatgcttgcccggcatttgtagatctctgaaacggcggaaaagtccaaggagcccaggaatgaaggttattagactctctcagtttctacttaaagggcacaggtgggaccaggtgaagaaggaagatcaggaagccacagggcccagactgtcaagggaactcctggatgagaaagagcccgaggttttgcaggacagtctggataggtgctatagcactccttctgtgtatctgggactgactgattcatgccagccctaccggtcagctttctacgtacttgagcagcagcgtattggcttggctgtggacatggatgaaattgagaagtatcaggaagtcgaggaagatcaagacccctcttgcccaagactgtcacgcgaactcttggccgagaaggagccagaggtgctgcaggacagcctcgatcgctgttacagtacaccaagtggatacctggaactgcccgacctcggtcaaccttaccggagtgccgtgtattccctggaggagcagtacttaggccttgctttggatgtggaccgcattaagaaagatcaagaagaagaggaggatcagggacctccctgtccgagactgtccagggagcttctcgaggttgtggaacccgaggtcctccaggactccttagacgttattcaactattaccagtggttctgaatagtttgacccctgcatcccccactgaggtgccctttatgcactggagaaaaaacatgctggcgttcctcctgacttgggagaagctgaaacgcaggggcagggggaggaaggagggggaggaggatcagagaaggaaagaggagggagaagagaagaagggcaagaagattaaaacccatcatgcacccgggagtgccgcctgctag

SEQ ID NO: 31501 - DNA, 258 bp, Artificial Sequence
  Description of Artificial Sequence: Synthetic coding sequence
gagatgcaaaaagccgaggaaaaagaggtgccggaggacagcttggaggaatgtgcaattacctgcagtaacagccacggaccttacgacagtaatcagcctcaccgcaagaccaaaattacgttcgaggaggacaaagtagatagcaccctgattggatcgagttctcacgtcgagtgggaggatgcagtgcacatcattccagagaacgaaagcgacgatgaggaggaagaggaaaagggacctgtgtccccgtag

SEQ ID NO: 31502 - DNA, 3570 bp, Artificial Sequence
  Description of Artificial Sequence: Synthetic coding sequence
atggctagacagccacctcctccctgggtgcacgcagctttcctcctatgtcttttgtccctaggaggtgcaatcgaaatcccaatggatctgactcagccaccgaccattacaaagcagagcgccaaggaccacatcgtagaccctagagacaacattctcatcgaatgcgaggccaagggcaaccccgctccttctttccattggactaggaattcgcgctttttcaacatcgccaaagacccacgcgtgtccatgcgtcgacggtcaggtaccctggtgatcgattttcggtccggggggcgccctgaggaatacgagggggagtaccagtgtttcgctaggaataagtttggaacagccttaagtaatcgtatccgcctgcaagtgtcaaaaagtcctctgtggcctaaagagaacttggatccagtggtggttcaggaaggcgcccccctgaccctgcagtgcaacccaccacctgggctgccctcccccgtgatcttttggatgtcttcgtctatggaacccataacacaggataagcgggttagtcagggacataatggagacctgtactttagtaacgtgatgctgcaagacatgcagacagactactcttgcaatgcccgcttccatttcactcatacaatccagcaaaaaaatcctttcaccctgaaagtgctgacaaatcatccctacaatgatagcagcttgcgtaaccacccagacatgtattcagcacggggagtggccgagcgcaccccatcttttatgtacccacagggcacagcctcaagtcaaatggtactgcgcggaatggatttgctactggagtgtatcgccagtggagttccaaccccagacatagcgtggtataaaaaaggcggggacctgcctagcgacaaggccaagttcgaaaactttaacaaagccctccggataaccaatgtctccgaagaggattctggtgaatatttttgcttggcttctaataagatgggctcgattcgccataccatatcagtgagggtgaaagcagctccctattggctggatgaacctaaaaatctcattctggcacctggtgaggatggccggctggtgtgccgtgcaaatggaaatcctaaaccaaccgttcagtggatggtaaatggagaaccccttcagagcgcgcccccgaaccctaaccgggaagtagccggcgacaccattatctttagagatacccagatcagctcccgagctgtttaccaatgtaacacgagtaatgaacacggatatctgctagcaaatgctttcgtttcagtcctggatgtcccgcccaggatgctgagccccaggaatcagctcattcgtgtgattctctacaatagaacgcgcctggactgccctttttttggcagcccaatacctaccctgcgatggttcaagaacggccagggcagtaacctagacggcgggaattatcacgtgtacgaaaacggatcactggagattaagatgatccggaaggaggaccaaggcatttatacttgtgtggctaccaatatcctaggtaaagcggaaaatcaagtccgtctggaggtcaaggacccaacaagaatctacagaatgccagaggaccaagtagccagacgcggaacaacagtgcagcttgagtgtagagtgaaacacgacccttcactgaagttaactgtcagttggttgaaggacgatgagcctctttacataggaaaccgtatgaaaaaagaagacgactccctgactatcttcggagtcgcagagcgggaccagggatcgtatacctgtgtggcaagcacagagctggaccaggatctggcaaaagcttatctgaccgtcctggcggatcaggcaactccgactaaccgactcgccgctcttcctaaaggtcggccagataggccgagggaccttgaattgactgatctcgcagagagatctgtgaggctgacttggattccgggagatgcaaacaacagcccgattaccgactacgtggtccagttcgaggaggatcaatttcaacctggagtgtggcacgatcattccaagtaccccggcagtgtgaactctgccgttctccgcctgagcccttacgtcaactaccaattcagagtgatcgccatcaacgaggttggtagctcccacccctccctcccatctgaaagataccgaacgagcggggcccctcctgagagcaatcctggcgacgttaaaggcgaaggaacaagaaagaataacatggagatcacatggactccaatgaatgctacatcagcattcggccctaacctgcggtacatcgtgaagtggagacggcgcgagacccgcgaggcctggaacaacgtcactgtgtggggtagccggtacgtcgtgggtcagaccccagtttatgttccttacgaaatacgggtgcaggcagaaaatgacttcggtaaggggcctgaacctgagtctgtgatcgggtacagcggcgaggactatcctagagcagccccaaccgaagtgaaagtacgagtcatgaattcaaccgctataagtttgcagtggaacagggtatatagtgacactgtgcaggggcagttacgcgaatacagggcttactactggcgggagtcatcacttttaaaaaacctctgggtgagccaaaaacgccagcaagcctctttcccaggcgacagacttcggggcgttgtgagccgcctgttcccctattcgaactataagcttgaaatggttgtagtgaatggacgcggtgacggtccacggtcggaaacaaaggagtttaccacacctgaaggcgtcccaagtgcaccccgacggttccgggtcagacagccaaatctggagaccatcaatttagagtgggatcatccggaacaccccaatggaatcatgatcgggtatacacttaaatatgttgcttttaatggaactaaagtggggaaacagatcgtggaaaattttagccccaatcaaactaagttcaccgtacagagaactgatccggtgagtagatatcgctttacattaagtgcccgcactcaagtcgggtcgggcgaggccgtgaccgaggagtctccggcacccccaaacgaggggtctcccctagcagcctacactaacaaccaggcggatatcgctactcagggatggttcattgggctcatgtgtgccatcgccctgctcgtcctcattcttttgattgtgtgttttatcaagcgtagcagaggagggaaataccccgtcagagagaagaaggacgtaccgctgggtccagaagatcctaaggaggaagacggatcattcgactactccgacgaagacaataagccccttcaagggagccagacatccttagacggaacgatcaaacagcaagagagcgacgattcactggtggattatggggagggcggggagggccagtttaacgaagacggctcctttattgggcagtacactgttaaaaaagataaggaggagacggagggcaatgaatccagtgaggctacatcccctgtcaatgcaatctactctcttgcttag

SEQ ID NO: 31503 - DNA, 3774 bp, Artificial Sequence
  Description of Artificial Sequence: Synthetic coding sequence
atggcccgacagccgccaccaccatgggtgcacgcagccttcttgctgtgcttgctgtccctaggtggtgccatcgagattcctatggacccaaatcctcagcacagattgactcagcctcccactataaccaaacagtcggccaaggaccatattgtcgacccacgggacaacattctcatcgagtgtgaggctaagggaaatcccgccccaagctttcactggactcgaaactctcgctttttcaacatcgccaaggacccacgggtcagcatgcgccgtcggtccggaacccttgtgatagacttcaggtctggcggtaggcccgaggaatatgagggtgagtaccagtgctttgcccggaataaatttggaacagcattatcgaacaggataaggctgcaagtttccaagtctccgttgtggcctaaagaaaatttagaccccgttgtggtgcaggaaggcgctcccttaaccctgcagtgcaaccccccacccggcttaccctcacccgtgatcttctggatgagcagttccatggagccaatcactcaggacaagagggtgagtcaaggccacaacggcgacctctacttttcaaacgtgatgctgcaagacatgcagacagactactcttgtaatgctcggttccatttcacacacaccatccaacaaaaaaacccattcacactgaaagtcctcaccactaggggcgtcgctgaacgaacccctagcttcatgtatccacagggcactgcatcttcgcagatggtgctccgtgggatggacctgcttttggagtgcatcgcttccggcgtgcctacacccgatattgcatggtacaagaaaggaggggatctgccctctgataaagcgaagttcgagaatttcaacaaggctctgagaatcacaaacgtgtctgaagaggattctggagagtacttctgcctggctagcaacaaaatgggctccatccgccataccatatctgttagggtcaaggccgccccctattggctggatgaaccaaaaaacctgattctcgctcctggcgaggatgggcgattagtctgcagagctaatggcaacccaaagcctaccgtgcagtggatggtgaacggggaaccccttcagtccgcgccacctaatcctaatcgcgaggtggcgggcgacacaattatcttccgagacacacagatttccagcagagccgtctaccagtgtaatacttctaatgagcacggctacctgttggctaatgccttcgtttcagtgctcgatgtgcctcctagaatgctgagtccgagaaaccagttgattcgggttatcctatacaatcgtacccgcctagattgtccgtttttcggaagcccaatcccaacactgcggtggtttaagaacggacaggggagtaatttagatggcggaaactaccatgtctacgagaatgggagcctggagatcaagatgatccgaaaagaggaccagggcatctatacgtgcgttgcaacgaatatcctcggcaaggctgaaaatcaggtacgtctggaggtaaaggacccaacgagaatatatcggatgcccgaggaccaggtggcgagaagaggtactaccgtacagctggaatgcagggtcaagcacgatccaagccttaaactcacagttagctggctgaaagatgatgaacccctttatattggcaatagaatgaagaaagaggatgattctctgactatttttggcgtggccgagagagaccaggggagctatacatgcgtggcaagcacagaactcgatcaggatttagcaaaggcttacctgaccgttctggcagatcaagctactcctactaaccggctggcagccttacctaagggtaggcccgataggccaagggaccttgagcttaccgatctggccgagcgcagcgtcagactgacatggatccctggagatgccaacaacagtccaataactgactatgtggtccagtttgaggaagaccagttccaaccaggtgtctggcatgatcactctaaataccccggcagcgtaaactctgcagttcttcgcctctcaccctacgtgaattaccaattcagagttattgctatcaacgaggtcggttcctcacatcccagtctgccaagcgaaaggtacaggaccagcggcgcaccacccgagtccaatccaggcgacgtgaaaggcgaaggtaccaggaaaaataacatggagatcacgtggacccccatgaacgccacaagtgcattcgggcctaatctgcgatatatcgtcaagtggagaaggagagagacccgagaggcctggaacaacgtcactgtttggggctccaggtatgtcgtcggccagactccagtatacgtaccatatgagatccgggtccaggccgagaatgactttggcaagggacctgaaccagaaagtgtcataggctatagcggagaagattatcctcgtgccgcccccacagaagtgaaagtcagggtcatgaactctaccgccatatcgttacaatggaatcgggtatattctgacaccgtgcagggccagcttagagaatatagggcctactactggagagaaagcagtttactgaaaaatttgtgggtgtcacagaagagacagcaggcatcattccctggagatagattgaggggggtggtgtcaaggttgttcccttattcaaactacaagcttgagatggttgtcgtcaacggtcggggcgacggacctaggtctgagacaaaggaatttactacccccgagggagtaccctctgcacctcgccggttccgggtgcgtcagcccaacctggaaacaataaatctggagtgggatcacccggaacaccctaacggcatcatgattggctacacccttaaatacgttgcattcaacggaactaaggtcggaaagcagatagtagaaaactttagccccaatcagactaagttcacagtgcagcggacggatcccgtctcccggtatcggtttactttgtctgcgagaacacaggtcggatctggcgaggccgttactgaggagtcccctgcgccacctaacgagggaagtcccgttatgagtccacctaccctgcctcccacaaccgtgggggccacgggcgcggtgtcgagcaccgatgccaccgccatagccgctactactgaagctacaacggttccaatcatccccactgttgcaccaaccacaattgcaactacaactactgtggccactactacaacaaccaccgccgccgcaacaaccactaccgagtctccacccaccactacttcggggaccaaaatccatgagtcagcttacaccaacaaccaggccgatattgcaacccagggttggttcattggactgatgtgtgcgatcgcgctcctggtgttgatcttattgatcgtatgtttcataaaacgaagccgcggtggcaagtatcctgtgcgcgagaagaaagatgtgcccctgggccccgaagacccgaaagaagaggatggcagcttcgactactctgacgaggacaataaaccactgcagggctcacagacttcacttgacggcaccattaaacagcaggagtctgatgattctctggtggattatggggaaggaggggaagggcagttcaacgaggatggcagctttataggccagtacaccgtgaaaaaggacaaagaggaaaccgagggcaatgaatcgtctgaggccacgtcacccgtaaacgccatctattctctggcttag

SEQ ID NO: 31504 - DNA, 3675 bp, Artificial Sequence
  Description of Artificial Sequence: Synthetic coding sequence
atggcacgccagccccctcctccttgggtgcacgctgctttcttgctctgtctgctctctttgggtggagcaatcgaaatacccatggatccaaatccccagcatcgactgacccagccccctacaataaccaagcagagcgccaaggaccatattgtcgacccgcgagacaacattctcatcgaatgtgaggccaagggaaaccccgctccctcattccattggacaagaaattcacgattttttaatattgctaaagatccacgagttagtatgagacgtagatcgggcacactggtgatagattttagatccggtggcaggcctgaggagtacgagggcgaatatcagtgttttgcccggaacaaattcgggaccgctctgagcaacagaattcggttgcaggtgtccaaatccccattgtggccgaaggagaacttagatcccgtcgtcgtacaggaaggcgcaccccttaccctgcagtgtaacccaccgcctggtctcccaagccctgtcatcttctggatgagcagctccatggaaccaatcacccaggacaagcgggtgagccagggacacaacggagacctctacttcagcaacgtaatgctgcaggatatgcagactgactatagctgtaatgcccgtttccactttactcatactattcaacagaagaatccatttaccttgaaagtactgactacaaggggcgtggcggaaaggaccccctctttcatgtaccctcagggaactgcaagcagccagatggtgcttcgcggcatggatctgttgttggaatgcattgcgtccggtgtccccacacccgacattgcatggtacaagaaaggaggcgatctgccctcagacaaggccaaattcgagaattttaataaagctttgcgcatcactaacgtcagcgaagaggactctggcgagtatttctgcctagcctcgaataagatgggctcaattcgccacactatcagcgttcgtgtgaaagctgctccgtattggttggatgaacctaagaacctcatcctggcccctggggaagacgggaggctcgtctgcagagcaaatgggaatccgaaacccacagtgcaatggatggttaacggggaacccctacaatccgctcctccaaacccaaatagagaagtggctggggatactattattttccgtgatacacagatatcgtcaagagctgtttaccaatgcaatacttcaaatgagcatggttatcttctagccaatgctttcgtatccgtcctcgacgtgcccccgcggatgctcagtcccagaaaccagctcattcgggtgatactctacaacaggactagacttgactgtcctttttttgggtcgcccattcctacattgcgctggttcaaaaacggccagggtagtaatctggacggtggcaattatcacgtatatgaaaacgggagcctagaaataaagatgatcagaaaagaggaccaggggatctacacctgcgtggccactaatatcctggggaaagcggaaaatcaggtgcgactagaggtgaaagaccctactagaatttaccgaatgccagaggatcaggttgctagacgcgggaccactgtgcaactcgaatgcagggttaaacacgacccttctttaaaactgacggtgagctggttgaaggatgacgaacccctgtacatcggaaatcgtatgaaaaaagaggacgatagcctgactatctttggggtcgccgagcgcgatcagggctcctacacctgcgtggcttcaaccgaactagatcaggatttggccaaagcttacctgacagtactcgctgaccaggccacaccaactaataggctggcagctctccctaaaggccgtccagatcggcctagggatctggagctaactgatctcgccgaacggagtgtcagactcacatggatcccaggcgacgccaacaactcgccaataactgattatgtggtccaattcgaggaagaccagtttcaacccggcgtttggcatgaccacagtaagtatccgggctccgtgaattccgctgtgctcagactttctccctacgtgaattatcaattccgtgtcatagcgatcaacgaggtgggctcctcgcacccaagcctgccttccgaacgctatcgcacttccggggcccctcccgaatcgaatcctggcgacgtcaagggagaagggaccagaaagaacaatatggagatcacgtggacgcccatgaatgctacaagcgcctttgggcccaatctgagatatatcgtaaagtggcggcgacgggagaccagagaggcctggaacaatgtgactgtctgggggagccgctatgttgttgggcaaacccccgtgtacgtgccctatgaaatccgcgtgcaggcagagaatgactttgggaaaggtccagagcctgaatcagttataggctactcaggagaagattatcctcgggccgcccctaccgaggtgaaagtccgggtcatgaattctacagctataagcctgcagtggaacagagtgtacagcgataccgttcaagggcagctgagggagtatcgcgcctactattggcgcgaatcttcgctcctgaaaaatctctgggtgtctcaaaaaagacagcaggcgtctttcccgggggatcgcttgaggggagtggtatcccgcctgttcccctatagtaattataaactggagatggtggtagtgaacggtcggggcgacggccccaggtcggagactaaggagtttactacaccagaaggcgtaccttctgcgccaaggcgatttagggttaggcaacccaacttggaaacgattaatttagagtgggaccatccagaacatcccaatggtattatgatcggctacacattgaagtatgtggcctttaatggcacaaaagtgggtaaacagatcgtggagaactttagccctaaccaaaccaaatttactgtccagcgcacggaccctgtatctaggtacaggttcaccctctcagcccggacccaggtgggcagtggggaggcagtaacggaggaatcgcccgctccgccgaacgagggaaatcacaccaagaagactgttcccgtcaaagcccaggcccagcccatccagctgactgatctgtatccaggcatgacttacacactgcgtgtctattctagggacaacgaggggatcagtagtaccgtcattacttttatgacaagcaccgcctacacgaataatcaggccgacattgctactcagggctggttcatcggattaatgtgcgcaatcgccctcctggtgctcatactcttgattgtgtgctttattaagcgaagccggggaggcaagtaccccgtgcgtgaaaagaaggacgttcctctgggccctgaagaccccaaagaagaagatggttcttttgactatagcgacgaagacaacaaacctctgcagggctctcagacaagtcttgacgggacaatcaagcagcaggagagcgatgacagtctggtggattacggagagggcggtgaggggcagtttaatgaggacggaagcttcattggacagtacactgtgaaaaaagacaaggaagagaccgaaggtaacgagtcttctgaggccacctctccggttaacgctatctactctctggcttag

SEQ ID NO: 31505 - DNA, 3723 bp, Artificial Sequence
  Description of Artificial Sequence: Synthetic coding sequence
atggcacggcagcctccccctccttgggtgcatgctgcatttcttctttgtttgttgtccttgggcggagccattgaaatcccaatggacccttcaatccagaatgagctgacccagcctccgactatcactaaacaaagcgcaaaagaccacatagtggatccgcgggataatattctgatcgaatgcgaggcaaaaggaaatccagcaccctcttttcactggacccggaacagccggttcttcaacatagccaaagatccgcgagtgtcaatgcggagacgcagcggaactcttgtgattgacttccgaagtggaggtagacctgaagaatatgagggggaatatcaatgtttcgcaaggaacaaattcggaaccgcgttatccaaccgaatccgtttacaggtcagcaaatcccctctgtggcctaaggagaatttggatccagtggttgtccaggagggagctccgctgaccctgcagtgtaacccccccccagggctgccctcccccgttattttttggatgagctcttccatggaacccatcacccaggacaagcgagtctctcagggccacaacggcgacctgtacttctccaatgttatgctgcaagacatgcaaaccgactactcatgcaacgcccgtttccacttcacgcatactatccagcagaaaaatccattcaccctgaaagttctgactacccggggcgtggcagaaagaaccccctcctttatgtaccctcagggcactgcttcctcccagatggtgctcagaggtatggatctcctgctggagtgtatcgcgtcaggcgtgcccactccagatattgcttggtataagaaggggggggacttgccaagcgacaaggccaagttcgaaaacttcaacaaagcactgcgcataactaacgttagtgaagaggattcaggggaatatttttgcctggcttcaaataaaatgggctctattagacacactatctcagtgcgtgtgaaagctgccccttactggctggatgaaccaaaaaatctcatcctagcccctggcgaagatggaaggctggtctgccgggcgaatggcaatcctaagcctacagttcaatggatggtgaatggggagcctctgcagagcgcgccacctaatcccaatagagaggtcgcaggggataccatcatctttcgtgacacccagatttcgtcccgggccgtttatcaatgcaacacatcaaatgagcatgggtatcttcttgctaatgccttcgtttctgtgttggatgtcccgccacggatgttgagtccaaggaaccaactcatccgtgtgatcctgtacaatcggacccggctagactgtccattcttcggcagtcccatccctacccttagatggtttaagaacggccaaggctccaatctggacggtggaaactaccacgtgtacgagaacgggtcactggagatcaagatgattcggaaagaagatcaaggcatatatacgtgtgtcgcaacaaatattttaggaaaagccgagaatcaagttaggctcgaagtgaaggaccctacaagaatttatcggatgcccgaggaccaagtggccaggcgaggaacaacagtgcagcttgagtgcagggtcaaacacgacccgtcgttgaaactgaccgtctcctggctcaaagacgacgagccactctacatcggcaatagaatgaagaaggaggatgactctctgactattttcggtgtggctgagcgtgatcagggtagttatacctgcgttgcttctaccgagctcgatcaagacctggccaaagcataccttacagttcttgctgaccaggccactcccaccaaccggttagccgccctgcccaagggcagacccgaccgcccccgcgacctcgagctgacggacctagccgagagatcagttcggttgacttggatcccaggtgacgcaaataactcgccgatcacggactacgtagtgcagttcgaagaagaccagtttcaacctggggtctggcatgatcactccaaatatccaggatctgtcaattccgctgtactgaggctctccccctacgttaactaccaattcagggtgatcgccatcaatgaggtgggaagctcccacccttcactgccatcggagagataccgaacatcgggcgctcccccagaatcgaaccccggggacgttaagggagagggaacaagaaaaaacaatatggaaatcacatggacacccatgaacgccacatctgcttttggtcccaatctgaggtacattgtgaagtggcgcaggagagagacccgggaagcctggaataatgtcacagtctgggggtctaggtacgtcgtcggacagactcctgtgtacgtgccctacgagatccgagttcaggccgaaaacgacttcggtaagggtccagagcctgaatccgttataggatattccggcgaagacctgcctagtgccccaagacggtttcgcgtgcgccagcccaatctcgagacgattaatttggagtgggaccatcctgaacaccctaacggaattatgatcggttatactttgaagtatgttgcctttaatggtacaaaggtcggtaagcagatcgtcgagaatttcagccctaatcagactaagttcacagtacaacggaccgacccagttagtagatacagatttactttgtctgccagaacacaggtgggatccggcgaggcagtgaccgaggagtcgcccgcaccccccaatgaggcaacaccaaccgctgctccccccaccttacccccaacaacagtgggtgctacgggtgctgttagcagcaccgatgctactgccattgccgcgaccaccgaggccacaacagtgcccattatacccactgtcgcaccaaccacaatcgccacaaccacaactgtggcgaccaccacaactaccaccgctgctgcaactacaaccaccgagagcccgcccactacaacttccgggaccaagatccatgaatcggccccagacgaacaaagtatttggaatgtcactgtgctaccaaatagtaaatgggctaatataacctggaagcataactttggcccagggacagattttgtggtcgaatatatcgatagcaaccacactaaaaagaccgttcccgtgaaggctcaggctcagcctattcagttgactgatctttacccaggcatgacctacaccctgcgtgtgtactcacgggacaatgaagggatcagtagtaccgtgatcactttcatgaccagtacagcatacacaaataaccaggcggacatagcgacccaaggctggtttatcgggctcatgtgtgctatagcgttgctggtgttgattctgctgattgtgtgtttcattaagcgcagccggggcgggaagtaccctgttcgtgagaaaaaggacgttcccctgggacctgaggatcctaaagaagaagacgggagttttgattattccgacgaggataataagccactccaggggtcacagacaagtctggacgggacaattaagcagcaggagagcgacgattccctcgtggactacggcgagggaggggagggccagtttaacgaagacggatcattcatcgggcagtacaccgtgaaaaaagataaagaagaaaccgaaggcaatgagtcctccgaagccacgtcgcctgtgaacgcgatatacagtttggcctag

SEQ ID NO: 31506 - DNA, 3510 bp, Artificial Sequence
  Description of Artificial Sequence: Synthetic coding sequence
atggcgagacaaccacctcctccatgggtgcatgccgcctttctgctatgtctcctgagtctcggaggtgcgattgaaatccctatggatctgacccaaccccctacaattactaagcagtccgctaaagatcatattgtagacccccgggataacattcttattgaatgcgaagccaaagggaatcctgctccttcctttcattggactcgcaatagtagattcttcaacattgcaaaggacccgcgagtatctatgcgaagacgttcaggaactctggttattgacttccgcagtggtggacgccctgaagaatatgagggagaatatcagtgcttcgctaggaacaaattcggcaccgcactctctaatcgtattcgcctccaggtcagcaaatccccactctggccaaaggaaaacctggacccggtcgtggtccaggaaggcgctcccctgaccttgcaatgtaaccctcctcccggtctgccaagccctgtaatcttttggatgtcctctagcatggagcccattactcaagataaaagggtgtcacagggccacaatggagatttatatttcagcaatgtgatgcttcaagacatgcaaaccgattatagctgtaatgcgcggtttcatttcacccatacaatccagcagaagaatcccttcactctgaaggtactgaccaaccacccctacaacgatagcagtctgcggaatcatcccgacatgtacagcgcacgaggcgtggctgagagaacccctagcttcatgtacccacaagggaccgcttcgagccagatggtgcttcggggcatggacttacttttggaatgcatcgcaagtggcgtccccaccccagacatcgcatggtataaaaaaggcggcgacctgccatccgacaaggcaaagtttgaaaacttcaataaggcactgcgaataaccaacgtgagcgaggaggattccggggaatacttttgtttggcgagcaacaaaatgggcagtattcgccatacaatctcagtgcgggtgaaggctgcaccgtactggctcgacgagcctaaaaacctaatcctggcgcccggagaggacgggcgattggtctgcagggccaacgggaaccccaagcccaccgtacagtggatggtgaacggggagcctctgcagagcgcccctcccaaccctaatcgggaagttgccggggacaccattatctttcgggatacgcagatctccagcagggccgtgtaccagtgtaacacttccaatgaacacggctatctgctggcgaacgccttcgtctctgtgctggatgtacccccccggatgctttcccctagaaaccagctgatccgcgtgattctatataaccgaacgaggctggattgtcccttttttggatcaccaatacccacactgcggtggtttaagaacggtcagggtagcaatctggacggcggcaactaccacgtgtatgagaacggatcactggaaatcaagatgattcggaaggaagatcagggaatctacacctgcgtggctacaaacatcctgggaaaggccgaaaatcaggtgcggctggaggtgaaagaccccaccagaatatatcgcatgccggaggatcaggtggccagaaggggcacaacggtacagctcgagtgtcgtgtcaagcatgacccaagcctaaaactcactgtgtcatggttgaaagacgacgagcctttgtatatcggaaatcgtatgaaaaaagaagacgactcgcttaccattttcggagtcgccgagagggaccagggctcatatacatgcgtggcgtctactgaacttgaccaggacttggcaaaagcctacttaaccgtccttgggcgcccagatagaccgcgcgacctggagctcacggacctagctgaacggtctgtcagattgacctggattccaggcgacgcaaacaactctccaattacagactacgtggtgcaattcgaagaagatcaattccagccaggtgtgtggcatgaccacagcaagtacccaggatcagtaaatagcgcagtgctgagattgagtccctacgtgaattaccagttcagagttattgcaattaacgaggtgggctctagccacccctccttgcccagcgagagatatcggacttccggcgcaccgcccgaatctaatcccggagatgtcaagggcgaaggcaccagaaagaataatatggagattacttggacgccaatgaatgccacaagcgccttcggcccaaatctacgttatattgtgaaatggagaagaagagagactcgcgaagcctggaacaacgttaccgtgtggggcagccgctacgtggtgggtcagaccccagtctacgtcccctatgagattagagtccaggcagaaaatgacttcggcaagggtcctgagcctgaatcagtgatcgggtattctggggaggattatccacgggccgcccccactgaagtgaaagttcgtgtgatgaattccacagccatcagcctgcagtggaacagagtctattcagatacagtccagggccagctgcgggaatacagggcgtactattggagagagtcatctttgttgaaaaatttgtgggtatcccagaaacggcagcaggccagctttcccggagatagactgcggggtgttgttagcagactgtttccttattcgaattacaaactcgagatggtggtggtgaacggccgcggcgatgggccccgctctgaaaccaaagagttcacgacacccgagggggtgcccagtgcaccacggagattccgagtcaggcagccaaacctggaaactataaacctcgagtgggaccatccggaacaccccaatggcattatgatcggttataccttgaagtatgtggcattcaatgggacgaaagtcggcaagcagatcgtggaaaatttcagcccaaaccagacaaagttcaccgtccaacgcaccgaccccgtgtcacgatatcggttcactcttagtgcccgcactcaagtgggctcaggggaggctgtgacagaagagtctccagctccacctaatgaagcctatacaaacaaccaggccgacattgcaacccaaggctggttcattggcctgatgtgcgctattgcactgttagtcctgatactcctaatagtgtgttttatcaaaaggagcaggggcggtaagtatccagtgagggaaaagaaggatgtccccttgggccctgaagatccaaaagaagaagatggctctttcgactactcggatgaggacaataagccgctccagggaagtcagacctctctcgacggcactattaaacagcaggaatcagacgattcacttgtggactacggggaaggcggtgaaggccaatttaacgaagatggttcctttattggacagtacaccgttaagaaagataaggaggaaaccgagggaaatgagagtagtgaggccacaagtcccgtaaatgcaatctactccttggcttag

SEQ ID NO: 31507 - DNA, 3216 bp, Artificial Sequence
  Description of Artificial Sequence: Synthetic coding sequence
atggcccgacaaccacctcccccttgggtacacgctgcctttctactgtgcttgttatcgctcggaggagcaatcgagatccctatggatccaaaccctcagcatcgattgactcagccacccacgattacaaagcagtctgcaaaagatcatattgtcgatccccgggacaacattctgattgagtgtgaagctaagggcaatccagcccccagcttccattggactagaaacagtcggttctttaacatcgcaaaggacccaagggtgtctatgagacgaaggagcggaacattggtcatcgatttccgatcaggagggagacccgaggaatacgagggtgagtaccaatgcttcgctcgaaacaagtttggaaccgccctgagcaaccgaattcgactccaggtatccaagagcccattgtggcctaaggaaaatctggatccagtcgtggtgcaggaaggagccccccttaccttacagtgtaacccacccccaggtctcccttctccggttattttttggatgagcagttctatggaacctatcacgcaggacaagcgggtctcacaaggccataacggagatctctattttagtaatgtgatgttgcaggacatgcagaccgactactcttgtaatgcgcggtttcattttacacacacaatccagcagaagaatccattcaccttgaaggtgctgactacaaggggcgtggccgaacggaccccaagctttatgtacccccagggaacagcgagctcccaaatggttttacgcggaatggatctcctgttagagtgcatcgcctcaggcgttccaacccctgacatcgcttggtacaagaagggcggggacctcccatcagacaaggcaaagttcgagaactttaacaaagctctcagaatcacaaatgtgtccgaagaggattcaggtgaatacttctgtttggcatccaataaaatgggcagcattagacacacaataagcgtgcgagttaaagccgccccctattggttggacgagcctaagaatctcatactggcccccggcgaagacgggaggctcgtttgccgggccaacgggaaccccaaacctactgtgcaatggatggtcaacggtgagccactccaatcagctccccctaacccaaaccgggaggtggccggtgacacaattattttcagagacactcaaatttcctcacgggctgtgtatcagtgtaatacgtcgaacgaacatggatacctgcttgccaacgcatttgtgagtgtgctcgatgtgcccccacggatgctatccccgcgcaaccagctgattcgcgttatcctttacaataggaccagacttgactgcccgttttttggctccccaatacctacccttcgctggtttaagaatgggcagggcagcaatctggacggcggaaattaccatgtctatgaaaatggctcgctagagattaagatgatccgaaaagaggatcagggcatttatacctgcgtggccaccaacatacttggaaaagccgagaaccaggttagacttgaggttaaagatcctactaggatttatagaatgcccgaggatcaggttgctcggcgagggaccacagtgcagctggaatgtcgagtgaaacacgatccttccctgaagctgacggtgtcgtggcttaaagatgacgagccactctacatcggcaatcgcatgaagaaagaagatgacagtctcaccatctttggcgtagcagagagggatcagggatcctatacctgcgtcgcaagtaccgaactggaccaggatctcgctaaggcttacctgaccgtgctggctgaccaggccacccccaccaacaggctggctgccttaccaaaaggtcgccctgaccgcccacgcgatctggaactgacggatctggccgagaggtcagtgcggcttacttggatccccggtgacgcaaacaattctccaatcacagactacgtcgtacagttcgaagaggatcaatttcaacctggggtatggcatgaccattccaagtacccaggaagcgtgaattctgcagtcctccgcctgagcccctatgtgaactaccagttcagggtgatagcaatcaatgaggtgggttcttctcacccaagcctccccagtgaacggtataggactagtggggctccaccagaatcaaatccgggggatgtgaaaggtgaggggacaagaaagaataatatggaaattacctggaccccgatgaacgctacgtccgcttttgggcccaatttgcgctacatcgtgaaatggcgccgcagggagactagagaggcgtggaacaacgtgaccgtctggggctcaagatacgttgtcggccaaaccccggtctacgtgccctacgagatacgcgtccaggcagagaacgacttcggcaaagggcccgagcccgaatcggtaataggatacagcggggaggacctgccctctgctccacggagattccgggtgcggcaacccaatctggagacgattaacctggagtgggatcaccccgagcatcccaacggcataatgattggctatactcttaagtacgtcgcttttaatggaacaaaggttggcaagcagatagtagagaacttcagtcccaatcagacaaaatttacagtgcaacgcacagacccggttagccggtatagattcactctcagtgctcgcacccaggtcggatctggcgaggcagttacagaggagagtcctgcacctccaaatgaaggaagcccagtgatgtcctacacaaataaccaggccgacattgctacacagggttggttcattgggctcatgtgtgctattgcactactggtgttaatcctcctaatcgtctgtttcattaaaagaagccggggaggaaaatatccagtaagggagaagaaagacgttccgctggggcccgaagatccaaaggaagaggatggatcttttgattacagcgacgaggacaacaaaccactccagggctcacagacaagcctcgacggaaccatcaagcagcaggagtcagacgacagcttagtggactatggcgaaggtggcgaaggccagttcaatgaggacggctccttcattggacaatatacagtgaagaaagataaagaagagacggagggcaacgagagctcagaagcaacttctccagtcaatgctatatactcactcgcctag

SEQ ID NO: 31508 - DNA, 3807 bp, Artificial Sequence
  Description of Artificial Sequence: Synthetic coding sequence
atggccaggcaacctccaccaccctgggtacatgcagccttcctcttatgtctgctgagccttggaggagctattgagataccaatggacccgaatccacagcacagactcactcagcctcctacgataacaaaacagagtgcaaaggaccacatcgtcgaccctagggacaatattcttattgagtgcgaggctaaggggaacccagcaccgtcattccactggacccggaacagtcggttcttcaacattgccaaggatccaagggtatctatgaggaggcggtccggtacgctggtaattgactttcgatccggcgggcgccccgaggagtacgagggcgaataccagtgcttcgcccgaaacaagtttggaaccgccctgtccaatcgaatacgtctgcaggtatccaaatcacctctgtggccaaaagaaaatctggacccagtcgtggtgcaggaaggggccccgttgacactgcagtgtaacccccccccaggtcttccatcaccagtaattttttggatgagcagctcgatggaacccataacccaggacaaacgggtgtcccagggtcataacggcgacctttatttctccaatgttatgttacaagacatgcagaccgattattcctgtaatgccagattccattttacccacacgatccagcaaaaaaacccattcactcttaaggtgcttaccactaggggcgtcgctgaacgtactcccagcttcatgtaccctcagggcacggcatcaagccagatggttttgcgtgggatggatctgcttctggaatgcattgcctcgggcgtgcccacacccgacatcgcatggtacaagaaaggtggtgatctgccatcagacaaggccaaatttgagaattttaataaggctttgaggatcacgaatgtgtccgaagaagatagcggcgagtatttttgtctcgcatccaataagatgggcagtatccgccacactatatctgtgcgcgtgaaggccgccccatactggctggatgaaccgaagaatcttattttagcaccgggtgaagacggccgcctcgtgtgcagggcgaatggcaatccaaagccaacagttcaatggatggtaaacggggagccactccagtccgctccccccaaccccaatcgcgaggtggccggcgatacaataatttttcgcgatacccaaataagctcccgagccgtgtaccagtgtaacacaagtaatgaacacgggtacctcctggcaaatgcctttgtctccgtgctcgacgttccaccgagaatgctgtcacccaggaaccagctgattcgggtgatactgtacaatcgcactcgcctggactgtccattctttggtagtcctattcctaccttaagatggttcaaaaatggacaggggtccaatcttgatgggggaaattaccacgtatacgaaaatggctctcttgagatcaagatgattcgcaaagaggaccagggaatatacacctgtgtggctacgaacatcctgggtaaagcagagaaccaagtaaggctggaggttaaagatccaacaagaatctatcgaatgcccgaggaccaagtggctaggcggggtacaaccgtccaactggagtgtcgcgtaaaacatgatccttccctgaagctgactgtgtcatggcttaaggacgacgagccactgtatatcggaaaccgaatgaagaaagaggatgacagtttaacaatatttggggtcgctgaacgggatcaaggcagctacacatgcgttgcctcaactgagttagatcaggatcttgcaaaagcttatctgaccgttttggccgaccaggccactccaaccaacaggctggcggccctgcccaaaggtcgtcccgatcggccaagagaccttgaactaactgatctggccgaacgctcagtacgactgacctggatccctggagacgccaataactccccgatcaccgactacgtcgtgcagtttgaggaggatcagtttcaaccgggagtttggcacgaccactcaaagtaccccgggtctgtcaattccgcagtgctgcgcctgagtccctacgttaattaccagtttagagtaatcgccattaatgaggtggggagttctcatccatctctcccatcagagagatataggacaagcggggcccctcctgagtcgaatcctggtgacgtgaaaggcgaaggaacaagaaagaacaatatggagattacttggactccgatgaatgccacgagtgctttcggccccaacctcaggtacatcgtaaagtggcgtcggcgagagacccgtgaagcatggaataacgtgactgtgtgggggtcgagatacgtggttggacagacacccgtttatgtcccatacgagataagagtgcaagctgagaacgacttcgggaagggtccagagcccgaaagtgttatcggctactcaggcgaggactatccaagagccgcaccaaccgaggtgaaggtgagagtcatgaatagcactgcaattagcttacaatggaacagggtatacagcgacaccgtccagggccagctgagggaataccgcgcttactactggagggaatcaagtcttctgaagaatctttgggtctcccaaaagcgacagcaggctagttttcccggagatcgattgcgcggcgtggtttccagactatttccttacagcaactacaagctcgaaatggtggtggtgaatggccggggggatggccccaggagcgaaacgaaagaattcaccacccctgagggcgtacccagcgcacccagacggttcagagttaggcagccgaatttggaaactatcaacctggagtgggaccaccctgagcacccaaacggcattatgatcggatacacgctcaaatacgtcgcctttaatgggaccaaggtaggcaagcaaatcgtggagaacttctcacctaatcagactaagtttactgtgcagaggactgatccagttagcaggtaccggtttacactgagtgcccgcacccaagtgggatcaggagaggccgtgactgaagagtcacctgccccacccaatgagggttctccggttatgtcacctgacgagcagagcatatggaatgtgacggtcctgcccaacagcaaatgggcgaatattacctggaaacataactttggacctggtacagacttcgtcgtcgagtacatagattctaaccacacaaagaagaccgttccggtgaaagctcaagcccagccaatccagctgactgacttgtatcctggcatgacatacaccctgcgcgtgtattcgagggataacgaagggatctcttccacagtgataactttcatgacaagcactgcgtataccaacaaccaggcagacatcgctacccaggggtggttcattggcctcatgtgcgctattgccctgcttgtattgatccttctaattgtctgttttataaaacgcagtaggggcgggaagtacccagttagggaaaaaaaagacgtgccattgggtcccgaagatccaaaagaagaggatggcagttttgactattcagacgaggataataagccccttcaggggtctcagacaagcctggatggcaccatcaaacaacaggaatccgacgattctttggtcgactacggcgaaggcggtgagggacagttcaatgaggacggaagcttcattgggcagtatactgtgaagaaagataaagaagagaccgagggcaatgaaagtagcgaagccactagcccagtgaatgcaatttactccctcgcttag

SEQ ID NO: 31509 - DNA, 3999 bp, Artificial Sequence
  Description of Artificial Sequence: Synthetic coding sequence
atggcccgccaaccaccgcctccttgggtccatgccgcttttttgctgtgtctcctgtcactgggaggggcaatagaaattcctatggacctttcaattgagacaactgtcacccagccgcccaccattacaaagcagtctgcaaaggatcatatcgtggacccacgagataacattctgatagaatgcgaggcaaaggggaacccagcaccaagtttccactggacccgcaattctcgcttctttaacatcgctaaagatccccgggtgtccatgcgtcgccgcagtggaaccttagtcatagactttaggtcaggaggtcggccagaggaatacgagggcgagtatcaatgcttcgctcggaacaagtttggcacagccctctccaaccgtattagactgcaggttagcaaaagcccactgtggcccaaggagaacctagacccagtcgtagtgcaggagggcgcccctctaactctgcagtgtaatcccccccctggcttgccaagcccagtaatcttttggatgagctcctctatggagcccatcacccaggataaacgggtgagccagggccacaatggcgacctttacttctcaaacgtaatgctacaggatatgcaaaccgattactcctgtaatgcacgttttcacttcacccacacgattcaacagaaaaatcccttcaccctgaaagtgctgactactaggggcgtggcagaacgaacaccatctttcatgtatcctcagggcacggccagttcccagatggtgcttaggggcatggatttactcctggagtgcattgcctccggagtgcctacgccggacatagcttggtacaagaaaggcggggacctgccatccgacaaagccaagtttgagaacttcaataaggccctgcgcattaccaacgtctcagaggaggattccggcgagtatttctgtctggcttctaacaaaatgggctctatacgccacaccatttcggtgagagtgaaagccgctccttactggctcgacgagcctaaaaacctgatcctcgcacctggggaggatggccgtctagtgtgtcgagccaacggtaatccaaagcccaccgtgcagtggatggtgaacggagaacccctgcagagcgcaccccccaacccaaatcgggaagtggccggcgacacgattattttccgcgacacgcagatttcctcaagagcggtctaccagtgcaacacttccaacgagcatggttatctccttgcaaacgctttcgtttcggtgcttgatgtccctcctcggatgttgtcgccacgtaaccagctgattagggtaattctgtacaatcggacaagattagactgtccctttttcggatcgccaatcccgactttgcgctggtttaagaacggacagggctcaaacctggatggtggtaattatcacgtgtatgaaaatgggtcgcttgaaatcaaaatgattcgcaaggaggatcaaggcatctatacttgcgtggccacaaatatcttaggcaaggccgagaatcaggttcgccttgaagtgaaagacccaactcgaatttatagaatgcctgaagatcaggtcgctcggcgcggcaccaccgtgcaactcgagtgtagggttaaacacgacccgagtcttaagctgactgtgagctggctgaaggacgatgaaccactttacattggcaacaggatgaagaaagaagacgacagcctgacaatatttggagtggctgaacgggatcagggctcctacacatgcgttgcctccacagaattagaccaggacctggctaaagcctacctgactgtcctgggtagacctgaccgccccagagatctcgagctgactgatctggctgaaaggtcagtgcgactgacctggatcccgggcgacgctaataactccccaatcacggattatgtcgttcagttcgaggaggaccagttccagccgggggtatggcacgatcacagtaagtatcctggtagcgttaattccgctgttctgaggctgtcaccatacgtgaattaccagttccgagtgattgctattaacgaggtcggctcctcacatccctcattgccttccgagagataccggacatcgggagctccgcctgaaagtaatcccggcgacgttaagggtgaagggacacgaaaaaacaacatggagattacttggaccccaatgaatgccacatccgctttcggacccaacctcagatacattgtgaagtggagacggcgagaaacccgagaagcatggaacaacgtgaccgtctggggcagcaggtacgtcgtcggccagacacccgtgtacgtcccttatgaaattcgcgtccaggcagagaacgacttcggtaagggtccggagccagagagtgtgattggatattcaggtgaggattaccctcgggccgccccaacagaggtgaaagtacgggtgatgaactccacagccatctcactccagtggaatagggtgtattctgacaccgtacagggacagctgcgcgaatacagagcctactattggcgggagtcctcgctcctgaaaaatctgtgggtgagccagaaaagacagcaagctagttttcctggcgacaggctgcggggtgtcgtgtcaagattgttcccctacagcaactataaacttgaaatggtggtggttaacgggcggggggatgggccaagatcggagacaaaggagtttaccacccccgagggcgttccctccgctccgagacgcttcagggtgcgtcagcccaatctcgagaccatcaaccttgaatgggatcaccctgagcaccctaatggaattatgatcggctatactcttaaatatgttgctttcaacggcaccaaagttggaaagcagatcgtggagaacttttcccccaatcagacgaagtttacagtgcagcgaacagacccagttagccgctatcgctttaccttgagcgccaggacacaggtgggctccggggaggccgtgacagaggaatcccccgcaccacctaatgagggccggtgtatggctgcagctcctggtgtgaaaggacctagcgtcggggctaccggtgctgtctcatctaccgatgccaccgctatagcggccacgaccgaggctaccaccgtaccaatcatcccaacagtagcgcccacgactatcgctaccaccactaccgttgccactacaactacaacaacagcagccgcaacgactacaaccgagagcccacccactaccaccagcggaactaaaatacacgagagtgcccctgacgaacaatctatctggaacgtgacagtgctgcctaattctaagtgggccaacattacctggaagcacaatttcgggcccggcacagacttcgtagtggagtacattgatagtaatcacaccaaaaaaactgtcccagtgaaggcccaagcccagcctatacagctgaccgatctgtacccaggcatgacatatacacttagggtgtacagcagggataacgaaggaatttcctcaaccgtaatcaccttcatgacctccaccgcttacaccaacaaccaggcagatatcgctacccaggggtggtttatcggccttatgtgcgcaatagcattactcgtcctgatactcctgatcgtatgtttcattaagcggagccgcggagggaagtatcctgtccgcgagaagaaggacgtccctctgggtcccgaggatcctaaggaggaggacggatcctttgactactccgatgaagataacaaacctctgcagggaagtcagacttccttggatggaacaattaaacagcaggagtccgacgactcgctggtcgattacggagagggaggcgaaggacagtttaatgaagatggctcctttatcggccagtatacagttaaaaaagataaggaggagactgaagggaacgagtcttctgaagccacgagcccggtgaacgctatttattccctggcatag

SEQ ID NO: 31510 - DNA, 4044 bp, Artificial Sequence
  Description of Artificial Sequence: Synthetic coding sequence
atggctaggcagcctccgccaccttgggtccacgcagcatttctcctttgtctgctgtccttgggtggagccatcgagatccctatggatccaaatccgcaacatcggctgacccagccaccgacaattacgaaacagagcgccaaggatcatatcgtggatcctcgcgacaacatcctaatcgaatgcgaggctaaagggaatcctgctccttcttttcactggacccgcaattctcgcttcttcaacattgccaaggatccacgagtttctatgagacgacggtccgggacactggtaatcgacttcagatccggcggccggcccgaggaatacgaaggggaatatcagtgttttgcaaggaacaaattcggtactgcactgtcaaacagaattagactgcaggtcagcaagagccctctgtggcctaaggagaatcttgaccccgtggtcgtgcaggaaggggcacctctgactctgcagtgcaatcctcccccaggactgccttctccagtgatcttctggatgagttcctccatggaaccaatcactcaggacaagagggtttcccaaggacacaacggagatttgtatttcagtaatgtgatgctccaagacatgcagactgattactcctgtaatgcaaggttccacttcacacacactatccagcagaaaaatccattcacactaaaggtcctcacgacccgcggtgtggctgaaagaactccctcatttatgtacccccaaggtaccgcttcgtcccaaatggtccttagggggatggatttgctgcttgaatgtatcgctagtggcgtccccacaccagatatcgcatggtacaagaaagggggagatttgccatccgataaagccaaatttgagaacttcaataaggccttgaggatcactaacgtctccgaggaggattcgggagagtatttctgcttggcttcgaacaagatgggctctatcagacacacaataagtgttagggtgaaggccgcaccctactggcttgatgagcctaagaaccttatcctcgccccaggcgaggacgggaggttagtgtgccgtgccaatggaaatccaaagcctaccgtccagtggatggtgaatggcgagcccttacagtctgcacctccaaatccaaaccgcgaggttgctggcgacaccataattttccgcgatacacagatcagcagtcgcgcagtctatcagtgtaacacgagcaatgagcatggctatctcctcgctaatgccttcgtcagcgtgctggatgtgcctcctcggatgctctcgcctcggaaccagctgattcgagtcattctgtataacaggacacgcctggattgcccattcttcggttcccccattcccacgttacgctggttcaagaacgggcagggaagcaacctggacggtggaaattatcacgtgtacgaaaatggatctttagaaataaaaatgataaggaaagaggatcaaggcatctatacatgtgtggcgacaaatattctgggcaaggcagaaaaccaggtgaggcttgaagtcaaggacccaactaggatctacagaatgccggaggaccaggttgcaaggaggggcactacggttcagctcgagtgtcgagtgaaacacgatcccagtctgaaattgaccgtttcatggttgaaggacgacgagcctctgtacataggaaaccggatgaagaaagaggacgacagcctgactatttttggggtcgctgagcgcgatcagggaagttatacatgcgtcgcgagcactgagttagaccaagacctggcaaaggcgtatctcaccgttttagcagaccaggccacgccaacgaatagacttgcagcccttcctaagggaaggcctgaccgaccaagagacttggagctcaccgaccttgcagagaggtcagttagactgacttggattccgggcgacgcgaacaatagccccattacagactatgtggtgcagttcgaagaggatcagttccaacccggcgtgtggcatgatcacagtaagtaccctggctccgttaacagcgccgtcctccgtttgagcccttacgtcaactaccaattcagagtaatcgccatcaatgaggtcggaagcagccacccttctctgcccagcgagaggtataggacgtctggagccccacctgaatccaatcccggtgacgttaaaggagagggcacacgaaagaacaacatggagattacctggaccccgatgaatgcaacttctgctttcgggcccaacctcagatatattgtcaagtggcggagacgcgaaactagggaggcctggaacaacgtaaccgtgtgggggtccagatatgttgtcggacagacccctgtgtacgttccttacgagatcagagtgcaggccgagaatgactttggaaaaggtccagagcctgagagcgtcattggctactccggcgaagactacccacgcgcagcgcccactgaggtcaaggtccgcgttatgaactcaacggcgattagtcttcagtggaatagggtgtacagcgatacagtgcagggccaactcagggagtacagggcttactactggagagaatccagtctcctcaaaaatctgtgggtctctcagaaacggcagcaggctagcttccccggtgaccgcctcagaggagtggtgtctcgcttgttcccgtactcaaactataaactggaaatggtcgttgtgaacgggaggggggacggacccaggagcgagacaaaagagtttactacacccgagggtgtgccttcggcgcctagacgttttcgggtcagacagccaaatctcgaaacaatcaacctggagtgggaccatcctgagcacccaaatgggattatgataggctatacactcaagtatgtggcttttaacggaaccaaagtcgggaagcagatcgtcgaaaatttcagcccaaatcagacgaaattcactgtgcagaggacagacccggtctctcggtacagattcaccctgtcggcccgcacacaggtcggcagtggtgaagccgtcacagaggagtctcctgcgccccctaacgaaggaagtccagtgatgagccctccaacattgccaccaacaactgtaggtgcaactggcgctgtgagctcaaccgatgcgacggccattgctgccacaacagaggcaactaccgtgcctatcatcccgactgtcgcacccactacgatcgcaaccacaactacagtcgccacaactaccaccaccaccgccgccgctaccacgacgaccgaaagcccccctactaccacgagcggcacaaagattcacgagagcgcccccgatgagcaaagcatatggaatgttacggtgttgccaaattccaagtgggctaacattacttggaaacataatttcggaccgggtaccgacttcgttgtggaatatatcgattccaaccacaccaagaaaacggtgcctgtaaaggcccaggcgcagcctatccagctgacagatctgtatcccggcatgacatataccctgcgggtctactcaagagacaatgagggcatttcttcaaccgttatcacctttatgacatctactgcctatacgaacaatcaggctgacatcgccactcaaggctggtttatcggattaatgtgcgccatcgctctgctagttctaatcttattaatcgtatgttttataaaacggtctcggggtggaaaatacccagtaagagagaagaaggacgtgccgctgggccccgaggaccctaaagaagaggacggtagtttcgactacagtgacgaggacaataaaccactccagggaagccaaaccagcctggacggaacgatcaagcagcaggaaagtgacgactctctggttgactacggcgagggtggtgaaggccagttcaatgaagatgggagctttataggacagtacacagttaagaaggataaagaagaaactgaaggcaatgaatccagtgaggctacttcccctgtgaacgcaatatactcactggcctag

SEQ ID NO: 31511 - DNA, 3723 bp, Artificial Sequence
  Description of Artificial Sequence: Synthetic coding sequence
atggcacggcagccaccccccccttgggtgcatgctgccttcctactgtgcctccttagtctcggaggggccatcgagattcccatggaccctagtattcagaacgagcttacccaacctcccaccatcacaaagcagtctgccaaagaccacatcgttgacccacgcgacaacattctgatcgagtgcgaagccaagggaaatcctgcacccagttttcactggacccgtaactcccgcttttttaacattgcgaaggacccaagggtgtcgatgaggcgccgcagtggtaccttagtaatcgacttccgatccggcggcagaccagaggagtatgagggtgaataccagtgttttgccaggaacaaattcggtaccgccctctccaatcgtatcaggctgcaggtgtcgaaaagcccgctttggcctaaagagaatctcgatcctgtggtcgtccaggagggggcccctctgacccttcaatgcaacccccctcctggcctgcctagtccggtgatattttggatgtcttcatctatggagcctattacacaggataaaagggtatcacaagggcataacggggatctgtatttcagtaatgtgatgcttcaagacatgcagaccgactatagttgcaatgctagatttcattttacccacaccattcaacaaaagaaccccttcactctcaaggttttgacaaccagaggagtggccgaaagaacgccatccttcatgtatcctcagggcactgctagcagccagatggtgcttagaggaatggaccttctcctcgaatgcatcgcctccggggttccgactccagacatcgcatggtacaaaaagggaggggacctcccaagcgataaagctaaatttgagaatttcaataaggctctgaggataacaaacgtgtccgaagaagattcgggtgagtacttctgtcttgcctccaacaaaatgggtagcatccgacatacaatctctgttagagttaaagcagctccatactggctcgatgaacctaagaacctgatcctggcccccggcgaggatggtagattggtttgccgagctaatggcaaccccaagccgaccgtgcagtggatggtgaatggcgagccattgcagagcgcacctccaaatcctaatcgagaagtggcaggcgataccataatctttagagatactcaaatctcaagccgggccgtttatcagtgcaacactagcaacgagcatgggtacttgttggccaatgctttcgtgtctgtgctcgatgtgcctcctcgcatgcttagccccagaaaccaattaattcgggtaatactgtataatcgaacccgactggactgtccgttctttgggtctcccataccaacacttcggtggttcaagaatgggcaaggatccaaccttgacggtgggaactaccatgtgtacgagaacggctccttagaaatcaaaatgatccgcaaggaagaccagggcatatacacatgcgttgcaacaaatatcctgggcaaggcggagaatcaggtgcgcctggaggtcaaagaccctaccagaatttaccgcatgccggaagaccaggtggctcgcaggggcacaacagtccagttggaatgtcgtgttaagcacgacccatcgctcaaactgaccgtttcttggctcaaggatgatgaacccctctacatagggaatcgcatgaaaaaagaggacgactctttaacgatcttcggcgtggcagaaagggaccagggctcttatacgtgtgtagcctcgacagagctcgaccaggacctggctaaggcatatctcactgttctcgcagaccaggccactcctactaaccggctcgctgcccttcctaaaggacgccctgatcgtccccgggatctggaactgacagatctggctgaacgatccgtgcgcttgacgtggatccctggagacgccaacaactcccctatcactgactatgtggtgcagtttgaggaggatcagtttcaacccggcgtgtggcacgatcacagcaaatacccaggctcagtaaactccgctgtcctcaggttgtccccttatgtgaattaccagttcagagttatcgctataaatgaagtggggtctagccaccctagccttccaagtgaacgctaccgcacctccggcgcccccccggaaagtaacccaggcgacgttaaaggggagggaacgagaaaaaacaacatggagatcacatggacacctatgaatgcaaccagcgctttcggtcctaatctccgatatattgtaaagtggagacgaagagagaccagggaagcatggaacaacgtaacggtttggggttccagatacgttgtgggacagacacccgtttatgtcccatatgaaattagggtccaggccgagaacgattttgggaaaggtccggagccagaaagcgttataggctatagtggggaagacctcccctccgctcctaggagatttcgcgtgagacagccaaacctcgagacaatcaacctggaatgggatcacccggaacaccctaatggcataatgattggttacaccctaaagtacgtcgccttcaatgggaccaaagttggtaagcagattgtggaaaatttttctcctaaccagaccaagtttacagtgcagcggaccgatcccgtatcccgatatagattcacattatccgcccgcactcaggtggggtctggagaagccgtgaccgaggagtcgcctgccccacctaatgaggctacaccaaccgccgcccctcccaccctcccccccacgacagttggcgcgacgggcgccgtgtcctccacagacgcaacagccattgctgccacaactgaagccacaaccgtgccaatcatccccacagttgcaccgacgacaattgctacgacaactactgtggcaacaaccaccaccacaacagcggccgccaccacaacgacggagtctccacctacaacaacttctggcacaaagatacacgagtctgccccagatgagcaatcaatttggaatgtaacagtcctgcccaatagcaagtgggctaacattacctggaagcacaacttcggtcccgggacggattttgtggtggagtacattgattctaaccacactaagaagacagtcccggtcaaggctcaggctcagccaatccagttaaccgacctataccccgggatgacctacaccctgcgagtttatagcagagataatgagggtatttcaagcacagtcattacttttatgaccagcaccgcctacacaaataatcaggctgatatcgccacccaggggtggttcatcgggcttatgtgcgccatcgctttgctcgttcttatcttgctgatcgtatgcttcatcaaaaggtctcgcgggggtaaatatcccgtgagagagaagaaggatgtgcccttggggccggaggatcccaaggaagaagacgggagtttcgattatagtgacgaagacaataagcctctgcaggggagccagacatcactggatggtacgatcaagcagcaggagtccgatgattccttggtcgactacggggagggcggggagggccagtttaacgaggatggctcttttattggacaatacaccgtcaagaaggataaggaggaaactgagggtaacgagtcgagcgaagccacctcccctgttaacgcaatctacagcctcgcctag

SEQ ID NO: 31512 - DNA, 1860 bp, Artificial Sequence
  Description of Artificial Sequence: Synthetic coding sequence
atggccaggcagcccccccctccgtgggtgcacgcggcatttctcctctgtctcttgagcttgggcggggcaatcgagattcctatggacccctccatccaaaacgaactgacccagcctccaacaattactaaacagagtgctaaggaccatatagtggatccacgtgataatatcctgattgagtgcgaggcaaaaggtaacccagccccctcttttcactggactaggaatagccgattctttaacatcgcaaaggatccacgagtgtctatgcgtcgcaggtcaggtactctagtgatagactttcgttccggcggcagacctgaagagtatgaaggggagtatcagtgtttcgcacggaacaaatttggaacggctttatctaacagaatccgtctgcaagtttccaaaagtcccttgtggccaaaagaaaatctcgacccagtggttgttcaggaaggggctcccttaactctgcagtgcaacccgcccccagggctgccgtcccccgtgattttctggatgtccagctccatggagccgatcacgcaagacaaacgtgtaagccagggtcacaatggagatctatacttctcaaatgtcatgctgcaggatatgcagacagactattcttgcaatgcccgctttcactttacccacactatacaacagaaaaatccttttacccttaaagtgctgaccaccagaggggtggcagaacgcacgcctagcttcatgtatccccagggaaccgctagctctcagatggtgctgcgtggcatggatctgttgttggagtgtattgcatcaggcgtgcccacgcctgacattgcttggtataagaaggggggcgatctgccaagcgacaaagcaaaattcgaaaattttaacaaggccttgcgaattacgaacgtaagcgaagaggattccggtgagtatttttgcctggcaagcaataaaatgggttccattcgacacaccatcagtgtacgggttaaagcagctccttattggcttgacgaacccaaaaacctgatcctcgctcccggcgaggacggaaggctggtatgtcgagccaatggcaaccctaaacccaccgtgcagtggatggtgaatggtgagcctctgcagtccgcccccccaaatcccaatagggaagtggccggcgacaccatcattttccgcgacacccagataagcagtcgggcagtgtatcagtgtaatacaagtaatgagcatggctatctgctggctaatgcttttgtgtctgttctggacgttccgcccagaatgctgagccctcgcaatcagttgatcagagttatcctctacaaccggactcgcttggactgtccattctttggttcaccaattcctactctccgctggttcaaaaatggacaggggagtaatctcgatgggggcaactatcacgtgtacgagaatggtagtctggagattaaaatgatcagaaaggaagaccagggtatttacacatgtgtggcgactaacatcttggggaaggccgagaaccaagtacgcctcgaagttaaggaccctaccagaatctatcggatgcctgaggaccaagttgcccgcagaggtacaaccgtgcaactggaatgcagagtgaaacacgacccctcactcaagttgacagtctcttggttgaaggacgatgaaccactgtacataggcaatcgtatgaaaaaggaggacgacagtctgactatcttcggtgtcgcagagagagaccaaggatcatacacctgcgtggcgtccactgagctggaccaggatctggcgaaggcctacctcactgttctcggtaattgcccctgtagtccttggcactag

SEQ ID NO: 31513 - DNA, 3525 bp, Artificial Sequence
  Description of Artificial Sequence: Synthetic coding sequence
atggctcgtcagcctcctcctccctgggttcacgccgccttccttctgtgcctgctcagccttggcggagccattgagattccaatggacctgacacaacccccgaccataactaagcaatccgccaaggaccacatagtcgacccacgcgataatatcctgattgagtgcgaggctaaggggaatcctgccccttctttccactggacaagaaacagcaggttctttaacattgccaaggacccccgcgtgtctatgaggcgccggtcagggacgctagttatcgatttccgtagtgggggccgacctgaggagtatgagggggaatatcagtgtttcgctaggaacaagttcgggaccgcgttgagcaaccgaatacgcttacaggtgtctaagtcaccactttggccaaaagagaaccttgaccccgtggtggtacaggagggagctcccctgacgctgcagtgcaacccacctcctggactcccctctcccgtgattttctggatgtcatcttccatggaacccatcacccaggataaaagggtctcccagggccataatggggatctatatttttctaatgtgatgctgcaggatatgcagacggactattcttgcaacgcccgcttccattttacccacaccatccagcagaagaacccctttaccttaaaggtgctaaccaatcacccatataatgattcgtcgttacgtaaccaccccgatatgtattccgcccgcggagtggctgagaggacgcccagttttatgtatccccagggtactgcctcttctcagatggttctgagaggaatggacttgctgctggagtgcatagcttccggtgtccctactccagacatcgcatggtataagaaaggcggtgatttgccaagcgacaaggctaagtttgagaattttaataaggcccttcgcatcacaaatgttagtgaagaggattccggcgagtacttttgcttggccagcaacaagatgggttccatccgacacacaattagcgtacgggtgaaggccgcgccatactggctggacgaacctaaaaacttgatcctagccccaggggaggatggccgactcgtttgtcgcgccaatggaaaccccaagcctaccgttcaatggatggtcaatggcgagcccttgcagagcgcacctcccaatcccaacagagaagtagctggggacacgatcatcttccgagacacccaaatcagcagtcgagctgtatatcaatgcaatacaagcaatgagcatgggtacttactggctaatgcctttgtgtcagtcctggacgtcccgcctcgcatgctcagcccaagaaaccagttaattcgtgtaatactgtataatcggaccagattggattgcccattcttcgggtctccaatcccaacgctgcgatggtttaagaacggccagggctcaaatctggacggaggaaactatcacgtgtatgaaaacggatcactagagatcaagatgatcagaaaggaagatcaggggatttatacgtgcgtggccactaacattctaggaaaggccgaaaatcaagttcgactggaggtgaaagaccccactaggatatacaggatgcccgaggaccaggttgcccgccgcggtactactgtgcagctggaatgcagggtcaaacacgatccctccttaaagctaacagtctcttggctcaaagatgatgaacccctttacatcggcaaccggatgaagaaagaagatgactctctcactattttcggagtggctgagcgagaccaaggatcgtacacttgcgtcgcgagcaccgagctcgatcaggatctggccaaagcgtatttgacagtcctggggcgccccgacagacctcgcgatttggaactcaccgacctggctgaacgctctgttcggctcacctggatccccggagatgccaacaacagccctattacagactacgtggtgcaattcgaagaggaccaatttcagcccggggtgtggcacgatcatagtaaatatccaggcagcgtgaactctgccgtactgaggctgtcgccatacgtcaattaccaattcagggtgatcgctatcaatgaagtggggagcagccatcccagcttgcccagcgagcgatacagaacctcaggagctcctcccgagtccaatccaggggatgtgaagggagaggggactagaaaaaacaatatggaaatcacttggactccaatgaatgctacaagcgccttcggacctaatttgagatacattgtcaaatggaggcgccgcgaaactcgagaagcctggaacaacgtgaccgtttggggcagtcggtacgtggtgggacagactcccgtctatgtcccatatgagattagggtacaggctgagaacgatttcggcaaaggcccagagccggagagtgtgatcggctattcaggtgaggactatccccgggctgcccctaccgaagtgaaagtgagggttatgaattctacggctatctccttacagtggaaccgagtctactcagacactgttcagggtcagctcagggagtacagagcctactactggcgggagtcttccctcctcaagaacctatgggtctctcagaaacggcagcaggcttcgttccctggcgacagactaaggggagtggttagccgcctcttcccatattcaaactataagctggagatggtggtggtgaatggtaggggcgacggccctagatcggaaaccaaggagttcacaacccccgagggagtgccaagcgctcctaggcgctttagggtgagacagcctaatctcgagacaattaacctggagtgggaccaccctgaacatcccaatgggataatgatcggctacacgcttaaatatgtggccttcaacggtaccaaagtgggcaaacagatcgtggaaaacttcagccccaaccaaaccaagttcaccgttcagcgaactgatcccgtgagcagataccggtttacattatccgcccgaacccaggtcggttctggtgaggctgtgacagaggaaagcccggccccacccaatgaggccacaccaacggcggcttataccaataatcaggccgacatagcaacacagggttggtttattggtttaatgtgtgcgatcgctctcctggtccttatactgttgattgtatgctttatcaagcgctccagaggcggtaaataccccgttcgagaaaaaaaagatgtgcccctggggccggaggacccaaaggaagaagacggaagtttcgattattccgacgaggacaataagccccttcagggatcacagacctccctcgatgggacaattaagcaacaggagtcagacgactctctggtggattacggggagggcggcgaggggcagttcaatgaagacggatcatttatcggacagtacacagtgaagaaggacaaggaggagaccgaggggaatgagtcatctgaggccacaagccctgttaacgccatatactctttggcatag

SEQ ID NO: 31514 - DNA, 3498 bp, Artificial Sequence
  Description of Artificial Sequence: Synthetic coding sequence
atcgagataccaatggacttgactcagccacctactattacgaagcagtcagccaaagatcacattgtagatccaagggacaacatcctgatagaatgtgaagccaaggggaaccctgcgcccagttttcactggacgcggaactcaagatttttcaacatagctaaggatccgagagtaagcatgagaaggcggagcggaacccttgttatcgatttccgaagcggtggacgccctgaggaatatgaaggcgaataccagtgtttcgcccgaaacaagttcggcaccgcattatcgaaccgaataagactgcaggtgtctaagagccccctctggccaaaagagaacctggaccctgtcgtggtacaagaaggcgctcctctgactctgcagtgtaatcctccgcccgggctccccagccccgtaatcttttggatgtcctccagcatggagcctattactcaggataagcgcgtgagccagggtcataatggcgatctctacttttccaatgtcatgctgcaggatatgcaaactgattacagttgcaatgctcggttccactttacgcatacaatacagcagaaaaatccgttcacccttaaggttctgactaatcatccatataatgacagctccctgcgtaaccaccctgacatgtattcggcgaggggagtggcagagcggacccctagctttatgtatccacagggaacagccagttcacagatggtgctcagaggaatggacttactcctggagtgtattgcgtcgggggtgcccacccctgacatcgcatggtacaagaaaggcggagatctcccttccgacaaggccaagttcgagaacttcaataaggcactgaggattactaacgttagcgaggaggattcaggcgagtatttctgcctggcttccaacaaaatgggtagcattcgccatacaatttcagtgagagttaaggcagcaccttattggctggacgaaccgaaaaacctgatcctggcaccaggtgaggacggccggcttgtgtgccgggctaatggcaatcccaaacccaccgtccagtggatggtgaatggggagccactgcaaagtgctccacccaaccccaatcgagaggttgcgggggacactatcatctttagggatacccagattagttcccgggccgtctaccagtgcaacaccagtaacgagcatggctacctgctggccaatgcttttgtctcagtcctggacgtgcccccacggatgctgagcccaaggaatcaactgatcagggtcatcctgtacaatagaactcgactcgactgcccctttttcggatcaccaattcccacgctgcgttggttcaaaaacggtcaggggtcaaacttggacgggggaaactatcatgtgtacgagaatggatccctggaaatcaaaatgattaggaaagaagaccaggggatctatacctgcgttgcaaccaacatcctcgggaaagcagaaaaccaagtgaggctggaggtcaaagatcctacacggatctacaggatgcctgaagaccaagttgctaggcgggggacgactgttcaactcgagtgtcgggtcaaacatgacccttccctcaagctcacagtctcctggctgaaggacgacgaaccgctgtacatcgggaatcggatgaagaaagaagatgatagcttaaccatcttcggggtagcagagcgtgatcaggggtcctacacatgtgtggcttctaccgaactggaccaggacctggctaaagcttacctgactgttttggctgaccaggccacaccaaccaatagactcgccgcactgcctaaggggaggccggataggccgagagacctggaactgacagatcttgctgaaagatccgtccgacttacatggattcctggggacgccaacaactcaccaataaccgactacgtggtgcagtttgaggaagatcagtttcagcccggggtgtggcacgaccacagcaagtacccaggaagcgttaattctgctgttctgcggttgagtccatacgtcaactatcagttcagggtgattgccataaatgaagtcggttcaagccatcctagcctacccagcgagagatacaggacgtctggggctccacccgagagcaacccaggggacgtcaagggggagggtacaagaaaaaataacatggaaatcacttggaccccgatgaacgcaactagcgctttcgggcccaaccttagatatatcgttaaatggagaagaagagagacacgcgaggcatggaacaatgtcacggtttggggaagccgttatgtcgtcggccaaacccctgtgtatgtcccatacgagatcagggttcaggccgagaatgacttcgggaaaggaccagagcctgaatctgtgatcggatactcaggcgaagattacccccgtgcagcaccaacagaggtcaaggtgagggtgatgaatagtacagctatctccctacaatggaaccgggtttactccgacaccgttcagggccaactaagggagtatagggcctactactggcgggagtcgtcactgctcaaaaatctgtgggtatcacagaaacgtcagcaggcgagcttccccggcgataggctgagaggcgtagtttccagacttttcccctattcaaactacaaactggagatggtggtggtaaatggcagaggagatgggccaaggtcagagaccaaggaatttacaactcccgagggggtgccatccgcccctcgtagatttcgtgtgagacagcctaacctggagaccattaacttagagtgggatcaccccgaacatccaaatggtatcatgatcggttacaccttaaagtatgttgctttcaacggcacaaaggtgggtaagcagatcgtggagaacttttcccccaaccaaacaaagtttaccgtacaaagaaccgaccctgtgtcgaggtatagattcacactgagcgctcgaacccaggtagggtcaggggaggctgtgacggaggaaagtcccgcccctcccaacgaggctactcccactgccgcttatacgaacaatcaggcagatatcgcgacccagggctggttcataggcctcatgtgtgcaatcgcccttctggtgcttatcctgctgattgtatgctttatcaagaggtctaggggaggcaagtatccagtccgtgaaaagaaggacgtgcctctcgggccagaggatccaaaggaggaggatggttccttcgattactcagacgaagacaacaagccactccaagggagccagacgtctctggacggcaccatcaagcagcaggaatccgatgatagtctcgtggattacggcgagggcggcgagggccagtttaatgaagacggaagcttcatcggacagtacacagtgaagaaggacaaggaggagacagagggcaatgagtcctccgaggccacgtcccctgtaaacgcaatctattcactggcatag

SEQ ID NO: 31515 - DNA, 909 bp, Artificial Sequence
  Description of Artificial Sequence: Synthetic coding sequence
atggcccgacagcccccacccccctgggtgcacgccgcctttctgctctgtctgctgtcattgggcggagcgatcgaaatccccatggaccccagcattcaaaacgagctgactcagcctccaacgatcacaaaacaatccgcgaaagatcatattgttgatcctagagacaacattttgatcgagtgcgaggctaaagggaacccagcacccagcttccactggacaaggaatagcaggtttttcaatatagctaaagatcctcgcgtgtctatgcgacgcaggtccggcacgctcgtaatcgactttcgtagcggtggtcggccagaagaatatgagggcgagtaccagtgttttgctcgcaacaaatttggtaccgccctatcgaatcgaatcagactgcaggtctccaaatcacctttgtggcctaaggagaatcttgatcctgtggtcgtgcaggaaggggctcccctgaccctccagtgcaaccccccaccaggcctccccagtcctgtgatattctggatgtcctcgtctatggagcccatcactcaggataagagggtgtctcagggacataatggtgatctatatttcagtaatgttatgctgcaagatatgcagaccgactatagctgtaacgccagatttcacttcacacataccatccagcaaaaaaatcccttcacattgaaagtcctgactactcggggcgtggcagaaagaactccatccttcatgtacccacagggcacggcctcttcccaaatggtgctccgcggaatggaccttttgcttgaatgcattgcctccggcgtacctacaccagatatcgcatggtataaaaaaggaggggatctgccttcagacaaagctaaattcgagaattttaacaaggcattgcgttag

SEQ ID NO: 31516 - DNA, 390 bp, Artificial Sequence
  Description of Artificial Sequence: Synthetic coding sequence
atggctaggcagcctccccctccttgggtccatgcggcatttctcctgtgtctcttaagtctagggggcgctattgaaatccctatggacccgtctatacagaatgaacttacacagccaccgacaattacgaaacaatcagccaaagaccatattgtggaccctcgtgacaatattctcattgaatgtgaagccaagggaaaccccgccccctcctttcactggactcggaattcccgcttctttaacatcgccaaggatcccagggtgagtatgcggcgcagatccgggaccctcgtgatcgactttagaagcggcggaagacccgaggagtacgaaggcgaatatcagtgcttcgcccggaacaagtttggtactgcactgagctag

SEQ ID NO: 31517 - DNA, 3510 bp, Artificial Sequence
  Description of Artificial Sequence: Synthetic coding sequence
atggcgaggcagcccccccccccatgggtccacgcggccttcctgctgtgcctgttgtccctcgggggcgccattgagatccctatggatttaactcagccccctacaatcacaaagcagtccgctaaggatcacatcgtggacccccgagataatatattaatcgagtgtgaggcaaagggaaatcctgcccctagttttcattggacacggaactctaggtttttcaacatcgccaaggatcctcgagtgagcatgcgtcggcgcagcggaactttggtgatagactttagatcgggaggccgtccagaggaatatgagggagagtaccagtgtttcgctaggaataaattcggtactgcactgagcaatcgtatccgattgcaggtttccaagagtcccctttggcctaaagaaaacctggacccagtggtggtgcaggaaggcgcaccactgaccctgcaatgtaaccctcctccaggtctgcccagtcctgttattttctggatgtccagcagtatggagcccattacacaggataagcgagtgtcacagggacataacggtgatttgtacttcagtaatgttatgctgcaagacatgcaaacagattactcctgcaatgctaggttccactttacacacacgattcagcagaagaacccttttactttaaaggtgctcaccaatcatccgtataatgactctagtctgcgtaaccatcccgatatgtactcggcgagaggcgtcgctgaaaggaccccttccttcatgtatcctcaaggaacagccagctcccagatggtcctgagaggcatggacctgcttctagagtgcatagccagcggtgtgcctacccccgatatcgcatggtacaaaaagggcggagatctgcccagcgataaagccaaatttgagaatttcaacaaggccctgcggatcactaatgtgagcgaggaagactccggtgagtacttctgcttggcctcgaacaagatggggtcaatccgacatacgataagcgttagagttaaggcagccccatactggctggacgagcccaagaaccttatcctggcacctggtgaggacggtcggctggtgtgccgagctaacgggaatccgaagcctaccgtgcagtggatggtaaacggagaaccactccagagtgcaccacctaaccccaatagggaggttgcgggtgacacaattattttcagagatactcagatatccagtagggccgtgtaccaatgtaacacatctaatgagcatggatacctgcttgccaacgccttcgtgagcgtcctggatgtgcctcctaggatgctgagtccccgcaatcagttgatcagagttatcctgtacaatcggacacgcctggactgcccattctttggcagtcccatccccacattacgctggttcaagaacggacagggatcgaatttagatggtgggaactatcacgtatacgagaacggctcactcgagatcaaaatgatccggaaagaggaccaggggatctatacttgtgtcgctaccaatatcctcggcaaagccgagaatcaggtgaggctggaggtgaaggaccctacaaggatttaccgcatgcccgaggatcaggttgcccggagaggcacaactgttcagctcgagtgtagagtgaaacacgacccttccctgaaattaaccgtctcttggctgaaagacgatgaaccactgtacataggaaatcgaatgaagaaggaagatgattccctgaccattttcggagtggccgaacgggaccagggttcttatacttgtgtcgcctctacggaactcgaccaggatctggccaaggcatatctaaccgtccttgggcgcccggatcgaccaagggacctggaactcaccgacttggctgaacgctccgttaggcttacatggattcccggtgatgcaaataactcaccaatcactgactatgtcgtacagttcgaggaagatcaatttcagcccggagtctggcacgaccattccaaatacccaggctccgtgaattccgccgtgctacgcctctcaccttacgttaattatcagtttcgggtcatcgctataaacgaagtgggaagcagtcatccgagtctgccttccgagcgttatcgaacttccggtgctccacctgagtccaaccccggcgacgtgaaaggggagggcacgcgtaaaaataatatggaaattacctggacccccatgaacgccacttctgccttcggccccaatctgaggtatatcgtgaagtggcgaaggagggagactcgcgaagcttggaacaatgtcacagtgtggggcagtcggtatgtggtagggcagactcccgtgtatgttccgtatgagatccgcgttcaagcggagaacgatttcggtaagggccccgaacccgaatcagttatcggatatagtggagaagattacccaagggccgctccaacagaagtgaaggtcagagtaatgaattccaccgcgatttctctccaatggaatagagtgtactctgacacagtgcaggggcagctgagagagtaccgggcatattattggagagagtctagcctgcttaaaaacctgtgggtctcccagaaaaggcagcaggccagctttccgggagacagacttaggggcgtggtctctaggctgtttccctattcgaactacaaattagaaatggtggtggtgaacggacgaggagacgggcccaggagcgagactaaagagtttacaacacccgagggagttcccagcgcccctaggcggtttagggtcagacaacctaacctagaaactatcaatctggagtgggatcaccctgaacaccccaatgggattatgatcggatatactcttaaatatgtggccttcaacggtaccaaggttgggaaacagattgtcgaaaacttttcacccaatcagacaaaatttactgtgcagaggactgatccagtgagtcggtacagatttaccttgagcgctaggacacaggtgggctccggggaagctgtgactgaggagagccctgcccctcctaacgaagcctatactaataaccaggctgatattgctacacagggatggttcatcggtctgatgtgcgccatcgctttgttggtactgattctgctcattgtttgctttatcaaacgttcccggggcggaaagtatcccgtccgtgagaaaaaagacgtgccacttggacccgaggatccaaaggaggaggacggaagcttcgactattcggacgaggacaataagccactgcagggttcacagactagtctcgacggaacaatcaagcagcaggagagtgatgactctctcgtcgattatggcgagggaggagaagggcagttcaacgaagatggcagctttattgggcagtacacagtgaagaaggacaaggaggagactgagggaaatgagagtagtgaggcgacctcacccgtgaatgccatttactctctcgcctag

SEQ ID NO: 31518 - DNA, 3525 bp, Artificial Sequence
  Description of Artificial Sequence: Synthetic coding sequence
atggccaggcagccgcctccaccgtgggtgcacgcagcctttcttctgtgtctgctttcacttggcggtgccatcgagatccccatggacctgacccagcctcccacaatcaccaagcaatcagccaaagatcatatcgtagaccccagggataacatactgatcgagtgtgaggcgaagggaaacccagctccgagctttcattggactcgcaattcccgcttcttcaatatcgcaaaggacccacgggtgtcaatgaggcgccggtcagggactcttgtcattgatttccgtagtggcggcaggccagaagagtacgaaggggaatatcagtgttttgccaggaacaagttcggcactgccctctcaaatcggatccgactgcaggtgtcaaagagccctttgtggccgaaagagaacctggacccagtggtagtccaggagggagctcctctgacactccagtgcaaccccccacctggactcccatctccggtcattttctggatgtccagctcaatggagcccatcacccaggataagcgagtctctcaaggccataatggcgatctttacttcagcaatgtcatgctgcaggacatgcagacagattattcttgtaacgcacggttccattttacacatactatccagcaaaagaacccgtttacgctcaaggtactgaccaaccatccctacaacgacagctcgctgagaaatcacccggacatgtactccgctagaggggtcgccgagaggacgcctagttttatgtatcctcaggggaccgctagtagtcagatggtgctgcggggtatggatctgctcttggaatgcatcgcctcaggtgtaccgactcccgatattgcctggtacaagaagggtggcgatctcccatccgataaagccaagttcgaaaatttcaacaaggcattgagaattactaacgtctccgaagaagattctggcgagtacttctgtcttgcttctaataaaatgggaagtatccgacatactatctcagtacgagtgaaggccgccccttactggctggacgagccaaaaaacctgatccttgcacccggcgaggatggccgcctggtgtgccgcgccaatgggaatccgaagcctactgtccagtggatggttaatggtgagccgctgcagagtgccccaccaaatcctaatcgggaggtcgctggcgatactattatatttagagacacacaaatcagctccagagctgtgtaccaatgcaatacgtcaaatgaacatggctaccttctggctaatgcctttgtatccgtgctcgatgtgccacccaggatgctgtcaccccgtaatcagctcattcgagtgatactgtacaaccggactaggctggactgtcccttttttggatcccctattcctacactgagatggttcaagaatggccagggatcaaatctggacggcggaaactaccacgtgtatgagaatggctccctcgaaatcaagatgatccgtaaagaggatcagggtatttacacttgtgtcgccaccaatattctcggtaaggccgaaaaccaggtccgactagaagtgaaggatccaacaaggatatatagaatgcccgaggatcaggtggctagacgtgggactactgtccagctagaatgtcgggttaagcacgatccgagcttaaagctcaccgtgtcgtggctgaaagatgacgagccgctgtacattggcaatcggatgaagaaggaggacgactctcttactatttttggggtcgcggaacgggatcaagggagttacacctgcgtggcttccactgagcttgaccaggaccttgccaaggcctacttgactgtgctgggacgtccagatcggcctcgggacctggaactcacagacctagccgagcggtctgtgcgcctgacctggattccaggtgatgcaaacaattcacctatcaccgactacgtcgtccagtttgaagaggaccagttccaacctggagtttggcatgaccactccaagtaccctggctctgtgaactctgccgtactgcggctttctccctacgtgaactaccaattcagagtgatagctatcaatgaagtaggcagtagtcacccatccctgccctcagagcgatatagaaccagcggggcccctccagaaagtaaccctggggatgtgaagggcgagggcaccagaaaaaacaatatggagattacctggaccccaatgaatgctacatctgcctttggaccaaatctgagatatattgtgaaatggcggaggagagagacccgagaagcgtggaacaatgtgacagtttggggcagccggtatgtggtaggacagaccccggtgtacgtgccttacgaaatccgagtacaggcagagaacgactttggtaaggggcccgagcccgagtcagtgattgggtactctggcgaggactacccacgcgcagccccaactgaagtcaaggtcagagtgatgaactctactgcaatatcccttcagtggaaccgggtgtacagtgacactgttcaggggcagttaagggaatacagagcctattactggcgtgaaagttctctcctgaagaatctgtgggtttctcagaagagacagcaggcaagctttcctggcgacagacttaggggtgtggttagcagactctttccgtacagtaattataagctggagatggttgtcgtcaatgggcgcggggatggacctcggtcagaaactaaagaatttacgacccctgaaggagtaccctctgctcctcgacggtttagggtacgtcaacccaatctggaaacaatcaacctggagtgggaccaccctgaacaccctaacgggattatgatagggtatacactgaagtacgtagccttcaacggaacgaaagtgggaaagcagattgtcgagaactttagcccaaatcagaccaagtttactgtacagagaaccgaccccgtgtcaagatatcggtttacccttagtgcccggacccaagtgggaagtggggaggcggtgaccgaggagtctccagctccaccgaacgaggccacgccaactgctgcgtacactaacaatcaggcggatatcgcaacacagggctggttcattgggcttatgtgtgcgatagctttgttggtactaattctgttaattgtgtgttttattaagcgatctcgcgggggaaagtaccccgtcagagagaagaaggatgttcccctcggtccagaggatcccaaagaggaggacggttctttcgattattcggacgaagacaataagccccttcaagggagccaaacttcactagatggcacaattaagcagcaggagtccgacgatagtctcgtggactacggtgaggggggcgaaggacagtttaatgaggacggcagctttataggtcagtatacagtgaagaaagacaaggaagagacagaaggcaacgagagctcggaggctaccagccccgtcaacgcaatttacagcctggcctag

SEQ ID NO: 31519 - DNA, 1503 bp, Artificial Sequence
  Description of Artificial Sequence: Synthetic coding sequence
ttgaaattccttgcagttttgctagccgcagggatgctggccttcctcggcgccgtaatttgcattatcgcctctgtgccactggctgcaagtcccgctcgcgccctccccggcggggctgataacgcatctgtagctagtggagctgcagcctcccctggtccgcagaggtccctgtctgctcttcacggagcagggggaagcgctggaccccccgccctgccgggagcgccagccgcctctgctcacccacttccgcccggcccccttttttctcgcttcctctgtacaccactggctgccgcgtgtccctcaggtgctcaacagggcgacgccgctggtgctgcccctggtgaacgggaagaacttttactgctgcaatccacggctgagcagctacggcaaacagcactgcagcaggaggccaggatacgggcggaccaggacaccataagggaactcacagggaagctgggcagatgtgaatcagggcttcctaggggtctgcaaggggccggcccaaggcgcgatacgatggcagacggcccttgggattccccagctctaatattggagctggaagatgccgtacgggctctcagggatcggatagatagacttgaacaagaattgcctgcgcgggtcaatctctccgccgcccctgctcccgtctcagctgttcccaccggcctgcacagcaaaatggaccagttagagggccagctactggcccaggttctagccctagaaaaggagagagtggccctgagccacagttctaggagacagagacaggaggtggaaaaggaacttgacgtcctgcagggccgagtggctgagctcgagcacgggtccagtgcatactctccacctgacgcatttaagatctccatccccatacgtaacaattatatgtacgcgagagttcgcaaagcccttcctgagctgtatgcatttactgcctgcatgtggctcagatcccgtagttccgggacagggcaaggtactccctttagttactctgtgcccggtcaggccaacgaaatagtgctcctggaagcaggtcatgagcccatggagctcttgataaatgataaggtagcgcagctgccactgtcactgaaagataacgggtggcaccacatctgtatcgcgtggaccactcgcgatgggctgtggtctgcataccaggacggcgagcttcagggcagcggagagaatctcgccgcttggcatccaatcaagccccacggaatccttattctgggacaggaacaggatacgctaggagggcgattcgatgccacccaggcgttcgtaggggacatagcccagtttaacctgtgggatcacgcactgacacctgcccaggtcttgggtatcgcaaactgtaccgcgcccctcctgggaaacgtgcttccttgggaggataagctggtagaggcatttggaggtgccaccaaggcagcctttgatgtttgcaagggccgcgccaaagcttag

SEQ ID NO: 31520 - DNA, 2526 bp, Artificial Sequence
  Description of Artificial Sequence: Synthetic coding sequence
atgaatctcttgtacaggaaaactaaactggagtggcgccagcacaaagaggaagaggccaagcgtagctcaagtaaagaggtagctcccgcaggaagcgctggtccagccgctgggcagggcccaggtgtgagagtgagggacatcgcatcactgcgcagatccctgcgcatgggcttcatgactatgcccgcttcccaggagcatacacctcatccctgccggtctgctatggccccccggagtctttcctgccacagtgtcggaagcatggatagtgtgggcggagggcccgggggggcatcaggcgggctgacagaagattcaagcacccggcggccaccggccaagcctcggcgacacccctctaccaagttgtctatggtgggtcctggcagtggggcggaaaccccccctagtaagaaggcaggcagtcagaagcccacaccagaagggagggaatcctctcgcaaagttcctccccagaagccccggcgttcacctaacacgcaactgtctgtgtcgtttgatgaatcttgccctccaggtccaagccctcgcggggggaatctccccctccagagactcacccgggggtctagggtcgcaggcgacccagacgtgggcgcacaggaagagccggtgtatattgaaatggtgggagatgtgttcagaggagggggccggtccggcggaggccttgcaggtcccccactggggggaggcggccctacaccgccagccggggccgacagcgactcagaggaaagcgaagccatttacgaagagatgaaatatcccctgccagaggaggccggtgagggcagggccaacggccccccccctctgacagccaccagcccaccacaacagccccatgccttacctcctcatgcacatcggaggcccgctagcgcactgccgtcaaggagggatggcaccccaactaagacaacgccttgcgaaattccacccccctttcccaacctactccagcaccggcctcctctcctggcctttccccaggcgaaaagcgcctctcggacgcctggggacggggtttcccgactgcccgttttgtgccacagtaaagaacctgcaggctccacaccagccccccaggtccccgcccgggagagagagacgccacccccccccccaccgccacccgccgccaacctcctgttgcttgggccttccggccgcgcccgctcacattcaaccccactgccgccccaggggtcggggcagccgcgtggagagcgggaactgcccaattcacatagcatgatctgtccaaaagccgccggcgcacccgcagcaccccctgctccggctgccctgttgcccgggccccccaaggataaagcggtatcctacaccatggtgtactctgccgtcaaggtcacaacacactccgtgctgcctgcaggtccgccattgggagctggcgagccaaagactgaaaaagagattagcgtgcttcatggcatgttgtgtaccagcagccgccccccagtcccaggcaagacatcgccccacggtggcgccatgggagccgcagcgggtgtgctgcaccatcgagggtgtctcgcttctcctcatagcttacccgaccctacagtcggccccctgactcccctctggacgtaccccgccacagcagcgggcctaaaacggccacctgcctacgagtccctaaaagcaggtggagtcctgaacaagggatgcggagtgggtgccccttctcccatggtcaaaatccagctgcaggagcagggcacagatggcggggcatttgcctctatttcctgcgctcatgtgatcgctagtgcgggaactccagaggaagaggaggaggaggtcggtgcagccactttcggggctggttgggcactgcaacgaaaggtgctttatggaggacggaaggccaaagaattggataaagtggaagacggtgcgagagcctggaacggaagcgccgaaggccccggtaaagtggagcgggaggatcgtggtccaggtacttcgggaattccagtgcggtctcagggggcggaggggctcctcgccaggatccaccatggggacaggggaggcagcaggaccgctctccctatcccttgccaaacctttcccgcctgtcaccggaacggtgattttacaggaggttatcgccttgggcggagcgccagcaccagcggagtgaggcaggtggtcctacataccccgcggccatgttctcagccaagggacgcgctcagccaaccgcacccggccctgcctctgcctctgcccctccctcctcagcctgcaagagagagggacgggaagctgttggaggtcatcgagcggaaaagatgcgtgtgcaaggaaattaaggcacggcatcgtcccgacaggggactatgtaagcaggagtccatgcccattcttcccagctggcgccgaggccctgagccacgcaagtcagggacaccaccctgtcgacgacagcacaccgtcctctgggatactgcaatctag

SEQ ID NO: 31521 - DNA, 2529 bp, Artificial Sequence
  Description of Artificial Sequence: Synthetic coding sequence
atgaatctactgtatcgcaagacaaaacttgaatggcgacagcacaaagaggaagaagccaagaggtcatcttcaaaggaggtggccccggcaggtagtgcaggtccagctgccggccaagggcccggggtgcgggtacgcgatatcgcctcactgaggcggtcgctcagaatgggcttcatgaccatgcctgccagccaggagcacactcctcacccctgccgaagcgctatggcaccaaggagcctgtcctgtcactcagtaggatcaatggattcggtgggcggtggtcccgggggggcctcaggcggactgacagaggattcaagtacccgcaggcctcccgccaagccacgccggcacccgtctactaaattgagtatggtgggacccggatcaggtgcagaaacacctcccagtaaaaaggccggttctcagaagccgactcccgagggtagggaatcttctagaaaagttccccctcagaagcccagaagatctcccaatacgcagttgtctgtttcatttgatgaatcctgcccacctggcccctctccccgcggaggtaatctgccactgcagaggctgactcggggcagccgggtcgcaggtgacccagacgtcggggcccaggaggagccagtgtacatcgagatggtgggcgatgtgttccggggaggcggccggtcggggggtggactggccgggcctcctcttggagggggcgggcctacaccgccagctggtgccgattcagatagcgaggagtccgaggcaatctatgaagagatgaagtatcctttgcccgaggaggccggtgagggtcgagccaatggcccccctccactgaccgctactagccccccccagcaaccacacgccctcccacctcacgcccatcggaggccggcctcggcactaccatcgcgtcgcgacggaacgcccactaagactacaccttgcgagatccctcctcccttcccgaatttgctgcaacatagaccccccttattggcctttcctcaggcaaaatctgccagccgcacgccgggggacggcgtgagcaggttacccgttctgtgtcattcaaaggaacccgccgggtcaacgccagctcctcaggtgccagctagggaacgagaaacccctccccctcctcctccaccaccagcagcaaacctgcttctgctgggacccagtggacgagctcggtcccattcaaccccccttcccccccagggctcgggacagccccgcggggaaagggagctgcctaactcccacagtatgatatgtccgaaagccgcaggggcgcctgccgccccccccgccccagccgctctccttccggggcccccaaaggacaaggctgtgtcatataccatggtctactccgcagtgaaggtgacgacccattctgtcctgcccgcaggaccccctctcggcgccggtgaacctaaaactgagaaggaaatttctgtcctgcatgggatgctgtgcacatcttctcgccctcccgtccctgggaaaacaagcccacatggcggtgccatgggagccgccgccggcgtcttgcaccacagggggtgtctggcctccccacatagtctgccagacccaacagtgggcccccttacccctctttggacttacccagccactgccgctggcctgaagagacctcccgcctatgagtccttgaaggcgggtggggtccttaataagggctgcggagtcggcgctcccagcccaatggtaaagatccagttgcaagaacaggggaccgatggtggcgcctttgcaagcatttcctgtgctcacgtgatagcgtctgccggaacaccggaggaggaggaggaggaggtgggagcagctacctttggggcaggctgggccctgcagcgtaaagtgctttatggcggcagaaaagccaaagagcttgacaccgaggtcgaagatggcgctagagcttggaatggtagtgctgagggcccagggaaggtcgagcgggaggacagaggcccgggaacctcaggcatcccggtccgttcacagggggccgagggcttgctggcgagaatccatcacggagacagggggggaagtagaacagctctccctatcccgtgccagacattcccagcttgtcaccgaaatggcgattttactggagggtatcgcctgggccgttctgcaagcacttccggcgtccggcaggtggtcttgcacacaccaagaccatgcagtcaacctcgagacgccctgtctcagccacacccggccttgcccctcccactccccctgcccccccagccagcgcgggaaagagacggcaaattactggaggtaattgagcgtaaacggtgtgtgtgtaaggagatcaaggcccgacaccgaccggatcggggcctctgtaagcaggagagtatgcccatcctgccctcatggcgacgcggacccgagcccaggaaatctggaacaccaccgtgtagacgccaacacacagttctatgggatacagctatttag

SEQ ID NO: 31522 - DNA, 2358 bp, Artificial Sequence
  Description of Artificial Sequence: Synthetic coding sequence
atgggatttatgaccatgcccgcgagccaggaacacacccctcacccgtgccgctcggccatggcacctcggagtttgtcctgtcactccgttggatctatggattcagtgggggggggaccagggggcgcttccgggggcttaaccgaggactccagcacgcgccgccctccggctaaacctagaagacatccaagtacgaaattgtcgatggtgggccctggttccggtgctgaaacccccccaagcaagaaagctggctcccagaagccgacccccgaaggaagagagtccagccggaaggtaccccctcaaaagccgagacggagccctaatacccagctctccgtgtcctttgacgagtcctgtccacctggccccagccccaggggaggcaatcttccacttcaacggctgacaagaggcagcagggtagcgggagatcctgatgttggggcacaggaagaaccagtgtatattgagatggtgggcgacgtgtttaggggagggggaaggtcaggaggaggtctcgctggccctccactgggaggaggcggacctaccccccctgccggagcagactctgacagcgaagagagcgaggcaatttacgaagaaatgaaatacccccttcctgaagaggccggagaaggccgcgctaacggccccccaccattgacagcaactagcccccctcagcagccacatgcactgccaccccacgcgcaccggcggccagcgtcagccttgccttctcggcgtgatggtacacctacaaaaactaccccatgcgagatcccgcctccattcccaaatctgctgcagcaccggccacccctgctggctttccctcaggcaaaatcggcgtcccgtactcctggggacggtgtgtctcgcttgcctgtactctgccactccaaggaacctgccggttcaacgcccgcgccccaggttccggcccgggaaagagagactcctccacctccccccccaccccctgcagcaaaccttcttttactggggccttccggtagggccaggagtcactccactcccctgcctccacaaggctcaggccagcctagaggtgaacgagagctacctaactcgcattctatgatctgtcccaaagccgcaggcgcgcccgcagcccctcctgctccggccgctctactgccagggccccctaaggacaaggctgtgtcctatacaatggtgtacagtgctgtgaaagtgacaacacattcagtgctgccagctggccccccgctcggcgctggcgagcccaaaaccgagaaggagatctccgtcctgcatggcatgctctgtacatcttcaaggcctccagtaccagggaaaacatcaccacatggaggagcaatgggagctgcggccggcgtgttgcaccatcggggatgcctggcatccccccatagcctgcctgatcccaccgtgggcccgctgacacccctctggacatatcccgccacggcagctgggctgaaaagaccccctgcctacgagtccctaaaagccggcggtgtacttaataaaggctgtggggtcggcgcccctagcccaatggtgaaaatacagctccaggaacaggggacagacggaggggctttcgcctcaatctcttgcgcccatgtgatcgcttctgccggcacaccggaggaagaagaggaggaggtgggcgcagccaccttcggtgctgggtgggccctccaacgcaaggtgctgtatggcgggcgcaaagctaaagagttggacaccgaggtagaagatggggccagagcctggaacggctctgctgagggaccgggcaaggtggaacgcgaagatcgggggccaggtacgtctggaatccctgttcgctctcagggggctgagggtctgctggcccggattcaccatggggatcgcggagggtcccggactgctctgcccattccatgtcagacgttcccagcttgccaccgaaatggtgattttaccggcggctatcggctgggacggagcgcctccactagcggtgtccgccaggtggtcttacatacgccccgaccttgtagccagcctagagacgctctgtcgcagccacaccccgccttgccattaccactgcccctcccccctcagcctgcgcgtgagagagacggcaagctcttagaggtgatcgaacgtaagcgttgcgtctgcaaagagattaaggccagacacagaccagacaggggcctgtgcaagcaggaaagcatgccgatcctgcccagttggaggaggggccccgagcctagaaaaagtggcacgccaccgtgtcgaagacagcacaccgtcctgtgggacaccgccatatag

SEQ ID NO: 31523 - DNA, 1962 bp, Artificial Sequence
  Description of Artificial Sequence: Synthetic coding sequence
atgatttcctccaagatgatgtctagcaaccccgaggaagaccctctagatacctttctccagtatatcgaggacatgggaatgaaggcctacgatggactagttattcagaatgcctctgatattgcgcgggagaacgatcggctaaggaacgagacaaacctcgcctatctcaaagaaaaaaatgaaaagaggcggagacaggaggaggccatcaagagaatcggaggggaggtgggcaggggtcacgaggggagctacgtaggaaagcatttcaggatgggtttcatgacaatgcctgcacctcaggatcggctaccacacccttgcagcagcggcttttctgtccgaagtcagagcctgcattccgtcggcggcaccgatgacgattcttcatgtggctcacgccgacagccgccccccaaacctaagagagacccttctaccaaattgtcaacgtctagtgaaacagtgtccagcaccgctgcctcaaaaagtggaaagacaccagaacgtactgaggcatcagctaagcctcggcctcactccgacgaatatagcaagaagatacctcccccaaagccgaagcgaaaccccaacactcagctctcaacttcctttgacgaaacctatatcaagaagcacggaccccgtcgcactagtctacctcgagattccagcttgagccaaatgggatcaccggctggagatccggaagaagaggaacctgtgtacatcgaaatggtaggaaacattctgagggactttcgcaaagaggatgacgaccagtccgaggccgtatatgaagagatgaaataccctatatttgacgacttgggccaggatgccaagtgcgactttgaccatcattcttgcagcagccaatgcgccacaccaaccgtgcccgacctggacttcgcaaaagcgtccgtgccttgtcctcccaagggattgctttgcgacatcccgccaccttttcccaatctgctctctcaccggccccctcttctcgtcttccctccggcacctgtgcactgcagccctaattccgacgaaagcccactcacaccgctggaggtaaccaaactgcctgtcctggaaaatgtgtcttacatgaaacagccagccggagcctctccctccaccctgccttcccatgtacccggccatgcgaagctcgaaaaagagcaggctgctgcactggggcccgccagcgccaccccagctttaagcagcagccccccccccccgagtaccctttatcgaacacagagtccccatggctatccaaagagccatagcacgagcccctcccccgtgtccatgggcaggtcactaactcctctgtctctcaaacgcccccccccctacgatgctgtgcactcaggaagtctgtcacggagctcaccaagcgttccccattcaaccccgaggccggtttcacaagacggagccaagatggttaacgccgctgtcaacacttatggcgccgcaccaggagggtctcgctcgcgcacacccacaagccctttggaggagttaaccagtttgttctcaagcggaagaagtttgttgcgcaaatcctcttccggccgccgctcaaaggaaccagctgaaaagtcgaccgaggagctaaaagtccggagtcactccacagagccattgcctaaactggacaataaggaacgcggtcaccacggggcttctagctctcgcgaaccggttaaagctcaggagtgggatggaacgcctggtacgcccgtggtgacttcacggctgggcaggtgctctgtcagccccaccttgttggctggcaaccacagttctgagcccaaggtgtcctgcaaactgggaaggtctgcctcaaccagtggtgtgcctcctccttcagttacaccattacgccaaagtagtgatttgcagcagtctcaggtaccaagtagcctggcaaatcgagactag

SEQ ID NO: 31524 - DNA, 435 bp, Artificial Sequence
  Description of Artificial Sequence: Synthetic coding sequence
atgattagctccaaaatgatgagttcaaacccagaagaagatcccctggatacctttctccagtacattgaggatatgggtatgaaagcttacgatggcttagtgatccaaaacgccagtgacatagctcgggagaatgaccgcctgcggaatgaaacaaacctggcttatctgaaagaaaagaacgagaagcgtagaaggcaggaggaagcgataaaacggatcaaccgggggaccgaaagcccaaagcctcagcatggcgcaattaccaaggtcggacagcagggtaagcgcccaccctggggggtgttcctgcaaagagcctgtcaaagtagcggcatgggatggaacacccgcgacacctgcggtcatcagtctacaagaaaaatgctgtgcgagccccacttagtgtccggcaagccacaattcaggtag

SEQ ID NO: 31525 - DNA, 498 bp, Artificial Sequence
  Description of Artificial Sequence: Synthetic coding sequence
ctggcatggcgacctggagaaagaggggcccccgcttcaaggccgagactggccctgctcttactgcttttgctgttgcctctgccctccggagcttggtataaacatgtagcttccccgcggtatcatacagttggccgggctgcagggctcttgatgggcttgcgccgctctccttatctgtggcggagagctctgcgtgccgctgcggggcccttggcgagagatacactgagtcctgagcccgctgcgcgcgaggcaccattgctgctgccctcctgggttcaggagctgtgggagacccgccgacgttctagtcaggccggcatccccgttcgtgccccgcggtcaccaagggcgcccgagcccgccctggagcctgaatccctcgacttctccggggccggccagcgcctgagacgtgatgtttccaggcctgcagtcgacccagctgctaataggctgggcctgccgtgcctggcccccggcccattttag

SEQ ID NO: 31526 - DNA, 1260 bp, Artificial Sequence
  Description of Artificial Sequence: Synthetic coding sequence
atgaatcggcatctgtggaaaagtcagttatgcgaaatggtgcaaccttcaggtgggccagcagccgatcaagacgtgctgggagaagagagtcctcttggcaagccagctatgcttcacctgccatccgaacagggggccccagagactctccagagatgccttgaggagaatcaggagctgagggacgctatccggcaatcaaaccagatccttcgtgaaaggtgtgaggagctactccatttccaagcatcacagcgggaagaaaaggagttcctgatgtgcaagttccaggaggcccggaagctagtggagcggttggggctcgagaagctggacctgaaaaggcagaaggaacaagctttgagggaggtggagcacttgaagagatgtcagcaacagatggcagaggataaagcctctgtgaaagcgcaggtgacctccttgctgggagaactgcaagagagtcagagtcgtctggaggcagctacaaaagaatgccaggctctcgaaggcagggctagggcagcgtctgaacaggctaggcagctcgagagtgagcgcgaggccctgcaacagcagcacagcgtacaggtggaccagctccgaatgcagggacaatccgttgaagccgctttgagaatggagaggcaggctgcttctgaggagaaacgaaaactagcccagcttcaagtcgcttatcatcagttgtttcaggagtacgacaaccacatcaaatccagcgttgtgggatccgaacgcaagaggggcatgcaacttgaagacctcaagcagcagctgcagcaggcagaggaggccttagtggctaaacaggaggttatcgacaaactcaaagaggaggccgagcagcacaagatcgtcatggagacagtacccgtgctgaaagcccaggcagacatttacaaagccgactttcaagcggaaagacaggcacgagagaaactcgcggaaaaaaaggagttgctgcaggaacagctggagcagctacagagggaatatagtaaactgaaagctagctgccaggagagtgcacgtatcgaggatatgaggaagcgccatgtggaggtgagccaggccccactgccccccgcccccgcctatctgtcatcccccctagccttaccctcccagagaaggagcccacctgaagaaccccccgatttctgctgcccaaaatgccagtaccaggcgccagacatggacactcttcagatccacgttatggagtgtatcgagtag

SEQ ID NO: 31527 - DNA, 1209 bp, Artificial Sequence
  Description of Artificial Sequence: Synthetic coding sequence
atgccgcccgtgagtaggagctcctactccgaggacatcgtgggctcacgcagacgcagaagaagcagctccggcagtccgccctcccctcagagccgttgtagctcttgggatggctgcagtcggagccactcccgcggccgtgaggggctgcgccccccctggagtgaattggatgtcggtgctctgtatcccttttctagaagcgggagcagaggcagactgcctcgtttccggaactacgccttcgccagttcatggtcgacaagctacagcggctatcgataccacaggcattgctatgcagaagagagacagtcagccgaagactatgaaaaagaagaatcccataggcagcggcggttaaaggaaagagaacgcattggtgagttaggagcacctgaagtatgggggccctctcctaagtttccgcagctggacagcgacgagcacaccccagttgaggacgaggaggaagtgacgcaccaaaagtcttcaagtagtgactcaaactcagaagaacaccgcaagaagaagacctctagatcaaggaataaaaagaagcgcaagaataaaagtagcaaacgtaaacacaggaagtacagcgactccgacagcaattcggagagcgatactaactctgatagcgatgacgataaaaagagagtgaaggcaaagaaaaaaaagaagaagaagaagcataagaccaaaaagaagaaaaacaagaaaactaagaaggagagcagcgattcgagttgtaaagatagcgaagaggacttgtctgaagcaacttggatggaacagcctaacgtggcagacacaatggatctgataggcccggaggcccccatcatccacacctcacaggatgagaagccgctgaagtatgggcacgccctgctaccaggggagggagccgcgatggccgaatacgtcaaagccgggaaaagaatcccccggagaggcgaaattggcttgacatcagaagagatcggcagcttcgaatgctccggctatgttatgtcaggtagccgtcaccggcgcatggaggccgtacgactcagaaaggagaaccagatttactccgcggacgagaagcgggcattggctagctttaaccaggaggaaaggcggaagagagaatctaagatactggcgtcttttagggaaatggtgcataagaaaacaaaggagaaggacgacaagtag

SEQ ID NO: 31528 - DNA, 576 bp, Artificial Sequence
  Description of Artificial Sequence: Synthetic coding sequence
atgggaaagagttgtaaagtggtggtctgtggtcaggcctctgtaggaaaaacatcgattcttgaacagttgctgtatgggaatcatgtggtcggaagcgaaatgattgaaacccaagaagatatctacgtcggatccatcgaaacggaccggggagttagagaacaggttcgattctacgacactcgagggttgcgggatggcgccgagctcccccgccattgcttctcctgcactgatggctacgtcttggtttatagcacagatagtcgcgagtcattccagcgggtggaactgctgaagaaggaaattgacaaaagtaaggataagaaggaggtcacaatcgtggtcctgggaaataaatgcgaccttcaggaacagagaagggtggacccagacgtggcgcagcattgggccaagtccgaaaaagtgaagctgtgggaggtgtccgtcgccgatcgacgctcgctccttgagccatttgtttacctggcaagcaagatgacccaaccccagtctaaaagtgccttccctctgtcccggaagaataaaggatctggttcattggacggatag

SEQ ID NO: 31529 - DNA, 2181 bp, Artificial Sequence
  Description of Artificial Sequence: Synthetic coding sequence
atggccgccccaggcggccgagggagaagcttgagcgggctcctcccggcccagaccagccttgaatatgccctcctcgacgccgttacacagcaggagaaggattctctggtctaccagtatctccagaaggtcgatgggtgggagcaggacctgagcgtgcccgagttccctgaaggcttggagtggctgaataccgaagaaccaattagcgtatataaagatctgtgtgggaagatagtggtgctggatttctttacctactgctgcatcaactgtattcacctactgcctgacctgcatgccctggagcatacatattccgacaaagatggcctcctgattattggagtacattcggccaagtttccaaacgagaaagtgctggacaatatcaaaagcgccgtgttgcgttataatataacccaccccatggtgaacgacgccgatgcgtccctgtggcaggagttagaagtatcttgctggccaactctggtgatactgggccctagaggtaacatgctcttttccttaataggcgaaggccataaggataagctgttcctctatacatcgatagcccttaagtactataaggatcgcgggcagattcgagacaacaagattgggatcaagctttacaaagattctttgccgccaagtcctctgctgtttcccggtaaggtgaccgtggatcaggtgactgacagactggtgatcgcggatactgggcaccaccgcattcttgttgtgtggaagaacgggcaaatccagtactccattggtgggcctaaccccggaaggaaggatggaattttttcagaatctacattcaactcacctcaaggggtcgcaatcatgaataacatcatctacgtggcagatactgaaaatcacctgatccggaagattgatctagaggccgagaaggtctctaccgtcgcggggatcggaatccaaggaacggacaaagagggaggagcgaaaggagagcagcagcctatttccagcccatgggacgtggtatttggaacatcagggagcgaagtgcagaggggcgacatcctgtggatcgccatggctggtacccatcagatttgggcattactgttagacagcggcaagctccctaagaaaaatgaactgactaaagggacctgtctcaggttcgccggctcgggcaacgaggagaacagaaataacgcctatccacataaggcagggttcgctcagccctcaggattgtcattggcgtccgaagatccttggagttgtctgttcgtcgcagactcagagtcttccacagtccgaactgtcagcctcaaagacggtgctgtcaaacatctggtgggcggagagcgggacccgatgaacctttttgccttcggagatgtggatggtgtgggcataaatgctaaactgcagcaccccctcggagtgacatgggacaaaaaaagaaatctcctctatgtcgccgacagttataatcacaagatcaaggtggtggatccaaaaacaaaaaattgtacaacgcttgccggtaccggggatactaataacgttacatccagttcattcacagaatctacatttaacgaaccaggcggcctttgtatcggggagaatggagagctcctgtacgtcgcagacacaaataaccaccagatcaaggtcatggatcttgagaccaagatggtatcagttctgccgatcttccggagcgagaatgcggttgtggacgggccgttcttggtggagaagcaaaagaccttgcccaaacttccgaaatcggctccctccatcaggcttagccctgtcaccgcttgtgctggtcaaaccctgcagttcaaactgcgtttggatctgccgtctggctctaaattgaccgagggcgtctcatcttgctggttcctgacagctgagggaaatgaatggttgctccagggccagatcgccgccggcgacatcgaaaacatttcatcacaaccaaccatctcccttcagatccccgatgattgtctttcactggaggccatcgtgtctgtgagcgtgtttctatattactgctccgcagacagctccgcgtgcatgatgaaagcaatcctcttttcacagcccctgcagataaccgatactcagcaggggtgcatcgcgcctgtcgaactccgctatgttttttag

SEQ ID NO: 31530 - DNA, 372 bp, Artificial Sequence
  Description of Artificial Sequence: Synthetic coding sequence
atgctggggttggaaggcccctgctgggtgggcccaggacccgacggcggcctggctgtctctgaggaatttggagacgtcaggttgttcgggagtgcccggcaacctttggggtctctgggtggctggactggtcacacctttggctgtccagccggcatctgcagcaactctgaggggaacgtcatcgtcgcggacgagcagagaaggcaggtgaccttgttcccgcgtgccgggccgcccatttgtttggtctcagaggggctcgggcaaccactgggtgtggcgtgcgccccgcagggacaacttcttgtcgcggacgctaaagataactccataaaagtgtaccagggcctcaaagaactcgcatag

SEQ ID NO: 31531 - DNA, 372 bp, Artificial Sequence
  Description of Artificial Sequence: Synthetic coding sequence
atgctcggcctcgaagggccatgttgggtgggtcctggccctgatggaggcttagccgtgtcggaagaattcggtgacgtgaggctgtttggatctgcacgccagcccttaggatcactcgggggatggacgggacatacctttggctgccccgctggcatctgcagtaattccgaggggaacgtgatcgtcgccgatgaacagcgcaggcaggtaacccttttccctagggcaggccccccaatttgcctggtgtcagagggcctgggccagccattaggagtcgcatgtgcgcctcagggacagcttctggtggcggatgctaaagacaattccataaaagtatatcaaggcctgaaagaattagcgtag

SEQ ID NO: 31532 - DNA, 4821 bp, Artificial Sequence
  Description of Artificial Sequence: Synthetic coding sequence
atggtcgtatttatcaacgccaagattaaatccctgataaaattatttaaaaagaagactgtgagcaacctggacgaggagtcaagatggacggtccattatacggctccttggcaccagcaggagaatgtctttctgcccaccacccgccctccctgtgtagaagatttgcataggcaagcaaaattgaacctcaagagcgtcctgcgcgagtgcgacaagctgcgtcatgatggctaccggtcttcccaatactatagccaggggccaacattcgccgccaatgcaagccctttttgcgatgattaccaggatgaggacgaagaaactgaccaaaaatgcagcctgtcatccagtgaggaggagcggtttatctccatacgtcgaccaaaaactcctgcctcatcagacttctctgacctgaatacgcaaaccaactggactaaatctctgccactgccaactcctgaggagaaaatgcggcagcaagctcaaacagtgcaagcagacgtagtgcctattaatataacaggcgagaatttcgacagacaggcttccctcaggaggtcattgatctatacggatacccttgtgcgtcggcctaagaaagtaaagcggcgcaaaactataacaggcgtccctgataatattcagaaagagctggctagcgggacaggccaagatgatgctgatgggcactccgtctacactcctgatcactattctacgctggggcggttcaactcctgtaggtctgccggccaacggagcgagaccagagattccagctgccagactgaagatgtgaaggttgtgccccccagcatgcgacggattcgcgcgcagaaaggacagggcattgcagcccagatgggtcatttcagcggtagttccggaaatatgagcgtgctttctgacagcgctggaattgtgtttccttcacgcctggacagcgatgcaggttttcacagtctcccccggtcaggcgcccgggcaaacatacagtcattagagccccgactgggcgcactcggcccggcgggagacatgaatggtaccttcctgtatcagaggggtcatccccaggcagatgaaaatctggggcatctcggaggcgcttccggtacgggtaccctcctccggccaaaaagccaggagcttcggcactttgagtctgaaaacataatgagtccggcctgcgtggtctcaccgcacgcaacatatagtacctctatcattccaaatgccacactgtcctcttcaagcgaagtgattgctatcccaacagctcagtccgctggtcagcgggagtcgaagagctctgggtcctctcatgcacggataaaaagtcgagatcacctcatatcgcgccatgccgtaaaaggtgacccacagtctcccggacgccattggaatgagggtcacgccaccattctctcccaggacctagacccccactcacctggagagccggcgctgctgtcattgtgcgattctgcagtgccactcaacgcaccagccaatcgggagaatggctcacaggccatgccctacaattgccgcaacaacttggctttcccggctcacccacaggacgtcgacgggaaatctgagtccagctatagtgggggagggggccatagtagttcagaaccctgggagtataagtcctccggaaatggtcgcgcctccccacttaaaccgcacctggccacacccggatattcgacaccaacctccaacatgagctcatgctccctggaccaaaccagcaacaaagaagacgccggcagcctttactccgaggatcatgacggctactgtgctagcgtgcacactgattctggccatggctcgggtaacctctgtaacagtagtgatggcttcggcaacccccgacatagtgtgatcaacgtgttcgtgggtcgggcccagaagaatcaaggtgacaggtctaactaccaggacaagtctcttagcagaaatatatcgctcaagaaagcgaagaagccaccgctacccccatcgcggacagacagtttacgccggataccaaagaagtccagtcaatgtaatggccaggtactgaatgaaagtctgatcgcaaccttacagcactcactgcaactatccctgcctggaaagtcaggctcttctccttcgcagtctccgtgctcagacctagaggagccgtggcttcctaggagccgcagtcagagcaccgtgagcgccggatcatcaatgacgagtgccaccaccccgaacgtctattcactctgtggagccaccccctcccagagcgatactagctccgtgaagtcggaatataccgacccatggggatattatatcgactatacaggcatgcaagaagatcccggaaacccagccggaggctgtagcacctctagtggcgtccccaccggtaatggccccgtccgtcacgtccaggaaggctcaagggcaactatgccccaggtgccgggcggcagtgttaaaccaaaaataatgtccccagagaagtcacacagggtaatcagtccaagcagtggctatagctctcaaagcaatacacctaccgctttgacaccagtgcccgtgtttcttaagtcagtaagccctgcgaatggaaaaggcaagcccaagcccaaagtgccagaaaggaaaagctccctcatcagttccgtgtcaatcagttccagctcaacatcattgtcctcatctacctctacggaggggagtggcaccatgaaaaagcttgatccagcagtagggagccctccagccccaccaccgccaccagtacctagccccccttttccttgtcccgcggaccgctccccatttcttcctccaccccctcccgttacagactgctcccaggggtcccccttaccccatagcccagtgttccctccgcctccaccagaggccttgatccccttttgctcaccaccagactggtgcctgtctcctccacggccagctctctcacccatcttaccagattcccccgtgagcctgccgctgccccctccactgttacctagctcggaacccccccctgccccccctcttgatcctaaattcatgaaagatactcggcctccattcactaactccggacagccagagagttccagggggtcacttcgcccgcccagcacaaaagaagaaacctctaggccaccgatgccactcatcacaactgaggctctgcaaatggtgcaactgcgacccgtccgcaagaatagcggggccgaagctgcacagctgtccgaacgaactgcgcaggagcagcgcactcccgtagccccacagtaccacctgaagccgagtgctttccttaagagccgaaatagcaccaatgaaatggaaagcgaaagccagcctgcttctgtaacctcttctctgcccactccagcaaagtctagctcccagggtgaccatgggtccgccgccgaacgcggcggacccgtgtcccgctcaccaggtgctccttctgcaggggaagccgaggcaagaccctcaccttcgacaaccccacttccagattcaagcccaagccggaaaccccctcctatctcaaagaaaccgaagctgtttctggtggtccccccgccacagaaggacttcgcagtagaacccgcagaaaacgtctccgaggctctacgggctgtcccttccccaactaccggtgaagagggatctgtgcatagtcgcgaggccaaggaaagttcagctgcccaggcaggctcgcacgcaacccatcccggaaccagtgttttggagggaggagcagccggaagcatgagcccatcacgagtggaggccaacgtgcccatggtgcaaccggacgtaagccccgctccaaaacaagaagagcctgctgagaattccgccgacactggcggcgatggggaaagttgtctgagccagcaggatggggctgccggcgtccctgaaacaaacgcagcgggaagctccagcgaggcttgcgattttctcaaggaggatgggaacgatgaggtgatgactccttctcgcccacggaccaccgaagatctgtttgcagcgattcataggtctaaacggaaggttctcggacgcagggactctgatgacgaccatagccgaaatcattctccaagtccaccggtaactcccacgggggctgctccctctcttgcctcacctaagcaggtgggcagtatacagagatccatacgcaaatcctccacctcctccgataatttcaaggcgttgctcctcaagaagggcagccgaagcgacacatcagcaaggatgtctgcagccgagatgctgaagaacactgatccaaggtttcaacggtccaggtccgaacccagccccgacgccccagaaagtccctcatcctgctcaccaagcaagaatcggagggcccaggaggagtgggcaaaaaatgaaggactgatgccaaggtctttgagcttctcggggcctagatacgggcggtccagaacacccccctctgcagcttcctctcgctatagcatgaggaacagaatacagtcgtccccaatgaccgtgataagtgagggcgaaggagaggcagtagagcctgtcgattcgattgcaaggggcgccctgggcgctgccgagggctgcagcttggatggattggccagagaggagatggatgaagggggcctcctgtgtggtgaaggccccgcagcttcattgcaacctcaagcccctggacccgtggatggaacagcctccgctgagggccgcgaaccctctccccagtgcggtggcagtctgagcgaggaaagctag

SEQ ID NO: 31533 - DNA, 4833 bp, Artificial Sequence
  Description of Artificial Sequence: Synthetic coding sequence
atgaagaaagaagggtctagcggtagctttaggctccagcccaacaccggcagcctcagcagagctgtgtcttggatcaatttttcctcactgtcaaggcaaaccaaaaggctgttcagatctgacggagagctatcagtgtgcggccaacaagtcgaagtcgatgacgaaaactggatttacagagcccaaccacggaaagccgttagcaacctggatgaagagtcaaggtggacggtgcattataccgcaccatggcatcaacaagagaacgtcttcctcccgactacacggcctccttgcgtggaggacctccacaggcaggccaagctgaaccttaaatcagtgctccgtgagtgtgataaactcagacacgacggttaccgctcttcccagtactatagtcagggcccgacttttgcagccaacgccagtccattttgcgatgactaccaggacgaagatgaagagacggatcagaaatgctcactctcatcaagtgaagaagaacgctttatctcaattcggcgcccaaaaacccctgcttcaagcgatttctcagacttgaacacacagacaaactggacaaagagcctgccgctgccgactcctgaagagaagatgcgccagcaggcccagacagtccaggccgacgtggttccaataaacattaccgctagcggaacaggacaagacgacgctgatggtcacagtgtgtacacccctgaccattatagtacactcggccggtttaacagctgccgtagcgcaggacagcgttctgaaaccagagatagctcctgccagacagaagacgtgaaggtggtgcctccctccatgcgacgaattcgtgctcagaaaggccaaggcattgcagctcagatggggcacttttccggttccagcggtaacatgtccgtgttatctgactctgccgggatcgtgtttccctctagactggactcagatgctggcttccactcactgcctagatccggtgcacgcgccaatatccagagtctggaaccccgattaggcgctttgggacccgcgggtgacatgaacggcacgttcctataccaaagaggccaccctcaagccgacgaaaaccttgggcacttgggaggcgccagtggtacggggactctgttacgacctaaaagtcaagagcttcggcattttgagagcgagaatatcatgtctccagcatgtgtggtttccccccacgcaacctactccacttcaatcattcccaacgcaacgttatcaagttctagtgaggtgattgctatcccgaccgcccagagtgcaggacaacgggagtcaaagagttctggatcgagccacgctcgcattaagtctcgggatcatctgattagcaggcacgcagtgaaaggtgacccacagtctccaggacgccactggaatgagggccatgctacaatccttagtcaggaccttgatccccatagccctggcgaacctgcccttctgagcctatgcgattccgccgttccccttaacgctccagctaacagagagaatgggagccaggctatgccatataattgccgtaataatttagctttccctgcccacccccaggacgtagatggaaagtcggagtcttcctacagcggtggggggggacacagtagttctgagccttgggagtacaaatctagtggcaatggacgcgcctctcctctaaaacctcatcttgccacgccaggttattcaacccctactagcaatatgagctcttgtagtctcgatcagacatctaacaaagaggatgccgggtctctgtacagcgaggaccatgacggttattgcgccagcgtccacacagactccgggcatgggagcggaaacctgtgtaacagctcagacggctttggcaatccccggcattcagtcataaacgtatttgtgggtcgtgcacagaagaatcagggcgaccgaagtaactatcaggataagtccctgagtcgtaatatcagcctgaagaaggcgaaaaagccacccctgcccccctcccgaacggacagtctcagacgaatccctaagaaatcctcccagtgcaacggtcaggtcctgaacgagtctctgattgcaacccttcagcactcactgcaattgagcctgccagggaagtccggatcatccccatcccaatccccatgtagtgacctggaggagccatggcttccaaggtctcggtcccagagtaccgttagcgctgggagctcgatgacttctgcaaccactcctaacgtctatagtctctgtggcgcaacccccagtcaaagtgacacatcttcagtgaagagcgagtatactgacccatggggctactacatagactacacagggatgcaggaggaccccggaaatcctgcaggtggatgtagcacatccagcggagtgcccacgggcaatgggcctgtccggcatgtccaggagggcagccgggcgaccatgccccaggtgcctggaggctccgttaaacctaaaatcatgtcccctgagaaatcccaccgtgtgatcagcccaagcagcgggtacagcagccagtcaaataccccaactgctttgacaccagtgcctgtctttttgaaaagcgtgtcccccgctaatggaaaaggtaagcccaaacctaaggttccagaacgcaagagcagtctgatctcttccgtttccatctcatcatcttctacttctctgtcgtcttccacatctacagagggtagtggtacgatgaaaaagctggatccagccgtgggctccccccccgcacccccgccccctcccgtgccaagtcctccatttccgtgccctgctgaccggagcccttttcttccacccccccctcccgttacagactgctctcagggtagccccctgccgcactcgcccgtctttccaccacctccccccgaagcgcttatccccttctgcagccccccagactggtgtcttagccccccaaggcctgctctttccccgattctaccagactctcctgtctctctgcctctccctccccctttgctacctagctccgaaccccccccggcaccacctctagatccaaagtttatgaaagacacacgacccccgtttacaaacagcggacagccagaatcatcccgtggctctctacgaccgccttcgactaaagaggagacctctagacctccgatgccgttgatcactacagaggctctgcagatggtccagcttaggccagtgaggaaaaattctggcgcagaagcagctcagctttccgagcgcaccgcccaggaacaacggacgccagtggccccacagtaccatctcaagccttctgcattcttaaagtccaggaactctacaaatgagatggagtccgagtcacagcctgccagtgttacaagctctcttcccactcccgcaaaaagttccagccagggcgaccatggttcagccgccgaacgcggaggccccgtgtcaagatcgccaggagcaccgtctgcgggggaagcagaagccaggccttccccaagcacaaccccactgcctgacagctctccctccaggaagccacctccgattagtaagaagcctaagctgtttctcgtggtaccccccccacagaaagactttgcagtggaacccgccgagaacgtatctgaggccctccgcgctgtgccatctccaactaccggagaagaaggatcagttcactctcgcgaagccaaggagagctctgcagcgcaggcggggtcccatgcaacccacccagggacctctgtgctggaaggaggcgccgccggaagcatgtcccccagtagagtggaagcaaatgtgccaatggttcagcccgatgtctctcctgcacccaagcaggaagaaccagctgaaaactcagcggacactggcggcgatggggaatcttgtttgtcccaacaagatggagctgccggcgtccccgagaccaacgcggcgggaagttctagcgaagcgtgtgactttctgaaagaggacggaaacgacgaagtgatgaccccctctcggccgaggacaactgaagacctatttgcggctattcaccgcagcaagcgcaaagtgctcggccggcgtgatagcgacgacgaccacagccgtaatcactcccccagtcctcctgtcacacccaccggcgccgcgccaagtttggcaagccccaaacaggtgggatcaatccagcgctccattcgcaaatcttcaacttcctcagacaattttaaagccctcctcctgaagaagggctccaggagtgatacatccgcccgtatgtcggccgcagaaatgctgaagaacactgatcctagatttcagcgaagccgctcagagccaagcccggacgccccggaatcaccatcaagctgttctcctagtaagaaccgccgtgcgcaagaggagtgggcaaaaaatgagggtctgatgccacgtagcctcagtttctccggcccacgttacggtagaagtcgtactcctcctagcgctgcctcctcgaggtattcaatgcggaatagaatccaaagttcaccaatgaccgtaataagcgaaggcgaaggggaagcagttgagcccgtggattcaatagctcgtggagcattgggagcagcggagggatgctcgctcgacgggttagcaagggaagagatggatgagggcggcctgctgtgtggcgagggccctgccgcgtcccttcagccccaggcaccaggtcccgtggacggaacagccagcgctgagggaagggagccttccccacagtgcggtggctctctctcagaggagagttag

SEQ ID NO: 31534 - DNA, 2130 bp, Artificial Sequence
  Description of Artificial Sequence: Synthetic coding sequence
atggagtcaatggggatggtatatagtgttccttcaagctgcaacggccccacagagtctacattcagtacctcgtggaagggagatgctttcacttacatgacaccatccgcaacgtctcagtcaaaccaagttaatgaaaatggaaagaacccctcttgcggcaattcctgggtgtcattaaataaagtgcctcccctggtgcccaaggaggcagccacactgcttgtagccagggataatccagcaggttgctccggcagcgctggctatccggagcgcctgatccagcagcgccatatgccggaacggccttctaagatcggcctgttgacatcgggaaccagtcgactggagacaggccctgggggtgcttcaaggtttcgagagcgctcattaagcgtccccactgatagcggaacaaccgacgtcgactacgatgaggagcagaaggccaacgaagcctgtgccctgccattcgcctctactagcagtgaaggctcaaatagcgcggacaacattgcttcattatccgcacagcaggaggctcaacacaggagacagagatccaagagcatctcgctgcggaaggctaaaaagaagcctagtccccctacacgcagcgtgtccctagtaaaggatgagcctggcttgctgccagaaggagggagtgctttacctaaggaccaacgccctaagagcttatgcctgtccttggagcaccaggggcaccactctagccacccagatgctcagggccaccctgcaatcccaaatcacaaggatccagaaagcacccagttcagccaccactggtacctcacagattggaaaagcggagatacataccaatccttgtcgtcttccagcaccgctacgggcactaccgttatagagtgtacacaggttcaggggtcctcagagagtctagcttctccaagcacaagtcgtgccactaccccctcacagttgtccattgaagtggaagctcgcgagatatcatcccccggacggcctccgggcttaatgtcaccctcctccggttactcgtcccagagcgagacccctacccctaccgtgagtatgtccctgaccctcggacatctgccacctccatcctcttccgtgagggtgcgccctgtggttcctgagcgaaagagctccctaccccctactagccccatggagaagttcccgaaaagtcgcctgagtttcgacctgcccctcacctcttcacctaatcttgacctaagcggtatgtctatatctatacgctcaaaaacaaaggtgagccggcatcattctgaaacaaacttcggtgttaagctggcccagaaaaccaaccccaaccaacccataatgcctatggtgacacaatctgatttacggagtgtgaggttgcgtagtgtcagcaaatccgagccggaggacgatattgaaagcccagaatatgcagaagaacccagagccgaagaggtgtttacactacccgaaaggaaaactaagcctccagtggcagagaagccccccgtggcccgtcggcctccgtcccttgtccacaaacctccgtccgtgcctgaggaatatgccctgaccagcccaacgcttgccatgcctccgagatcctccattcagcatgccaggcctcttccgcaggactcatataccgtggtccggaaacctaaaccttcttccttcccagacggaaggagccctggagaatcaacggcaccctcctcgctggtctttacccccttcgcaagcagctcagacgcttttttttctgggacacagcagccgcctcaaggcagcgtagaggacgaagggcctaaagtgcgtgtgctgccggagcgaatctccctgcagtcccaggaagaggcagagaagaaaaaaggcaaaatcccgccgccggtaccaaagaagccgagcgttctgtacctgcctctgacctctccgactgctcagatggaagcctatgtcgcagaaccccgactcccattgagtcctattatcaccttggaggaggacacaaagtgtccagcgaccggggacgatcttcaatctctgggccagagggtgacgagcactcctcaggctgattctgagcgagaagcgagccccctgggatag

SEQ ID NO: 31535 - DNA, 2130 bp, Artificial Sequence
  Description of Artificial Sequence: Synthetic coding sequence
atggagtctatgggcatggtttatagcgtgccatcctcctgtaacggcccaactgagagcactttcagtacttcatggaagggagacgcctttacttacatgactccttctgctactagccagtctaaccaggtgaatgaaaacggcaagaatcccagttgcggaaacagctgggtgagcctgaataaggtgccccccctggtacccaaagaagcagctaccctgctcgtggcacgagataatcctgcaggatgctccgggtcggccgggtatccggagaggcttattcagcagcgacatatgcctgagagaccctctaagatagggctgctgaccagcgggactagtcgcctggagactgggcccgggggagcatcaaggttcagagagcggtctttatcggtccccaccgatagcgggactacggacgttgattacgatgaagaacaaaaggcgaatgaagcttgtgccttgccctttgcctcaacaagctctgaaggtagcaactccgcagacaatatcgcaagcctgtcggcacagcaggaggcccagcacagaaggcagaggagtaagtccatttcgctcagaaaagccaaaaagaaaccgagcccgcctacacggagtgttagtctggtgaaggatgagcctggtctcctgcctgagggaggctctgccttgcccaaagatcagagaccaaaaagcctgtgcctctccctggagcaccaaggacatcacagctcgcaccctgatgcccagggccatcctgccattcctaaccacaaagatcctgagtcaactcagtttagccaccactggtacttaactgattggaaatcaggagacacctaccaaagcctgagttcctccagcacagccacaggcactacggtgatcgagtgcacacaggtgcagggcagctctgaaagcctggccagtccgtccactagccgtgcgacaacaccctctcagctatccatcgaagtggaggctagggagatttcttcacctggacggccacccgggctcatgtctccttcatccggctactcttctcaatccgaaaccccaacacccaccgtgagtatgtcacttaccctaggacatctccctcccccatcctcttcagtcagggtccggccggttgtccccgagcggaaatcgtctttgccgcccacaagtcccatggagaaatttccaaaaagtcgtctctccttcgatctgcccctcactagctcccctaatctcgatctaagcggaatgtccatttctatccgctccaagaccaaggtttcccgccaccatagtgagacgaattttggcgtcaaacttgcgcagaagaccaaccccaatcagccaattatgcccatggtcactcagtctgacctccgttctgtacggttgcgcagcgtgtccaagtccgaaccagaagacgatattgagtcgccagaatatgccgaagaaccgcgagcagaggaagtattcaccctaccagagagaaagacaaaaccacctgtagcagagaaacctcctgtggcgagaaggccccctagtctggtgcacaagcctccttcagttcctgaggaatatgcgttgacttctccaaccctggctatgccaccacgctctagcattcagcatgcacgcccgctgccccaggacagctataccgtggtgaggaaaccgaaaccctcctctttcccggacggtaggtctccgggcgaatcgacagctccttccagtctcgtatttaccccttttgcttcctctagtgacgcattcttttctgggacgcagcagcccccccagggcagtgtcgaagatgaaggtccaaaagtaagagtcctccccgagaggattagcctccagagccaggaagaggccgagaagaaaaaaggcaagatccctccccctgttccaaaaaaacccagcgtcttatatctccctcttacttctcccaccgcccagatggaggcctacgtggctgaaccaagactgccactatctccaattatcacattggaagaagacaccaagtgccctgccaccggagacgacctccagagtctcgggcaaagggttacgtctacgccacaagccgatagtgagcgtgaggccagccccctgggatag

SEQ ID NO: 31536 - DNA, 3678 bp, Artificial Sequence
  Description of Artificial Sequence: Synthetic coding sequence
atgccattttaccgtcgaaccgtggttccccaacgattgtgccccagaaatcctccccaacagctggccgagttgcgagacgtgtctcacctcgctgccctctccctgttaaggcagctggcagatctgtgtggacacagcctcgccctcctggaggatctggaaggacacctcctagctctcgggagaaggactgattccctttatcggagaacggtgcgtcttagacggcgcctcccctgccgcctcctgggacccgaagaggatgaggaggagttagcagccgcaaattcgggcagggagaatgctaccgccacagcccactccagaagcagctggcgccagcccgtgaacgtgttcttaagctcaggaaggcctccgagtgtagaggagctcctgagggaggcccagctgaatctgcaatctctcctccaagaggagtacgaggagcaatattccgaagcacggctggtggggcagaccttcagatctagcgatgaagcaactaagcccacacccaatccccgcccacagtcagccaggcggctggagttcatcctgatgcccacaaagcggcagttgtccgaggatgaaaccacaacacagggggtaagggccccggaggcctctctcagcctatctaccacggctgataaacagactgcttggaactctctgtttccattaccaattctcgaggaaaagcggtggcctcagctttgcagtacccaatcggacatcgtgcctataaatatctccggacagcaattcgacaaacacgccagccttcggcattctctatttaacacagagacagcagtcaacccaaagtcaaccctcagacggaggagaactattattgggttttctaacttctcccaaagagatcagggtcacagcaattcgcctgcgggctctgttgctcactcaactacctctgatattaggcccagtcacagcgtacccgaaggggttcatggaagggtggccgtggggcaggatgctcgattcccatctctcactagccctgtgctgagaactccatcgtccgaaccagacgaacctcaccaggctcgctcaggacccaacccccccgggatggagtcaatgggcatggtgtattcagtcccctcgagttgcaatggcccaacagagagcactttttccacaagctggaagggagacgcgtttacctacatgactccatccgccacttctcagagcaaccaggtaaatgagaatggaaagaatccgtcttgcggcaatagctgggtgtcactgaacaaagtgccccctcttgtgcccaaggaagccgccaccctgttggttgccagggataatcctgcaggttgctctggaagcgctggctatcccgagagactcattcagcaacgccatatgcctgaacgaccctctaagataggcctgctgactagtggaacctcccgtcttgagacaggccccggcggcgcttctcggtttcgagagaggtctttatccgtgcctaccgacagtggcacgacagacgtagattacgacgaagaacagaaggccaacgaggcatgcgctctgccttttgcttcaaccagcagcgaaggcagcaactccgcggataatattgctagcctctccgcacagcaggaggcccagcatcgcagacagagatccaagagtattagtctgcggaaggccaaaaagaaaccttcacctccaactagaagcgtcagtctggttaaggatgagccaggcctgctgccggagggtgggtccgcgctccctaaggatcagagaccaaaaagcctgtgcctgtcccttgaacatcaggggcatcactcgtcacatcccgacgcccagggacatcctgctattcccaaccataaggatcctgaaagcacccagtttagccatcactggtatctcaccgactggaagagtggggatacctaccaatctctgagctcttctagtacagctactggcacgacagtaatagagtgcacacaagtccagggttctagcgaatccctcgctagcccttcaactagtcgtgcaaccactccttctcagttgtcaatcgaagtggaggccagagaaatcagctcccccgggcgtcccccaggactcatgtcaccatcctcagggtactcctctcagagcgagaccccgaccccaaccgtgagtatgagcctcacgctcggtcacctcccacctccatctagttcagttcgggtccgccccgtcgtgcccgaacgtaaatcgagcctgcctcctacttctccaatggaaaagtttccgaaatccagactttcatttgatctcccccttacttcatctccaaacctggacctgtccggtatgtccatttccatccgcagtaaaaccaaggtgagcagacaccacagcgagaccaactttggtgtaaagctcgcacagaaaactaacccaaaccagccaattatgcccatggtaacacaatctgacttgcgcagcgtgcggcttaggtccgtgtctaagagtgaacccgaggacgatatcgagtctccggagtacgctgaagaacctagagcagaagaggtctttacgctaccagaaaggaaaactaagccgcccgtggctgaaaaacccccagttgctcgtcgaccaccttctctagtgcataagcctcccagcgtgccagaggagtatgcgctgacgtcccctactctggctatgccacctcggtcgagcattcaacatgcacggccacttcctcaggactcgtataccgtggtaagaaaacctaaaccatcttctttccccgacggtaggtcccctggcgagtcaacagcaccttcttcccttgtgtttacgccttttgcctctagcagtgatgcatttttcagcggtacccagcagccccctcagggtagcgtggaggacgagggccccaaggtcagggtgctcccagaacgaataagtcttcagtcccaagaggaggcagagaaaaagaaaggcaaaatccccccaccagtgccgaagaaaccttcagtgctgtatttgccgctcacgagccccactgctcaaatggaagcctacgtggctgagccccggctcccactctctcctattattacgcttgaggaagatactaaatgtccggcaaccggagatgaccttcagagcctggggcagcgggtgacttctaccccccaggcagacagtgaaagagaggcctccccactcggcagttctgtcgaacctggaacagaggagaagagtttgattagcgataaaaccgcagaatggatagcagaagatgacgacgacgtgttcgtcgctagccggactaccgaggatctgtttaccgtcatccataggtccaagcgcaagctgttagggtggaaagagccgggcgaagcctttgttggcggacgaaccagctcccattctcctataaaaaatactgctgaaagtcctatctctgagtccacagcgaccgcaggcagcggatctagcgccaaccttgatgcagggcggaatgacgacttcaaggccctgcttcagaagaagggatccaaagctacccccaggtctcgaccttccgcagccgaactgctgaagacgacaaacccattggccaggcgcatcatcgcacagttctccaaggactacgaaactacagacaatccatctacctag

SEQ ID NO: 31537 - DNA, 2139 bp, Artificial Sequence
  Description of Artificial Sequence: Synthetic coding sequence
atgcctgatcaggataaaaaggttaagaccactgaaaaatccacagacaagcaacaggagatcactattcgagactactcagacctgaagagactgcgatgtctgctgaatgtacagtccagcaaacagcagcttcctgccataaactttgactctgcgcaaaattcgatgacaaagtcagagccggccatcagagcggggggccacagagctcgcggccagtggcatgagagcaccgaagctgtggagttagaaaatttctcaatcaactacaagaacgagcgtaacttctccaaacacccccagaggaaactgttccaggagatctttacagcactcgtcaaaaacaggctcatctctcgtgagtgggtgaatcgcgctccaagcattcacttcctgcgggtgctaatctgtctgagactgctgatgagagacccctgctaccaggagattctgcacagcctcggaggtattgaaaatttagcacagtacatggaaatagtggcaaatgagtaccttggttacggcgaggaacaacacacagtggacaaactagtaaacatgacgtacattttccagaagctggcagccgtaaaggaccagcgggaatgggtgacgacgtccggtgcgcataaaacactggtgaacctcctgggtgcacgggacacaaatgtactcctgggcagcctcctggccctagccagtctcgctgaaagccaggaatgccgagaaaaaatctctgaactgaacatcgttgagaatttgctgatgatactgcacgaatatgatttgttatctaaaagactgacagccgaactcttaaggctcctgtgtgccgagcctcaggtaaaagagcaggttaagctctacgaaggaatccctgtattgctgtccctccttcactccgaccatctgaagctgctctggagtatcgtctggatactggttcaagtgtgcgaggatcctgaaaccagtgttgagatccgaatctggggcggcataaaacagctgctgcacatcctgcagggtgaccgaaatttcgtgtcagaccattcgtccattgggtcgctgagtagcgccaacgccgctggtcgaatccagcagctccacctgtccgaagatttgtcccccagggaaatccaggaaaacactttcagcctccaggctgcgtgctgtgcagccctgacggaactggtgttgaatgacacgaatgcgcatcaagtcgttcaggagaatggcgtgtataccattgcaaaactgatcttaccaaacaagcaaaaaaatgctgccaaatcgaatctgctgcagtgctatgcctttcgtgcactgcgatttttgttttctatggagcggaacaggccactctttaaacgcctgttcccaactgacctgttcgagatatttattgatattggccattacgtgagagatatcagtgcctacgaagaacttgtgagcaaattaaacctgctggtggaggacgaactcaagcaaatcgctgaaaatatcgagtctattaaccaaaataaagcacccctcaagtacattgggaactacgccatccttgatcaccttggctctggcgcttttgggtgcgtctataaggtgcgaaaacacagcgggcagaacctcctggcaatgaaggaagttaatctgcataatcccgcttttggcaaggacaagaaggatcgtgattccagcgttagaaatatcgtttctgaactgacaatcattaaagagcagttgtatcatccaaatattgtgaggtactataagaccttcctggaaaacgacaggctttacatagtcatggaacttatcgaaggcgcccctctgggcgagcacttctcctccttgaaggaaaagcatcatcacttcacagaagagcgtctgtggaaaatatttattcagctctgtttagccctgagatatctgcataaagagaaacgcattgtccatagggatctgaccccaaacaatatcatgctaggtgacaaggataaggtgacagtaacagactttggcctggccaaacagaagcaagagaatagcaagctcacttcggtcgtaggcacgatcttgtacagttgcgttcagcacttgtatctgcgcagtcccgctcccgctctggcaacctag

SEQ ID NO: 31538 - DNA, 1215 bp, Artificial Sequence
  Description of Artificial Sequence: Synthetic coding sequence
atggagctgattgagggcgcacccctcggcgaacatttttcaagtcttaaggagaagcaccatcacttcactgaggagagactgtggaagatcttcatccaactgtgcctcgccctgcgttatttgcacaaggagaaacgtattgtccaccgggatctaactcccaacaacattatgctgggcgacaaagataaggtcaccgtgacagacttcggcttggccaaacagaagcaggagaacagcaaactgacaagcgtggtgggcacaatcctatacagctgccccgaggttctgaagtccgagccttatggagaaaaggccgacgtgtgggctgtaggctgcattctctaccagatggctacattgtccccgcctttctacagcacgaatatgctttccctggccaccaaaatcgtggaggctgtgtacgaacccgtgccagagggcatatactctgaaaaggtgaccgacacaattagcaggtgtttgacccccgacgctgaagctagaccagatattgttgaagtgtcgagcatgatcagtgacgtgatgatgaagtaccttgacaacctgtctacttctcagctttctctggagaagaagctggaacgtgagagaagaagaactcaaaggtacttcatggaggcgaacaggaacacagtcacgtgtcaccacgaactggctgtcctgtcccatgaaacatttgaaaaagccagcctgtcaagctcgtccagcggggccgcaagtcttaagtctgagctttcagaatcagcggacctaccgccagagggttttcaagcctcatacggcaaggacgaggatcgagcctgcgatgaaattttgtcagatgataactttaatctggaaaatgccgagaaggacacatattccgaggttgatgacgagttggatatctctgataattcgagctcttcgtcctcatctcctttgaaggaatccacattcaatatcttgaagaggtccttttccgcatcaggaggggaacggcagtcccagactcgagactttacgggcggaactgggtcccgccctcgccctgctcttctgcctttggacttactacttaaggttccccctcatatgctgcgagcacacatcaaagaaatcgaagcagagctggtgaccggctggcagtcccacagtctgcccgccgtgatactgcgcaacctgaaagatcatggctccacctactag

SEQ ID NO: 31539 - DNA, 1284 bp, Artificial Sequence
  Description of Artificial Sequence: Synthetic coding sequence
atggtgcctgtgcagccagccgagcctccagaggtcctgaaatcagagccgtatggtgagaaggctgacgtctgggcggtgggttgcatcctctaccagatggctacccttagcccacctttttatagcacaaatatgctgtctctggctaccaaaatagtcgaagccgtgtatgaaccagtacccgagggcatctactcggagaaggtcaccgacaccatttcacgttgtttaactcctgacgccgaggctagacccgatatcgtcgaggtgagctccatgatttctgatgttatgatgaagtacctggacaatctgagtacaagtcaactgtcgctggagaaaaagctggaacgggagaggcgccggactcagagatactttatggaggcaaaccggaatacagtaacctgccaccacgagctggccgttttgtctcacgagaccttcgaaaaggcatccctgtcaagctcctctagcggcgctgcctcactgaagtcagaactcagcgaaagcgccgacctgccacccgaaggttttcaagcctcctatggtaaagacgaagacagggcatgcgacgagatattgtcagatgacaatttcaaccttgaaaatgctgaaaaagacacctattccgaagtcgacgatgagctggacatcagcgataacagctcatcatcaagttctagcccccttaaagagagcaccttcaacatacttaaacgttccttctctgcctccggtggagagagacaaagccaaacccgcgactttaccggaggtacagggagtcgcccaaggcccgcctccgctggcattgccgtcagccagagaaaggtgcgccaaatttccgatcccattcagcagatcctgatccagcttcataagattatttacattacccagctacccccagccttgcaccacaatctgaaacgacgtgtaattgaacgtttcaaaaaatccttgttttcccagcaaagtaatccttgtaacctgaagagtgaaatcaaaaagctgagtcagggatcccctgagccaattgagcctaacttcttcacagccgactaccacttacttcatagatcttcaggagggaactccctgtctcccaatgaccccacgggcttgccaacctcaattgagctcgaagaggggattacatatgagcagatgcaaaccgtgattgaagaggtgctggaagaatccggatactacaatttcacatctaataggtatcattcttatccctggggaaccaaaaaccatccaacaaaaaggtag

SEQ ID NO: 31540 - DNA, 1425 bp, Artificial Sequence
  Description of Artificial Sequence: Synthetic coding sequence
atggtccccgtccaacccgccgagccccctgaggtgctgaagagcgagccatacggagagaaggctgatgtgtgggccgtcggctgcattctgtatcaaatggccactctgagtccccccttctattctaccaatatgctgagcctggcgaccaaaattgtcgaggcagtatacgagccagtccccgaaggaatctactccgagaaggtgactgacacaattagccggtgcctgactcctgacgcagaggcccggcccgacattgtggaagtcagctccatgatatcagacgttatgatgaagtatctggacaatctgtctaccagccagcttagcctcgaaaagaaactggagcgtgaacgacgaaggacccagcggtattttatggaggccaatcggaatactgtgacgtgtcaccacgagctggcggtgctgtcccatgaaacgttcgagaaggctagcctgagtagtagcagttccggagcagcatcattgaaaagcgagctgagcgagagcgcggacctgccccctgagggctttcaggcctcctacggcaaggacgaggacagggcctgtgatgaaatcttaagcgacgataactttaatctggagaatgcggaaaaagacacttactctgaagtggatgatgaattggatatcagcgacaactcctcgtcgtccagctcttctccactcaaagagtccacatttaatattttaaagagatcattctcagccagtggaggggagaggcagagccagacgagagacttcaccggaggtaccggctctcgacctaggcctgcactactgcctctggacctactcctaaaagtccctccacacatgttaagagctcacattaaggaaatagaagccgaacttgtgaccgggtggcagagccacagtctgcccgctgtgatcctgcggaatctaaaagaccacgcaagtgccgggatcgccgtttcccaacgaaaagtcagacaaatcagcgacccaattcagcagatcttaattcagctgcacaaaatcatctacatcacacagctgccccctgccctgcatcacaatctgaagcgtcgcgtgatagagaggtttaagaaatctcttttctcccagcaatccaatccgtgtaatctcaaatctgagatcaaaaagctgagtcagggaagtccagagccgatcgaacccaattttttcacagccgactaccacttgctacatcggagtagcggaggtaactccctgtcacctaacgaccccacagggctgcccacatctatcgagctcgaggaaggcattacttatgagcagatgcagactgtgatagaagaggtgttagaggagagcggttactacaattttacatccaacaggtaccatagctacccgtggggcaccaaaaatcaccctactaagaggtag

SEQ ID NO: 31541 - DNA, 2178 bp, Artificial Sequence
  Description of Artificial Sequence: Synthetic coding sequence
atgcctgaccaggataaaaaagtaaaaacgaccgagaaatccacagacaaacagcaagaaattacgattcgggattatagtgatctcaagcgcctcagatgtttgcttaacgtccaaagttctaaacagcagttacccgccataaacttcgactccgcacagaactccatgaccaagtccgagcctgcaatcagagccggtgggcatagggcacgtggacagtggcacgagtctacagaggcagtcgaactggagaattttagtatcaactacaagaacgaacgcaatttttctaaacacccccagcgaaagctttttcaggaaatcttcaccgctctggtcaagaatcggctcatcagcagagaatgggttaatcgggccccctccatccacttccttcgagttctcatctgcctacgacttctgatgcgcgatccttgttaccaagagatactgcactcattaggtgggatcgagaatttggcccagtatatggaaatcgtcgccaacgagtaccttgggtacggcgaggaacagcatactgtagataagcttgtgaacatgacatatatctttcaaaaactggccgcagtcaaggaccagagggaatgggtgacaacgagtggggcgcataagaccctcgtaaacctcttgggtgcaagagataccaatgtgctgttggggtcgctgctggctctagccagcttggccgagagtcaagagtgtcgggaaaagatctcagaattgaacatcgtggagaacctgctgatgatcctgcatgaatatgaccttttgtctaagcggctcactgccgagctcctgcgcttgctctgtgctgagccacaggtgaaagaacaagtgaagctttatgagggcattcccgtcttactctctcttctccatagcgaccacctgaagctgctgtggtctatcgtatggatccttgtgcaagtctgtgaagaccccgaaacttcagtagaaatcaggatctggggaggcataaagcagcttctacacatcctccagggcgacaggaatttcgtgtctgatcattcctccattggttcactgagcagtgccaacgccgcggggaggatccaacaattgcatctgtccgaggatctgagcccccgggaaattcaagaaaacacgttctctctacaggccgcttgctgcgctgcgcttacagagttggtcctgaatgatactaacgctcaccaggtagtgcaggagaatggggtatatacaatcgctaagctcattctgcctaataagcagaagaacgccgccaagtcgaacctgttgcagtgctatgccttcagagctctgcggttcctgtttagcatggagcgcaaccgaccgttatttaaacgattgtttcccacggacctgttcgagatttttattgatatcgggcactacgtacgggatatctcggcgtacgaggaactggtgtctaaactgaatctgctggtagaagatgagcttaaacagattgcggaaaacatagaatccattaaccagaataaggctccactgaagtatatcggaaactatgctatcctagaccaccttggatccggcgccttcggttgcgtctacaaggtccgtaaacattccggccagaaccttttagctatgaaggaagtgaacctgcacaatcccgccttcgggaaagacaagaaggacagggactcttcagttaggaatattgtaagtgagctgacgatcattaaggagcagctctaccatccaaatatcgtgcgctattacaagactttccttgaaaatgatcgactgtacatcgttatggagctgattgagggcgcccctctgggagagcacttcagctcactaaaggaaaagcatcatcatttcaccgaggaaagactatggaagatctttattcaattatgtctggccctccggtacctgcacaaggagaaacggatcgttcaccgcgaccttactccgaacaatatcatgctcggtgataaggacaaagtcacagtatcatgtctgaaatgcgccgcgccactgcccagcttatcatgttcatgcagcggacatattaagcgtgccggtagttcgtttgcgttttgttaccattggaagctaccagacgctagccaggaggccaatgcgatcatggtcccggtgcagcccgcagaaccatag

SEQ ID NO: 31542 - DNA, 291 bp, Artificial Sequence
  Description of Artificial Sequence: Synthetic coding sequence
atgcccgaccaggacaagaaagtgaaaacgaccgaaaagtcaacagataagcagcaggaaatcactatacgcgattactcagacctcaaacggctccggtgtctgctgaatgtgcaaagctccaagcaacaactccctgctatcaatttcgattccgctcagaattctatgacgaagagtgagcccgcaatcagggctggcgggcatagagccagaggccagtggcatgagtccaccgaagcggtcgagctcgaaaacttttccataaattataaaaacgaaaggaattag

SEQ ID NO: 31543 - DNA, 402 bp, Artificial Sequence
  Description of Artificial Sequence: Synthetic coding sequence
atgccagaccaggacaagaaggtaaaaacaaccgaaaaatcaacagacaagcaacaggaaatcacaatacgggattatagcgacctgaaacgtctacggtgtctgctgaacgtgcagtcctcaaagcagcaattgcccgccatcaactttgacagcgctcagaattctatgacaaagtcagaacccgcgatacgcgcaggaggccatcgcgctcgaggacagtggcatgagtctaccgaagcggtcgagctcgagaacttttctattaactataaaaacgagcgcaatttttctaagcacccgcaacggaagctttttcaggaaatcttcaccgctcttgtgaagaacaggctgatttcgagagaatgggtcaaccgagcgcccagtattcatttcctgtag

SEQ ID NO: 31544 - DNA, 2127 bp, Artificial Sequence
  Description of Artificial Sequence: Synthetic coding sequence
atggataagtacgatgtcataaaagctataggacagggcgcatttgggaaagcatacctggccaaagggaagtccgattcaaagcattgtgtaattaaggagatcaacttcgaaaagatgcctattcaggagaaggaggcctcaaaaaaagaagtgatcctgttagaaaaaatgaaacatcctaatattgtggcgtttttcaacagttttcaggagaatggtcgcctgtttattgtcatggagtattgcgacggaggcgatctgatgaagaggatcaaccgccaaagaggagtactgttttccgaagatcagatattgggatggtttgtgcagatcagtctgggacttaagcatattcacgaccgcaaaatacttcatagggacattaaggcacaaaacatcttcctatctaagaacggaatggtcgccaagctgggcgattttggaatcgcgagggtgctgaacaactctatggagctcgctcgtacctgtatcggaactccttactatttaagccctgaaatctgtcagaacaagccatacaataataagaccgatatttggagcctgggttgtgtcctgtacgagctttgcaccttaaaacatcctttcgaaggcaataatctgcagcagcttgtgctaaagatctgccaagctcatttcgcccctatctctcccggcttttctcgcgaactgcatagcctcatttcacagttattccaagtcagccccagagaccgaccatctataaattcaattctgaagaggccttttctggaaaacctgattccgaagtacctgacacctgaagtcattcaggaggagttcagtcacatgttgatatgtcgagctggcgcccctgcatcccgtcacgccgggaaagtagtccagaaatgtaaaatacaaaaggtgaggttccagggaaagtgccccccaaggtcccggatttccgtgccaatcaagaggaatgccatcctccaccggaatgaatggcggcctcctgccggggcacagaaagctcgatcaataaaaatgatcgagagacccaagatagcagccgtatgtggacattatgattattattacgcacagcttgatatgctgagacggcgtgcccataaaccttcctaccaccctatccctcaggagaataccggagtggaggattatgggcaagaaacccggcacggcccaagtccctcccaatggccggcagagtatcttcaacgcaaatttgaggcccagcagtataagcttaaagttgagaagcagctgggcctgaggcctagctcggcggaaccgaattacaatcagcggcaagaactgcgcagcaacggggaagagccccgcttccaggagctgccctttcggaagaacgaaatgaaggaacaagagtactggaaacagttagaggagatccggcagcagtatcataacgacatgaaagaaatcagaaaaaaaatgggccgtgaaccggaagaaaattctaaaatctctcataaaacttacttagtgaagaagtcgaacctacctgttcatcaagacgctagtgaaggtgaggctcctgtgcagatggagtttcggagttgctgtccgggctggtccgctatggccaggtcttggcttaccgcgacaagcgcttcccaggacatcgaaaaagaccttaagcagatgagattgcagaacacaaaggagtctaagaatcccgaacaaaaatataaggcgaaaaaaggagtcaaatttgaaattaatctcgacaaatgtatcagcgatgagaatattttgcaggaagaggaggccatggacatccccaacgaaacactaacattcgaagatggaatgaagttcaaagagtacgagtgtgtgaaggaacacggcgattacactgataaggccttcgaaaagctgcactgtcctgaagccggattttcaacccagactgtggcagctgtgggaaatcggagacaatgggatggtggagctccccagaccctcctccagatgatggccgtggcagatattactagtacatgtccaaccggtcctgatagcgagagcgttctttcggtctcgagacaagaaggtaaaacgaaagacccttacagtcctgttctaatattgatgtag

SEQ ID NO: 31545 - DNA, 429 bp, Artificial Sequence
  Description of Artificial Sequence: Synthetic coding sequence
atgaacattaatccatgcttagtactgtgcgagtgttctcttagcatcagcctggacgcagacccactggtgtctccctttgcgactggcccgtgtccaggggcccccagagaggtcgtggccatgcagagcgacgttgggcagggttttcccatgcagagcaactggcgggccccagtccatgcgtgtacctccggggccgtcaggaaagggtggccaggatgtggccgcaggcggcataagatggggggcggtcccgtgtcctgggagcaaagacagaaggaagtggaggccgctcaagggtctgaggagcgcgggcccggatcgttagccgtctctctgttgtccttagccgttggcatccataggataagtccaattctgggattccatatttgctgtatgcaggtgctgatggtgctgaagtag

SEQ ID NO: 31546 - DNA, 744 bp, Artificial Sequence
  Description of Artificial Sequence: Synthetic coding sequence
atgctcgtgctgcggtcaggccttacaaaggcccttgcttcaaggaccctggcgccccaggtgtgttcctcctttgcaaccggccctcgccagtatgatggcacattttatgaattccgcacatactaccttaagccaagcaacatgaatgcattcatggagaacctgaagaagaatattcatttgaggacctcttactccgagttggtgggattttggtcggtggaatttgggggacggacaaataaggtttttcacatctggaagtatgacaactttgctcacagggccgaggtacgtaaggccttagccaattgcaaagaatggcaggagcaatctattatcccaaacttggccagaattgataagcaagagaccgaaatcacctacctgatcccgtggtccaaattggaaaagcccccaaaagagggggtctatgagctggccgtgtttcagatgaagcccggcgggccagccttgtggggggatgcgttcgagcgcgccatcaatgctcatgtgaacctgggatatactaaagtggtcggcgttttccatacagaatacggcgaactgaacagagtgcatgtcttgtggtggaatgaatcagctgactctcgagccgcaggccgacataaaagccacgaagacccgcgcgtggtcgcagcagtgagagagtccgtaaattacctcgtatctcagcagaacatgctgttgatcccggccagcttctcacctctcaagtag

SEQ ID NO: 31547 - DNA, 1632 bp, Artificial Sequence
  Description of Artificial Sequence: Synthetic coding sequence
atgcgtgacaataccagccccatctctgtgatcctagttagctccggtagcaggggtaacaagctgctgtttaggtatccatttcagaggtcacaggagcacccggccagccagacctcaaaaccccgcagcaggtatgctgcttctaacactggagatcatgcagatgagcaggacggcgatagccgattttcagatgttatactcgccaccattctggctacaaaatctgagatgtgcgggcagaagttcgaacttaagatagataatgtgcggttcgtcgggcatcccacactgctgcagcacgcccttggacaggctaatgccgatcctagcgtgataaattgtttgcataacttgtctcgcagaattgccacagtgctgcagcatgaagagaggaggtgccaataccttactcgggaggccaagctgatcctggcacttcaggacgaggtcagcgccatggcagatggaaacgaaggcccccagtcacccttccaccatatccttcccaaatgcaaactcgcccgtgatctgaaagaggcctacgatagcctctgtacttccggagtggtgcggctgcatattaatagttggcttgaggtgagcttttgtctgccccacaagattcactacgctgcaagcagtctcatccccccagaggcaatcgagaggagtctaaaagctatccgcccttaccatgccctgctgctactgtcggatgaaaagagtctgttgggggagctgccaatagactgctctccagctcttgtgcgagtgataaaaacgacctctgccgtgaagaatttacagcagctggcccaggacgccgatctggctctcctgcaagtgtttcaactcgccgcccatctggtgtactggggcaaggccattatcatataccctctgtgcgagaacaacgtatatatgttgtcacctaatgcttcagtttgtctgtattcaccactagccgaacagttttcccatcaattccccagtcatgacctacctagcgtgttggccaagttcagccttccagtgtccctgagcgagttcaggaacccgctcgcccccgctgtgcaggaaacccaactcatacagatggtagtttggatgctacagcgaagactgctgatccaacttcatacatatgtatgcctcatggcgagtccaagtgaggaggagcctcgcccccgggaggatgacgtcccgttcaccgcccgggtgggaggaaggtccctctctactccgaacgccctatcattcggcagcccaacatctagtgacgacatgactctgacaagtccaagcatggataatagcagcgcagagcttttaccctctggtgacagccccctgaatcagagaatgactgagaacttgcttgccagtagtgaacatgagagggcagcgattcttagtgtcccggctgcccaaaaccctgaagacctcagaatgttcgcccgactcctccactattttcgtggccggcaccatctggaagaaatcatgtataatgaaaatacacggcgcagtcagctgttgatgttgttcgacaagtttagatcggtgctggtcgtcacgacccacgaggacccagtgatcgcagtgttccaagctctcctcccctag

SEQ ID NO: 31548 - DNA, 1170 bp, Artificial Sequence
  Description of Artificial Sequence: Synthetic coding sequence
atggccgacgggaacgaagggccccagtctccattccaccacattctccccaaatgtaaactcgctcgcgacctcaaagaagcatatgactccctctgcacctcaggagtcgtgagattacatatcaatagttggctggaggtctctttttgcctgccacataagattcattacgccgccagctccctaatccctcccgaagccatcgagaggtctttaaaagccattcgcccctaccatgccctgctgctccttagtgatgagaaatctctgctgggcgaactacctattgactgctcacccgccctggtcagagtgatcaagaccacatcagctgtgaagaacctccaacagctcgcccaggatgccgacctcgcactgctgcaggtctttcagttggctgcacaccttgtgtactggggaaaagcaattataatctatcctctgtgcgagaacaacgtctatatgctttctcctaacgccagtgtctgcctgtatagtcccttggccgagcaattttcacatcaattccccagtcatgacctcccttctgtcctggccaaatttagcttgccagtttcattgagcgagttccgtaaccccctcgctcctgccgtgcaagaaactcaactgatccagatggtcgtttggatgcttcaacgccggctgctaatccagctgcatacttacgtatgtcttatggctagtccatccgaggaagaacctagaccccgggaggatgatgtaccatttacggcccgggtaggcgggcggagtctgtctactcccaacgcattgtcctttggaagtcccaccagttcggatgacatgacccttacaagcccctctatggataattcctcggccgagcttctccctagtggggattcccctctgaaccaaaggatgacagagaatctcggacagctgtctgagcatgagagggcagccattctgagcgttccggccgcccaaaatccagaggatctgcgaatgttcgccaggctgttacactattttcggggtagacatcacctcgaagaaattatgtataacgaaaatactcgacgctcacaactcctcatgctgttcgataagttccggagtgtgctggtggtgaccacgcacgaggaccccgtaattgccgtgttccaggccctgttaccatag

SEQ ID NO: 31549 - DNA, 1707 bp, Artificial Sequence
  Description of Artificial Sequence: Synthetic coding sequence
atgagggataacacctctcccatctccgtaatcctggttagttccgggtctcgagggaacaaattgcttttccgctatcccttccagcgatctcaggagcacccagctagccaaacatctaaacccaggtctcgatacgccgcctcaaacacgggcgatcacgctgatgaacaagacggcgattctcgcttttccgacgtaatcttggcaaccatcctcgctacaaagtccgagatgtgtggtcagaagtttgaactcaaaatcgacaacgttcggtttgtgggacaccccaccttattacaacacgcgctcggccaaatatcaaagactgaccctagcccgaaaagagaggctccgaccatgatattgtttaacgtggtttttgcactcagagccaatgctgatcccagtgtaatcaattgtctccacaatctctcacggcgaatcgcaactgttctgcagcatgaagaacgtcgctgtcagtatttgactcgggaggcgaagctaatcctggcacttcaagatgaagtaagtgcaatggcagacgggaatgaggggccccagtcccccttccatcacatactcccaaaatgtaagttggcccgggatctgaaagaagcctacgacagcctgtgtacgtcaggcgtcgttcggttgcacattaattcctggttggaggtttctttctgcttgccacacaagatccattatgctgcttcttcgctgatccctccagaagccattgagcgatcactaaaggccatccgcccatatcacgcattgttgcttctctccgacgaaaaaagtttactaggtgagcttccgattgactgttctcctgcgctggtgagggttatcaaaacaaccagcgctgtgaaaaacttgcagcagctcgctcaggacgctgacctggcgctgctgcaagtattccagttagcggcacacctcgtgtattgggggaaagccatcataatatatcctctgtgtgaaaataacgtctacatgctgtccccaaatgcctcggtgtgtttgtactcccccctggccgaacaattctctcaccaattccccagtcatgacctcccttcagtgctcgccaaattttctctgccggtgagcctttctgagtttcgcaaccccttagccccagcagtacaggagactcaactgatccagatggtcgtgtggatgctgcagagacggctgttgatccaactccacacctatgtctgccttatggctagcccctcagaggaagagccgagacctcgtgaggacgatgttccctttaccgctcgggtgggaggccgctctctgtcgactcctaatgccctgagtttcggctctcctacatcctctgacgatatgactctcacaagtccatccatggacaacagttctgctgagctcctgcccagcggcgacagccccctcaatcagaggatgacggagaatctcctggcgtcctctgaacacgaaagagctgccatactctcagtccccgccgcccagaatcccgaggacctgagaatgtttgccagactcctccattacttcagggggaggcaccacctggaagaaattatgtacaacgagaatacacgccggtctcagctgctgatgctgtttgacaagtttagaagcgtcctggttgtaacaacacacgaggacccggtgatcgctgtgtttcaagcattacttccatag

SEQ ID NO: 31550 - DNA, 210 bp, Artificial Sequence
  Description of Artificial Sequence: Synthetic coding sequence
atgcgcgataatacttcacccatcagtgtcattctggtctcatcgggatctcgcggcaataagttgctgtttagatacccctttcagcgctcccaggaacacccagccagccaaacttccaaacctaggagccggtatgcagcttcaaatactggggatcatgccgatgaacaggacggcgactcccgcccaactcagaccaggcaatag

SEQ ID NO: 31551 - DNA, 999 bp, Artificial Sequence
  Description of Artificial Sequence: Synthetic coding sequence
atgcttgcttggcaagatggcggggccaaggctgcaccatctcaccacaaaatctcattctcggtactggacatcctcgaccctcagaagttcacccgcgccgctctccctgctgttcgcccagcaccccgcgaagctaggaagagtctagccgaagtggaagccggaaaggatgcctcctctcgcgaccccgttcggcagctggagacacccggacagggattcgcagcctcccttctcactagacaggcacaccctcaccactcaagcgatgccagggatgccgccggaccaggggcggggcaagcttcgccccttgagggaagcgaagctgaagaagaagaggatgctgaggatccgcgccgcccccgcctcagggagcgggccgctaggttgctgccaggcttggcaaggtcaccagacgccccagctggggcactcgctagcggtgagccatgcgaggacgggggcggaggtccggtgcggagcccgcccgggtcaccaggctcacctcgcccccgccgacgcagattagagccgaattgcgctaaacctcggcgggctagaactgcattcacctatgagcaattggttgcattggagaacaaatttcgggcgactcgttatctttctgtgtgcgagaggctgaatctcgcattgtccctgtcactcaccgagacacaggtaaagatttggttccagaaccggcgaaccaagtggaagaagcaaaacccaggagccgatggggcggcacaagtgggcgggggggccccacagcccggagctgcgggggggggcggcggcggcgggtccgggggctcccctggcccgcctggaaccggggcacttcatttccaaacttttccttcctacagtgccgcaaatgttctgtttcccagtgccgcctccttccccctcacggcggccgctcctgggagcccctttgctccattccttggccctagttatctcactcctttctacgctccgaggttgtag

SEQ ID NO: 31552 - DNA, 933 bp, Artificial Sequence
  Description of Artificial Sequence: Synthetic coding sequence
atgctggcttggcaggacggcggcgccaaagccgcccctagtcaccataagatcagtttctccgtgctagatatactggacccccagaagttcaccagagccgctctacctgctgtgcggccagccccaagagaagccaggaaatcactggccgaagttgaagccggaaaggatgctagctccagggaccccgtaaggcagttggagacacccgatgcagccggtccaggcgccgggcaggctagccctctggaaggcagcgaagcagaggaggaggaggacgctgaggaccctagaaggccacggctgagggaacgagccgctcgactgctccccggattagcaaggagtccagatgcccctgccggggccctggcctctggcgaaccgtgcgaggatggcggagggggaccagtgcggtcccctccgggttcgccaggatcgcccaggcctaggaggcgcagattagagcccaattgtgccaaaccaagacgcgcccgaaccgcgttcacgtatgagcagttggtggctttagagaataagttcagagctactcgatatctctcagtctgtgagaggttaaatctagccctctccctgagtctgactgagacgcaggtaaagatttggttccagaaccgaagaactaagtggaaaaagcagaaccccggcgcggacggcgccgcgcaggtgggagggggggccccacagcctggcgctgcagggggtggtggagggggaggctctggtggctctccgggcccacctgggacaggggccctccattttcagacctttccttcttactccgccgccaacgtgctgtttccttcagccgcctctttccctcttacagccgcagctcccggatccccgttcgccccttttctgggcccatcttatctcactcccttttacgcacctagactgtag

SEQ ID NO: 31553 - DNA, 114 bp, Artificial Sequence
  Description of Artificial Sequence: Synthetic coding sequence
gaggaatggattacatattctaatagctgctactacatcgggaaggaaaggcgcacctgggaggagcgggtttgctggcctgtgctccgcagaacattaatttgctttctgtag

SEQ ID NO: 31554 - DNA, 3123 bp, Artificial Sequence
  Description of Artificial Sequence: Synthetic coding sequence
atggtgtcttccgcacagatgggctttaatttgcaagcgctccttgaacaactgtctcaagatgagttgagcaagttcaagtacctgatcacgaccttcagtctggcacacgagttacagaagatcccgcacaaagaggtggataaggccgacggaaaacagctggttgaaatcctgacgactcactgtgattcatactgggtcgaaatggcttccctacaggtatttgagaagatgcacagaatggacctgagcgagcgtgcgaaagatgaggttcgggaggctgccctcaaatcctttaataagcggaagccattaagtttggggatcactcgcaaagagcggccacccctagacgtagacgaaatgctggagagatttaaaaccgaagcccaggacaaggataaccgctgccgttacattttaaaaacaaaatttcgtgagatgtggaagtcatggcctggcgacagcaaagaagttcaggttatggcagagcggtacaaaatgctgatcccgttttcaaatccacgggttctgcctggaccgttctcctataccgtggtgttgtatggtccggccggtctgggcaaaaccaccctcgctcagaagctgatgctggattgggccgaggacaatttaatccacaaattcaagtacgctttctatctatcctgtcgcgagctgtcacggctcgggccatgctctttcgctgaactggtcttcagggattggccggagctgcaggacgatattccccacatactggcgcaggcaagaaaaatattgttcgttatcgacggatttgatgaactcggagctgcccccggagcactaatagaggacatctgcggtgactgggagaaaaaaaaaccagtccccgtcctgttaggttctttgctcaatagagtgatgctccctaaggctgcactccttgtcacaaccagacccagggccctccgggatcttcgcatccttgcggaggaacctatctacatcagagttgaaggttttctggaagaagatagacgagcctattttctgcggcactttggggatgaggaccaggcaatgagagcattcgaactgatgaggtcaaacgctgccttgttccagctggggagcgctccggccgtgtgctggattgtctgtaccactctcaagctgcaaatggaaaagggcgaggatcccgttccaacatgcctcacaagaacaggactgttccttcggtttctgtgttcccgattcccacaaggcgctcagctcagaggcgctctaaggacactgtcccttctggctgcccagggcttgtgggcccaaactagtgtgctgcaccgggaggatcttgaacgtctcggcgtccaagagtctgacttgaggctgtttcttgatggggatatccttagacaggacagggtgtccaagggatgctatagctttatacatcttagtttccagcagttcctcaccgcgctattctatactttagagaaggaagaggaagaggatcgcgacgggcatacttgggacataggggatgttcaaaaactcctgtctggtgtggaaagactgcgtaacccggacctcatccaggctggatattattcgtttggcctggccaatgagaagcgtgccaaagaactggaagccacctttggatgccggatgtcacccgacattaagcaggaactgctcagatgtgatatctcatgtaagggagggcattccacagtgacagacctccaagagctgctgggctgcctgtatgaatcccaagaagaggaactggtgaaagaagttatggcccaatttaaggaaatctccctccatttaaatgccgtggacgtggtgccaagcagcttctgcgtgaagcattgccgtaatctgcaaaaaatgagcctgcaggtcatcaaagaaaatctaccggaaaacgtaacagcatcagaatctgatgccgaggtggagcggagccaggatgatcaacatatgcttccattctggacagacctatgcagcattttcggctccaataaggatttaatgggcttggcaataaacgatagtttcctgagtgcctccctcgtcaggattctgtgcgagcagatcgcttccgatacgtgccacctacagcgggtggtgttcaagaacatctcacccgctgatgcccaccgcaacctgtgcctggctctgagaggccataaaaccgtaacttatttgacgttgcagggcaatgatcaggatgacatgttcccggccctgtgcgaagtactgcgacatccggaatgtaaccttagatatctcgggcttgtctcctgtagcgccacaacacaacaatgggcggatctgagcttagcactcgaggttaaccagtccttaacttgtgtcaatctgagcgataatgagctgctggacgaaggagccaaactcctgtacaccacattaagacatcctaagtgcttcctccagagactatccctcgaaaactgtcacctcacagaagcaaactgtaaggacctggccgccgtgctggtcgtctcgagagagctgacccatttgtgtctggccaagaatccgattggcaatacgggtgtcaagtttttatgcgaaggcctgaggtacccggaatgcaagctgcagactctggttctttggaattgtgacatcacatcagacggctgctgtgatctgacaaagctgcttcaggaaaaaagttctctgttgtgtttagacttggggctcaatcatattggcgtgaagggaatgaagtttctgtgtgaggctctgaggaagcctctctgtaatctccggtgcctgtggctgtggggatgtagtatcccccccttctcgtgtgaggacctgtgctcagccctgtcttgtaaccagagtctagtgaccttggatctaggacagaatcccctcggcagttctggcgtaaagatgctttttgagacccttacatgttctagcggcactctgaggacgctgcgattgaagatagatgatttcaacgacgagctgaacaagctgttagaggagattgaagaaaagaaccctcagcttatcattgataccgaaaagcatcacccttgggctgagcgccccagcagccacgattttatgatttag

SEQ ID NO: 31555 - DNA, 3189 bp, Artificial Sequence
  Description of Artificial Sequence: Synthetic coding sequence
atggtcagcagtgctcagatgggtttcaacctgcaggcattgcttgaacagttgagccaggacgaactgagcaaattcaagtatttaatcactacattctctctggcacatgagctccagaagattccacataaggaggttgataaggctgatggtaaacagctcgtcgagatattgactactcactgtgattcctattgggttgaaatggccagtctccaggtcttcgagaaaatgcacagaatggatctgtctgaaagagccaaggatgaagtgcgggaggccgccctgaagtcttttaacaagcgcaaacctctgtcactcggtataactcgcaaagaacggcccccactggatgtagacgagatgctggagcgctttaaaacagaggcacaggcctttaccgaaacaaagggcaatgtcatctgtctggggaaagaggttttcaaggggaaaaagcctgacaaagataaccggtgtcgttacattctaaaaacaaagtttagagaaatgtggaagtcctggcccggcgattccaaggaagtgcaggtcatggcagaacgttataaaatgctgatccctttctctaacccccgggtgctgccaggcccgttctcatatactgtcgtcctgtacggccccgctggtctgggcaagaccaccttggctcagaaactaatgctcgactgggccgaggacaatcttatacacaagtttaaatacgcattctaccttagctgcagagaactgagtcggttgggtccctgttcttttgctgaattagtgttcagagactggccagagctgcaagatgacatccctcacattctggcacaggccagaaaaattttattcgtgatcgacggcttcgacgaattaggggccgccccaggggcactgatcgaagatatttgtggagactgggagaagaagaagcccgtgccagtgttgttgggaagcttgttaaatcgcgtaatgctgccaaaagcagctctgttggtcacaacaagaccgcgtgctctcagagacttgagaattctggctgaggaaccgatttacataagggtggaggggttcctggaagaggatcgcagggcttattttctaaggcactttggcgacgaggaccaggctatgcgcgcctttgagttgatgcgtagcaacgcagctctctttcagctgggcagcgccccagcggtctgctggatcgtgtgcaccacactcaaactccagatggagaaaggcgaggaccccgttccgacctgcctcacacgaacagggttgttcctgaggttcctgtgttcgaggttcccccagggcgcccagctccgaggggccctgaggactctatctctcctggccgctcaggggctgtgggcccaaaccagtgtcctccacagagaggatctcgagaggcttggcgtgcaggaatcagacctgagactgttcctggatggggacatcctgaggcaggacagagtctctaagggatgctacagctttatccatctgtcctttcaacagttcctgactgccctgttctatacacttgaaaaagaagaggaggaggaccgagatggacatacctgggacattggcgatgttcaaaaactgctgtccggcgtggagcgactcaggaatccagatttgatccaggccggctattactccttcggcctggctaacgaaaaacgggccaaagagcttgaggccactttcggctgccgcatgtcaccagacattaagcaggaactgctgcgttgtgatatttcatgtaagggaggacacagcacagtcactgacctccaggagctgctgggatgtctctatgagtcacaggaggaagagcttgtgaaggaggtgatggcacagttcaaagagattagcctgcacttaaatgctgtggacgtggtgccttcatcattttgcgtcaaacactgccggaatctccaaaagatgtcgctgcaggttattaaggaaaacctccccgaaaatgtgacagcgtcggagagtgatgctgaagtcgaaagatcccaggatgatcagcacatgctgccattctggaccgatctttgttcaatctttggctccaacaaagatctcatggggctggctatcaatgattctttcttgagcgcaagccttgttagaattctctgtgagcagatcgcttccgatacctgccacctccaacgcgtggtgtttaagaatatctctccagctgatgctcatcggaatctgtgtcttgctctcaggggacataaaactgtcacatatctgacccttcagggtaatgatcaggatgatatgtttcctgcattgtgcgaggttttaaggcatcccgagtgcaacttgaggtacctagggctggtgtcatgctccgccactacacaacaatgggctgacctctcattggccctggaagtcaaccagtccctcacctgtgtcaacctctctgataatgaactgcttgatgaaggagctaagctcctgtatacgaccctcagacaccccaagtgctttctgcagcgcctgtcgcttgagaattgtcacctcactgaggcgaactgtaaggacttagccgctgtgctggttgtgtccagggaactaactcatctatgcctggcgaagaacccgattgggaatactggagtaaaattcttgtgtgaaggactcagatacccagaatgcaagcttcagacactcgtgctgtggaattgtgacatcactagtgatggatgttgcgatctcactaagctgctgcaggaaaaaagtagtctgctgtgtctggatctgggcctgaatcacatcggggttaaaggaatgaaattcctatgcgaagctttgcggaaacccctctgcaacttgaggtgcctgtggctttggggctgttccatccctccattcagttgcgaggacctgtgtagcgctcttagttgcaatcagtccctggtaacattggacctgggacagaatccactgggcagctcaggggtgaagatgttgttcgaaactttgacatgcagtagtggaacccttcgcactctgcgactgaagattgatgacttcaacgatgaactcaacaagctcctcgaggagattgaagagaagaatcctcagctgataatcgatacagagaagcatcacccttgggccgagaggcctagctcccatgattttatgatttag

SEQ ID NO: 31556 - DNA, 3189 bp, Artificial Sequence
  Description of Artificial Sequence: Synthetic coding sequence
atggttagttccgcccagatgggctttaacctccaggctttactggagcaattgtctcaggatgaactaagcaaatttaaatatttgattaccactttcagtctagcccatgaattgcaaaaaatcccgcataaggaagtggacaaagccgatgggaaacagctggtggagattctgactactcactgtgacagttactgggttgagatggcctccttacaggtttttgaaaagatgcaccgtatggacttgtcagaaagagcaaaagatgaggtgcgtgaagctgctctgaagagcttcaacaagcgaaagccgctaagcctaggtattacacggaaggagagaccacctctggatgtggatgagatgctcgagcggttcaaaactgaggcccaagctttcaccgagaccaaaggaaacgtgatttgtctggggaaagaggtctttaaagggaaaaagcccgacaaggacaacaggtgccgttacattcttaaaacgaagttccgggagatgtggaaatcatggccaggggactcaaaggaggtacaggtaatggccgaacggtacaaaatgcttatccctttctcaaaccccagggtacttccgggcccattcagctacaccgtagtcctgtacggccccgcaggcctagggaaaactacgctcgcccagaagttaatgctggattgggctgaagataatctgatacacaagttcaagtatgctttttacctctcttgccgtgagctcagtcggttggggccttgttctttcgcagagcttgtcttcagagactggccagaactgcaggacgacatcccacatattctcgcccaagctcgcaagatcctttttgttatagatggatttgatgagctcggtgccgccccaggggccttgatcgaggatatatgcggtgattgggagaagaagaagccagtacccgttctgctggggagcttgttgaaccgcgtcatgctacccaaggccgccttgctggtgaccacccgacctcgggcattacgagatctgagaatcctcgccgaagaaccaatatacatcagggtggagggatttctggaggaagaccggcgagcctacttcctgcgccactttggagatgaagatcaagcaatgagagcctttgagttaatgaggagtaacgccgccctgtttcagctcggttccgctccagctgtgtgttggatcgtgtgcaccaccttgaaattacagatggagaaaggagaggatcctgtccccacctgcctgacccggactggtttgtttttgcggttcctgtgctctagattcccacagggcgcccagctgcgaggcgccttgcgtacactgtccctgctcgccgcccaggggttgtgggctcagacatccgtgctccaccgggaggatctcgagaggttgggcgtgcaggaaagtgatctgagactgttcctagatggagatattctgaggcaggatcgtgtgagcaagggctgttattcctttatccacctgagttttcagcagttcctgaccgccctgttttatacactagagaaggaggaggaagaggacagggacggccatacatgggatatcggggacgtccagaaattactctccggagtcgagcggctgagaaacccagatcttatccaggcaggttattactcctttgggctagccaacgagaagcgcgctaaagaactggaagccacgttcgggtgcaggatgtctcccgatattaaacaagagctgctgagatgcgatatctcctgcaaggggggccattcaactgtgacagacctccaggaactactcgggtgtctttatgagagtcaggaagaagagctggtgaaagaggtgatggcccagtttaaggagatatccttacacctgaacgccgttgacgtggtgccatcatctttttgcgtgaagcattgccggaaccttcaaaagatgtcactgcaggtgatcaaggagaatcttcccgagaatgtaactgcatctgaatccgacgcagaagtggaacggtcccaggacgaccagcacatgctgcctttctggactgatctgtgttctatcttcggctctaataaggacctgatgggacttgctatcaatgatagctttctaagtgccagccttgtcaggatcctttgcgaacagatcgctagcgacacctgtcacctccagagagtggtattcaaaaacatctctccggctgacgcccaccgcaacctgtgcctcgcattacggggacataaaactgtcacttacttaacactgcagggcaacgaccaagacgatatgttccctgccctttgtgaggtgctgcgacaccctgaatgtaatctgcggtatctcggccttgtttcttgtagtgctaccacccaacagtgggccgatttgtctcttgccctcgaggtgaaccagagtctgacttgtgtaaacttgagcgacaatgagctactcgacgaaggggccaagctactgtacaccacactcaggcaccccaaatgctttctgcagcgtctgtccctcgagaactgtcacttaacagaggccaactgtaaggacctcgcagccgttctggtggtatctagagagctgacacacctttgtttagcgaagaacccgattggtaatactggagtcaaattcctgtgcgaggggctacgctaccctgaatgcaagctgcagactctggtgctgtggaattgtgacattacaagcgacggctgctgcgacctcaccaagcttctgcaggagaagagctccttactctgcctggacctgggcttgaaccatataggtgttaaaggcatgaaattcttgtgcgaggcactcaggaagcctctgtgtaatttgaggtgtttgtggctgtggggatgtagtattccacctttcagttgtgaagacttgtgttccgccctttcctgtaaccagagcctcgtgacactcgacttaggacaaaacccactgggttcttccggggtaaaaatgctctttgaaacactcacctgttcctcaggcaccttgcgcacacttcggctgaaaatagacgacttcaacgatgaactgaataagttattagaggaaatagaagagaagaacccccagctgattatagacaccgaaaaacaccacccgtgggccgaaagaccatctagccacgatttcatgatctag

SEQ ID NO: 31557 - DNA, 3189 bp, Artificial Sequence
  Description of Artificial Sequence: Synthetic coding sequence
atggtctcatccgcccagatggggttcaaccttcaagctctgctcgagcagttatctcaggacgagcttagcaagttcaaatatctgatcaccacattctcccttgcccacgagcttcagaaaatacctcataaggaggtcgacaaagcggacggtaagcagctggtggaaatcttaaccacgcactgtgacagttattgggtagaaatggccagcctgcaagtcttcgaaaagatgcaccgcatggatctgtcagaacgggcaaaggacgaggtgagggaggccgccctaaaaagctttaataagagaaaacctctgagtctcggaattactcgcaaagaaaggccaccgctggatgttgatgagatgctggagcggttcaagactgaggcacaagcatttaccgaaacgaagggaaatgtaatttgtctgggaaaggaggtgttcaagggcaagaagcccgacaaggacaatcgttgcagatacatcctgaagaccaagttccgcgaaatgtggaagagctggcccggcgacagcaaagaagtccaggtaatggcagagcggtataaaatgctcatcccattctccaaccccagggtgctgcccgggccgtttagttacactgttgtgctctacggaccagccggcttaggaaaaacaactctcgcccagaaactgatgctggactgggcagaggataacttgattcataagttcaaatatgccttttatctgagttgtagagagctgtccaggctgggcccatgcagttttgcagagttggtcttccgtgattggccagagctccaggacgatatcccacacatactagctcaagccaggaagattctgtttgtaatcgatggtttcgatgagttgggcgcagctcccggagctcttatagaggacatctgtggggactgggaaaagaaaaagccggttccggttctgctgggaagcctccttaatcgggtcatgctgccaaaggccgctctgctggtaactactaggccaagagccctgcgcgatctcaggattcttgccgaggagcctatctacatccgcgttgaagggtttctggaagaagatagaagggcctactttctgcgccactttggcgatgaggaccaggctatgcgggcctttgaactgatgagaagtaatgcagccctgttccagctcgggagtgcccccgcagtatgttggattgtctgcactacactgaaactccagatggagaagggagaagaccccgtccccacgtgcctgacaagaactggacttttcctgcgttttttgtgtagcaggttccctcaaggggcgcagctgcgcggcgcactgaggactttaagtttgctggcagcccaaggcctgtgggcgcagacttctgtgctgcatcgtgaggatctggaacgcctgggggtacaggagagcgatctccggttgtttttggatggtgacatactaagacaagacagagtcagtaaaggatgctactctttcatccatctaagtttccagcagttcttgactgccctgttttacactttggaaaaggaggaggaggaggaccgggatggacacacctgggacattggtgatgtgcagaaactgctctctggcgtcgagaggctgagaaacccagacctaatccaggctggatactacagcttcggtctagccaacgaaaaacgtgccaaggagctggaagctacatttgggtgccggatgtcacctgacatcaagcaggagttgctacgttgcgacatttcatgcaagggaggacactctactgtgaccgacctgcaggaactgttggggtgtctgtacgagtcccaggaggaagagcttgtgaaagaggtaatggcacagttcaaagagataagcctccatctgaacgccgtggatgtcgttccatcttccttttgtgtaaagcactgtaggaacctacagaagatgagcttacaggtcataaaggaaaacctacctgagaacgtgactgcatccgagagcgatgctgaagttgagcgatcgcaggacgaccaacacatgctgcctttttggacagacttgtgttctatttttggtagcaataaagatctcatgggtctagccatcaatgactccttcttgtccgccagcctggtgcgtatactatgtgaacagatagcatctgacacctgccatctccaaagggtggtttttaaaaatatctcccctgctgacgctcataggaatttgtgtctggcccttagaggccacaagacggttacttacttgaccctgcagggcaatgatcaggatgacatgtttcccgcactctgtgaggtgctcaggcaccctgaatgcaacctcaggtacttaggcctggtgtcgtgtagcgcgaccactcaacagtgggccgacttatccctggctctggaagtcaatcagtccctgacatgtgtgaatctatccgacaacgaactgctggatgaaggggcaaaattactatacactacgttgcggcaccccaaatgctttttacagcggctgtcactcgagaactgtcacctgacagaggccaattgtaaagacctggccgccgtgctcgtcgtgtccagggagctaacccacctttgtctggcgaagaaccctataggaaatactggtgtgaagtttctttgcgagggtttaaggtatcccgaatgtaaactgcaaaccctggtgttatggaactgcgacatcacttccgacggctgttgtgatttgaccaaactgctgcaggagaaaagctcattactctgtttggacctgggcctgaaccatatcggcgtcaagggcatgaagtttctctgcgaggctctgcgcaaacctctgtgtaacctgaggtgcctgtggctgtggggctgctcaatccccccatttagttgcgaggatttatgtagcgccctgagttgtaaccagtctctggtcactttagacctgggccagaacccgttgggctctagtggtgtgaaaatgttgttcgagacactgacttgctccagcggaactttgagaaccctccggctcaagatcgacgattttaacgacgagctgaataaattgctcgaagagatcgaagaaaaaaatcctcagctgatcattgacactgagaagcaccatccctgggccgagagaccctctagtcatgacttcatgatatag

SEQ ID NO: 31558 - DNA, 3189 bp, Artificial Sequence
  Description of Artificial Sequence: Synthetic coding sequence
atggtgtccagcgcccagatgggatttaatctccaggcgctgcttgagcaactgtcccaagacgaactgagcaaatttaagtatctcatcactaccttctctctggctcatgaactccagaaaattccacataaagaggtggacaaggcagacggcaaacagttggtagagatcctgaccacccattgtgactcatactgggtcgagatggcctcattgcaggtctttgagaaaatgcatcgaatggacctatctgagcgggccaaggacgaggtgagagaagcagctctcaaatcgttcaataagcgcaaaccactatctcttggcatcaccaggaaggagcggccccctctggatgtggacgaaatgttagaaagatttaagacagaagcccaagcctttaccgaaacgaagggtaatgtcatatgcctcgggaaggaggtatttaagggcaaaaaacctgataaagacaaccggtgtagatacatcctcaagaccaaatttcgggagatgtggaagtcttggcccggtgactcaaaagaagtgcaggtcatggctgagcgctataagatgctcatacccttttctaaccctcgggtactacctgggccattttcctacaccgtggtactgtatggacctgctgggctgggaaaaacaacccttgcacagaagttgatgctagactgggcggaagacaacctgattcacaaatttaagtacgctttctacctctcctgccgcgagctgtctcgcctggggccctgcagtttcgcggaactagtgtttcgggattggcctgagctgcaggacgacattcctcacatactcgcccaagcgcgaaaaatcttgtttgtgattgatggcttcgacgaactgggtgcagcgcctggggcactgattgaggatatctgtggtgactgggagaaaaagaaacccgtgcctgtccttttagggtctctcctgaatcgcgtcatgctgccaaaagccgctctattagttaccaccaggcctcgggctcttagagaccttcgcatcctggccgaagagccaatatacatccgagtagaaggttttctggaagaggaccgccgagcttatttccttcggcatttcggggacgaggatcaggccatgagagcgtttgagctcatgagatctaacgccgccttgttccaactggggagtgccccagccgtctgttggattgtctgcactacgctcaaactgcagatggagaagggagaagaccctgtacccacctgcctgactcggactggcctctttctgaggtttctgtgcagcaggttcccccagggcgcccagctgagaggtgccctgcgtacactttctctgctggccgcccaaggcctttgggcccaaacttccgtcctgcaccgtgaggacctcgagcgcctaggcgtgcaggagagcgacctgcgcctgtttcttgatggggatatcctcaggcaggatcgggtttcaaagggatgttattctttcatccacctaagctttcagcagttcttgacggccctattctacactctggaaaaagaggaagaggaggacagggatgggcatacatgggatatcggcgacgtgcaaaaactactctccggtgttgaacggctgagaaatccggacctgattcaggccggatactatagttttggtctcgcaaacgaaaagagggcgaaagagctggaggctacctttggatgtaggatgtctccggatatcaaacaggagctgctgcgatgcgacatcagctgcaagggaggtcatagcactgtcacggatctccaggaactgctaggttgtctgtatgagtcccaggaagaagaactcgttaaggaagtgatggcacaatttaaagagatttctctgcacctgaatgctgtggacgttgtgcctagttctttctgtgtaaagcactgtcgcaacttgcaaaaaatgtctttgcaggtgataaaagagaatttgccagagaacgtgaccgcatccgaatcagatgctgaggttgagagatcccaggatgatcagcatatgcttccgttttggaccgatttgtgtagcattttcggaagtaataaggatctgatgggattggcgattaacgacagctttctgtcagcctcgcttgtgcggattctgtgtgagcagattgcatctgacacatgtcatctccaaagggttgttttcaaaaacatttcgcctgccgatgcacatcgaaatctgtgcctagcccttagaggacataagactgttacttatctgaccctgcagggcaacgaccaggatgatatgttcccggcattgtgcgaggtgcttcgacaccccgagtgcaacttgagatacctgggactggtgagctgctcggcaaccactcagcaatgggccgatctcagtctggctctggaagtaaaccagtcactgacgtgtgtgaacttatcagacaacgagcttttggatgaaggcgccaaactgctatacacaactttgagacacccgaaatgttttctgcagaggctcagccttgagaattgccacctgacggaggcaaactgtaaggacctcgctgcggtcttggtggtcagcagagaactgacgcacttatgtcttgcaaagaatccaataggcaacactggggtgaagtttctatgcgagggcctgcgctacccagaatgcaaattgcagaccctcgtgctgtggaactgtgatatcacctctgatggatgttgcgacctcacaaagctcctgcaggagaaaagctctctcctgtgcttagatctgggtcttaaccatatcggcgtgaagggtatgaagtttctctgtgaggcacttcgcaaacctctgtgcaacctacgatgtctctggctgtggggctgttcgattccgcctttcagttgcgaagacctgtgctcagccttgtcctgtaaccagtcactggtgaccctggatctcgggcagaacccacttggaagtagcggcgtgaagatgttattcgagaccctcacatgttcaagtgggacgctgcgcaccctgagacttaagattgacgactttaacgacgagctgaataaactgctggaagaaattgaagagaaaaacccgcagcttattattgacaccgaaaagcaccatccgtgggcagaacggcccagctctcacgacttcatgatttag

SEQ ID NO: 31559 - DNA, 3189 bp, Artificial Sequence
  Description of Artificial Sequence: Synthetic coding sequence
atggttagttcagcccagatggggttcaatctgcaagcactgctagagcagctgagccaggacgaactgagcaagttcaaataccttataacgaccttttccctagctcacgaattacaaaaaattccacataaggaggtcgacaaggctgatggcaagcagctagttgagattctcactactcattgcgactcttactgggttgagatggcttcattgcaggtgtttgaaaaaatgcaccgtatggatctctccgaaagggctaaggacgaggtacgcgaggccgcattgaagtcttttaataaaaggaagcccttatctctgggcattacccggaaggaacggccccctctggacgtagacgagatgctggagcgatttaagaccgaggctcaagcctttactgagaccaagggcaacgtcatatgcttagggaaggaggtttttaagggtaaaaagccagataaagacaataggtgtcggtatatactgaagacaaaatttagggagatgtggaaatcatggccaggcgatagtaaggaagtgcaggttatggctgagcgttataaaatgcttattccattttccaacccccgggtgcttcccgggcccttttcttataccgtggtgttgtacggtccagctgggctgggaaagaccacgcttgcccagaagttgatgctcgattgggccgaagataacttgatccataagttcaaatacgctttttacctgagttgcagagaactttcccgcctaggaccttgttccttcgccgaattggttttccgagactggccagagctgcaggacgatattccacatattcttgcccaggcccggaaaatactttttgtaattgatgggttcgacgagctcggcgcggcaccaggggccttgatcgaggacatctgtggcgattgggaaaagaagaaacccgtgccagtgttgctgggcagtcttctgaacagagtaatgctaccgaaagccgcgctgctggtgacaacacggccccgtgcccttcgagacctccggatactggccgaggaaccgatttatattcgtgtcgaagggttccttgaggaggacagacgggcttacttcctgcggcactttggcgatgaggaccaggccatgagagcctttgagctaatgagaagcaatgcggccttgttccagctgggcagcgcccccgctgtctgttggatagtttgcacaaccctgaaattgcagatggaaaagggcgaggatccggtgcccacctgcttaacacgtaccggtttgtttctgcggttcctctgctcaaggtttccacaaggtgcccagctgaggggcgctctgaggactctgagcctactggcagctcagggtctgtgggcccaaacatcagtcttacatcgggaggatttggagcgcttgggagtgcaggaaagcgacctgcggttgtttcttgacggcgatatcctccgccaagacagagtgtccaaagggtgctattcatttatccacctaagttttcagcaattcttaacagcgctgttttacacccttgaaaaggaggaagaagaagaccgtgatggtcacacatgggacattggagatgtccagaaactgctgtcaggagtggaacgcctcaggaacccggacctgattcaagctggctactatagcttcggccttgcaaacgagaagcgagcgaaggaactcgaagcaacttttggctgcagaatgagccctgatataaagcaagaattgttgcgctgcgatatatcttgcaagggtgggcatagcactgtcaccgacctacaagaactgctgggatgcctatacgagagccaggaagaagaattagtgaaagaggtcatggcccagtttaaggagatttctttgcatttgaatgcggttgacgttgtgccctcgtcattctgcgtgaagcattgcagaaatctgcagaagatgagccttcaggttatcaaagaaaatctgccagagaacgtgactgcttccgaatcagacgccgaggtcgagagatcacaggacgaccagcatatgcttccgttctggacagatctgtgttcaatctttggctccaacaaggatctgatgggattagccatcaatgactcattcctttcagcctctttagtacgcattctgtgtgagcaaattgccagcgacacatgccacctgcaacgcgtagttttcaaaaatattagtcccgcggacgctcatcgaaacttgtgcctggctttaaggggacacaaaacagtcacctacttgaccctgcagggtaatgaccaggacgatatgttcccagctctttgtgaagtgctacgccaccctgagtgcaatctgaggtatctcggattagtgtcatgcagtgcaacaactcaacaatgggccgacttgtccctggctttagaagtgaatcagtcgttaacttgcgtcaacttgagtgacaatgagttgctcgacgagggcgccaagctgttatatacaaccttaagacatcccaagtgcttcctgcagcggctgtctctggaaaattgccacttgaccgaagcgaattgtaaggatctggccgccgtgctggtggtctctagagaactgacacatttgtgcctcgcaaagaatccaatcgggaataccggcgtgaaatttctttgtgaggggcttagatatcccgaatgcaaactgcagaccctggtgctgtggaattgtgatataacgtcagacgggtgctgcgaccttaccaagctgcttcaagaaaaatcctccctgctctgtctcgatttgggtcttaaccatattggagtcaaggggatgaagttcctttgtgaggctttgcggaaaccactgtgcaacctgcggtgtctctggctgtggggatgctcaatcccacctttcagttgcgaagacctttgtagcgccctgagttgcaatcagtctttggttacacttgatctgggccagaatcccctggggtcttccggtgtgaaaatgttatttgagactctaacttgctccagcggcacgcttagaacactgaggttgaaaattgacgacttcaatgatgagctcaacaagctcctcgaggaaatcgaagaaaagaaccctcagctgatcattgacactgaaaagcaccacccgtgggccgagcgaccttcctcccacgactttatgatttag

SEQ ID NO: 31560 - DNA, 3123 bp, Artificial Sequence
  Description of Artificial Sequence: Synthetic coding sequence
atggtgtctagtgcgcaaatgggatttaatctccaggcattgttagaacaattatctcaagatgagctctccaaattcaaatacttgattacaacattttccctggcccacgagctccaaaaaattccccacaaggaggtagacaaagcggacggtaagcaactggtagaaatcttgaccacacattgcgacagttactgggtggaaatggcttccctgcaggttttcgagaaaatgcacagaatggatctgtccgaacgcgccaaagacgaagtacgggaggccgcattgaagtctttcaacaaaagaaagcctctgtccctggggatcaccagaaaggagcggccccctctggacgtggatgaaatgttagagagattcaaaaccgaggcccaggacaaggacaatcgctgccggtatattctcaagaccaagttccgagaaatgtggaagtcttggcccggtgattccaaggaagtgcaggtgatggctgaacgatacaaaatgctgataccattctccaatcccagggtgctccctgggcctttctcctacacggtcgttctgtatgggcctgccggccttggaaagacgacgcttgcgcaaaaactcatgctcgattgggccgaggacaacctcatccacaagtttaaatacgctttctatctgtcttgccgggaattgtctcggctcgggccatgctcctttgcagaactggtgttcagggactggcccgaactgcaggacgatataccccatattcttgcccaggctaggaaaatcctattcgtcattgatggcttcgatgagctgggcgctgcaccaggcgcactaatcgaagatatctgtggagactgggagaagaaaaaaccagtgcctgtacttctgggttctctgcttaatcgtgtcatgctgcctaaagccgccctgttggttacaacacgacctcgcgcacttagggatctgcggattctggcagaggagccaatttatatccgcgtggagggattcctagaggaagaccgccgcgcctacttcctccggcatttcggcgacgaggatcaggcaatgcgggcttttgaactcatgcgatccaacgccgccttgttccaactgggtagtgcacccgcagtctgctggatcgtctgtaccacccttaagctgcagatggagaaaggtgaagatccagttccaacttgtctaacgcggaccggacttttcctccggttcctctgcagtagattccctcagggcgcccagctgcgcggcgcactgagaaccctcagcctcctggccgctcaaggtctgtgggctcagacctctgttttgcacagggaagatcttgagaggttaggcgtgcaggagagcgatttacggctgtttctcgacggggacattctgcggcaggacagagtaagtaagggctgttacagcttcattcacctctcattccaacagttcctaaccgcactcttctataccctagagaaggaggaggaagaggaccgtgacggccacacatgggatatcggcgatgtacagaaactgttatcgggggtcgagaggctccggaatccagatcttattcaggcgggctattactcctttggcctcgcaaatgaaaagcgggcaaaggagctcgaagccacctttggttgtcggatgtctccagatataaagcaggaattgctgagatgtgatatttcttgtaagggcggccactccaccgtcaccgatcttcaggaacttcttggctgtctgtatgagagccaggaagaggagctggttaaagaagtgatggcccagtttaaggagatctctctgcatcttaatgccgttgatgttgttccctctagcttctgcgtcaaacattgtcggaacctccaaaagatgtcactccaggttattaaggagaatctccctgaaaacgttacagcttccgagtctgacgccgaggtggagagatctcaggatgaccagcatatgctccccttttggactgacctttgttccatctttggatcaaacaaggacttaatgggtctggccattaacgactcgtttctaagcgcgagtcttgttaggattttgtgtgaacaaatagcctctgacacatgtcatcttcaaagggtagtcttcaagaacatatctcctgcagacgcccatcgcaacttatgtctcgcactgaggggacacaaaaccgtcacctatctaacacttcagggcaatgaccaggacgacatgttcccagccctatgtgaagttctccgccacccagagtgcaacctgcggtacctgggcctggtgagttgctcagctacaacacaacagtgggccgacctttctctagctttagaagtcaatcaaagcctgacatgcgtcaacttgagcgacaatgagctgctagacgagggcgctaaactcctgtacactacgctgcgtcatcctaaatgcttcctccagcggctttccctggaaaactgtcacctgaccgaagccaactgcaaagatttggcagccgtgctggtggtgtcccgcgaacttactcatctgtgcctggctaagaaccccatcggtaacacaggcgtaaagtttctgtgcgagggattgagataccccgaatgtaagttacagaccctagtcctgtggaattgtgacattactagcgacggttgctgtgatctgaccaagttactgcaggagaaaagctcccttctgtgtctggacctcggactgaaccacataggtgttaaaggcatgaagttcctctgtgaggctttgcggaaacctctctgcaatctgcggtgtctgtggctgtggggctgcagcatcccaccgtttagttgtgaagacttgtgtagtgcactgagctgcaatcagtccctggttaccctggatttggggcaaaaccctctagggtcttcaggcgtaaaaatgttgttcgaaactcttacatgtagctcagggaccttacgcaccctgcggttaaagatcgatgacttcaatgacgagctgaacaagttgcttgaggagatcgaagagaaaaacccacagctgataatagacactgagaaacaccatccgtgggcggaacgccccagtagtcacgattttatgatctag

SEQ ID NO: 31561 - DNA, 3189 bp, Artificial Sequence
  Description of Artificial Sequence: Synthetic coding sequence
atggtcagcagcgctcaaatgggcttcaatcttcaggctctgttagaacagctgtcacaggatgagcttagcaaattcaaatatctgattacgaccttttccctggcgcatgaattgcagaagattccccacaaagaagtagataaagctgatggaaagcagctagtggagattcttacaacacattgcgattcttattgggtggaaatggcgagcttgcaggtgtttgagaagatgcaccgtatggatttgagcgaaagggccaaagacgaagtccgcgaagcagcgcttaaaagcttcaataaaaggaagcctctgtccctcgggataactcggaaggaacggcctcctttagatgtggacgaaatgcttgagaggtttaagactgaggcccaagcttttaccgaaaccaagggaaacgtgatctgtctgggaaaagaggtattcaagggtaagaagcctgacaaggacaacagatgtagatatatcttgaagacgaaatttcgtgagatgtggaagtcatggcctggagacagcaaagaggttcaggttatggccgagcgatacaaaatgctcataccctttagtaatccgcgcgtactgcctgggccattctcttacacggtggtcctgtatggcccagctggtctggggaagacaacactggcccagaaactgatgctggattgggccgaggataaccttatccataagtttaagtacgccttttatctatcatgtcgggagctcagtcgtctcgggccatgttcttttgctgagctggtgtttagagactggccagagctccaggatgatatcccgcacatactggcacaggccagaaaaatacttttcgtgattgatggcttcgacgagctgggagccgcccctggcgccttgatagaggacatctgtggcgattgggaaaagaagaagccagtgcccgtcttgctcggatctcttcttaatcgagttatgctgcctaaggcagcgctccttgtcacaacgcgccctagggccctgcgggatctgaggatcctagccgaggagcccatttacatacgcgtggagggattcttggaggaagatcgccgtgcttacttcctgaggcacttcggtgatgaggatcaggctatgagggcctttgaactcatgcggagtaatgccgccttatttcagctgggctccgcacccgcagtgtgctggatcgtctgcaccactctgaagcttcagatggagaagggggaggatcccgtccccacgtgtctgacaaggactggtctgtttctgcgatttctgtgttcccgattccctcaaggagcacagctgaggggtgcactgcggacactctccctgctcgccgcccaaggactgtgggcacagacctccgttctccatagggaagacctggagcggctcggcgtccaggaatcagatctgcgcctgttcttagacggggatatcctgagacaggaccgagtctccaaagggtgttatagtttcatccatctgtcattccagcagtttttgaccgccctgttttacaccctagaaaaggaagaggaagaggatagggacggccatacttgggatatcggcgacgtccagaagctgctctcaggcgtcgaacgcctgagaaaccccgacctcattcaggccggatactactcctttggcctggctaacgagaagcgggcaaaggaactggaagcgacttttggatgtagaatgtcaccggatataaaacaggagctattaaggtgcgatattagctgcaagggtggccactcgactgtaacagatttacaggagttgctaggttgtttatatgaatcacaggaagaagagctggttaaggaagtgatggcccagttcaaggaaattagcctgcatcttaatgccgtggatgtggttcctagctccttttgcgtgaaacattgccggaacctgcaaaaaatgtccctacaggtcattaaggagaacctgccagaaaatgtgacggctagcgagagcgatgccgaagttgagcggagtcaggacgatcagcacatgctccccttctggacagacctgtgctctatttttggcagtaacaaggatctgatggggctcgccattaatgattcgtttctgtccgcctctctagtaaggattttgtgcgagcagattgcgagcgatacttgccacttacagcgcgtagtgtttaagaacatcagccccgctgatgcccacaggaatttgtgccttgccttgcgaggccataagaccgtgacataccttactctgcagggcaatgatcaggacgacatgtttccagccctctgtgaagttttgagacatcccgaatgcaacttacggtacctcgggctggtaagctgctcagcaacaacccaacagtgggctgacctctctctggccctcgaagtgaaccagtcacttacctgcgtcaacctgagtgacaacgaactcctcgacgagggggccaaactgctatacacaacgcttcgccatccaaaatgctttctgcaacggctgagcctggagaactgtcatctcactgaagcaaattgcaaggatctggccgccgtgctcgtggtctcaagggaattaacccacctgtgcctggccaaaaatccaatcggtaatacgggagtaaagttcctctgtgagggactgagataccccgagtgcaagctccagactctggtgttatggaattgtgacatcacctctgacggatgttgcgatctcaccaagcttctacaggaaaaatcctctcttctgtgcctggacctgggacttaaccatattggtgtgaaagggatgaagttcttgtgtgaggctctgcgcaagccgttatgtaatctgagatgtctgtggttgtgggggtgttccattcccccttttagttgcgaggacctgtgctcggccctgtcttgcaaccagtctctggtaactctggacttagggcagaatccactgggatctagcggcgtgaagatgctgttcgagaccttaacttgtagcagcggtaccctgcggacattaaggctgaaaattgatgatttcaatgacgaactgaataagctcttagaagaaatagaagagaagaatccccagctgattatcgacacagaaaagcaccacccgtgggctgagaggccatcctctcacgactttatgatttag

SEQ ID NO: 31562 - DNA, 3189 bp, Artificial Sequence
  Description of Artificial Sequence: Synthetic coding sequence
atggtgagctccgcacaaatgggattcaatctgcaggcactgttagaacagttgtctcaagatgagctttcaaaatttaaatacctcataacaacattcagccttgcgcacgaactgcagaaaatccctcacaaggaggtggataaggcagatggcaagcagctggtggagatcctcactacgcactgcgactcgtactgggtggaaatggcatccctccaggtgtttgaaaagatgcaccgaatggacctgtctgaacgggccaaggacgaggttagagaggccgcccttaagtccttcaataagcgaaagccactctcactaggtattacacggaaggaaaggcccccattggacgtagacgagatgctggaacgcttcaagacagaagctcaggcttttactgagaccaagggaaatgtgatctgcctaggcaaggaagtgttcaaaggtaaaaagcctgataaagataacagatgcagatacattttaaaaactaagtttcgggagatgtggaagtcttggcctggagactccaaagaagtgcaggtaatggccgagcggtacaagatgctgattcctttttcaaatccacgggtcttgccaggaccttttagttatacagtagtgctgtatggccccgctggcttaggaaagaccaccctggcccagaaactaatgctggactgggcagaggacaatctgattcataaattcaagtacgccttttatttgtcatgcagagagttgagtagattggggccgtgcagcttcgccgaacttgttttccgggactggcccgagttacaggacgacatcccccatatattggcccaggctcgcaagatattattcgttatcgacggcttcgacgaacttggagctgcgcctggcgctctcatagaggatatctgtggggattgggaaaagaagaagcccgttcccgtgctcctgggcagcctgctcaatagggtaatgttgccaaaagcggctttgctggtgactacaaggccgcgcgcacttagagatcttaggatacttgctgaagagcctatttatatcagagtggaggggttccttgaggaagataggagggcctattttctgcggcatttcggggatgaggatcaggcaatgagggcctttgagttgatgcgctcaaatgcagctctcttccaattaggttccgcacccgctgtctgctggattgtctgcacaaccttgaagttacagatggaaaagggcgaggaccctgtccccacctgtctgacaaggactggactcttcctgagattcttatgttccaggtttccccagggcgcacagctgcggggcgccctgaggactctgagtctgctcgccgctcagggactgtgggcacaaacaagcgtgctccaccgggaggatttggaaaggctgggagtgcaggagtctgacttacgtctgttcctcgacggagacattctgagacaagacagagtatccaaaggttgctactcctttatacacctgtcattccagcagtttctgacagctctgttttatacgttggagaaggaagaggaagaggaccgagatgggcacacctgggatattggggacgtgcagaaactcctgagtggtgtggagcgcctgcgaaatcctgacctgatccaggcagggtactactcctttgggctcgctaatgagaagagggcaaaggagctggaagcaaccttcggctgccgcatgtcacctgatatcaagcaggaattgctcagatgtgacatctcctgtaagggcgggcactctaccgtaacagacctgcaggaactgctgggctgcttgtacgagtcccaagaagaggaactagtaaaagaggtgatggcccagttcaaagagatttctctccacttgaacgccgtggacgtagtgccatctagcttctgtgtgaagcactgccgtaacttacagaagatgagtctacaagtcataaaggagaatctgcccgagaacgtgactgctagcgagtccgacgccgaggtggagaggtcacaggacgatcagcatatgctgccattctggaccgatctgtgttcaatatttggctccaataaggatctgatgggcttggcgatcaacgacagtttcttgagcgcatcacttgtacgcatcctatgtgagcaaattgcgtcagacacctgtcatcttcagcgagtcgtgttcaaaaacatctcacctgccgatgcacaccgtaatctctgtctagcgctgcgggggcacaaaactgttacatacctgactctccaagggaatgatcaggatgatatgtttcctgccctgtgcgaagtcctacgccatcccgagtgtaatctgagatacctgggtttggtttcatgttccgcgactacacagcagtgggccgacctctcactcgcgcttgaggtgaatcagtcactgacgtgtgtgaatcttagcgataacgagctgttggatgaaggcgcaaaactcctctacaccaccctgagacatcccaagtgtttcctccagcgtctctcactggagaactgccatctgaccgaggctaactgcaaagatctggccgcagtgctggtcgtaagtagagagttaacacatctgtgcctggctaaaaatcccatcggtaacacgggggtcaagtttctgtgcgaaggcctgagatacccggaatgcaaactgcagaccctagtgctttggaactgcgacatcacctccgacggctgttgcgatctgactaaactcctgcaggaaaagtcgtctctgctatgtttagatctgggcctgaatcacattggcgtgaaaggaatgaagtttctttgtgaggccttgcggaaaccactgtgtaatctgcgctgcctctggttgtggggctgctctatcccccctttcagctgtgaggacctgtgctcggctctcagttgtaaccagtcacttgtcacactcgatctgggccaaaatcccctcggatcttccggtgtcaaaatgctgtttgagaccctgacctgtagttccggtaccctcaggacactgagattgaagatcgatgacttcaacgatgagctgaacaaactgttggaggagatcgaagagaagaatccacaacttataattgataccgagaagcatcacccctgggctgaacgccctagcagccacgacttcatgatttag

SEQ ID NO: 31563 - DNA, 3189 bp, Artificial Sequence
  Description of Artificial Sequence: Synthetic coding sequence
atggtttcctccgcccagatggggtttaacctgcaggcactcttggagcaactttcccaggacgagctcagtaagtttaagtatctcatcaccacattcagcttggcacatgagctacagaagatcccacataaagaggttgacaaagctgacgggaagcagctggtcgagattctgacaacccactgtgattcatattgggtggagatggcgtccttacaggttttcgagaagatgcacaggatggatttaagtgagagagccaaagatgaagtgcgggaagcagcactgaaatcctttaataagcggaaaccgctcagtctcggaatcacaagaaaggagagaccccctcttgatgtggacgagatgctcgaaagattcaaaacagaggctcaggcttttactgaaactaagggaaatgtcatatgcctcggcaaggaggtgttcaagggaaaaaagcccgacaaagacaaccgatgcagatacatcctgaaaacaaaattcagggagatgtggaaatcctggccgggcgattctaaggaagtccaggtcatggctgaaaggtacaaaatgctaataccatttagcaatcccagagttctcccagggcccttctcgtataccgttgtcctttacggacctgctggcctgggcaaaactactttggctcagaaattgatgcttgactgggcagaagataacttgattcacaagttcaagtacgcattctaccttagctgccgagaactgtctaggctcgggccctgttctttcgccgagctggtctttagggactggcctgagctgcaggatgatattcctcatatactggcccaagcaagaaagattctctttgtcatcgatgggttcgatgaactcggcgcagcgcctggggcgttgattgaagatatctgcggggattgggagaagaagaagcctgttcccgtgctactggggtctcttctcaaccgggtgatgctaccgaaggcggcattattagtgactacaaggccgcgagctttgagggacctacgcattcttgcagaagagcccatctacatccgcgttgaggggtttttggaggaagaccgtcgcgcatattttctgcggcacttcggggacgaagaccaagcaatgcgggcgttcgagctgatgagatccaacgcagctttgtttcagctgggaagtgcccctgctgtgtgttggatcgtgtgtactacactgaaacttcagatggagaagggagaggatccagtccccacctgccttaccaggactggactatttttaagatttctttgcagtagatttccgcagggcgcccagctgcgaggggcgctgcggacactgagcctgctggccgcccaaggtctgtgggcgcagaccagcgtgctccacagagaagatctggagagactgggtgtgcaggaaagtgaccttaggttattccttgatggagatattcttaggcaggaccgggtgtccaaaggctgctatagcttcatccacctgagtttccagcagtttttgactgctctgttctacaccttggaaaaggaggaagaagaagatcgcgatggccacacctgggatattggtgatgtacagaaactgctgtcaggcgtggagcgcctcaggaacccagacttaatccaggcaggatattactcattcggtctggccaatgagaagagagctaaagagctggaggcaaccttcggatgcagaatgtcccctgacatcaaacaggaactacttagatgcgatatttcttgcaagggagggcactcaactgtaactgacctccaggaacttctgggctgtctctatgagagccaggaagaggagctagtgaaggaagtcatggctcagttcaaggagataagcctccacttgaacgctgtcgacgtagtgccttcaagtttttgcgtcaagcactgccgtaacctgcagaaaatgagcctccaagtgatcaaagaaaatctcccagaaaacgtaactgctagcgaatcggatgcagaggtcgaacgatcccaggacgatcagcatatgctccctttttggaccgatctttgttcgatctttgggagcaacaaggacttgatgggcctcgcgatcaacgactcctttctgagcgcgtcactcgtcaggatactatgtgaacagatcgcttctgatacttgccacttacaaagggtcgtctttaaaaacatttctcctgctgacgcccaccgcaatttgtgcttggcactcagaggccacaaaacagtcacatatctgactctgcagggcaatgaccaggacgacatgttccctgctctctgtgaggtgctgagacaccccgaatgcaacctgcgatatctaggcctggtgtcttgttccgcgacaacccagcagtgggcggacctttcactggcgctcgaggtgaatcagagtcttacctgtgtgaatttgtctgataatgagttgctggacgagggggcaaaactgctatacacaacactcaggcatccaaagtgcttcctgcaacgactcagcctcgagaattgtcacctgaccgaggcaaattgtaaggatttagcggctgtgttggtggtgtcccgtgagctgacacatctgtgcctggccaaaaaccccattggaaatactggcgtgaaatttctctgcgaggggctaaggtatcccgaatgcaagctgcagactctcgttctctggaactgtgatatcacaagcgatggttgttgcgatttgaccaagcttctgcaggaaaagagtagcttactctgcctggacctcggtctcaaccacattggtgtgaaaggaatgaagttcctatgtgaggcactgagaaaacccttgtgtaacctcaggtgtctatggctctggggatgcagcatcccccctttctcgtgcgaggatttatgctcagcattaagttgtaaccagtcgctagtgacactggacctcgggcagaaccctttggggagctcaggggtcaagatgctatttgagactctgacttgttcctccggcaccttgagaacgctgcgactgaagatcgacgacttcaatgatgaacttaataaactgcttgaagaaatcgaggaaaagaaccctcaactgatcatagacaccgagaagcaccatccttgggccgagcgtccatcttcccatgacttcatgatatag

SEQ ID NO: 31564 - DNA, 3189 bp, Artificial Sequence
  Description of Artificial Sequence: Synthetic coding sequence
atggtgtcgtctgctcagatgggcttcaacctgcaggccctgctggaacagttatctcaagacgagttgtcaaagtttaaatatctcattaccaccttttccctggctcacgagttgcaaaaaatcccccataaggaggtcgacaaggcggatgggaaacagctggtggagatactgaccacacactgcgactcctattgggtcgagatggcctctctgcaggttttcgagaagatgcataggatggatctgtcagaaagggctaaagacgaggtgagggaagcagcgctcaaatcattcaataaaagaaagcccttaagtttgggaattacaagaaaagagaggcccccactcgatgtggatgaaatgctggagcgatttaagacagaggcccaggccttcactgagacgaagggaaacgtgatttgcctggggaaggaagtctttaaagggaagaaacccgacaaagataacagatgccgttatatccttaagacaaagttcagggagatgtggaaatcctggcctggggattcaaaagaggtgcaagtgatggctgagcggtataagatgctcattcccttctccaatcccagagtactgcccggaccattctcatataccgttgtcctctacgggcccgccgggttgggcaaaaccaccctcgcacagaaactgatgcttgattgggccgaggataatctgatccataagttcaagtacgcgttttatctgagctgccgcgaactcagcagactgggtccctgtagctttgctgagttagtgttcagagactggcccgagctccaagacgatattccacacatcctggcacaagctcgaaaaattttgttcgtgattgatggcttcgatgaacttggcgctgctcccggagcccttatcgaggacatctgcggcgactgggagaagaaaaaacctgtgcctgtcctattagggtccctgctgaatagggtgatgctgcctaaggctgcactgctggtgaccacccggccccgggctcttcgagacttgcgcatccttgcagaagagcctatctatatccgtgtggaggggttcctggaagaagatcggagggcatattttctccgccacttcggcgatgaagaccaggcaatgcgtgccttcgagctcatgagatctaacgccgctttgttccagctcgggtcagcgcctgccgtgtgttggatcgtgtgcactaccctaaagctgcaaatggaaaaaggtgaggaccccgtccctacctgtctgactcgaaccggcctcttcctccgtttcctgtgttcaagattccctcagggtgcccagctgcggggagccctgcgcaccctgtctcttctggctgcacaaggactttgggctcaaacctctgttttacaccgcgaggatttggagagattaggggtgcaggagtctgacctccggctgtttttggatggcgatattttgaggcaggacagagtctcaaaaggatgctacagtttcatacacctctctttccaacagttcttgaccgccttattctacaccctcgaaaaggaggaggaagaggatagggatggccatacatgggacattggagacgtacaaaagctgctgtccggagtggaaaggcttcgcaaccctgacctcatccaggcggggtattattcctttgggctagccaatgagaagagagccaaagaactggaggctaccttcggctgtcgaatgtcacccgatattaagcaggaactcctgagatgtgatattagctgcaaaggtggtcattccacggttacagacttacaggaattgctgggctgtctttatgaatctcaagaagaggaacttgtgaaggaggtcatggctcagttcaaggagataagtttacacctgaatgctgtcgacgtggttccatcttctttctgtgtcaagcattgcaggaacctacagaagatgtccctgcaggtcattaaagagaacttgcctgagaatgtcacagctagcgagtccgacgcagaggtcgagaggagtcaggatgaccagcacatgctccccttttggacagacttgtgctctatattcgggtctaacaaggatctgatgggcctggccatcaatgacagcttcttgagcgccagtctggtgcggatattatgtgagcagattgccagtgatacttgccacctgcagcgggtggtgtttaaaaacatttcacccgccgacgcccacagaaacctctgtctggccctgaggggacacaagaccgtgacctacttaaccttgcagggcaacgaccaggacgacatgttccccgctctgtgcgaggtgttgaggcaccctgagtgtaatctcaggtatctgggtctggtttcttgttctgccaccacccaacaatgggccgatttatccctcgctcttgaggttaaccagagtctcacctgtgtcaatttatccgacaatgaactgctggacgaaggagctaagctgctgtacacgacgctccgacacccgaagtgttttctgcaaagattgtctcttgaaaactgtcatctgacagaggcaaattgtaaggatctcgcggccgtccttgtggtcagccgagaactgacacatttgtgtctggcaaagaatcccatcgggaatactggggttaagtttctgtgcgagggcctaaggtacccggagtgcaagctgcagactttggtgttgtggaattgcgacatcacatccgatggatgctgtgaccttactaagctgctgcaggagaagagttctctgctttgcctggacctcgggcttaaccatatcggagtaaaaggaatgaagttcctttgcgaggcattgagaaagcctctatgcaatttgcgatgcctctggctctggggctgctctattccaccctttagctgcgaagatctctgctctgctctgtcctgcaaccagagtttggtgactttagaccttggacagaatccgctgggctcctcaggagtcaaaatgttgtttgaaacactgacatgtagctctggtacactcaggactctaaggctcaagattgacgactttaatgacgagctgaacaaactcctggaagagatcgaagagaagaacccccagctgattatcgataccgagaaacaccatccctgggctgaacggccttcctcccacgatttcatgatctag

SEQ ID NO: 31565 - DNA, 3123 bp, Artificial Sequence
  Description of Artificial Sequence: Synthetic coding sequence
atggtcagcagtgctcagatgggatttaacctgcaggctctgctcgaacaattatcgcaagatgaactctccaaattcaagtacctaattacaacattctcccttgcccatgagcttcaaaagatcccgcataaggaggtcgataaggctgatggcaaacagttggtcgaaattctgactacacactgtgactcgtactgggtggagatggcaagtctacaggtgtttgaaaagatgcatcggatggacctttccgaacgcgccaaggatgaggtgcgagaagctgcgctcaagagctttaataaaagaaagcctctgtcactcgggattactaggaaagagcgacctccccttgacgttgatgagatgctcgaacgcttcaagacagaggcacaagacaaggacaatagatgcagatacatcctcaaaaccaagtttcgggaaatgtggaagtcctggcctggcgacagcaaagaagtgcaggtcatggccgagcgctacaaaatgctgatccctttcagcaatcccagggtgctcccagggccattttcttatacggtcgtgttgtatgggcccgctggattaggcaagaccactctcgcacagaaattgatgctggattgggctgaggacaacctgattcacaagtttaaatatgcattctatttaagctgccgggaactgtcacgacttgggccctgctcctttgccgaacttgtgtttagagactggcccgagctccaggacgacattccacacatccttgctcaagctcgcaaaattctttttgtcatcgatggctttgatgaattgggagcggccccaggagctttgatcgaggacatatgtggggattgggagaaaaagaaacctgtccctgttctgttgggttccttgttgaaccgtgtgatgctgcctaaggccgcccttctcgtgaccacgcggcctagagctctgcgcgacctcaggattctggcggaggaacccatttacatccgagtggaaggattcttagaggaggaccggcgcgcatacttcctccggcattttggcgatgaggaccaggccatgagggcttttgaactgatgcggagtaacgcagcactgttccaactggggtcagcccctgcggtgtgttggatagtgtgtactacgttaaagctacagatggaaaaaggggaagaccctgtcccaacctgcctgacccggaccggattattcctgagatttctatgctcacgattcccccaaggagcccagctgaggggggcattaagaacgctgagtctgctggcagcgcaggggctttgggctcaaacgtctgttctccatcgggaagaccttgagcggctcggcgtacaagagtctgacttgaggttatttcttgacggcgacattctgcggcaggaccgggtgtccaaaggatgctattcttttatccatttgagcttccaacagtttctcaccgcactgttctacacccttgagaaggaggaagaggaggatagagacggtcatacatgggatatcggcgatgtgcagaagttactgagcggtgtcgaaaggctgaggaatcccgacctgatccaggctggttattattcttttggcctcgcaaacgagaaaagggccaaggagctggaggccacttttggctgccgtatgtctcccgacattaaacaggaactgttgagatgcgatatcagctgtaagggcggtcattccacagttactgatctgcaggaactcttagggtgcctgtacgaatcacaggaagaagagctggtgaaggaggtgatggcccaatttaaagaaataagcttgcacctgaacgcggtggacgtcgtaccgtcttctttttgtgtgaagcactgccgcaatctacagaagatgagcctccaagtgattaaggagaacctgcccgagaacgtgacagcatcagagagcgatgcagaggtggaacgatctcaagacgatcaacacatgttgccgttttggacagacctgtgtagcatatttggtagtaataaggacttaatgggcctcgccatcaacgactccttcttgagtgcgtcactcgttagaatactctgcgagcaaattgctagcgacacctgccacctacagagggtggtcttcaaaaatatcagccccgccgatgcccaccgcaacctgtgcctggctctgcggggccacaaaacagtgacctacctgactctgcagggcaatgatcaagacgacatgtttcctgctttatgcgaggtgctcagacacccagagtgtaacctccgctacctgggcttagtcagttgttctgccaccacgcagcagtgggccgatttgtccctcgctctcgaggttaaccagagcctcacttgtgtgaacctgtcagataatgagctgctcgatgagggcgcaaaactgttatacacgactctgaggcaccctaaatgttttcttcagcggctgtccctagaaaactgtcatctgaccgaggccaactgcaaggatttggctgctgttctggtggtctctagagaattaacacacctgtgcctggctaagaatccgatcgggaacacaggggtgaagttcctctgtgaagggctgaggtacccagagtgtaaactgcagaccctggtgctgtggaactgcgatatcacctctgacgggtgttgtgacttgactaaactattgcaggaaaaatccagcctactgtgcctggacctgggcctgaaccatatcggcgtcaagggaatgaagtttctatgcgaagcactgcgaaagccactttgtaatctgaggtgcctttggctgtgggggtgtagcattccacccttcagctgcgaagatctgtgttctgctttgtcatgcaaccagtctctggtgacgctcgatttggggcagaatcctctcgggtcttccggcgtgaaaatgctgtttgagactcttacgtgcagctcagggaccctaaggactttgaggcttaaaatcgacgatttcaatgatgagcttaataaactgctagaggagatagaggagaaaaatcctcagctgatcattgataccgaaaaacaccacccctgggctgagaggccaagttctcatgattttatgatttag

SEQ ID NO: 31566 - DNA, 3123 bp, Artificial Sequence
  Description of Artificial Sequence: Synthetic coding sequence
atggtgtctagcgcccagatgggctttaatttgcaggctctgttggagcagctatctcaggatgaacttagtaaatttaagtacttgattactacgttctctctggcacacgaactccagaaaatcccccataaagaagtcgacaaagcggacgggaagcagttggtggagatactgaccacccactgtgactcctattgggtagaaatggcatcgttgcaggtgttcgaaaagatgcaccggatggacctgagtgagcgggcaaaggatgaggtgcgggaagcagcattgaagagctttaataagaggaagcccctttccctcggtatcactaggaaagaaagacctccactggacgtggacgaaatgttggagagattcaaaaccgaagctcaggataaggacaatcgatgtcgttacatccttaaaacaaaatttagagaaatgtggaagagctggcccggtgatagtaaagaggtccaggttatggcagagagatacaagatgctcatcccattcagcaacccaagggtgcttcctggaccattttcttacaccgtggttctttacggccccgcagggcttgggaagaccaccctcgcacagaagctgatgcttgactgggccgaagacaatctgatccataagttcaagtacgctttttacctgtcctgccgtgaattgtcccggctaggcccctgcagcttcgcggagctagtattcagggattggcccgaattacaggacgacatacctcatatcctcgcccaagccagaaaaatcctgttcgtgattgatgggttcgatgaactgggcgccgcccccggagctctgattgaggatatttgtggcgactgggaaaagaagaaaccagtccccgtcttgctcgggtccctactgaacagggtgatgcttcccaaagccgccctccttgtgaccactaggccccgcgccctccgggatctgaggatcttagcagaagagcccatctacatcagagtagaggggtttctggaagaagataggcgcgcttattttctgagacatttcggcgacgaggatcaagccatgcgcgcatttgagctgatgcgaagcaatgcggccctgttccagctcggatctgccccagccgtgtgctggatcgtttgtactaccctgaaattacagatggagaaaggggaagaccctgttcctacttgcctcactagaacaggcctgttcctgcgtttcctgtgcagccggtttccacagggggcgcagctgagaggagcactaagaacattgagcctgttagccgctcagggcctgtgggcccagacttcagtgttgcaccgtgaggatctagaaaggttgggggtccaagagtccgacctaagacttttcctcgatggggatatcctcaggcaggaccgcgtgtcaaaagggtgctacagtttcatccacttgtccttccagcagttcctcacagctctgttttacactctggaaaaggaggaagaagaggaccgcgatggacatacgtgggatataggcgatgtgcaaaagctcttgagcggcgtagagcgcttaagaaatcctgaccttattcaggccggatattatagctttggccttgctaacgaaaaacgggccaaggaactcgaggccactttcggctgccgcatgtctccagatatcaagcaagagcttttgcgttgtgacatctcctgtaagggcggacattctactgtgacagatctgcaagagctgctgggatgcctgtacgaatcccaggaagaggagctggtgaaagaagtgatggcccagttcaaggaaatcagcctgcatttaaatgcggtcgatgtggtgccctcaagcttttgtgttaaacattgtcggaatttgcaaaagatgtctctccaggtgatcaaagagaacctgcccgagaatgtcaccgccagtgaatcagatgctgaagtcgaaaggtctcaagatgatcagcatatgcttcccttctggacagacctctgcagtatcttcgggtccaataaggatcttatgggtctggccatcaatgattccttcttgagcgccagcctggtgcgaattttgtgcgaacagattgcatcagatacatgccatctgcagcgagttgtcttcaaaaatatcagtcctgcagatgcccatagaaacctgtgcctggccctccgagggcacaaaaccgttacatatctcaccctccaggggaacgaccaagatgatatgtttcctgcactttgcgaagtgctcaggcacccagagtgcaatctccgatacctgggactcgttagctgctcagccaccactcagcagtgggccgatttatctctagcactggaggtgaatcagtccttaacttgcgtcaacctaagcgataatgagctcttggatgagggcgcgaagttgctctatactacactgcgacaccccaaatgcttcctgcagagactctctctcgagaactgccacctcaccgaagctaactgtaaagatctagccgctgtgttagtggtgagcagagagcttacccacctctgcctggctaagaaccctatcggaaacactggggttaaattcctgtgtgaaggcttgcggtatcccgaatgcaagttgcagactttggtgctgtggaattgtgacattacttctgatgggtgctgcgacttaaccaagcttctgcaagagaagtcctcactcctgtgtctggacttgggacttaaccacatcggagtgaagggcatgaaattcttgtgcgaagcactccgaaaacctctttgtaacctgcggtgcctgtggctgtggggctgcagcattccacctttctcctgtgaggacctttgttccgccctgagttgcaatcaatccctggttaccttggatttaggccagaatcctctgggctctagtggagtcaaaatgctgttcgaaacactgacctgtagctcaggaacactccgcaccctgaggttgaagattgacgacttcaatgatgagctgaacaaactgctcgaggaaatcgaagaaaaaaatccccagctaattattgacaccgagaagcaccatccctgggccgagcgcccatctagtcatgacttcatgatttag

SEQ ID NO: 31567 - DNA, 3189 bp, Artificial Sequence
  Description of Artificial Sequence: Synthetic coding sequence
atggtgtcaagcgcccagatggggttcaacttgcaggcattgctagaacagctgagccaggatgaattgagcaagtttaagtacttgatcacaactttttccctggctcatgagctgcagaagattccacacaaggaggtggataaggccgacggcaaacaacttgttgaaatattaacaacccattgtgacagttactgggtcgagatggcgtcgctacaggtgttcgagaaaatgcaccgcatggacttaagcgagcgtgcgaaagatgaggtccgagaggcagctctaaagagctttaataaacgaaaaccactttccttaggcattacacgaaaagagagaccccccttggatgtagacgagatgctggaaaggttcaagactgaagcacaggccttcacggaaactaagggaaacgtgatctgtctggggaaggaggtgttcaaaggcaagaaacctgataaagataaccgttgcagatatatcctcaagaccaagttcagggagatgtggaagtcttggcccggagactcgaaggaagttcaggtgatggctgagcgctacaagatgctaattcccttcagcaatcctcgggttctcccaggcccgttcagttataccgtagttctgtacggccccgccggactcggcaagaccactctggcacagaaactgatgcttgattgggctgaggataatctgatccataagtttaaatacgccttttatctgtcgtgccgagagctttcaagacttggcccctgtagctttgctgagctagtctttcgagactggcctgaactccaagatgacattcctcatattttagctcaggctcgcaaaatcctgtttgtgatagacggatttgatgagctcggcgctgcccccggtgcgttgatagaggacatctgtggagattgggagaaaaagaagcccgttcctgtgctgctcggaagcctcctgaatcgggtaatgctgccaaaggcagccctgctcgtgacaactcgacccagagcattgagggaccttaggattcttgccgaggagcccatatatatccgagtggagggctttctggaagaggaccgcagggcctatttcctccgccattttggagatgaggatcaggccatgcgagcctttgagttgatgcgcagcaatgccgcgctgtttcagttgggctcggccccagccgtctgttggatcgtatgtaccacactgaagctacaaatggagaaaggtgaagaccctgtaccaacatgcctgacccgaactggactttttctcagatttctgtgcagccgatttccgcaaggtgcccagttaagaggggccttaagaacacttagccttctggccgcccaggggttgtgggctcaaaccagtgtgttgcatagagaggacctggagagactaggcgtccaggagtccgacctgcgcctgttcctcgacggtgacatattacgccaagaccgagtatcaaaggggtgctactcctttatacatctgtcgtttcagcagtttcttacagccctgttctatacactcgaaaaagaagaagaggaggaccgcgatggacatacttgggatataggagatgtgcagaagctattgagtggcgtggagcgactgaggaaccctgacttgattcaggcgggatactattcattcggactcgcaaatgagaaacgggctaaagagctggaggcgacctttggatgtcgcatgtctcctgacattaagcaggagcttctccgatgcgatatttcctgtaagggggggcactcaaccgtgactgatctgcaggaattgctgggatgcttatacgagagtcaggaggaggaactcgtgaaagaggtgatggctcagttcaaggaaatcagccttcacctgaatgctgtcgatgtggttccgtcctcattttgtgtgaaacattgccgtaacttgcagaagatgtcgcttcaagtgatcaaagagaatctgcccgagaacgtgactgcaagcgaatctgatgcagaagtagagcggtctcaggatgatcagcacatgctgccattctggacagacctgtgtagtatctttggctcaaacaaggacctgatgggtttagccataaacgattcattcttgtcagctagcctcgtgcgtattctgtgcgagcagatcgcctccgatacctgccatctgcagagagtggtatttaaaaacattagccctgccgatgcgcataggaacttgtgcctggctcttcgcggccataagaccgtcacttatctgactctgcagggaaatgaccaggatgatatgttcccagctctgtgcgaggtgctgcgccacccagagtgcaatttgcgttacctggggttggtgtcctgcagcgccaccacacagcagtgggcagatctgagcctagcgttggaggtgaaccagagccttacatgcgtcaacctctcagataacgagctgctggacgaaggggccaagttactatatacaaccctacgccaccctaaatgctttcttcagcgactgtctttagagaactgccacctcaccgaggctaattgtaaagacttggcagccgttttagtggtcagccgagagctgacgcatctgtgtctggctaagaaccctattggcaatacaggggtaaaattcctatgcgagggtctgaggtaccctgagtgcaaacttcagaccttggttctctggaattgcgacatcacatccgatggttgttgcgatctgacaaagctgctgcaggaaaagtcatcactcctctgcctggacctcggacttaaccacatcggcgtcaaaggtatgaagtttctgtgtgaggctttaagaaaaccactatgcaatctgcggtgcctatggttatggggatgttccattcctcctttcagctgtgaggacctctgctcggccctgagctgcaaccagagcctggtcaccctggacctcggtcaaaatccgctgggcagttctggcgttaagatgctgttcgagacccttacttgcagtagcgggacactaaggactctgcgcttaaaaatcgacgacttcaatgacgagttaaataagctgctggaggaaattgaggaaaaaaatccacagctgatcatcgatacagaaaaacaccacccatgggcggaacggcctagctcccatgacttcatgatctag

SEQ ID NO: 31568 - DNA, 3123 bp, Artificial Sequence
  Description of Artificial Sequence: Synthetic coding sequence
atggtcagttctgcccagatggggtttaatctgcaagccctgctggagcagttgagccaggacgaattgagtaagtttaagtacctgataactaccttctctttggctcatgagctgcagaaaataccgcacaaagaagttgacaaggccgatggcaagcagcttgtcgagattcttacaacgcactgcgattcttactgggtggagatggcctctctccaggtgtttgagaagatgcataggatggatcttagtgagcgggccaaagatgaagtccgcgaagcggccctcaagtcttttaataaaagaaagcccttgtcactcggcatcacacggaaggagcgccctccgctggatgtggacgaaatgctggaacggtttaaaacagaagcccaggataaggataacaggtgtaggtatatcctgaagaccaagttcagggaaatgtggaaaagttggcctggagactcaaaggaagtgcaggtaatggctgagcgttataagatgctcatacctttcagcaatccccgcgtgctgcctggaccattctcctacactgtcgtcctttacggtcctgctggcctgggcaagaccacgctcgctcagaagctgatgctggactgggcagaggataacctcattcacaaattcaagtacgccttctacctgagttgcagggagctcagtcgcctcggaccctgcagcttcgcagagcttgtttttcgcgattggcctgagttgcaggacgacataccacatatcttggctcaggctcggaagatcttgttcgtgatagacgggtttgatgagttgggagccgctccaggcgctctgatcgaggacatttgcggtgactgggaaaaaaagaagcctgtgcctgtgcttctgggcagcctgttgaaccgagtcatgttgccaaaagctgccttactcgtgacaaccagacctcgggcgctgagagacttgaggattttagctgaagaacctatttatattcgagtcgaaggtttccttgaggaagatcgtagggcctactttctaaggcatttcggcgacgaagaccaggccatgagagcctttgagctgatgagatctaatgctgctctttttcagctgggcagtgcccctgcagtgtgttggattgtctgtaccacgctaaagctgcagatggagaagggcgaagatccggtccctacctgtctcaccagaaccggcctgtttctccgcttcttgtgtagtaggttcccacagggtgcgcagctgagaggagccctcagaacactgtctctcctggccgcccagggcctgtgggcccagacttcagtgttgcatcgcgaagatctcgagcgcctgggggtgcaagagagcgatcttagacttttcttggatggtgatatcctgagacaagacagagtcagtaaaggatgctacagtttcattcacctgtcatttcaacagttcctgaccgctctgttttatacgttagagaaggaggaagaggaggatcgagacggccacacttgggacattggcgacgtccagaagctactgtcaggtgtggagcgcctaagaaatcctgacctgatccaggctggctactatagcttcggcttggccaacgagaaaagggctaaagagttggaggcgacctttggttgcagaatgtctccagacattaagcaggagttactgcgctgcgacatctcatgtaagggaggacattcaactgtgaccgaccttcaagagctgttaggatgcctgtatgagagccaggaggaggaattggtgaaagaagtgatggctcagttcaaagaaatctcgctgcatctgaatgccgtcgacgtggtgccatcctcattttgcgtcaaacattgtcggaacttgcagaagatgagcttgcaagtcattaaggagaatctgcccgaaaatgtcacagccagtgagtcagacgccgaggtggagcgttcacaggatgatcaacacatgttaccattttggacagatctttgctccatttttggctctaataaggacctgatggggctggccatcaatgattcattcctatccgcttccctggtgaggatcttgtgcgagcagattgcctccgacacgtgccacctccagcgagtagtttttaagaatatttctccggcggatgcccataggaatctctgtctcgcgctgcgggggcacaagacagtcacttatctgaccctccaaggcaatgatcaggatgacatgttccccgctctctgcgaagttctgcggcacccggaatgcaatctccgctacctaggcctcgttagttgctcggctaccacgcaacaatgggccgacctaagcctcgcgttggaggtgaaccagtcactgacttgcgtgaatctctcagataacgagctcctggacgagggtgcgaagctcctgtacacgactcttcggcaccccaaatgtttcctccagagactgtctctagaaaattgtcacctgaccgaagccaactgcaaagatttagccgctgttctggtggtctctagggagttgacacacctctgtctggctaaaaacccaattggcaatacaggcgtaaaatttctgtgtgaaggcctgcgctaccccgagtgcaaacttcagaccctggtgttatggaactgtgatataacatcagacggctgttgcgatctcacgaagctgctccaggagaagtcttcccttctttgtctggacctgggccttaatcatattggggtgaagggcatgaagttcttgtgcgaagctctgagaaaacccctctgtaatctacggtgtctctggctgtggggctgcagcatccctccatttagctgcgaagatctctgctcagccctctcgtgtaaccaaagcctggttacattagacctgggccagaaccctcttgggtcttccggggtaaagatgctgttcgaaacccttacgtgctctagcggcacactgcgcacactgagactcaaaattgacgacttcaatgacgaactaaataagcttctcgaagaaattgaggagaagaatcctcagttaattatcgatacagagaagcatcatccatgggcagaacgccctagcagccacgactttatgatatag

SEQ ID NO: 31569 - DNA, 3189 bp, Artificial Sequence
  Description of Artificial Sequence: Synthetic coding sequence
atggtctctagtgcacagatgggattcaatttgcaggcactgctcgaacaactatcccaagatgaattaagcaaatttaaatacctgattacaacctttagcttggcccacgaattacagaaaatcccccataaggaggtggacaaggcggacggaaaacagttggttgaaatccttactactcactgtgactcttactgggtggaaatggcttcacttcaggtgtttgagaaaatgcaccgaatggacttatcagaaagggccaaagacgaggtgagagaggctgcactgaagtcctttaataagaggaagccactgtcactaggcattacaagaaaagagagaccccccctcgacgtcgatgaaatgcttgaaagattcaagacagaagctcaggcctttactgaaaccaagggcaacgttatttgcctgggcaaagaggttttcaagggaaagaagcccgataaagataatcggtgtcgatacatcctcaaaaccaagtttagggagatgtggaaatcttggccaggcgactctaaggaggtgcaggtcatggctgagaggtacaagatgctcatccccttctccaatccaagagtcttgccaggacccttttcctacactgtagtgctgtacgggcctgcaggcctggggaagaccaccctggcacagaaactgatgctggactgggctgaggacaatctcatccacaagtttaagtacgccttctatctaagttgtcgggagttgtcccggctaggaccatgcagctttgccgaactggtcttcagagactggccggaattacaggacgacatcccgcatatactggcccaggctagaaagatcctcttcgttatcgacggctttgacgagctgggcgcagctccgggtgcactgatcgaggatatctgcggcgactgggaaaaaaagaaacccgtacccgtgctgcttggctccctcctgaaccgcgtgatgctgcccaaggctgcgctattggtgacaacccgccctcgcgcactgagggatctgagaatcctggccgaagagcctatctacatccgggtggaaggattcctggaggaagaccgcagagcctacttcctgcgacacttcggcgacgaagaccaagctatgagggcttttgagctgatgcggtctaacgcagctctgtttcaactgggatctgctccagccgtctgttggatcgtttgtactacccttaagctacagatggagaagggagaagatccagtccctacctgtttgacccggacgggtctgttcttgcgctttctttgctccagattcccacagggggcccagctgcggggcgcccttcgcaccctttcgctgctcgcagctcagggcctctgggcacagacaagcgtcttgcatcgcgaggacctggaaagacttggcgtccaggagtcagatctgcgcctgtttcttgatggcgacatcttaaggcaggatcgcgtctcaaagggctgttatagcttcatccatctgagctttcagcagtttttaaccgcactgttctatacactggaaaaggaggaggaggaggaccgggatggccacacttgggatattggagacgtgcagaagctcttgtctggcgtggaacggcttcgcaacccagatctgatacaggcaggttattactcctttggtctcgctaacgaaaagagagccaaagagctcgaagcaacgttcggctgcaggatgagtcccgacatcaaacaagagctgctgcgctgtgatatctcctgtaagggcggacacagcaccgtgactgatctccaggaactgctgggttgtctatacgagtcgcaggaggaagagctcgtgaaggaggtcatggcgcagttcaaggagatctccctgcatttgaacgcagtggatgttgtcccgagcagcttctgcgttaaacattgtcgcaacctccaaaaaatgtccttgcaagttatcaaagagaacctgccagaaaatgtcacagcatccgagtctgatgccgaggtcgaacgttcccaggatgatcagcatatgttgccgttctggacggacctctgctctatctttggttctaacaaggacctgatggggttggccatcaacgattcctttctgtctgccagcctcgttcgtatactgtgcgaacaaatcgcaagtgacacctgccacctacagcgcgtggtatttaaaaacatttcccccgcggacgcacacagaaatctttgcctcgcacttcgcggtcacaagacagtgacctatctgacacttcaagggaatgatcaggacgacatgtttccagcattgtgcgaggtgcttaggcatcctgaatgtaatttgcggtaccttggcctggtgagttgttctgccacaactcaacaatgggcagacttaagcctcgccctcgaggtgaatcagtcgctcacctgcgtgaatctgtcagacaacgaactcctcgacgaaggagccaagttattatacaccactcttaggcacccaaagtgcttcctgcagaggctctcgctggagaactgccatctgaccgaggccaactgtaaagatcttgcggccgtgctcgtagtgagccgcgaattgactcacttgtgcctggcgaagaatcccatcggaaacacaggcgtgaagttcctgtgtgaggggctgcgctatccagagtgcaagctgcaaacactggtcctctggaattgtgatatcacgtctgacgggtgttgtgatctgactaaactattgcaggagaagagctcccttctttgcctggatcttggactcaatcacattggcgtgaagggtatgaagtttctgtgtgaagccctcaggaagccattatgtaatttacgctgtctctggttgtggggatgctccatcccaccattcagctgcgaagacttgtgctcagcgctgtcctgcaatcagagtcttgtgaccctcgacctcggtcaaaacccacttggatcaagcggggtcaaaatgttgttcgagactctcacctgtagttcaggcacactcagaacgctgcgactcaagattgatgacttcaatgatgaactaaacaagctcctcgaagagatcgaggagaaaaatcctcagctgatcatcgacacggagaagcatcacccctgggcagagaggcctagctcacatgactttatgatttag

SEQ ID NO: 31570 - DNA, 3189 bp, Artificial Sequence
  Description of Artificial Sequence: Synthetic coding sequence
atggtgtctagtgcacagatggggttcaacttgcaggctctattagaacagctctcccaggatgagttgagcaaatttaaatacctgatcacaacattcagtttggcccatgagcttcaaaaaatcccccacaaagaagtcgacaaagctgatggcaaacagctggttgagattcttacaacccactgtgattcctattgggttgagatggccagtctacaagtatttgaaaaaatgcacaggatggacttgagcgagagagcaaaagacgaggtgcgcgaggctgccctgaaaagtttcaataaacgcaagcccctgagccttggaatcacacgtaaagagcgtccccctcttgatgtggatgaaatgctggagcggtttaagaccgaggcccaagcctttacagaaacaaagggcaatgtgatctgcctcggtaaggaagtgtttaaagggaagaagccggacaaggacaaccggtgtcggtatatattgaaaactaagttccgggagatgtggaaatcatggcctggtgactcgaaggaggtgcaagtcatggctgaacgctataagatgctgatcccattctccaatcctcgcgtgctaccaggaccattttcctatactgtggtcctgtacggccccgcagggctgggtaagactactttggcccagaaactcatgcttgactgggccgaagacaatctgattcataaattcaagtacgcattctacctctcatgtagagagctgagtagattagggccatgttctttcgccgagctcgtgtttcgggactggccggaactacaggatgatataccgcatatcttggcccaagcaagaaagattctgttcgtgattgacgggtttgatgaactcggcgcagcgccaggggccctcattgaggatatctgtggcgattgggaaaagaaaaaaccggtccccgtgttgctgggatcactactcaacagggtcatgcttccaaaggcggcacttctggtcaccacccgacctcgagcgctgagggatttgcgcattctggctgaggagccaatctacattcgggtggaaggattcctggaggaggataggcgtgcatatttccttcgacacttcggtgacgaagatcaggctatgcgtgccttcgagcttatgaggtccaacgcagcactcttccagttgggcagtgcacctgccgtgtgttggattgtgtgtacaaccctgaaattgcagatggaaaagggcgaggaccccgttcccacttgcctaactagaaccggcctctttctgcggttcctgtgttccagattcccacaaggcgctcaactgcgaggagcccttcgcacactgtctctgctcgccgctcaaggactatgggcgcagacctctgtgctgcatagagaagacctcgagcgtttaggcgtccaggaaagtgatctgcgcctgttcctggatggggacatattgcgacaggacagggtgtccaaaggctgttactcatttattcatctctcttttcagcaattcttgactgcacttttttatacactcgagaaagaggaagaagaggacagagatggtcatacgtgggacatcggagacgtgcagaagttactctcaggtgtggagaggttaaggaaccctgacttaattcaggccggttattattctttcggactggccaacgagaaaagggctaaagagttggaggccaccttcggctgtaggatgagcccggacattaaacaggaattgctgcgttgtgacataagctgcaaaggcggccactctaccgtgaccgaccttcaggagctgcttgggtgcctgtatgaaagtcaggaagaggagctagtaaaggaagtgatggctcagtttaaagagatttctttgcacctgaacgcagttgacgtggtgcccagctcattctgtgtcaagcactgcagaaatcttcagaagatgagtcttcaggtgatcaaggaaaacctgccagaaaatgtgaccgcttctgaatccgacgcagaggtggaaaggtcacaagatgaccagcatatgctgccattctggaccgacctgtgtagtatcttcggaagcaacaaagatctcatgggactggcaatcaacgacagtttcttgtccgcaagtctggtgaggattctgtgcgaacagattgcctccgatacttgccacctccagagggtggtcttcaagaatatcagcccggccgacgctcataggaacctgtgtctcgcactgcgcggacataaaacagtgacctatcttaccctccagggtaacgatcaggatgacatgtttcctgctctgtgcgaggttctgaggcaccctgaatgtaatttgcggtatctcgggctggtgagctgtagcgctaccactcagcaatgggccgacctatcgctggccctcgaggtgaaccagtccctgacctgcgtcaatctcagcgataatgagttattggacgagggcgccaagttattgtatacaaccttgcgacacccgaaatgctttctacagagattgagcttggaaaactgccatctgactgaggcgaattgtaaggacttagcggcagttctcgtagtgagtagagagctgacacacctctgcctggcgaagaaccctatagggaatactggggtcaagtttttatgcgagggcctgagataccccgaatgcaaattacagactcttgtcttatggaactgcgacattacgtccgatggctgttgtgacctcactaaacttctgcaagagaagtctagtctgctttgtttagacttgggcctcaatcacatcggcgtaaaaggcatgaaattcctctgcgaggccctgcgcaaacctttatgcaatcttcgctgtctctggctctggggctgctcaattccacccttttcctgcgaagatctgtgttcagcactttcatgtaaccagtctctagttaccctggacctaggtcagaatcccctaggatcctctggcgtgaagatgctttttgagaccctcacctgctccagcggtactcttcgcaccctgagactgaaaattgatgatttcaacgatgaactcaacaaactcctggaggagatcgaagaaaaaaacccgcaactgattatagatacagaaaaacaccacccgtgggccgagagaccatcctcccatgactttatgatttag

SEQ ID NO: 31571 - DNA, 3189 bp, Artificial Sequence
  Description of Artificial Sequence: Synthetic coding sequence
atggttagttccgctcaaatgggctttaatctacaggcgctgctggagcagctcagtcaggatgaactgagcaaattcaagtatctgattacaacattcagtctggcccacgagctgcaaaaaatcccccataaggaagtagataaagccgacggtaaacagctggtggaaattctcacgactcattgcgattcctactgggtcgagatggcttcattacaagttttcgaaaagatgcataggatggatctgtccgagcgggccaaagatgaggtccgtgaagcagctttgaaatcctttaataagaggaagccgttatcactgggtattacccggaaggaaagacctccattggacgtcgatgagatgctggaacgttttaagactgaggcacaggcttttactgagacgaagggcaacgttatatgtttgggtaaagaggtcttcaaggggaaaaaacccgacaaggataatagatgtcgctacatcctcaagacaaagtttcgggaaatgtggaaatcttggcctggcgacagtaaagaggtgcaggtgatggccgagcgctataaaatgttaattcccttttcgaaccctagagttctccccggcccctttagctacacagtcgtgttgtacggaccagccggcctggggaagaccactctggcccagaagctgatgcttgactgggccgaggacaatttgatccacaagttcaagtatgccttttacctgtcatgcagagagctgtccagactcggcccctgctccttcgccgagctggtttttagagactggcccgagcttcaggatgacattccccatatcttggcccaggcacggaaaatactgttcgtgatcgacggcttcgatgagctcggtgcggcacctggtgcgctcatcgaggatatctgtggcgattgggagaaaaagaaacccgtacccgtcttactgggatcccttctgaacagggtgatgcttcccaaggcagccttactcgtgaccacaagacctagagctctccgagaccttaggatactcgcagaggaacccatctacatacgggtggaaggctttctggaggaagacaggcgggcatatttcttacgtcacttcggcgacgaggaccaagctatgcgagcttttgaacttatgagatccaacgccgccctgtttcaactgggctccgctcccgcggtgtgttggatcgtatgtacaacccttaagttgcagatggagaagggagaggatccagtgcccacctgcttgacaaggaccgggctgttcttaagatttctatgttctagattccctcagggtgcccaattacggggcgcactcaggaccctgagcctgttggcggcccaaggcctttgggcccagacgagcgtgctgcaccgagaggacctggagagactgggtgtgcaggaaagcgatctgaggttgttcctggacggcgatattctccggcaggaccgggttagtaaaggctgctactcgttcatccatctttccttccagcagtttctgactgccctgttttatactttagaaaaggaagaggaggaggatagggacgggcatacctgggatattggagacgtgcagaagcttcttagtggcgtcgaaaggctgcgtaaccctgacctcatccaggctggatactattctttcgggctggcgaatgagaagcgcgctaaagagcttgaagctacattcggctgcagaatgtcacctgacattaaacaagaacttcttagatgcgacatatcatgcaagggggggcattctactgttaccgacctccaagagctcctgggatgtttgtatgagagccaggaagaggagctcgttaaggaggtgatggctcaatttaaagagatttctctgcatttaaatgcggtggacgtggtgccgtcttccttttgcgtgaagcattgccgtaatctgcagaaaatgtccttgcaagtcatcaaagagaatttacctgaaaatgttaccgcttcggaatctgacgccgaggtggagcggtcccaggatgaccagcacatgctgccattttggaccgacctctgtagcatattcggttctaataaggacctcatggggttggccataaacgattccttcctcagtgcttctctggttcggatcctgtgcgaacagatcgcatccgacacctgccatctgcagcgggtggtgtttaagaacatctccccagccgatgcacaccggaacctatgtcttgccctgcgcggccacaaaaccgtgacgtacctcacactacagggcaacgaccaggatgacatgttccccgccctttgcgaggtcctaaggcacccggagtgtaatctgagatacctcggactcgtcagctgcagcgctacaactcagcagtgggcagatttgagcctggccctggaggtgaatcagagtttgacttgtgtgaatctttccgacaacgaattattggacgagggtgccaagctcctctatactaccctacgccacccaaagtgctttctccagaggctctctctcgagaattgccatctcacagaggccaactgcaaagatctggctgcagttctggtcgtctccagagaactaactcatctgtgcctggcaaaaaaccctatcggaaacaccggcgtgaaattcttatgtgaggggctcagatacccggaatgtaaactccagacccttgttttatggaactgcgacattacttcagatgggtgctgcgatctgaccaagctgctccaggagaagtcctccctgctgtgcttagacctcgggctcaaccatattggtgtcaaaggaatgaagttcctttgcgaggcattacggaaacccctctgtaatcttaggtgtctgtggctgtggggctgcagcattcctcccttctcgtgcgaggacctatgtagcgccctgtcatgtaatcagtctcttgtaaccctggacctggggcagaatcctttaggctcgtcaggcgtgaaaatgctctttgaaacattaacttgcagcagcgggaccctccgcaccttgcggctgaaaatcgatgatttcaatgacgaactgaataagctcctggaagaaatagaagaaaagaatccccaattgattatagataccgaaaagcaccacccttgggccgagagaccaagttcgcacgattttatgatatag

SEQ ID NO: 31572 - DNA, 3123 bp, Artificial Sequence
  Description of Artificial Sequence: Synthetic coding sequence
atggtgagcagcgcgcagatgggctttaatttgcaagctctgctcgagcagctcagccaggacgagctgtccaaattcaagtatttgattacgactttctctctggcccacgaactgcagaaaataccccacaaagaagtggacaaggcggacggtaagcagctggtagaaattcttacgacccactgtgactcgtactgggtggagatggcctccctgcaggttttcgaaaagatgcaccggatggacctatccgaaagagctaaggacgaggttagagaggctgcattgaagtccttcaacaaacggaagccgctgagcttaggcatcacgcggaaagagcggccaccattggatgtagatgagatgttagaacgttttaaaacagaggctcaagacaaggataacaggtgtagatatatcttaaagacaaagtttagagagatgtggaagtcttggcctggagactcaaaagaggtacaggtgatggctgagagatacaaaatgttaataccatttagtaaccctcgcgtcctccctggccccttttcttacacagtcgttctgtatggtcccgcaggtttgggaaaaactaccttggcccagaagctgatgctggactgggccgaggacaatctgatccacaaatttaagtatgctttttatttatcatgtcgggagttaagccgcttgggaccgtgctcctttgccgagctggtattcagggactggccggagctgcaagatgacatcccacacatcctggcccaggctaggaaaattcttttcgtgattgacgggttcgacgaacttggcgccgcacctggcgcactgattgaagatatctgtggcgactgggagaagaagaagcctgtgccggtgctgctgggctcccttttgaatcgggtcatgctgcccaaggccgcactgctggtcacaactcgaccaagggcccttcgcgatttaaggatcttggcggaggagcccatttatatccgggtcgaggggtttctagaggaggatagaagggcgtatttcctcagacattttggcgacgaggaccaagcaatgcgggcttttgagctcatgcggagtaacgctgccttgttccagctgggctcagcgccagctgtatgctggattgtgtgtactactttgaagctgcagatggagaagggggaagatccagttcccacttgcctcactcgcaccggactcttcttgcggttcctgtgctcccggttcccgcagggtgcgcagcttagaggggcgctcaggactctgtcgcttttagccgcccagggactgtgggcacagactagcgtccttcatcgagaggatcttgaaaggctgggcgttcaggagagcgacctccgcttgttcctagatggcgatatccttaggcaggaccgtgttagcaaggggtgttacagcttcatccatcttagcttccagcaatttctgacagccctgttttataccttggagaaagaggaggaagaagaccgcgacggtcacacttgggatattggcgacgttcagaagcttctcagtggagtggagagactgcggaatcccgacctgattcaagctggatactacagttttgggttggccaacgaaaagcgggccaaggagcttgaggctacctttggatgccgaatgagcccagacataaagcaggagctcttaaggtgcgatattagctgtaaaggcggacacagcaccgtcacagatttgcaagaactccttgggtgcctgtacgagtcacaggaggaggaactggttaaggaggtcatggctcagttcaaagaaatttcattgcacctaaacgctgttgacgtggtgcctagctccttttgtgtgaaacactgcaggaatctgcagaaaatgtcactgcaagtcatcaaggagaacctacccgaaaacgtgactgcgtccgaaagcgacgcagaggtggaacggtcgcaggatgaccagcacatgctccccttctggacagatctttgctccatatttggctccaacaaagatctgatgggtttagctattaatgattcctttctgtcagcatcgctggtgagaatcctctgtgagcagatagcctcagacacctgccacctgcagcgtgttgtcttcaaaaatatatcccctgccgacgcccatcgcaacctgtgtctagccctgcgggggcataagaccgtgacttaccttaccctccagggcaacgaccaagacgacatgttccccgcactgtgcgaggttctaagacaccccgaatgcaatctgcggtacctgggcctggttagttgctctgcaacaacgcagcagtgggcagatctttccctggctttggaagtcaatcagagcctcacctgcgtgaatttatccgataatgaattgttggacgagggagccaagctgctgtatacgactctgcggcatcccaagtgctttcttcagcggctgtccctcgagaactgtcatcttaccgaggccaactgtaaagatcttgccgcggtgctcgtggtaagtcgggaactcacacacctgtgcctagctaaaaaccctatcgggaacaccggggtgaagtttctgtgcgaagggctcagatacccagaatgtaaactgcagaccctggtgctgtggaattgcgacatcacttccgacggttgctgtgatctaaccaaattgctccaggaaaagtcctctctactttgcctggatttaggactgaaccacatcggcgtgaaaggaatgaagttcctttgtgaggcattgaggaaacctctttgtaacttgaggtgcctgtggctgtgggggtgcagtatcccaccattttcctgtgaagacctgtgttctgccctgtcctgtaaccaaagtctggttaccttggacctgggtcagaatcccttgggatctagtggtgtgaaaatgctgttcgagacgttgacctgttctagtgggacccttcggacactccggctcaagatcgacgatttcaatgacgagctgaataagttgctggaagagatcgaagaaaaaaaccctcagctcatcatcgacaccgagaaacaccacccttgggcggaaagaccatctagccacgatttcatgatatag

SEQ ID NO: 31573 - DNA, 3123 bp, Artificial Sequence
  Description of Artificial Sequence: Synthetic coding sequence
atggtgagctcagcccagatgggcttcaatctgcaagccctcctggagcagctgtcacaggacgagctttcgaaattcaagtatctcattactaccttctctctggctcacgagctccagaagatacctcacaaagaggttgacaaggccgatgggaagcagttagttgagattttgacaacgcattgcgacagttactgggttgagatggccagtcttcaggtcttcgaaaaaatgcatagaatggacttgtcagagcgggctaaggatgaggtccgggaagctgcgctcaagtcattcaacaaacgcaaacccctttcgctggggatcacacgtaaggagagacctcccctcgacgttgacgagatgctggaacgcttcaaaacggaagcacaggataaagacaatcggtgcaggtacattctgaaaacaaagtttcgcgagatgtggaaatcatggcccggcgacagcaaggaagtgcaggtgatggcagagcgatacaagatgctgattcccttcagcaatcccagagtcctgcccggaccatttagttatacggtggttttgtatggcccagcagggctcgggaaaactactctagcccagaaactgatgctcgactgggcagaagataacctcattcataagttcaaatacgcattctatctgagctgccgagaactaagccgactaggcccttgttcctttgcagagttggtctttagggattggccagagttacaggatgatattccacatattctggcccaagccagaaagatcctcttcgtcatagatggattcgacgagctgggggcggcacccggggcactcattgaggatatatgtggcgattgggaaaaaaagaagcctgtcccggtgcttttaggcagtttgctcaacagagttatgctgccaaaagcagccctgctggtcacaacccgtccccgcgctctgagggacctcaggatcttagcagaggaaccaatttatattagagtggagggattcctcgaagaagaccgccgggcttactttctgaggcactttggcgatgaagatcaggcaatgagagcgttcgagctgatgaggtctaatgccgccctcttccagttaggatccgctcccgcagtgtgctggattgtatgtactactctgaaactgcaaatggagaaaggggaagacccagtaccgacttgcctgacccgcacagggctcttcctgaggttcctatgttcacgatttccgcagggggcacagctccgcggcgcgctgcgcacactgtcactgctggcggcccaaggtctctgggcccagactagtgtgctgcaccgagaagacttggaaaggcttggtgtgcaggagagcgacctcaggctctttctggatggtgacatactccggcaagacagagtgtccaaaggctgttattccttcatacacctgagcttccaacagtttctaacggccctgttctacacgctggagaaagaagaagaggaagaccgagatggccatacttgggatatcggcgacgtgcagaaattattgtccggcgtcgagcggctccgcaacccggaccttatccaggcaggctattatagcttcggcctggctaatgagaaaagagccaaggaattggaagctacatttgggtgcaggatgagtcccgatatcaaacaggagttactccggtgtgatatttcgtgcaagggtggccactcaactgttactgacctgcaggagcttctgggttgtctttatgaatcacaggaagaggagctggtcaaggaagtcatggcacagtttaaagagatctccttacacctaaacgccgtggatgtggtcccctcttctttctgcgttaaacattgtaggaatttacagaaaatgtcactgcaggtgattaaggaaaacctgccagagaatgtaacagcatctgagtctgatgctgaagtagaaagatcccaggacgatcaacacatgctaccattttggaccgacctttgtagtattttcgggtccaacaaagacctcatgggcctagcaattaacgactccttcctgagcgccagtctggttcgcatcctctgcgagcagatcgcctctgatacgtgccacctccagagagttgtgttcaagaatatcagcccagcagatgcccaccgtaatctctgccttgccctcagaggtcacaaaacagtgacgtatctaacgctgcagggaaacgatcaagatgacatgttcccagccctgtgcgaagtcttacggcatcccgaatgcaacctccggtatctggggcttgtttcctgcagtgctactactcaacagtgggccgatcttagtttggctctggaagtcaatcagtctttaacttgtgtaaatctttccgacaacgaattgttagacgagggcgctaagctgctgtatacaacgttacggcatccaaagtgctttttacaacggctttcactagagaattgccacctgaccgaagcgaattgcaaagatctcgccgccgtcctggtcgttagccgggagctgacgcatttatgcctggccaaaaacccaataggcaacacaggtgtaaaattcctgtgtgaggggctgcgataccccgaatgcaagctgcaaacactggtgctgtggaattgtgacataacaagtgacgggtgttgcgacctcactaaactcctacaggagaagtcttcactcctctgcctcgatctcggtttaaaccacattggcgtaaagggcatgaagttcctgtgcgaagctcttaggaaacctctctgtaacctacggtgcctgtggttgtggggttgttctatcccgcccttctcttgtgaggacctgtgtagcgctcttagttgtaatcagagtttggttactctcgatttagggcagaaccctctcggcagtagcggagtgaaaatgcttttcgagaccttgacctgttcatcaggaactctgcggacgttaaggttgaagatcgacgacttcaacgacgagttgaataaactgctggaggaaatcgaagagaaaaatccccaacttatcattgacaccgagaagcaccatccttgggcagagcggccgtcttcacacgatttcatgatctag

SEQ ID NO: 31574 - DNA, 3189 bp, Artificial Sequence
  Description of Artificial Sequence: Synthetic coding sequence
atggtgagtagcgcccagatggggtttaacctgcaggcactacttgaacagctgtcccaggacgaactgtcaaaattcaagtaccttattaccacctttagtttagcacacgaactgcaaaaaatacctcacaaggaagtggacaaagcagatgggaagcagttagtggagatcctcactacacattgcgacagctactgggtcgagatggcctctctgcaggtgttcgaaaaaatgcaccggatggatctctctgagagagctaaagatgaagttagagaagcagcactgaagtcattcaacaagcgcaagccgctttctctcgggattacacggaaggaaaggccaccgctcgatgtggatgagatgcttgagagattcaagaccgaagctcaggccttcactgagactaagggaaacgttatttgtctcggcaaagaggtgttcaagggtaagaaacctgacaaagacaaccgctgcaggtacatcctgaaaacaaaattccgggagatgtggaaatcatggccaggcgactcaaaagaagtgcaggtgatggcagagcggtacaagatgctcatccccttcagtaacccacgcgtcttgccgggaccattctcctacacggtggtgctgtacgggcctgccggcttgggcaagactaccttagctcagaagttaatgttagactgggccgaagacaatcttattcataagtttaagtacgctttctacttatcgtgtcgcgagctgagccgcctggggccatgctccttcgccgaactcgtcttcagggactggcctgaactgcaggacgacatccctcacatccttgctcaggccagaaagatcctgtttgtcattgacgggtttgacgaactcggagctgctcccggagctctcatagaggacatatgcggggactgggagaagaagaaaccggtccctgtcctactgggatccctgttaaaccgtgtgatgctcccaaaagctgcattactggtcactacaagaccacgcgctctgcgcgacttacggatcctcgcagaggagcctatttacattagggtggagggattcctggaggaggataggcgagcttacttcctcagacacttcggcgacgaggatcaggccatgcgagccttcgagctgatgcgcagcaacgccgcactatttcagttgggaagcgcgcccgctgtttgctggatagtctgcacaacgctcaaactccagatggagaaaggcgaagaccctgtcccgacctgccttacacgaacgggtctgtttctaaggtttctgtgcagcaggttcccccagggcgctcaactccgcggagctctccgcactctgagccttttggcagcacaaggcctatgggcgcagacaagcgtcctccaccgggaggatctggaacgactgggagttcaggaatccgatctgagattgttcttggacggagacattctcagacaggaccgtgtgtcaaagggttgttacagttttattcacctgagtttccagcagttcctgacagcgttgttctataccctggagaaagaggaagaggaggaccgggatggacacacatgggacatcggcgacgtgcaaaaactgctgagcggcgttgaaaggctgcgcaatccggatctaattcaggccggctactactcgttcgggcttgccaacgaaaagcgggctaaagagctggaggcaacctttggctgccgtatgtccccagatattaagcaagagcttctgcggtgcgatatctcttgtaagggggggcacagtactgttacagaccttcaggagttgttgggatgtctgtacgagtcccaggaagaggaactggtcaaggaagtcatggcacagtttaaggaaatttcattgcacctgaatgctgtggacgtggtgccctcatctttttgtgtcaagcactgcaggaacttacagaaaatgagccttcaagtgatcaaggagaatctgcccgagaacgtcacagcttccgaaagcgacgctgaagtcgagcgaagtcaggatgaccagcacatgttacccttctggaccgatttatgcagcatcttcggcagcaataaggatctgatgggcctggccataaatgatagcttccttagcgcctcacttgtgcgaattctttgtgaacagattgcttccgatacatgccatcttcagcgagtagttttcaaaaatatctcacccgccgatgcccaccggaacctgtgcctcgctctccggggccataagacggtcacgtatctcaccttgcagggtaacgatcaggatgacatgttccccgctctgtgcgaggtcctgcgccacccagagtgtaatctcagatatttaggcttagtgagctgcagtgccacgacccagcagtgggccgatctatcactggctctggaagttaaccagagcttgacttgcgttaacttgagcgataacgaactcctcgacgagggcgcaaagttactgtacactactctgcgccaccccaagtgcttcctccagaggctctcattggaaaattgccacctgactgaggccaattgcaaggatctggctgcagtgcttgtggtctcacgagagctgactcatctgtgtctggccaagaaccccattgggaataccggcgtaaaattcctctgcgagggtctccggtaccccgaatgtaaactgcagactctcgtcctctggaattgcgatataactagtgatgggtgctgcgatctgaccaagctgctgcaagagaaaagttccttgctgtgccttgacctcggactgaaccatattggagtgaagggtatgaagttcctctgtgaggcactccgcaagccattatgcaacctgcggtgcttgtggctgtggggctgcagcattcctccatttagctgtgaagacctgtgcagcgctctgtcctgcaaccagtccctggtcacactcgatttggggcagaacccactgggctcaagcggcgtgaaaatgcttttcgagaccctcacgtgctcgtccggtaccctaaggacccttcgcctaaagattgacgattttaatgacgagctgaacaagcttttggaagagattgaggagaaaaatccccaactgattatcgacaccgagaagcaccacccgtgggcagagcgccccagttctcatgatttcatgatttag

SEQ ID NO: 31575 - DNA, 2943 bp, Artificial Sequence
  Description of Artificial Sequence: Synthetic coding sequence
atgacaagtccccagctggaatggacattgcagaccctgctggaacagctcaatgaagacgaactgaagtcattcaagagtctactgtgggcttttcccttagaagacgttctgcagaaaaccccttggagtgaagtggaggaggccgatggaaagaaactcgcggagattctcgtaaacacttcctctgagaactggatacgcaatgcaacagtgaacatcctggaggagatgaatctgaccgaactttgcaaaatggccaaagccgagatgatggaggacggccaggttcaggaaattgataatcccgagctcggggatgcagaggaagacagcgaacttgctaagcctggggagaaggaaggatggagaaactctatggaaaagcaaagcctggtctggaagaatacattctggcagggagacattgacaactttcacgacgacgtcaccctgcgtaaccagcgcttcatcccgttcctgaacccccgcacccctcggaaactgaccccctacacggtggtgttgcacggacccgccggagtggggaagaccactctcgccaagaagtgcatgttggactggaccgattgtaacctgtcgcctaccctgcggtacgcgttctatctgagttgcaaagagctgtctagaatggggccttgttcattcgccgaactcatctccaaggattggccagagctgcaggacgacattcctagcatactggcccaggcacaacgcatcctgtttgtcgtggacggactggatgagctaaaggtgccccctggagcacttattcaagacatatgtggggattgggagaagaagaaacccgtacctgtgctcctcgggtcgctccttaagagaaagatgctgcctcgcgccgcccttctcgttaccaccaggcccagggctttgcgcgacctgcagttactcgcccagcagcctatttacgttcgggtggaaggcttcctggaggaggatcgaagggcctactttttgaggcactttggtgacgaagatcaggcaatgcgcgccttcgaactgatgagatcaaacgctgcattgtttcaactgggctccgctccagcagtgtgctggatcgtttgcaccacgctgaagctccagatggaaaagggggaggacccagtgccaacctgccttaccagaaccggcttgttcctgcgcttcctctgtagcagattccctcagggtgctcaactgaggggggccctccggactctgagtctgctcgctgcacagggcctgtgggcacagatgtcagtctttcacagggaagacctggagagattaggtgttcaggaaagcgatctgagactcttcctggatggcgacatcctacggcaggaccgcgtgtcaaaaggatgttacagcttcatccacctctcctttcagcagttcctcacagcactattctatgcccttgaaaaggaggagggcgaagaccgcgacggccacgcatgggatatcggcgacgtgcaaaagttgctctcgggcgaggaaagactgaaaaaccccgatctgatccaggtaggtcattttctgttcggccttgcaaacgaaaaaagggccaaggaactggaggccacatttggctgtcgtatgagtcctgatatcaaacaggagctcctccagtgtaaagcccacctgcacgccaacaagcctctgtcagtaacagacctgaaagaggtcctgggctgcctatacgaatcacaggaagaggaactggcaaaagttgtggtagcaccttttaaagaaatatccatccatctgacaaatacatcggaggtaatgcattgctcttttagcctaaaacactgccaggacttgcagaaactaagtctgcaggttgctaagggggtcttcctagagaactacatggattttgagctggacatcgagttcgaaaggtgcacttatctgaccatcccaaattgggccaggcaggacctgcgctctctgagattgtggactgacttctgctccctattctctagtaatagcaacctgaaatttctcgaagtcaaacagtcctttctgtcagactcatccgttagaattctgtgtgatcacgttactcgcagcacatgccatttgcagaaagtggaaatcaagaacgtcacacctgacaccgcgtaccgggacttttgtcttgcattcattggaaaaaagacgctgacccaccttactctagcgggacatattgaatgggagagaaccatgatgctgatgctgtgtgatcttctgcggaaccacaaatgcaacctccagtatctcaggcttggcggacactgtgcgactcccgagcagtgggccgaattcttctacgttctcaaggcaaaccagtccctgaaacacctgcgactcagcgcaaacgtgttgcttgacgaaggcgcaatgctcctctacaagactatgaccaggcctaagcatttcttacaaatgctgagcctagaaaactgccggctcactgaggcctcctgcaaagacctcgccgccgtcctggtagtgtccaaaaagttaacccatctctgcttagctaaaaacccaatcggagacaccggagtgaaattcctctgtgagggactgtcttatcctgattgcaagttgcagacactggtgctgcagcagtgctctataactaagctgggctgcagatatctaagtgaggctctccaggaggcttgctccctgacaaatctggatctgagcatcaaccagattgctcgggggttatggatcctttgccaggcccttgagaaccctaattgtaatctcaagcatctgcggctaaaaacctacgagactaatttagagattaagaagctgttagaggaggtcaaggaaaagaaccctaagttaacaattgactgtaacgcatctggagccacggctccgccgtgctgcgacttcttctgctag

SEQ ID NO: 31576 - DNA, 3030 bp, Artificial Sequence
  Description of Artificial Sequence: Synthetic coding sequence
atgacaagcccacagttagaatggacactgcagaccctcctggagcaattaaacgaggacgagctcaagtcattcaaatcattactgtgggccttccccttggaagacgtgctacagaagacaccatggtcagaagttgaggaggccgacggtaagaaactggctgagatattagtcaatacatcttctgagaattggatacggaacgcaaccgttaacatactcgaggaaatgaacctcaccgaactgtgtaaaatggccaaggcagaaatgatggaagacggacaagtgcaggagatcgacaatccagagctaggggatgctgaggaggattcggaactggctaaacctggcgagaaagagggctggcgcaactcaatggagaagcaaagtcttgtctggaagaacacgttttggcaaggtgacattgataactttcacgacgacgtgactcttcggaatcagcgctttatcccctttctcaatcctcgcactcctcggaagttaacgccgtatacagtcgtcctccatggtcctgcaggcgtgggaaagactaccctggccaagaagtgcatgctggactggacggattgcaatctctctcctacactgagatatgccttttacttgtcctgtaaagaactgtctaggatgggtccgtgtagctttgcggaattaatttccaaagattggcctgaactccaagacgatatcccatccatcctggctcaggcccagaggatactcttcgtggtggatgggctggatgagctcaaagtcccccctggggcactgattcaagacatctgcggcgactgggagaagaagaaacccgttccagtccttctagggtccctgctcaagcgaaagatgctgccacgtgcagccctcctggtgaccactcgcccgagggccctccgggacctgcagctgctagcccagcagcctatctatgtgagggtggagggttttctggaggaagaccgtcgtgcttacttcttgaggcactttggggacgaggatcaagccatgagggcctttgagctaatgcgctctaacgccgcgctgtttcagctgggcagtgcacctgcagtctgctggattgtttgtacaacactcaagctccagatggagaagggagaagaccctgtgcccacatgcctaacccgcacagggctgttcctgagatttctgtgctctcgcttcccgcagggggcgcagctgagaggagccctgagaaccctttccctcctagccgcccagggactgtgggctcagatgtccgtctttcaccgcgaggaccttgaacggctcggcgtgcaagagtctgatcttcgcctcttcctggacggggatattctccggcaggaccgcgtgagcaaaggatgttatagtttcatccacctgtcctttcagcagttcctgaccgcacttttttatgccctggagaaagaagagggggaagatcgtgacgggcacgcctgggatatcggagacgtgcaaaagttgctcagtggcgaggagcggcttaagaaccctgacctgattcaagtcgggcattttctgttcggcctggccaacgagaaaagagctaaagaacttgaggctactttcgggtgccgaatgagtcctgacatcaaacaggagctgctgcagtgcaaagctcatctacacgccaataaaccgctttcggtgaccgatctgaaggaggtgcttggatgcctgtacgagtcccaggaggaggagctggctaaagtggtggttgctcctttcaaggagatctcaattcatttaaccaacacatctgaggttatgcattgtagtttcagtctgaaacactgtcaggatctgcagaagttgtctctgcaagtcgctaagggagtgttcctggagaactacatggatttcgagctagacatcgagttcgaatcatcaaatagcaacctgaaatttctcgaagtgaaacagagcttcctctcagatagcagcgtacgcatactgtgtgaccacgtcacccgctccacttgccacctgcagaaagtagagatcaaaaacgtaacccctgatactgcttatcgggatttctgtctggcctttatcgggaaaaagacgctgacccacctcaccctcgcaggtcatatcgagtgggagcggactatgatgcttatgctgtgcgatttactaagaaatcataaatgcaatctgcagtatctgagactggggggccactgtgcaacccctgaacagtgggccgaatttttctacgtgctgaaggccaaccaaagtctgaagcatctgaggttatctgccaacgtgttgcttgacgagggggcaatgctcttgtataagactatgactcgccccaaacacttcttacagatgctctccttggagaattgccgactcactgaggcttcatgcaaggacctggcggctgttctcgtggtttcaaaaaaattgacacacctgtgcctcgcaaaaaaccctattggggacactggcgtgaaatttttgtgtgaaggcttatcatatcccgactgcaaactgcagactctggtgctacagcaatgttccattaccaagctgggctgccgatatctgagcgaggcactgcaggaagcttgcagtctcacgaacttagatctgtccatcaaccagatagcacggggactgtggatcctttgccaggcattggagaatcctaattgcaatctaaagcatcttaggttgtggagctgctccctgatgcctttttattgccagcacctgggaagcgctctcctatctaaccagaaactcgagacattggacctcggtcagaaccacttgtggaagagtggcatcattaaactgtttggtgttttgcggcagcggaccgggtccctcaagatcctgagactgaaaacatatgagactaatcttgagatcaagaagcttcttgaagaagtgaaggaaaaaaatcccaaactaacaattgactgcaacgcctccggggcaaccgccccaccatgttgtgacttcttttgctag

SEQ ID NO: 31577 - DNA, 3198 bp, Artificial Sequence
  Description of Artificial Sequence: Synthetic coding sequence
atgtcgaggaagcatagactggaagcacgcccggatctgcgggagtttttttctctgaatttgagatctcacacccgatccactatgaccagtcctcagctcgaatggaccctgcaaaccctcttggagcaattgaacgaggatgagctgaagagctttaaaagcctgttgtgggcatttccactcgaggatgtcttgcagaaaactccttggagcgaggtcgaggaagccgacggcaaaaaactggcggagatactggtcaacacgagctccgaaaactggattcggaacgcaactgtcaatatactcgaagaaatgaatctgacagagctttgtaagatggcaaaggcagaaatgatggaagatggtcaggtgcaagagatcgacaatcccgagctcggagatgctgaagaggatagtgaactggccaagcccggagaaaaggaaggttggaggaactcaatggagaaacagtctttagtgtggaagaatactttttggcaaggagatatcgataactttcacgacgacgttacgttaaggaaccagaggttcataccattcctgaatcctcggacgccgcggaagctgaccccttacaccgttgtgctgcatggacctgccggagtggggaagactaccctggccaagaaatgcatgctcgattggaccgattgtaatttgtcccctaccctgagatatgcattttacctgtcttgcaaggagttgtcccggatgggcccctgttcattcgctgaacttatatctaaggattggccggagctccaggacgacatcccatctatcctagctcaggcccaacggatcctgttcgtggtggacggcctggatgagctgaaagtaccacctggcgcactgatacaggatatttgtggcgattgggagaagaagaaacctgtgccagtactactggggagtctgcttaaacgtaagatgctgcccagggctgccttactggttacgaccagaccacgagcgctacgggatctgcagttactcgctcaacagccaatttacgtgagggtggagggattcctcgaggaggaccggagagcttatttcctccgccactttggagacgaggaccaagctatgcgggccttcgagttgatgcggtcaaacgccgctctcttccagttgggaagcgcccctgccgtttgttggatcgtctgcacaactttgaagctccagatggagaagggcgaggatccagtgccaacctgcttaacaaggacaggtttgttccttagatttctgtgttccaggttccctcagggggctcaactgcggggcgccctcagaacactctcgctgctggccgcgcaggggctgtgggctcagatgtcagtcttccatcgcgaagacctggagcgtttaggtgttcaagaaagcgatttgagactgttcttggatggcgatatcctcaggcaggatagggtttctaaagggtgttattcatttattcaccttagtttccagcaattcctgaccgcactgttctacgctctggaaaaagaagaaggggaagacagagacgggcacgcctgggacattggggacgttcagaagttgctgtctggcgaggaaagactcaagaatcctgacctgattcaggtagggcactttcttttcggcctagcaaacgagaagcgcgctaaagaattggaggccacctttggctgccggatgtcccccgatataaaacaggagctactccagtgcaaagctcacctgcacgcgaataaaccactgagcgtgacagaccttaaagaagtcctggggtgcctctacgagtctcaggaggaagagctggccaaggtggtggtggccccctttaaagagattagcattcatctgaccaacaccagcgaggtcatgcattgtagtttcagcctcaaacattgtcaagatcttcagaagctgagcttgcaggtggccaagggagtgttcctcgagaattatatggactttgaactcgatattgaattcgagcgctgtacttatctgacgatccctaattgggcccgccaggacctgcgatctctgcgattgtggacggacttttgttctttgttcagttctaattctaatcttaagttcttggaggtcaagcaaagctttctgtctgactcatccgtgaggattctctgtgaccacgtgaccagaagcacatgccaccttcagaaggtcgagatcaagaacgttacgcctgacaccgcatatagagatttctgcttagcttttattggcaagaagacactcacacacttgacacttgctggacatattgaatgggaacggacaatgatgttaatgttgtgtgatctgctcaggaatcacaagtgtaatcttcagtacctgcgcttgggcggtcattgcgcaacaccagagcagtgggcagagtttttttatgttcttaaagccaatcagtctctgaagcacctgcgcctgtccgctaacgtgctgctggatgagggcgcaatgctcctttacaaaacaatgactagacccaagcattttctgcaaatgctgagccttgagaattgccgactgaccgaagcatcttgcaaggatctggccgctgtcctggtggtgtcaaaaaagctcacacacctctgcctggcaaaaaatccaattggtgacacgggcgtgaagttcctgtgcgaggggctgtcctatccagactgcaaacttcagacactggtgctccagcagtgtagcatcactaagctcgggtgccgctatttaagtgaggcacttcaggaagcgtgttccctgacaaacctagacttgtccattaaccaaattgctaggggactgtggatactgtgtcaagccctggagaacccaaattgtaacttaaaacatctgcgcctgtggagctgttcactcatgccgttctactgccagcatctcggaagcgcattgctgagtaaccaaaagctggaaactctcgatctgggccaaaaccatctatggaagtccggcatcatcaaattattcggagtgctaagacaacgcaccggatctctgaagattctaagattgaagacatacgagacaaatctggagatcaagaaactgctggaggaggttaaagaaaaaaacccaaagctgactatcgattgtaatgccagcggagctactgcccctccctgttgcgatttcttctgctag

SEQ ID NO: 31578 - DNA, 3030 bp, Artificial Sequence
  Description of Artificial Sequence: Synthetic coding sequence
atgacctcgccccagctggagtggaccttacaaaccctgctagagcagctcaatgaagacgagcttaagtcttttaaatcattgctctgggccttccccctcgaagatgtcttacaaaagactccttggagcgaagtcgaagaggccgatggtaagaagcttgctgagatattggtgaacacctcatcagaaaactggattagaaacgctactgtgaatatactggaggaaatgaacttaacagaactctgcaagatggctaaagcagagatgatggaggacggccaggtgcaggagatagataaccccgaacttggtgacgcagaggaggacagcgagttggccaagcctggcgaaaaggaaggctggaggaacagcatggaaaaacaatccctggtgtggaaaaataccttctggcaaggcgatattgacaatttccacgacgacgtgacactccggaaccaacggtttataccttttctcaatccacgcaccccgcgaaagctgacgccctatacagtcgtgcttcacggccccgcaggcgtgggaaaaacaacccttgcgaagaaatgcatgctggattggaccgactgcaaccttagcccgaccctcagatacgcattttacctctcatgtaaagagttgtcacggatggggccttgctcttttgccgagctgattagtaaagattggccagagttacaggacgacatcccctccattctggcccaagcccaacgcatcctttttgtagtggacggattggacgaactgaaggtgccgcccggtgctctgatacaggacatttgcggagactgggagaagaaaaagcccgtgccagtcctgcttgggagcctgctcaaaagaaaaatgcttccgcgggctgcacttctggtcacgaccaggccgagggccctgcgcgacctccagttactggctcaacagcccatttatgtgcgagttgaaggattcctggaagaggatcgacgagcttattttcttcgtcatttcggtgatgaggaccaggccatgagagcctttgaattgatgcgcagtaatgcagcactttttcagctgggctctgcgcccgcggtttgttggatcgtgtgcacaacattaaaactgcagatggagaaaggtgaagaccctgtgcctacctgtctgacacggaccggcctgttccttcggttcctctgcagcagatttccacagggtgcgcagctccgcggcgcgctacggaccctttccctcctcgcggctcagggactgtgggcccagatgtctgtgttccaccgtgaagatctggagcgtttaggtgttcaagaaagtgatttaaggctcttcctggacggcgatattctgagacaggatagggtcagcaagggctgttacagttttatccacctaagcttccagcagttcctgacggccctgttctacgcgctggagaaagaagagggcgaggatagagacggacacgcatgggatatcggggatgtgcagaagctcctgtccggcgaggaacggcttaagaatcctgacctcattcaagttggccattttctattcggccttgctaacgagaagagggccaaagaattggaagcaacctttggctgcagaatgagcccagatatcaaacaggaactcctgcaatgcaaagcccatttgcatgcaaataagccattatctgtgacagacctgaaagaggtgcttggctgcttgtatgaaagtcaagaagaagaactggcaaaggtggtcgtggccccatttaaggaaatctcaattcatttgacgaacaccagcgaggtcatgcattgttcattcagtctgaaacactgtcaagatctgcagaagctaagtctccaggtcgctaaaggagtgtttctggaaaactacatggacttcgaactggatattgaattcgagtcgtctaattcaaatctgaaattcttagaggtaaagcagagctttctgtcagactcaagcgtgcgcatcctgtgcgaccacgttacacggtctacctgccacctccaaaaagtggaaattaagaacgtcacgccagataccgcatatcgggacttttgcttggcgtttatcggaaaaaagacattgacccatctgacactggctgggcacatagagtgggaaaggacgatgatgctgatgctgtgcgatttgctgaggaaccacaagtgcaacctgcagtatctgaggctagggggacactgcgccactccagaacagtgggccgagtttttctacgtgttaaaggccaatcaatctcttaagcacctacgccttagcgccaatgtacttttagacgagggggcaatgctgctgtacaaaactatgaccagacccaaacactttctgcagatgctgagtttggagaactgccgactgacagaggcctcttgcaaggacctggctgcggtcctggttgtatcaaagaagctgacgcatctctgccttgcaaagaatccaatcggggataccggagtgaagttcctctgcgaaggactttcttaccctgattgcaaactgcagaccctcgtgcttcaacagtgtagcataactaagcttggttgtcgatacctttcagaggctctgcaagaggcgtgcagtctgacgaacctcgacctcagtatcaatcagatcgcccgggggctctggatcctctgccaggcactggagaatccgaactgtaatctgaagcaccttcgtctgtggagttgttctctgatgccgttctactgccagcacttaggatctgcgttactgtcaaatcagaagctcgagaccctggacctcggacagaaccacttgtggaaatccggcattattaaactcttcggggtgctgcgacagagaacaggcagcctgaagatcctgcgattaaagacatacgagacaaatctggagatcaagaagctgctggaggaggtcaaggagaaaaatccaaaactgacgattgattgcaacgcctcaggggctacagcccctccctgctgtgattttttctgttag

SEQ ID NO: 31579 - DNA, 3198 bp, Artificial Sequence
  Description of Artificial Sequence: Synthetic coding sequence
atgtccaggaagcacagattagaggcaaggcctgacttgagggagttcttcagccttaacttgcgatcacacacccggagcaccatgaccagccctcagctggagtggacgctccagacattactggaacagctgaatgaggacgaactgaaatcctttaagtcactgctgtgggccttcccactcgaggacgtgctacagaagaccccttggagcgaagtagaagaggctgatgggaaaaagctggctgagattcttgtcaatacaagctctgagaattggatcagaaatgctaccgtgaacattctcgaggaaatgaacctgaccgagctttgtaagatggccaaggctgagatgatggaggacgggcaggtacaggagatcgacaaccccgaactcggggacgcagaggaagactcagaattggccaagcctggcgagaaggaaggctggcggaactctatggagaagcaatcactcgtgtggaagaacacattttggcagggcgatatcgataactttcacgacgacgtgactctgcggaatcagcgttttatcccatttctgaatccccgcacccccagaaaattgaccccttacaccgtagtcctccacggccctgccggggtgggtaagacaaccctggccaaaaagtgcatgcttgattggaccgattgtaacctttcacctactttaagatacgctttctacctcagttgcaaagaactgtctcggatgggtccatgttcttttgctgaactaattagtaaggattggcccgagttgcaggatgacattccctcaatcctggcgcaggcgcagcgcatcctcttcgtggtcgacggactagatgaacttaaagtccctccaggagccctcatacaggacatctgcggtgactgggaaaaaaaaaagcctgtgccagttttactggggtccctcctgaaaaggaaaatgctcccacgcgcagctttgctggttacgacgagaccccgtgctctcagggacctccagctcctggcccagcagccaatctacgtacgcgtcgaagggttcttggaagaggaccgtagagcttactttctgcggcactttggtgatgaagatcaggcaatgcgggccttcgagctcatgaggtcgaacgcagcactcttccagcttgggagcgcccctgccgtgtgctggattgtctgcacgacactgaaactacagatggagaaaggtgaggacccggtccccacctgtctaacacggactggactgtttctgcggttcctctgttcccggttcccccagggggcccagcttcgaggtgctctccgaacgctaagcctactggctgcgcagggcctttgggcacagatgagtgtcttccatcgtgaggacctcgaaaggctgggcgtacaggaatccgatctccgtctcttcctcgatggcgatatcttacgccaggatagagtgtccaagggctgttattccttcattcacctgagctttcaacagttcctcactgccttgttttatgcccttgagaaggaggagggagaggacagggacggccacgcatgggatatcggagacgtgcaaaagttgttatctggcgaagagcgtttgaagaaccctgacctaattcaggttggacattttctctttgggctggctaatgagaagcgggcaaaagagttggaggctaccttcggttgcagaatgtcgcctgacataaagcaggaacttttgcagtgcaaggctcacttgcacgccaataaacctctcagtgtgactgatctcaaagaggtgctcggctgtctatatgagtcacaggaggaggagttggcaaaggtggtggtggcccctttcaaggagatctccatacatctaaccaacaccagtgaggtcatgcactgcagcttcagccttaaacactgccaggacctgcaaaagctgtctctacaggtggctaaaggggtttttcttgagaattatatggacttcgagctcgacatcgaatttgagcgatgtacttacctcacgattcccaactgggctaggcaagacctgcggagcctcagactttggacagatttctgctcacttttttctagcaatagtaacttaaaattcctggaggtaaaacaaagctttctgtcagatagttccgtcaggatcctgtgcgatcatgtcacaagatccacctgtcatcttcagaaggtcgaaatcaaaaacgtgactccagacaccgcctacagagatttttgccttgcttttatcggcaagaaaaccctcacccacctcaccttagccgggcatattgaatgggagagaaccatgatgctgatgttgtgtgatctgctcaggaaccacaagtgtaacttgcagtacctgagactcggcgggcactgcgcaacccccgaacagtgggcagaattcttttacgtgctgaaggccaatcaaagtctaaaacacctgcgattgtctgccaacgtactgctggatgagggggcgatgttgctgtacaagacaatgactcgacccaaacacttcctgcagatgctgtctctcgagaattgcaggctgaccgaggcatcctgtaaagatctcgcagcggtactggtggtgtccaaaaagctgactcacctgtgcctcgccaagaaccccataggtgatacaggggtgaagtttctctgtgagggcctgagctacccagactgcaagctacagacactcgttctgcagcagtgctctatcactaaactcggttgtcgctatctgagcgaggccctgcaagaagcttgctcacttaccaacctggatcttagcattaatcaaatcgccagagggctatggatcctgtgccaggccttggaaaatccaaactgcaatctcaaacacctgaggttgtggtcctgcagtctgatgccattctactgccagcacctgggttcagcgctcctctccaatcagaagctcgagacactggacctgggacagaatcacctgtggaagagtggcattattaagctctttggggtcctgaggcagcggacaggaagcctcaaaatcctccgactgaaaacttacgagaccaaccttgaaattaaaaaactactggaggaagtcaaggaaaagaatcccaagctaactattgattgcaatgctagtggagccaccgcacccccttgctgcgattttttttgctag

SEQ ID NO: 31580 - DNA, 3030 bp, Artificial Sequence
  Description of Artificial Sequence: Synthetic coding sequence
atgacctcacctcagctggagtggacactccaaacacttctggagcagctgaatgaggacgaactgaagtccttcaaatccttgctgtgggcatttccactggaggacgtgctgcagaagaccccctggtcagaggtggaggaggccgacggcaagaagttggctgaaattcttgtgaacacgtcttctgagaactggattagaaatgcaactgtgaacattttggaggagatgaaccttactgagctgtgcaaaatggctaaggcagaaatgatggaggacgggcaggtgcaggagatcgacaaccccgaacttggcgatgctgaggaggattcagaattggccaagcctggagagaaagaaggctggcgaaattctatggaaaaacagtcccttgtgtggaaaaatacgttttggcagggagatattgacaacttccacgatgacgtgacactcagaaaccagaggttcatcccattcctaaatcccagaactccacgaaaactgactccttacaccgttgtcctacacggcccggccggggtgggcaaaacaactctggccaagaagtgcatgcttgactggacggactgcaatctgtcacctaccctgagatacgctttctatctgtcttgcaaggaattgtcgagaatggggccatgctccttcgctgagctgattagcaaggactggcccgagctgcaggacgatatcccttcaatcttggcccaagcacagagaattttattcgtggtggatggcttggacgaactaaaagtcccccccggcgccttgatccaggatatctgcggggattgggaaaagaaaaagcccgtcccagtcctcctcggcagcctacttaagcgtaagatgctgccaagggcagcactgttggtaacaaccaggccacgtgctctgagggacctgcaactcctcgcacagcagccaatctatgtccgggtggagggatttctggaggaagaccgacgtgcgtattttctgaggcactttggagacgaagatcaggccatgcgcgccttcgaactgatgaggtccaacgccgccctgttccagttgggatcagccccagcagtttgttggatcgtgtgcaccacgctcaagctccagatggagaaaggcgaagaccccgtgccaacttgtcttaccagaaccgggttatttctccggtttctgtgtagtcgtttcccccaaggcgctcagttacgcggcgctctgcgaactttgtcgctcttggccgcgcaggggctgtgggcgcagatgtccgtgttccatcgcgaggatttagagcgtcttggtgttcaggagagcgatctgcgactgttcctggatggcgacattctacgtcaagaccgtgtcagcaaagggtgttatagctttatccatctctcgtttcagcagttcctcaccgctcttttctatgcactcgaaaaagaggagggtgaggaccgcgatggccacgcctgggacatcggggacgttcagaagctgctgagcggtgaagagcgtttgaagaatcctgacttgattcaagtcggccacttccttttcggcctagccaatgagaagcgcgctaaggaactggaggctacatttggctgccgcatgagccccgatattaaacaggaactgctccagtgtaaggcccatttacacgccaacaaacctctcagcgtgaccgacctgaaggaagttttaggctgtctgtacgagtcacaggaggaagagcttgctaaagtcgtcgttgcaccattcaaggagattagtattcacttaactaacacttcagaggtgatgcattgctccttttccctcaagcattgccaagatctacagaaactcagccttcaagtggctaagggggtcttcctggagaactacatggactttgaactcgacattgagtttgaaagtagcaatagtaacttaaagttccttgaagtgaagcaatcattcctctccgatagtagcgtgcgcatcctctgcgaccacgtgactcgatctacttgtcacctgcagaaggtagaaatcaaaaacgtgaccccagatacagcctatcgagacttctgcctcgccttcattggcaagaagacattaacacaccttacactcgctggccatattgaatgggagcggactatgatgcttatgttgtgcgacttgctgaggaatcacaagtgcaacctgcaatacctgcgtctaggcggccattgcgctacccctgaacagtgggccgaattcttctacgtgctgaaggctaatcagtctctgaaacacctacgtctttctgccaacgtgctgctcgacgagggggccatgttgctctataagacaatgacacggcctaaacatttcttgcagatgctctctttggagaactgccgactcaccgaggctagttgtaaggatcttgctgcagtactcgtcgtgagtaagaaactcacacatctttgtctagcaaaaaatcctattggggatacaggagtgaaatttctctgcgaggggctctcgtatcccgactgtaaacttcagaccctggttctgcaacaatgctctatcaccaagctcggttgcaggtacctgagtgaggccttacaggaggcttgtagtctcacaaacttggacctctccatcaaccaaatcgcccggggcttgtggattctttgccaagccctcgagaatcccaactgtaacctgaagcacctcagactctggagctgttccctgatgccattttactgccagcatctcggttcggctttgttgtccaaccagaagcttgagactctagatctggggcagaaccacttgtggaagtctgggatcatcaaactgttcggcgtcttacggcagcgaacaggttctctcaaaatcctcagactgaagacttatgagaccaacttggagatcaagaaacttctcgaggaggttaaggagaaaaatcctaagttgacaatagattgcaacgctagtggcgcaacagccccaccgtgttgtgactttttttgttag

SEQ ID NO: 31581 - DNA, 3198 bp, Artificial Sequence
  Description of Artificial Sequence: Synthetic coding sequence
atgtccaggaaacatagactcgaggcccgccccgatctgagggagttcttctctttaaacctgaggtcccatacacggagtacaatgacctccccccagctggagtggactctgcaaacattattagaacaactgaacgaggacgagctcaaaagttttaaaagtctgctgtgggcttttcccctggaggatgtgctgcagaagaccccatggtccgaggtcgaagaggcagatggcaagaaactcgccgagatattggtgaacacaagctctgaaaattggatcaggaatgccaccgtgaacatattagaggaaatgaacctgacagagctctgtaaaatggcaaaggctgaaatgatggaggacgggcaagtgcaggaaatcgacaaccctgagctgggggatgcagaggaagactccgagcttgccaaaccaggtgagaaggaggggtggcgcaatagtatggagaagcagtcactcgtctggaaaaacaccttctggcagggtgacatagacaattttcacgacgacgtcactctgcgcaaccaaaggttcatacctttcctcaatcctcgcactcctcgaaaactcacaccttatacagtagtgctccatgggcccgcaggagtggggaaaactaccctcgctaaaaagtgcatgttggattggactgactgcaacctctctccgactttacgctacgccttttatttatcttgcaaggagctgtctcgcatgggcccgtgttcattcgccgagctaatctctaaagactggccagagttgcaggatgatattccaagtattctggcacaggcccagcggatcttgtttgtggtggatgggctggacgagttgaaggtgccccccggcgccttgatccaagacatttgtggggactgggaaaagaagaagccagtgcccgtgttactagggagcttgttgaagcggaaaatgttgccccgcgcagccctgcttgtgacgacacgaccccgagcactgagggacttacagctgctggcacagcaacctatttatgtgcgcgtggagggctttctggaagaggatcgacgcgcttattttctccgtcatttcggggacgaagatcaggctatgcgggcattcgaactgatgcgttccaacgcggcactttttcaactgggtagtgccccagccgtttgttggatcgtgtgtaccacactgaagctgcagatggagaagggtgaggacccggtgcccacgtgcttgacaaggacaggtctgttcctcaggtttctatgctctagatttcctcagggagcccaactgaggggtgcgctgcggactcttagtctgctggctgcccagggcctatgggcacaaatgtctgtgttccacagagaagacctggagagattgggagttcaagaaagtgacctgaggctgtttttggacggagatatcctacgccaggatcgggtgtctaagggttgttattcattcatccaccttagctttcagcagttcctgactgctttgttctacgctctggagaaggaggagggagaggatagagacggacacgcatgggacatcggcgacgtgcagaagctgctgtcgggagaggaacgactgaaaaaccctgacctgatccaggtaggccattttctgtttgggctcgctaatgaaaaacgggctaaggaattggaagctaccttcggttgtaggatgtcaccggacattaagcaggaactgctgcagtgcaaagctcacttgcacgctaacaagccactaagcgtcaccgacttgaaagaggttctgggctgcttgtacgaatcccaggaggaggagctcgccaaagtggtggtggcccccttcaaagaaatcagcatacacctgactaacacttccgaggtgatgcactgcagcttcagcctcaagcattgtcaggacctgcagaagctctccctgcaggtggcaaagggggtattcttggagaattatatggacttcgaactagatatcgaatttgagagatgtacctacctgactattcctaattgggcccggcaggacctgaggtccttgcgtctgtggaccgatttctgcagtctgttcagttcaaacagcaatctgaaattcctcgaggtcaagcagtcgttcctgagcgattccagtgttcgaatcctgtgtgatcatgtgacaaggtccacatgtcaccttcagaaagtggaaattaaaaacgtaaccccagatacagcgtatcgtgacttctgccttgcttttatcggaaagaagaccctcacacatctgactttggctggacacattgaatgggaacgtacaatgatgttgatgttgtgcgatttgctgcgcaaccataagtgcaatttacagtatttaaggctgggaggacactgcgcaacacctgagcagtgggcagagtttttctacgtgctgaaggctaaccagtctctcaagcacctgcgcctaagcgccaacgtcctgctcgatgagggggcgatgttgctctacaagacgatgacccggccgaaacattttttacagatgttgagtctggagaattgtcggctgacggaagcaagttgcaaggacttagcggccgtgttggtagtaagcaaaaaactgacgcacctgtgtctcgccaagaaccctatcggcgacacaggggtgaagttcctgtgcgagggtttgtcttatcctgattgcaagctgcagacactcgttctgcagcagtgctcaatcaccaagttgggatgtcggtacctgtccgaggccttgcaggaggcctgctccttgaccaacctcgatctcagcattaatcagattgcacgaggactgtggatcctttgtcaggccctggaaaatccaaactgcaaccttaaacaccttcggctctggagctgctccctgatgccgttctactgccagcatttgggaagtgccctgctgtcaaatcaaaagttggagaccctggatttggggcagaatcatctctggaagtctgggattatcaagcttttcggcgtattgcgtcaacgcactggctccctgaagattctccggctgaaaacctatgaaacaaacctcgaaattaaaaagctgttggaggaagttaaggagaaaaatcccaaactgactatcgactgtaacgcctccggtgctaccgcacctccttgttgcgattttttttgctag

SEQ ID NO: 31582 - DNA, 2943 bp, Artificial Sequence
  Description of Artificial Sequence: Synthetic coding sequence
atgaccagccctcagctagagtggacgctgcagacattgctagagcagctgaacgaagatgagctcaagtcctttaaatcactcctgtgggcctttcccctggaagacgtgttacagaagacaccctggagtgaagttgaggaagcagatgggaaaaaactggctgaaatcctcgtgaacactagctccgagaattggatccgcaatgccactgtcaacattctcgaggagatgaacctgaccgagttgtgcaagatggcaaaggctgagatgatggaggacggccaggtccaggaaattgacaaccctgagctaggggacgcagaagaggacagcgagctggccaaacccggggagaaggagggctggcgtaatagtatggagaaacaaagtctcgtgtggaagaacacattctggcagggtgacattgacaacttccacgatgacgtgacactccgcaatcaacgctttatcccattcttgaacccacggacccctcgcaagctgaccccttataccgtcgtcctgcatggcccggcaggtgtgggaaagacaacattggcaaagaagtgcatgctggactggacagattgtaacttatctcccacgctgagatacgccttttacctgtcttgcaaagagctcagtaggatgggaccctgctcttttgccgaattgatttccaaggattggcccgaactgcaggatgatatccccagtatcttagcacaggcccagcgcattctgtttgtcgttgacggcctggatgagctgaaagttcctccgggcgcactcattcaggatatctgcggtgattgggagaagaagaagcctgtccccgtgctgctcggcagtctactgaaacgaaaaatgttgcctcgggcagctctgcttgttacaacacgtccaagagccctccgggacctccaactgctggcccaacagcctatctacgtgagagtcgaggggttcttagaggaagaccgccgagcatacttcctacgacatttcggagatgaggaccaggcgatgagagcattcgaattgatgagaagtaacgccgccctttttcagctggggtccgcacccgctgtgtgttggatcgtatgtacgacccttaagctgcagatggagaagggagaggacccagtgccaacatgcctgaccagaaccggactgttcttacggttcctatgctccagatttccccaaggggcgcaactgcgcggagccttgaggaccctcagtctactggccgcacagggactgtgggcacagatgtccgtgtttcaccgcgaggatctggagcgcctcggcgtccaggagtcggatctgcgcctgtttctggacggcgacatcctcaggcaagatcgggtgagcaagggatgctacagctttattcacctctcctttcagcagtttctgacagcgcttttctacgcactggagaaggaggaaggagaagacagggacgggcatgcttgggatattggggatgtccagaagttgttaagcggggaggagcgtctaaagaacccagacctaattcaagtagggcattttctgttcggactcgccaacgaaaagcgggccaaggagttagaagccacatttggctgccgcatgagccccgatattaaacaggagctgctgcaatgcaaagcacacctgcacgccaacaaacccttatcagtgacagatcttaaagaggtattgggttgcctttacgagtcacaggaggaggagctggccaaggtggtagtggccccctttaaggaaattagcatacacctgactaatactagcgaagtcatgcactgctctttttcattaaaacactgtcaggacctgcagaaactgtccctgcaggtggccaaaggagttttcctcgaaaactatatggactttgaattggacatcgaatttgagcgctgcacctatctcactattcctaactgggctcgtcaagaccttcggagtttgcgcttatggaccgatttttgtagtctgttctcatccaactccaatctcaaatttttggaggtgaagcaaagttttttgtccgactcctcggtgcggattctctgtgaccacgtgacccgatcgacttgccatttacagaaggtggaaatcaagaacgttacgccggacaccgcttatagggacttctgtctcgctttcatcgggaagaagacactgacgcacctaacgctcgccggccacatcgagtgggaacgaactatgatgcttatgctctgtgatctccttcgcaatcacaaatgtaatctgcagtatctcagactgggaggccactgtgcaacgcccgagcagtgggccgaattcttttacgtgcttaaggccaatcaatccctgaagcacctgagattgagcgcgaacgtcctgcttgatgagggcgctatgctcctgtacaagaccatgactcgaccaaagcattttttgcaaatgttgtccctggaaaattgcagactaaccgaggcaagctgtaaggacctggccgcagtgctggtcgtgagcaagaagctgacccatctgtgcctggccaaaaacccaattggggatactggagtgaaattcctgtgtgagggtttatcctatcccgattgcaaacttcagaccctggtgttacaacaatgctctatcacaaaactggggtgcagatatttgagcgaagccctacaagaagcttgcagcttgacaaatctggacctctccatcaatcagatcgcaaggggactgtggatcctttgtcaagccttagagaacccgaattgcaacttgaagcatttaagattgaaaacttatgaaaccaacctagaaattaaaaaactgctggaggaggtgaaagagaagaaccctaaactaactatcgactgcaatgcctcgggcgcgaccgctcctccatgctgtgactttttttgctag

SEQ ID NO: 31583 - DNA, 3030 bp, Artificial Sequence
  Description of Artificial Sequence: Synthetic coding sequence
atgaccagtccccagctggagtggaccttacagacgctgcttgagcagctcaacgaagatgaactgaagtcgttcaaaagcctgttatgggcgtttccgctggaggacgtgttgcagaaaaccccttggtcagaagtggaggaggccgacgggaaaaaactggccgagatactcgtaaacacgtcttccgaaaattggatcaggaatgcaacagtcaacattctggaggaaatgaatcttacggaactctgcaagatggccaaggccgaaatgatggaggacggccaggtccaggagattgataaccccgagctgggcgatgccgaggaggatagcgagctggctaagccaggtgagaaggaagggtggaggaactcaatggaaaaacagagcctcgtgtggaaaaacaccttctggcagggcgatattgataattttcacgacgacgtgactctgaggaaccagcgcttcatcccattcttgaatcctcgaactccaaggaaactgaccccctatacagtggtcttgcatgggcccgctggcgttggcaaaactactctggcaaaaaaatgcatgcttgactggaccgattgtaatctgtcaccaactctccgctatgctttttacctctcctgtaaagagctgagtagaatgggtccatgtagttttgcagagctgattagcaaagattggccagagctccaagatgatatcccatctatcttggctcaagcacaaaggatcctgtttgtcgtggatggcttggacgaacttaaagtgcctccaggggctcttatccaagatatctgtggcgactgggagaaaaagaaacccgtcccagtcttactcgggagcctgctcaaaaggaaaatgctcccacgcgcagcccttttagtgaccacacgcccacgggcactccgcgacctacagcttcttgcgcagcaaccaatctacgtgagagtcgaaggcttcctcgaagaggataggcgggcctattttctcaggcattttggtgatgaggatcaggccatgcgcgcgtttgagctcatgcgatccaatgctgccctttttcagctcggaagtgctccagcagtgtgttggattgtgtgcacaacactgaaactgcagatggaaaagggagaggatcccgtgccaacatgtttgacaaggaccggactattcctcagattcttgtgttctcgctttccacagggggcacaattgagaggcgctctgagaacattaagcctgctcgctgcccagggactttgggctcaaatgagcgtgttccatcgcgaggatctcgagcggcttggggtacaagaatccgacctgaggctctttttggatggagatatactccgccaggatagagtgagtaaaggctgttactcttttatccacctgagctttcagcaatttttgacagcccttttttacgcgctggagaaggaggagggcgaggaccgggatggtcacgcgtgggacataggcgacgtacagaaactcttgagtggggaggagcgccttaagaatccagacttgatccaggttggacatttcctattcggcctggcaaatgagaaacgtgccaaagagttagaggctacattcggatgcagaatgtcacccgacattaagcaagaactacttcagtgcaaagctcacctgcacgcgaataaacctcttagcgttaccgacctaaaggaagtattaggctgcctgtatgaaagccaggaggaagagctggctaaggtcgtggttgctccgtttaaagagatttcgatccacctcacaaatacctcagaagtgatgcattgctcattctctctgaagcattgtcaggatctccaaaagctgtcattgcaggtggctaagggagttttcctagaaaactacatggactttgaactggacattgaatttgaatcgtccaattccaacctgaaattcttagaagtcaaacagagtttcctctcagactcatctgtgcggatcctgtgcgatcatgtcacacggtctacatgtcacctgcagaaagtcgagatcaaaaatgtcactccggatacagcgtaccgtgacttttgcctggcgtttatcggaaaaaaaacacttacgcatttaaccctcgccgggcatatcgagtgggagcggaccatgatgctgatgctctgtgatttgctccggaatcacaaatgtaatttgcagtatttacgtctgggtggacattgcgctactccagaacagtgggccgagttcttttacgtccttaaagccaatcagagcctaaagcacctgagactttccgccaacgttttgctggacgagggggcgatgctgctgtacaagacaatgacgcgaccgaaacacttcttgcagatgctgagcctggaaaattgtagactgacagaagctagttgtaaagatctcgcagccgtgctggtcgtgagtaaaaaactgacgcacctctgcctggcgaagaacccaattggcgacacaggcgtgaaatttctatgcgaggggttgtcttaccccgactgcaaattgcagaccctggtcctccagcagtgctcaattactaagctcgggtgtagatatctgagtgaagcgctgcaggaagcctgcagcctgaccaatctggatctgtctattaaccagatcgcgcggggcttgtggatcctgtgccaggcactagagaatcctaattgcaatcttaagcatcttcgactgtggagttgctcactgatgccgttctattgtcagcatctaggaagtgccttgctgtccaatcaaaaactcgagacccttgacctaggccagaatcatctctggaagtcaggcatcatcaaactgttcggcgtcttacgacagcgtacgggctctttgaaaattctgcgcctcaagacctacgaaacgaacctggaaattaagaagctactggaagaggttaaggagaagaatcccaagttaaccatcgattgcaatgcaagtggcgcgaccgccccaccctgttgtgattttttttgctag

SEQ ID NO: 31584 - DNA, 2943 bp, Artificial Sequence
  Description of Artificial Sequence: Synthetic coding sequence
atgacctccccacagctggaatggacattacagactctgctggagcagttgaatgaggacgagctgaaaagtttcaagtcgttgttgtgggcatttcccctggaagatgtgctgcaaaagacaccatggagcgaagtcgaggaggccgacggcaagaagttggccgaaattctggtaaacacttcctccgagaattggattcgcaatgcaacagtgaatatcctggaagaaatgaacctgaccgagctgtgcaaaatggccaaggccgaaatgatggaagacggtcaggtacaggagatcgacaaccctgaactaggcgacgctgaagaagatagtgagctggcaaagcctggcgagaaggagggatggcggaactcaatggagaaacagagcctggtgtggaagaatactttttggcagggcgacattgacaatttccacgacgacgtaacccttagaaatcagagatttattccatttctgaatccaaggaccccccggaaactcacaccttacaccgtcgtcctccacggaccggccggcgttgggaaaactaccctggcgaaaaagtgtatgctagattggacagattgcaacttatcacctacgctgagatatgccttctatttgtcctgcaaggaactatcccgcatgggcccttgtagtttcgccgaattgatttctaaggattggcccgagctgcaggacgacataccatccatattggcccaagcccagcggatcctgtttgttgtggatgggctcgacgaacttaaggtgcctcctggggctctgatccaggacatatgcggcgactgggaaaagaagaagcctgtgccagtcctgctggggtctctcctgaagcgcaagatgctgcctagggccgcgctgctcgtcactactcgtcctagggctctgcgagatctccagcttcttgctcagcagcctatttatgtgagagtagaaggcttccttgaggaagaccggcgagcctatttcctgagacacttcggagatgaagaccaggcgatgcgcgctttcgagttgatgaggtccaacgccgctctatttcaattgggctcagcacccgctgtgtgttggattgtttgcacaaccctaaaactccagatggaaaaaggcgaagacccagtacctacttgcctgacaagaacagggttgttcctcagattcttgtgcagtcgatttccacagggggcccaattacgcggcgctttgcgcacactctctttgctagccgctcagggattgtgggcacagatgtctgtatttcatagggaagacctggagaggttaggcgttcaggagtctgacctgcggttgttcctggacggcgacatcctgcggcaagatagggtttctaaagggtgttatagctttatacacctgtcattccagcaattcctgactgcgcttttctacgcgcttgaaaaggaagagggggaggatagggatggccacgcttgggacatcggcgacgtgcagaaattgttatccggcgaagagaggcttaaaaaccccgacctcattcaggtaggtcattttctgtttggcctcgctaatgaaaaacgagctaaagaactggaggccacttttgggtgtagaatgtctccagatatcaagcaggagcttctgcagtgtaaggcacacctgcatgcaaataagcctctcagcgtaacagacttaaaggaagtcctgggatgtctttacgagagccaagaggaagagcttgccaaagtggtggtggctcccttcaaagagattagcattcacctgacaaatacatccgaggtgatgcactgcagtttctctcttaaacactgccaagatctccagaaactttctctacaggttgccaaaggcgtttttctggaaaactatatggactttgagttggacatcgagttcgaacgatgcacataccttacaatcccgaactgggcacgacaggatctacggagtctcagattatggacagatttctgctcacttttttcatccaacagtaacctgaaatttctggaagtcaaacagtcattcctgtccgactcgtcggtgaggatcctctgtgaccacgttacccgtagcacctgccacctgcagaaggtggagatcaagaatgtcacccccgacactgcgtaccgcgatttttgcctggcctttataggcaagaagactctcactcacctgaccctggcgggacacatcgagtgggagcgaacaatgatgttgatgctgtgcgacctgctcaggaatcacaagtgcaacttgcaatacctacggcttggcggccattgtgcaacacctgagcaatgggcagagttcttctacgtgttaaaggcaaatcagagcttaaagcacctccggctttcagcaaatgtactgctggacgagggagcaatgctcttgtataagaccatgactcgaccgaagcattttcttcagatgctgtcactcgaaaactgtagactgaccgaagctagctgtaaggaccttgctgccgtcctcgttgtgagtaagaagctcacgcacctctgcttggcgaaaaatccaatcggagacacgggtgttaagttcctgtgcgaaggcctgagttatccagattgcaagttacagaccctggtgcttcagcagtgctctatcaccaagctggggtgtagatacctttccgaagccctgcaggaagcatgcagcttgaccaacttggacttgtccattaatcagattgcaagaggcttgtggatcctgtgtcaagccctcgaaaaccctaactgcaatctgaagcacttaagactcaagacatacgaaacaaatctggaaattaaaaaactgctggaggaagtcaaggagaaaaaccctaaacttaccatcgattgcaatgcctccggcgccaccgctcctccatgctgcgatttcttttgttag

SEQ ID NO: 31585 - DNA, 2943 bp, Artificial Sequence
  Description of Artificial Sequence: Synthetic coding sequence
atgacgtccccacagcttgaatggacccttcagactctgctggagcagctaaatgaggacgagttgaagagttttaaatctctgctgtgggcttttccattagaagacgttctgcagaagacgccttggtccgaggtggaagaggctgatggcaagaaactcgccgaaatcctggtgaacacaagtagcgagaactggatcaggaatgcaactgttaatattctcgaggagatgaatctcactgagctctgtaagatggcgaaagccgaaatgatggaagatgggcaagtacaagagatcgacaaccccgaacttggagatgccgaagaggacagcgagctcgccaaacccggagaaaaagagggatggaggaattcaatggaaaagcagagcctggtgtggaagaacacattctggcaaggggacatcgacaactttcatgacgatgtaactctcaggaatcagagatttataccctttctgaatcccaggactccccgtaaactcacgccttataccgtggtattgcacggtcccgcaggcgtcggaaagacaaccctggctaagaagtgtatgctggattggaccgattgcaacctgtcccctacattacgctacgctttctatctctcctgcaaagagctgtcgaggatgggtccctgtagctttgccgaattgatctctaaggactggcctgaactgcaggatgacatccccagcatccttgctcaggcccaaaggatactctttgtcgtggacggcttggatgaattaaaggtcccaccgggggccttgatccaagatatatgtggcgattgggagaagaagaaacccgtcccggtactcctggggagcctgttgaagagaaaaatgcttcccagagccgcattattagtgaccactcgacctagggcacttagggacttgcagctactagcgcagcagcctatctacgttcgagtcgaaggttttttggaggaagatcggagagcttatttcctgaggcatttcggtgatgaagaccaagccatgcgagccttcgagctgatgcgctcaaacgccgccttgtttcaactgggaagcgcgccagccgtgtgctggatcgtgtgcacaaccctgaagttacaaatggaaaaaggcgaggatcctgttcctacgtgcctcaccagaaccggattgttcctccgtttcctgtgttcccgctttcctcagggcgcgcagctacggggggccttacgaacactgagcctccttgcagcccagggcctgtgggctcaaatgtccgtctttcacagggaagacctagagcgactgggcgtccaggaatctgacttacgcctgtttctcgatggggacatcctgaggcaggacagagtatcaaaggggtgctacagttttatccatctgagtttccagcagttccttaccgcgctattctacgccctcgagaaggaagagggtgaggatcgagatgggcatgcgtgggatataggggatgtgcaaaagttgctgtcaggggaagagcgccttaaaaaccccgacctgattcaggtcggccatttcctatttgggcttgctaacgaaaaacgagctaaggagttggaagccaccttcgggtgcaggatgagtccagatatcaagcaagagctacttcagtgcaaagcccaccttcacgctaataagcctctaagcgttaccgacctgaaggaggtcctcgggtgcctctacgagtctcaggaggaggaattggccaaggtagtggtagcaccatttaaggaaatctcaatacatctcaccaacacaagcgaggtgatgcactgttcattttccctgaagcactgccaggacctgcagaaacttagcctgcaagtcgccaagggggtttttctcgaaaactatatggacttcgaattggacattgaatttgagcggtgtacatacctgaccatcccaaattgggccagacaagatctacgatcgctcagattgtggaccgatttctgttcccttttttctagcaattccaacctcaagttcctagaggtaaagcaaagctttttgtcagacagctcagtccgaatactttgtgatcatgttacacgcagcacctgccacctgcagaaagtggagatcaagaacgtgactcccgatacagcatatagggacttttgcctggccttcatcggcaaaaaaaccctgactcaccttacgctggcaggacacatcgaatgggagcggactatgatgctgatgctgtgcgaccttctgcgcaaccacaagtgcaatctgcaatatttgcggctgggtggacactgtgccactcctgagcaatgggctgaattcttttatgtactcaaggccaaccagtcgttgaagcatctgcgcctgtccgcaaatgtgttgctagacgaaggcgccatgctcctttacaagaccatgacacgacctaaacacttcctgcagatgttgtccctagagaactgcagacttacagaggcatcatgcaaagaccttgccgccgttcttgtagtctcgaagaaacttacacacctctgtctggctaaaaacccgatcggtgacacaggcgtaaaattcctctgtgagggtctgagctaccccgactgtaagctgcagacactggtgctgcaacaatgtagtatcacgaaactaggatgccggtacctatcagaggcgctgcaggaggcctgttctctgacaaacttagatttatctatcaaccagatagctcgtggtctgtggatactttgccaagcgctggagaatccaaattgtaacctcaaacaccttcgccttaagacttatgaaacgaatctggaaattaagaaactcctcgaggaggtgaaagagaagaaccccaagctaaccatcgactgtaatgcttccggggctaccgccccgccctgctgtgactttttctgttag

SEQ ID NO: 31586 - DNA, 2943 bp, Artificial Sequence
  Description of Artificial Sequence: Synthetic coding sequence
atgacaagcccgcaactggagtggactttgcaaacccttctcgagcagctcaacgaagacgaactcaaatctttcaaaagtcttttgtgggccttccccttagaagacgttttgcaaaaaaccccctggtctgaagtcgaggaggcagatgggaagaagctggccgagatcctggtgaacacctctagtgagaactggatacggaacgccactgtgaatatcctggaggagatgaacctgaccgagctatgcaaaatggccaaagccgaaatgatggaggacggacaagttcaggagatcgataaccctgagctgggggatgccgaggaagacagtgagctggccaagcccggagaaaaggagggctggcgcaacagcatggagaagcagtcgcttgtgtggaagaataccttttggcagggggatatagacaactttcatgatgatgttacacttaggaatcaaaggttcatacctttcctgaatccccgtacaccgaggaaactgaccccttatactgtagttttacacggaccagccggagtagggaagacgacactagcaaagaaatgcatgctggactggacggattgcaacctgagtccaacactccgctatgcattctacctctcttgtaaagagctctcacggatggggccttgttccttcgccgagcttatctcaaaggactggccggagcttcaagacgacataccgtctatcttagctcaggcgcagcgcatcttgtttgtggtcgacggcctagatgaactgaaagtcccacccggagccctcatccaagacatatgtggcgattgggaaaaaaaaaaacctgtgcctgtgctgcttggctcgctgcttaagcgaaagatgttgcctcgggcggccttgctcgtgactacgcgaccgcgagctctccgtgatttacagctgctagcccagcagcccatctacgtgcgggttgaggggtttcttgaggaggatcggcgtgcatattttctcagacactttggagatgaggaccaggcaatgagggcatttgagctcatgagaagcaatgccgcactcttccagcttggctctgcccccgccgtatgttggatagtgtgcaccaccctcaagctgcagatggagaaaggcgaagacccagtaccaacttgcctaacacgcacagggctgttcctccgatttctctgtagccggtttccacaaggagctcagttgaggggagcgctcagaaccttgagtcttcttgcagcgcaagggctttgggctcagatgagtgtattccacagggaggatctggaaaggctgggcgtgcaggagtcagacctgagattatttctcgatggcgacatcttacggcaggatcgcgtgagtaaggggtgttacagctttatccacctttcttttcagcagttcctcaccgcactcttttatgccctggaaaaagaggagggtgaggaccgagacggtcatgcgtgggatattggcgatgtccagaaattgttgtctggcgaggagcgactgaaaaatcccgaccttattcaggtgggacactttctgtttggccttgccaatgagaagcgcgcaaaggagcttgaggctacctttgggtgtaggatgagtccagacataaaacaggagcttttgcagtgtaaggcacacctgcacgctaataaaccgctctccgttacagacctgaaggaggtcctgggctgcctatacgaatctcaggaggaagagctggcaaaagtggtagtcgcaccgttcaaggagatctcaattcacctgacgaatacctctgaagttatgcattgcagcttctccctgaaacactgtcaagatctccaaaaactatctcttcaggtagctaaaggcgttttcttagaaaactacatggactttgaactagacattgagttcgagagatgcacctatttaaccatccccaactgggcccgccaggacctacggtctctgcgcctgtggacggatttctgtagcctgttttcctcgaactccaacctgaaatttctggaggttaaacagagtttcctgtccgattcttcagtccggattttgtgtgaccacgtgaccagaagcacgtgccacctgcaaaaggtggaaatcaagaatgtcacaccagatactgcgtatcgggacttttgtctggccttcattgggaagaagaccctgacacatctgactctcgccggacacatcgaatgggagcggaccatgatgctcatgctgtgtgatctcttgaggaaccataagtgtaacctgcagtatctgagactgggaggacattgcgcaacacctgagcaatgggctgagttcttctatgttctcaaagcgaatcaaagcctgaaacatctgcgcctctctgcaaatgtgcttctcgatgaaggggccatgctgctctacaagacaatgacaaggcctaagcacttcctgcagatgttgtctctggaaaactgtagactgacagaggcctcttgtaaagatctggctgcagtattagtcgtgtctaaaaagctgactcacctctgcctcgcaaagaatccgatcggagacacaggggtgaagtttctgtgtgagggactcagctatcccgactgcaaattgcaaaccctggttctgcagcagtgttcgattacgaaactagggtgtaggtatctgagcgaagcccttcaagaagcgtgctccttgaccaatctggacctttccataaaccagatcgctcgggggttgtggatcctgtgtcaggccctagagaacccaaattgcaacctgaaacatcttcgactgaagacctatgaaacaaacctggagattaaaaaactcctagaagaagtcaaagagaagaaccccaagctaactattgattgcaacgccagcggcgcaaccgctccaccttgttgcgacttcttctgttag

SEQ ID NO: 31587 - DNA, 3198 bp, Artificial Sequence
  Description of Artificial Sequence: Synthetic coding sequence
atgagcaggaaacatagactggaggcgcgtccagatcttcgcgagtttttttcactcaatttgcggtcccacaccagatccacaatgacatccccccaacttgagtggaccctccagacactgttagagcagctaaatgaggatgagctaaaatcgttcaaatccctgttatgggcctttccactcgaagacgttttacagaaaacaccctggagcgaggtggaagaagccgatgggaaaaaactggcagaaatcctcgtcaacacctctagtgagaattggattaggaacgccactgtgaacattctggaggaaatgaacctgacagagctttgtaaaatggccaaagccgagatgatggaggacggacaagttcaggagattgataatcccgaactgggtgacgccgaggaggattcagaactggcaaagcccggggagaaagagggttggcgaaactcaatggaaaaacaaagcctagtatggaaaaatacgttctggcagggggacatcgataactttcacgatgatgtgaccctgaggaatcaacgatttattccgttcttgaatccccgcacgcctaggaaactgactccttacacagtggttcttcatggacccgccggagtgggaaaaaccactctagcgaagaaatgtatgcttgattggaccgactgtaacctcagtcccacacttcggtatgctttctacttatcctgtaaggaactgtcccggatgggaccctgctcttttgccgaactgatctctaaggactggccagaattacaggatgatattccatccattctcgcacaagcccaaagaatcctatttgttgtggacgggctagacgaactgaaagtgcccccaggtgctctcattcaagatatttgcggtgactgggagaagaagaaaccagtgccagttctcctagggagcttattgaagcgcaagatgttgcctcgggccgccctgctcgtgaccacacggccccgggccctgcgtgatctccagctgctcgcccagcaacctatttacgtgcgagtcgagggatttcttgaagaagatcgccgggcatacttcctcagacactttggggacgaggaccaggcaatgagagcctttgaattgatgcgatcaaatgccgccctgttccagttgggcagcgcccccgctgtttgttggatagtgtgtaccaccctgaagcttcaaatggagaaaggcgaggatccagtgcctacctgcctcacgagaacaggactgttcctgagatttctctgttctcgttttccccagggcgcccagctgcgcggcgccctgcgtacactgtcactcctggcggcccagggactgtgggcccaaatgtcagtgttccatagggaggacctggagcgcctgggagtccaggagagcgatcttcgcctgtttctggacggcgatattctgcgtcaggacagagtgagtaagggctgttattctttcatccatctctccttccagcagtttttgacagctttattttacgcgctcgaaaaagaagagggggaggaccgcgatggacatgcgtgggacattggagatgtacagaaactgctgtccggggaggagaggcttaagaaccccgacctaatccaggtgggtcactttcttttcggcttggcaaatgagaagcgcgcaaaggaacttgaagctacattcggatgtcgtatgagtcccgatatcaagcaggaactactccagtgcaaggcccacctgcatgcaaacaagcccctttctgtcacagacctaaaagaggtcctcgggtgcttgtacgagtcccaggaggaggaactggcgaaagtggtcgtcgccccctttaaggagatatctattcacctcaccaacacaagcgaagtcatgcactgtagcttctctttgaagcactgccaggacctccagaaactctccttgcaggtcgctaaaggtgtgttcttggagaactacatggattttgagctggacatcgagtttgagcggtgcacttacttgaccatccccaattgggcgagacaggatctgaggtctctccgactttggacagatttttgcagcctgttttctagtaatagcaatctaaaattcctggaggtgaaacaatcttttctgtcagactccagcgttagaatcctgtgcgaccatgtgacccggtccacctgtcacctgcagaaagtggagattaaaaatgttactccagatactgcatatagagacttctgccttgcctttattggaaagaagaccctgactcaccttacattggctggacacatcgagtgggagcgaaccatgatgctgatgctttgcgacctactcagaaatcacaagtgtaatcttcagtacctcaggctcggcggtcattgtgcaaccccagaacagtgggcggaatttttttatgtgctcaaagccaaccagagtctgaagcatctgagacttagtgccaacgtgttgctggatgaaggcgcaatgctgctctacaaaacaatgactcgacccaagcactttctgcaaatgttgtctttggagaactgtcggctcacagaagcgtcctgcaaagatctggcggccgtcctagtcgtgagcaagaaactgactcacctgtgtctggctaagaacccaatcggagacactggagtcaagttcctgtgtgaaggacttagctaccccgactgtaagttacagacccttgttctgcagcagtgttctattaccaaacttggctgcagatacttgagcgaggcactgcaggaagcctgttccctaacaaatcttgacttgtctataaaccagatcgcccgcgggttgtggattttgtgccaggcacttgaaaacccgaactgcaaccttaagcacctccgtctgtggtcctgtagcctgatgcccttttattgccaacatcttgggagcgcccttctctcgaatcagaagctagaaacccttgacttggggcaaaatcacttgtggaaatctgggatcatcaagctcttcggggtcctgcgccagaggacaggcagtcttaaaatcctacggttgaaaacctacgaaaccaacctggagatcaagaagctgttagaggaggtcaaagagaaaaaccctaagctgacaatcgactgcaacgcctcaggcgcaacggcacctccttgctgcgatttcttctgttag

SEQ ID NO: 31588 - DNA, 3198 bp, Artificial Sequence
  Description of Artificial Sequence: Synthetic coding sequence
atgagcaggaagcacaggctggaggcccgccctgatctccgtgagttcttttcgcttaatttgcgtagtcacacccggtccacaatgacaagcccccagttagaatggacattgcaaactctcctagagcagcttaacgaggatgagttgaaaagcttcaagagcttactctgggcatttcctctcgaggatgtgcttcagaagaccccctggtctgaggtagaggaagctgacgggaagaaattagccgagatactggtcaatacttcttcagagaattggattaggaacgctacagtgaacatactggaggagatgaatcttacagaactctgtaagatggccaaggcagagatgatggaagacgggcaggtgcaagaaattgacaacccagagctcggcgacgccgaagaagattcagagctggccaagcccggagagaaggaggggtggaggaatagcatggagaaacagagcttggtgtggaagaacaccttctggcagggcgatattgataattttcacgatgatgtcacactacgtaaccagaggttcattccattcttgaacccaaggacccccaggaaactgactccgtatactgtggtgcttcacggtccagctggggtggggaagacaacgctagctaagaagtgtatgctcgactggacagattgcaatttgtcaccgactttgcgttatgccttttatctgagctgtaaagagttgtccagaatgggcccctgttcctttgctgaactgatcagcaaggactggcccgagttgcaggacgatatcccctccatacttgcccaggcccaaagaattctgttcgttgtagacggactagacgagctgaaggtgcccccaggagcactcatccaggacatttgcggcgattgggagaaaaaaaagccagttccagtattgctcggctccttgctgaaaagaaagatgttgcccagggccgccctcctggtgaccaccaggccaagggcactgagagatctgcagttactcgcacagcagcctatctacgtgagggtcgaaggctttttggaggaggataggagagcgtacttcttgagacatttcggcgacgaggaccaggccatgcgggctttcgagctgatgcgcagcaacgcagccctcttccaacttgggtccgctcctgcagtgtgttggatcgtgtgcacaacgctcaaactccagatggaaaagggggaagatccagtcccaacttgcctgactcgcacgggactcttcctgaggtttctgtgcagcagatttccacaaggggcccagctgcgcggagccctcagaactttgagtctcctggccgctcaggggctctgggcccagatgtccgtgttccatagggaggaccttgaaaggctaggagttcaagagagtgatctgcgactgtttctggatggggacatcctcagacaggaccgtgtcagtaaggggtgctattcgtttatccatctgtccttccagcagttcttaaccgccctcttctatgctttagagaaagaggaaggggaggatcgagatggtcacgcatgggatatcggagacgtccaaaaattgctgtcaggggaagaacgacttaagaatcccgacctgatccaggtggggcacttcctgttcggcttggccaatgagaagcgggccaaagagcttgaggcaactttcgggtgcaggatgtcacctgatattaagcaagagctgctacagtgtaaggcccacctgcatgccaataaaccgctgtctgttacagacctcaaagaagtattaggatgtctgtacgaatcccaagaggaagagctcgcaaaggtggtcgtcgcgccctttaaggaaatcagtatccaccttactaacacttcagaagtaatgcattgctccttcagcctgaagcattgccaagacctccagaagctctccctccaggtggccaagggggtgttcctcgagaactatatggacttcgaattagacatagagtttgaaagatgcacctatctgaccatccctaattgggcacggcaggacctacgatctttgaggctgtggacagatttttgtagcctgttctcatctaactcaaatctgaagttcctggaggtgaaacagtcgtttctgtccgactcttcagtaagaatactctgcgaccatgttacacgttccacctgccacctgcagaaggtggagatcaagaacgttacccctgacacagcctacagagatttttgcctggcttttatcggaaagaagacactgactcacctcacacttgctggccatattgagtgggaaagaactatgatgctcatgctgtgcgatcttctgagaaaccataagtgcaatctgcagtaccttaggctagggggccattgcgccacccctgagcagtgggccgaattcttctacgtgctgaaggctaaccagagccttaagcatttgcggttatccgccaatgtactgctggacgagggagccatgctcctgtataagacaatgacaaggccaaagcacttcctgcaaatgctctcccttgagaattgccgactgacagaggcgtcatgcaaggatttggccgcagtgctggtcgtttccaagaagctgacacatctgtgtctcgctaagaatcccatcggcgataccggcgttaaatttttatgcgagggactgtcctatcctgattgcaaactacagacactggtgcttcagcagtgttccatcactaaactggggtgcaggtacctgagtgaagctttacaggaggcttgtagtttgactaacctggatcttagtataaaccagatcgcccgagggctttggatcctctgtcaggccctagaaaacccgaattgcaacttaaaacatctacggctttggagctgttcacttatgcccttctattgccaacacctggggtcagcgctgttaagcaatcagaagttagaaactctggatctgggacagaaccacctgtggaaaagtggtattattaagttatttggagtgctgcgccagaggacagggtccctaaagatactgagactgaagacatacgaaactaatctggagattaagaaacttctcgaggaggttaaagaaaaaaatccaaaactgacaatcgactgcaatgcctcaggcgccacggcaccaccatgttgtgatttcttttgttag

SEQ ID NO: 31589 - DNA, 2943 bp, Artificial Sequence
  Description of Artificial Sequence: Synthetic coding sequence
atgacatcacctcaactggagtggacgctgcagacacttcttgaacaattaaacgaagacgagctcaaatcctttaaatccctgctgtgggctttcccattagaggatgtgctgcagaagacaccgtggagtgaagtggaagaagccgatggaaagaagctggccgagatcttagtgaacacctcctctgaaaattggatccgcaacgccacggtgaatatccttgaggaaatgaacttaacggagctctgtaagatggcaaaggcagaaatgatggaggatgggcaggtccaggagatcgataatcccgaactcggagacgcagaagaggattccgaactcgccaaacctggagagaaggaaggctggcgtaatagtatggaaaaacagagcctggtgtggaaaaacaccttctggcaaggcgacatcgacaactttcatgatgacgtcactttacggaatcagaggttcattccattcctgaacccaaggacaccccggaaactgaccccctacacggtagtgcttcacggacccgccggagtcgggaagaccaccttggccaagaagtgcatgctggattggaccgactgcaacctttcaccaactttgcgatacgctttttacctgtcatgtaaggaattgagcaggatgggaccctgtagcttcgccgagctgatttccaaggattggccagagctgcaagatgacatccctagcatcctcgcccaggcacagcggatcctgttcgtggtggatggtctggatgaactcaaggtcccaccgggggccttgatacaggatatatgcggggattgggagaagaaaaaacctgttcctgtactgctggggtctcttctgaagagaaagatgctacctcgcgccgccctgttggtgaccacacggcctagagcgctacgagacctgcagctcctggcgcaacagccgatttatgtgcgcgttgaagggttcctggaggaagatcgccgagcttattttctgcgtcactttggggatgaagatcaggccatgcgggcattcgagttgatgcgcagcaatgcagctttattccagctgggatcggccccggccgtatgctggatagtgtgtaccactctgaaattacagatggaaaagggagaagatcccgtgccaacatgtctgaccaggacaggcttgtttctccggtttctgtgctccagatttccccaaggagcccagcttcggggcgccctgagaactttaagccttcttgccgcccaggggctgtgggcacaaatgtccgtctttcaccgggaagatcttgaacggctgggcgtgcaagaaagtgatctccgcctgtttctcgatggtgacattttaagacaggaccgcgtgagtaagggctgctacagctttattcacctctcttttcagcagtttttgactgcactattttatgctttggagaaggaggagggtgaggaccgcgacggtcatgcttgggacatcggagatgtccagaagcttcttagtggcgaggagcgattgaaaaacccagaccttatacaggtcgggcattttctgttcggactcgccaatgaaaagagggcaaaagagttagaggccacatttggttgccggatgagcccagatattaagcaagaactgctgcaatgcaaggctcacctgcatgccaacaagccacttagcgttactgatctgaaggaagtgcttggctgtctgtatgagtctcaagaagaagagctggcgaaagtagtggtagctccgttcaaggaaatttccattcaccttaccaataccagcgaagttatgcattgcagcttcagcctaaaacattgtcaggaccttcagaaattgagcctccaggttgcgaagggagtgtttctcgagaactacatggactttgaactcgatatcgaatttgagcgctgtacctacttgactatccccaattgggcacggcaggacctccgctcgttacgcctatggacagacttttgcagtttgttctcaagtaactctaacttgaagtttttggaggtcaaacagtcatttctttccgactcatcagtgcgaatcctctgtgatcacgtgacccgatcaacgtgtcacctgcaaaaggtggaaattaagaatgtgacccccgatacggcataccgcgatttttgcttagccttcattgggaagaagactctgacccacttgaccctagcaggccatattgagtgggaacgaacgatgatgctaatgctgtgcgatctgttacgcaaccacaaatgtaacttacagtaccttcggctaggggggcattgcgccacgcccgagcagtgggccgaatttttctacgtgctgaaggccaaccagagtctaaaacatcttaggctatcggccaatgtccttcttgatgaaggggccatgctactctataagacgatgacacggcctaaacatttcttgcagatgctgagccttgaaaactgtaggctcaccgaggcatcttgcaaggatctggccgccgtgctggtcgtgtccaagaagttaacccatttatgcctcgcgaaaaatcccatcggggacacaggagtcaagttcctatgcgagggcctgtcatacccagactgcaagctgcagactctcgtgctgcagcagtgttctattactaagctgggctgccgctacctatcggaagcactacaggaggcttgttctcttacaaatttggacctgtccattaaccagatagccaggggattatggatcctgtgtcaggctctggagaatcccaactgtaatcttaagcatctgcggctgaagacctacgagacaaacttggagattaaaaaactcctagaagaagtcaaagaaaagaatccgaaactgacaattgattgtaatgcctccggcgctactgccccaccctgctgtgatttcttttgctag

SEQ ID NO: 31590 - DNA, 3030 bp, Artificial Sequence
  Description of Artificial Sequence: Synthetic coding sequence
atgacttcgccgcagctcgaatggaccctgcagaccctgctggagcaactgaacgaagacgagctgaagtccttcaagtccctgttgtgggccttccctctcgaggacgttcttcagaagacaccctggtccgaagtagaggaagcggatggaaagaaactcgccgagatcctggtgaacacttcgagtgagaactggatcagaaacgccactgtgaacatcctcgaggaaatgaatctaactgagctctgtaagatggccaaagctgaaatgatggaggacggacaagtgcaggagattgacaatcccgagctgggggacgctgaagaggatagcgaattggctaagccgggagagaaagagggctggagaaactcaatggagaaacagtccttagtgtggaagaatacgttttggcagggagacattgataattttcacgatgatgtgaccctaaggaatcagcggttcattcccttcctaaacccaagaactccacgaaaactaaccccttacaccgtagtgttgcacggccccgcaggggtcgggaagacaaccctggctaagaaatgcatgctggattggactgactgtaatctgagtccaaccctccggtacgcattttacctttcttgcaaagagttgtcccgaatgggaccatgcagttttgcagaactcatctccaaggactggcctgagcttcaagacgatataccctcaatccttgctcaggctcagcggatcttgtttgtggttgatggcttggacgagcttaaagtgccacctggagccctcatacaggacatatgtggagattgggaaaagaaaaagccagtacctgtacttttgggctcactactgaaaaggaaaatgctgcctcgcgcagctctcttggtaacaaccagaccgcgagctctgagagatctccaactgctcgcccagcagcctatctatgtacgcgtggagggtttcttggaggaagacaggagggcctacttccttcgccattttggagatgaggaccaagcaatgagggcatttgagttgatgcgcagcaatgctgccctcttccagctaggctcggcccctgctgtgtgctggatcgtttgtaccacattaaaattgcagatggagaagggagaggacccggtgcccacttgtttgacacgaaccgggttgttcctgcggttcctgtgctctagatttcctcaaggcgcgcagctgagaggggccctgagaacattaagtctgctcgcggcacagggattatgggcccagatgagtgtcttccatcgcgaagacctcgagcggctgggcgtgcaggagtccgacctgagactctttttggacggagatatactcaggcaggatagggtcagtaagggatgctactcttttattcacttaagcttccagcagtttctcaccgcacttttttatgcactcgagaaggaggaaggagaagacagagatgggcatgcatgggatatcggcgatgttcaaaagctcctctctggcgaagagaggctgaaaaaccccgacttaattcaggtagggcattttctcttcggccttgctaatgaaaaacgcgccaaggagttagaagccacgttcggctgccggatgtcaccagatattaaacaggaactcctgcagtgcaaagcccatttacatgcgaacaaacctctcagtgttacagatttgaaagaggtgctcggctgcctctacgagtcccaggaggaagagctggccaaggtcgttgtcgcgccttttaaggaaatctctattcatctgactaacacatctgaggtgatgcactgctcctttagcctcaagcattgccaagacctccaaaaattgagcctgcaggtggcaaagggtgtttttctggagaattacatggactttgagcttgacattgagttcgaatcttcaaattctaatctaaaattcctggaagtgaagcagagcttcctctctgattcctcagtgcgaatcctgtgcgatcacgtgacaagaagcacctgtcaccttcaaaaggtggagataaagaatgtgactccagataccgcctatcgcgacttttgcttagcctttatcggaaaaaaaacactaacacatctgaccctggccggccacattgaatgggagaggactatgatgctcatgctctgcgaccttttgaggaatcacaaatgcaatctgcaataccttcggctgggcggtcactgcgcaacacctgaacagtgggctgagttcttttatgtcctgaaggctaatcagtccttgaagcatctccgactgagtgccaatgttctgctggacgagggggctatgcttctctacaagacaatgacgaggcctaaacacttcctccagatgctctcactcgagaattgtcgcttgaccgaggcttcatgcaaagatctagcagcagtgcttgtcgtctcaaaaaagctcacccatctgtgccttgccaaaaaccccataggagacactggagtgaagtttctctgtgagggactgagttacccagactgtaaactgcagactctcgtgctacagcagtgttctatcacaaaacttggatgtaggtatttatccgaagccctgcaggaagcctgtagtttaactaatctcgacctgtctatcaaccagatagcgagaggcctgtggatcctttgtcaggctctggaaaaccccaactgcaatctgaagcaccttaggctttggtcctgcagcctgatgccattctattgccagcatctgggcagcgctctgctgagcaatcaaaagttggagactctggatctgggccaaaaccacttgtggaagtccggcattattaaactcttcggggttctcagacaacggactggctctctgaagatccttcgcctcaagacatacgaaacaaatctggagattaagaaacttctggaggaggttaaagaaaaaaaccccaagcttactatcgattgtaacgcatctggagctaccgcccccccatgttgcgatttcttttgttag

SEQ ID NO: 31591 - DNA, 3030 bp, Artificial Sequence
  Description of Artificial Sequence: Synthetic coding sequence
atgacctctcctcagctggagtggacactccagacactgcttgagcagttgaacgaggacgagcttaaaagttttaaatctctcctgtgggcttttcctctcgaggatgtactccaaaagacaccgtggtccgaagttgaggaggctgatggcaagaaactggcagaaatcttagtgaacacctcatctgagaactggattcggaatgcaactgttaacatcctggaagagatgaacttgacagaattatgcaagatggccaaggccgaaatgatggaggatggccaggtgcaggagattgataaccccgagttgggagatgctgaggaagacagtgaactcgcaaaaccaggcgaaaaagagggatggcggaactcaatggaaaagcagagcctggtgtggaagaataccttttggcaaggggacatcgataattttcacgacgatgtgaccctccgtaaccaaaggttcataccctttctcaacccaaggaccccacggaagctgacaccttacaccgtggtcctccatgggcccgccggcgtggggaagacaacgctcgccaagaagtgtatgctggattggactgattgcaatctgagtccaacgctgcggtatgctttctacctcagctgcaaggaactctcccggatgggaccttgttcttttgcagagttgatctcaaaagattggccggaacttcaggacgatattccctctattctggcccaggcccagcgtatcctctttgtggtggatggtctggatgagcttaaggtgcccccgggtgcgctgatccaggatatctgcggcgactgggagaaaaagaagcccgttcccgtgctgctcgggtcactgctcaaacggaagatgctgcctagggctgccctgttggtgacaacccgtcccagggcactcagagatttacagctcctggctcaacagcccatctatgtgcgcgtcgaaggattcctggaggaagatcgccgggcatacttcctgcgccacttcggggatgaggaccaggcgatgcgcgcctttgaactcatgcggtctaacgccgctctgttccaattgggaagtgctcctgcagtctgctggattgtatgtaccactttgaagctgcagatggaaaagggtgaggacccggtccccacatgcctcacgcgaaccggattgtttctacgcttcttgtgcagccgctttcctcagggtgcgcagctgcgcggcgccctgcggacactttccctcctagcagcccaaggactctgggctcagatgagcgtgtttcaccgggaagaccttgagcgcctcggggtgcaggaaagtgatcttcggctgtttctggacggggacattcttcgacaggacagggtctctaaagggtgctactctttcatacacctcagcttccaacaatttctcaccgcactcttttatgccttagaaaaagaagaaggtgaagacagagacggccacgcctgggacatcggagacgtgcaaaaactcctgagcggtgaggagcggcttaagaaccctgacctgattcaggtgggccatttcctcttcgggctagcaaacgagaagcgtgctaaggagcttgaagcaacattcgggtgtcggatgtctcctgacatcaaacaggagcttttacaatgcaaagcccacttgcatgcaaacaaacccctgagcgtgacagatctgaaggaagtgctgggttgtttatacgagagccaggaagaggagctggccaaggtagtcgtggcccccttcaaagagataagtatccatctgacgaacacttcagaggtaatgcactgtagcttctccttaaagcactgccaggacctccagaaactcagtttgcaggtggccaaaggagtcttcttagagaactacatggatttcgagctcgacattgagtttgaaagttccaacagcaatctcaaatttcttgaagtcaaacagagcttcctgtcggattcatccgtacgaattttatgtgatcacgtcacgcgttctacatgtcacttgcagaaagtggaaatcaaaaacgtgacgcctgacacagcctaccgggatttctgtctggcttttattgggaagaaaactctgacacacttaacactcgctgggcatatcgaatgggaacgcacgatgatgctgatgctttgcgatctactgcgtaatcacaagtgcaacctgcagtacctgaggctgggaggtcactgtgctacgcctgaacagtgggcagaatttttttacgtgctgaaggctaaccagtcgctgaaacacctccgtctgagcgcgaatgtcctcctggatgagggtgccatgctgctctataagacaatgacccgcccaaagcattttcttcagatgctgagcctcgaaaactgtaggctgaccgaagcttcatgtaaggatttggcggctgttctggtggtatcaaagaagcttacccacctgtgcctcgcaaaaaacccaattggggacacgggcgtgaaatttctgtgcgagggactctcatatcctgactgcaagttgcagacccttgtcctgcagcagtgttcaatcactaagctcggctgcagatatctcagcgaggccctgcaagaggcctgttcattaacgaacctggacttatcaatcaatcaaattgctcgtgggctgtggattctgtgccaggctctggaaaatccaaactgcaacctcaagcacctcaggctctggagctgttctcttatgccattctattgccagcatttgggctccgctttgttaagcaaccagaaactggagacacttgacctggggcagaaccacttgtggaagagcggaattatcaagctgtttggtgtattgcgccagagaaccggatcgcttaaaatcctgcggctgaaaacttacgagaccaatcttgaaatcaagaagctgctggaggaagtgaaggagaaaaaccccaagctcaccattgactgcaatgcatccggggctactgcccctccatgttgcgacttcttctgctag

SEQ ID NO: 31592 - DNA, 3198 bp, Artificial Sequence
  Description of Artificial Sequence: Synthetic coding sequence
atgtcccgcaagcaccggctggaggcgagacccgacctcagagagtttttctcgctaaatttgaggtcacacactcgttccacgatgacaagtccccagctggaatggaccttgcagactctgcttgagcagttaaatgaggacgagttgaagtcatttaagtcccttctttgggccttcccccttgaggatgtcctccagaaaacaccctggtcggaggtggaggaagctgatggcaaaaaactggccgaaattcttgtgaatactagcagtgagaactggatccgcaatgccactgtcaacattttagaagagatgaatctcacagagctatgtaaaatggcaaaagccgagatgatggaggacggccaggtgcaggagatagataacccagaactgggtgatgccgaagaggactctgagctggccaaaccgggcgagaaggaaggatggcgcaatagcatggagaaacagtccttggtatggaaaaacactttttggcaaggtgacattgacaattttcacgatgatgtcaccctccgcaatcagcgattcatccctttcctgaaccctaggacacctaggaagctgaccccatacaccgttgtactgcatggacctgccggagttggcaagaccacactggctaagaagtgtatgttggactggaccgattgtaacctatcccctactttgcgatacgccttctacctgagctgtaaagaactttcacggatgggtccctgctcctttgccgaactgatttccaaagattggcctgagcttcaggatgatattcctagcatcctcgcccaggcccagaggatccttttcgtggtagatgggctggatgaattaaaggtgccccctggggccctcatccaagacatctgtggggactgggaaaagaagaagccagtccctgtgctgctgggctcccttctgaagagaaaaatgcttcccagggccgcgctgctggtgaccacacgacctagggcactacgtgacctgcagctcttggcccagcagcccatttatgtccgcgtggaaggattcctcgaggaagacaggcgggcatatttcctacgacatttcggtgatgaggaccaggcaatgagagcctttgaactgatgagaagcaatgctgccctcttccagctcgggtccgccccggcagtgtgttggattgtgtgtaccaccctaaagctgcagatggagaaaggtgaggatcctgtgccaacatgccttactaggacagggctcttcctccgttttctctgtagccgctttccccaaggggcacagctgaggggcgcgttgaggaccctctcccttctcgccgcacaaggattgtgggcccaaatgtccgtgttccaccgcgaagatcttgagagactgggagtacaagagagcgacttgaggctatttcttgacggcgatattctccgtcaagatagggtctcaaagggttgctattcattcattcatctgtcattccagcagttcctgactgccctattttatgctctcgagaaagaggagggtgaagaccgcgatggccatgcctgggatatcggggacgtgcagaagctcctgagcggcgaggaacgactcaaaaatcctgatctgatccaagtggggcatttcctctttggcctagcgaacgagaaaagggcgaaggaactcgaagccaccttcggttgtaggatgagtcctgacattaaacaggagctgctccagtgcaaggcacacctgcacgctaataaaccactcagtgtcacagacctgaaagaggtgcttgggtgtctatacgagtcccaggaggaagaattggccaaggtagtagtggccccattcaaggaaatcagtattcacctaactaacaccagcgaggtgatgcactgttccttcagtctcaagcactgccaggacctgcagaagctcagccttcaggtggcaaagggcgtgtttctggagaattacatggacttcgaacttgacatagagttcgaacgatgcacatacctgacaatcccaaattgggctcgtcaggacttgaggagcctgagattgtggactgacttctgttccctcttctccagcaattccaacttgaagtttcttgaagtgaagcagagctttttaagtgatagtagcgtccgaattctatgcgatcacgtgacaaggagtacctgccacctccaaaaagtcgagatcaagaacgtgaccccagacacggcctacagggatttctgtttggctttcatcggtaaaaaaaccctaacccaccttactttagctggccacattgagtgggagcgtacgatgatgttaatgctgtgcgacctcctgcgcaatcataagtgcaatctccagtatctgcgtctaggcgggcactgcgctacacctgaacagtgggctgagtttttctatgtgctgaaggcgaatcagtctctcaagcaccttagactttcagcaaacgtgttactggatgagggcgccatgctcttatacaagaccatgacccggcccaaacactttcttcaaatgctcagtctggaaaattgccgcctgaccgaagcaagctgcaaggatctcgcagccgtgctcgttgtgagcaaaaagcttacgcatctttgtctggcaaagaaccccattggggacacgggcgttaagtttctctgcgagggcctcagctacccagactgcaaactgcagactcttgtcctgcagcagtgcagcatcaccaagttggggtgtcgatacctaagtgaggctctgcaagaggcttgttccttaacaaatctggacctaagcatcaatcaaatcgccaggggactatggattctttgccaggcacttgagaacccgaattgtaacctgaagcacctgcgactctggtcctgctctcttatgcctttctattgccagcacctgggctcagctcttctgtcaaaccagaagctggagacactcgatctggggcagaatcacctgtggaagtccgggattataaagctttttggggtactaaggcaacgaacaggcagtctcaagatactacgcctgaaaacatacgagaccaatctcgagataaagaagttgctggaagaggtcaaagaaaaaaaccccaaacttacaatcgactgtaatgcatcaggagcaacagcccccccttgttgcgatttcttttgttag

SEQ ID NO: 31593 - DNA, 3114 bp, Artificial Sequence
  Description of Artificial Sequence: Synthetic coding sequence
atgacatcgcctcagctcgagtggactctgcaaacccttctcgaacagctgaacgaggatgaacttaaatctttcaaaagtctgctgtgggcattccccctcgaggatgttctgcagaagactccctggagcgaagtggaagaggcagatggcaaaaagctggcagaaattctcgtgaacacatcaagcgagaattggatccgcaatgctacagtgaacatcctagaagaaatgaacctgacagagttgtgtaagatggctaaggccgaaatgatggaagacggccaagtgcaggagatcgacaacccagagcttggcgacgcagaggaagatagcgagttggctaagcccggagagaaggaaggttggcggaactcgatggaaaagcaatctctggtgtggaagaatacattttggcagggggatattgataattttcatgacgatgtgactctgcggaaccagagatttattcccttcctcaatccgcgtacccctcggaagttgacaccctacaccgtggtactccacggccccgctggtgttggcaaaacaaccctggcaaagaagtgtatgctggattggacagattgcaatctaagccctactctgagatacgcgttctatctgtcctgcaaagagctgtcccgcatggggccctgctccttcgcagaactgataagtaaagactggcccgaactccaggacgacattcctagcattcttgcccaagcccagcggatcttatttgtcgtggatggcttggatgagttgaaggtcccccctggcgccctcatccaggacatatgcggtgattgggaaaaaaaaaagccagtcccagtgctactcggttccttactgaagcgaaagatgctacccagagccgccctgttggtcacaacacgccctagagccctgagggacctccaattgttggcacagcaacccatctacgtgcgcgtggaggggtttctggaagaggatcggcgggcctatttcttgcgccactttggcgatgaagaccaagccatgcgtgcatttgaattgatgagaagcaatgctgcattgtttcagctgggctctgccccggcagtgtgttggatcgtatgcacaacgctcaaacttcagatggaaaaaggggaggaccccgtcccaacatgcctgacgcgaacaggactctttcttcgattcttgtgtagccgctttccccaaggtgcccaacttcgcggggccctacgcacactgagtctgctggctgcgcagggcctttgggcacaaatgtcagtgttccacagggaagatctggagcgcctgggagtgcaggagtcagatctgcgactgttcctcgacggggatatcctgaggcaagacagagtctctaaaggctgctacagctttatacatctgagctttcaacagtttctgacagcgttattctacgccttggaaaaggaagaaggggaggatagagatgggcatgcttgggatattggcgatgtccaaaaattgttatcaggcgaggaacggctgaagaatcccgacttgatccaagttggccacttcctgttcggcctcgcaaacgaaaagagggccaaggaactggaggctacctttggctgtcgaatgagccccgacatcaaacaggagcttctccagtgtaaagcccacctgcatgccaataaaccactttccgtcacggatttgaaagaagtgcttggttgtctgtacgaatctcaggaggaagaattagccaaagtggtcgtggctcctttcaaagaaatttcaatccacctcaccaatacctccgaggtaatgcactgttcgtttagcctcaaacattgccaggacctgcaaaagctgtccttacaggttgccaagggcgtattcttggaaaactacatggacttcgaactcgacattgagttcgaacgttgtacttatttaaccatccccaattgggcaagacaggacctccgatcactacggctctggacagacttctgcagcctgttctcttccaattccaatctgaagttcttggaagtgaagcagtcattcttgagtgactccagtgtgcggattctgtgcgatcacgtaactcggtctacttgtcacttgcagaaagtggaaattaagaatgttaccccagacaccgcctatagggatttctgcctcgccttcatcggcaaaaaaaccctcacccatttgacattggctgggcatatcgagtgggagcgtactatgatgcttatgctgtgtgatttattgcgaaatcacaagtgcaaccttcagtatttacggctgggggggcactgtgcaacaccagaacaatgggccgagttcttttatgtactcaaagccaaccagtctctcaaacatctgcgcctctcagccaacgttttgcttgatgagggcgccatgctgttgtacaagaccatgacccgtccgaaacatttccttcagatgctctccctggaaaactgccggctgaccgaggcttcgtgtaaggatctcgctgcagtgctggttgtcagtaaaaaattgacacatttatgcctggcaaaaaacccaatcggagacaccggagtaaagttcctgtgcgagggactgtcttatcctgactgcaagctgcaaacactggtgttgcaacaatgttctattaccaaattagggtgcagatatctcagcgaagccctccaggaggcgtgctctctgaccaatctggatctcagcattaaccaaattgccagagggttgtggatcttgtgccaggcccttgaaaaccctaactgcaacctgaagcacctccgtttgtggtcttgtagcctcatgcctttttactgtcagcacttgggaagtgccctcctgtcgaaccagaagctcgagacactggatctaggccagaatcacctttggaaatctggtattatcaaactgtttggggtgctgagacagcgtacaggctcactgaagattctccggctcaaaacatatgaaaccaatctggagattaaaaaactgctagaggaagttaaggaaaagaaccctaagctgaccattgattgtaatgcaagcggagcgacagcaccaccttgctgtgattttttttgctag

SEQ ID NO: 31594 - DNA, 3114 bp, Artificial Sequence
  Description of Artificial Sequence: Synthetic coding sequence
atgaccagccctcaactggaatggactctacagacactgctagaacagttaaatgaagacgaactgaagagctttaaaagcttactgtgggcatttcccctggaggacgtgttgcagaagactccctggtcggaggtcgaagaggcagacggcaagaaactggccgagatcttagtgaacacctcctccgaaaactggattaggaatgctacggtaaatatcttagaagagatgaacctcaccgaactttgtaagatggcaaaggcagaaatgatggaggatgggcaagtccaggaaattgacaaccccgaactaggtgatgctgaggaagactcagagctggctaagcccggagagaaggagggatggcggaacagtatggagaagcaatccttggtgtggaagaacacgttctggcaaggagacattgataacttccacgacgatgtaaccctgagaaatcagaggtttattccatttctgaatcccaggacacctagaaaattgacgccctatacagtagtcctccacgggcccgcaggtgtgggaaagacaactctggcgaaaaaatgtatgctcgattggacggattgcaacctgtctccaaccctgcggtacgctttttatctcagctgtaaagaattgagcaggatgggcccttgctcattcgcggagctgatttccaaagattggccggagttgcaagatgatattcctagcatcttggctcaggcgcagcggatattattcgtggtggacggtcttgatgaactgaaagttccaccaggagctttgattcaggacatttgcggcgactgggaaaaaaagaaacctgttcccgtcctcctggggtccctgctgaagcggaaaatgttgccacgggcagcactcttggtgacaacccgccctcgcgccctacgcgacctccagctcctagctcagcagcccatttatgtgcgcgtcgagggctttctggaggaggatcgcagagcttatttcctccgtcattttggagatgaggatcaagctatgagggccttcgagctgatgaggtcgaacgcagcgctgttccaacttggctctgcccccgccgtgtgctggattgtgtgtacgacacttaaactacaaatggagaagggggaagaccctgtgcctacatgtcttaccagaactggcctgtttctcagattcctgtgtagcaggttcccccagggagcacaactgcggggagcactgcggacgttgagtttgctggctgctcagggtctctgggctcagatgtcagtgttccatcgagaagacctggagcgtttgggcgtccaggaaagcgatttacgactatttctggatggcgatattctgcgtcaggatcgcgtgtctaaggggtgctacagttttatacacctgtctttccaacagtttctgactgctttgttttatgccctggaaaaagaggagggagaggatcgtgacggccatgcctgggacatcggggacgtccaaaagctgctctcaggcgaagagcgcctgaagaatcctgatctcatccaggtgggtcactttcttttcgggctcgcaaatgagaaacgcgccaaagagttggaggctacgtttgggtgtcgtatgtctcctgatattaagcaggaacttctacaatgtaaggcacacttacacgcaaacaagcccctcagcgtgaccgacctgaaagaagtgctgggctgcctgtatgaatcacaggaggaggaactcgcgaaagtcgttgttgcccctttcaaagagatatccatacacttaactaatactagcgaagtgatgcactgcagttttagtctaaagcactgccaagatctacagaagttatccctacaggtggcaaagggcgtctttttagaaaactatatggattttgagctagatatcgaattcgagagatgcacctacttgaccatacccaattgggcgaggcaggatctgaggtcattgaggctctggacagatttttgctctctgtttagctccaatagcaatctgaagtttctggaggtcaagcagtccttcctctccgactcctcggtaagaattctctgcgatcacgtcacccggtcaacatgccatctccagaaagtcgaaatcaaaaacgttacccctgatactgcctaccgagacttttgcctcgcttttatcggaaagaagacgttgacccaccttaccctggccgggcatattgagtgggaacggacaatgatgctgatgctatgtgacctcctgcgcaatcacaagtgcaacctacagtatctgaggctgggaggtcactgcgctacgcccgagcagtgggcagagttcttctacgtgcttaaggcaaaccagtcactgaagcacctgagattgtccgctaatgtgttgctggacgagggggccatgttgctctacaaaacgatgactagacctaagcacttcctccagatgctgtctctggaaaactgccgacttacagaagccagctgtaaggacctggcggctgtgttagttgtgagcaagaagttgacccacctgtgtctggctaagaatcccatcggggacaccggcgtgaagtttctatgcgaagggctgtcctaccctgactgtaagctgcagacactcgtgctgcagcagtgttccatcaccaagctaggctgtcgttatctcagtgaggcgttgcaagaggcttgtagcctaacaaatttggatttgagcatcaaccagatcgctagaggtctgtggatcctgtgtcaagcactggaaaatcccaactgtaacctgaagcaccttagattgtggagctgcagcctgatgccattttactgtcagcatctgggcagcgctcttctctcgaatcagaaattggagaccctcgatctgggtcagaatcacctctggaagagcggcattatcaagttatttggggtgctgaggcagcggactggcagcttgaagatcttgcggctgaagacctacgagacaaatctggagattaaaaaactgctcgaagaagttaaagaaaaaaacccaaaactcactatagattgcaacgctagcggcgccactgccccaccctgctgtgatttcttctgctag

SEQ ID NO: 31595 - DNA, 3114 bp, Artificial Sequence
  Description of Artificial Sequence: Synthetic coding sequence
atgaccagcccacaattggaatggacgctgcaaaccctacttgaacaactcaacgaggacgagctcaagtcatttaagtctttgctttgggctttcccgctggaagacgtgctacagaagactccttggagtgaggtcgaggaagctgatggcaaaaagctcgccgaaatactagtcaataccagcagtgaaaactggattcgtaatgccacggtcaacatattggaggagatgaacctgacagagttgtgcaaaatggcaaaagcggaaatgatggaggatggtcaggtgcaggagattgacaaccctgagcttggcgacgctgaagaggattcggaactggctaagcccggcgaaaaggagggctggagaaattctatggagaaacagtctctagtgtggaagaacaccttttggcaaggcgacatcgacaacttccatgatgatgtgacactcaggaatcagagatttatcccattcctcaatccacgaacgccgagaaagcttactccgtatactgtggtcttgcacggcccagctggcgtggggaaaactaccctggcaaaaaagtgtatgctcgactggacagattgtaacctatcccccactctccgctatgccttctacctgagctgcaaagaactcagccgaatgggtccgtgttctttcgcggagttaatcagcaaagattggcctgaattgcaagacgatatcccatccattcttgcccaggcacagcggatcttattcgtggtagatgggttggacgaactgaaagtgcctcccggtgcgttgatccaggacatttgcggagactgggagaagaaaaaaccagtcccagtgctactgggcagcctcctgaaacggaagatgctgccccgcgccgcccttctggtgacaacacggcccagggcccttagagatctgcagctgttggctcaacagcccatctatgttcgggtagagggctttcttgaggaggaccgcagggcatactttctgagacattttggtgacgaagaccaagccatgcgagccttcgaactaatgcggtcaaacgcagctctgttccaactgggttccgcacccgctgtgtgctggattgtgtgcaccaccctgaaacttcagatggaaaagggcgaagacccagtacctacttgtcttactagaacgggactctttttgcgtttcctctgtagcagattcccccagggtgcccagttacgcggcgccctcagaaccctgagtcttttggccgcccaaggcctgtgggctcagatgtccgtctttcatcgcgaggaccttgaacggcttggagtacaggaatctgacctccgcttgtttctggacggagacattcttagacaagaccgggtttcaaagggttgttactccttcatacatctgagcttccagcagtttctgaccgccttgttctacgctcttgaaaaagaggagggagaggatcgggacgggcatgcatgggatatcggggatgtgcaaaagctcctctcaggggaggagagactgaaaaacccagacctgatacaggtgggtcattttctgtttggcctggcaaatgaaaagcgggctaaggagctggaagccacatttggctgcaggatgtcacccgatatcaagcaggagctgttacagtgcaaggcgcacctgcacgccaacaagcctctctcagtgaccgacctcaaggaagtgctaggctgcctgtatgagtcacaggaggaagaactggctaaggtggtggtcgcgcctttcaaggagatctccatccatcttactaatacaagtgaagtgatgcactgctccttctcacttaaacactgccaggacctgcagaagctcagtttgcaggtcgccaagggtgtgttcctcgagaattatatggacttcgagctggacattgagttcgaacgctgtacctatttaactatccccaattgggctcgccaggacctcaggtctctgcggctatggacggacttttgctctctgttctcttccaactctaatctgaaattcctcgaggtaaagcagagctttctgagcgattcaagcgtcaggatattgtgtgaccacgtgacacgcagcacttgccacctacagaaggttgagatcaagaacgttactccagacacagcgtatcgagacttctgtctggcgtttatcggcaagaaaacacttacccatctgaccctggccggacacatcgaatgggaaagaacaatgatgctcatgctgtgcgacctactgcgcaaccacaaatgtaatctccagtatctgagactgggcgggcattgcgcaactcctgagcagtgggcggagtttttttatgtcctgaaggccaaccagtcactaaaacatctgcgcttgagcgccaacgtgttgcttgacgagggggcaatgctgctgtacaaaacaatgacaagacccaagcatttcttgcaaatgttgagtctcgagaattgcaggcttaccgaggcctcgtgcaaagacctggctgcggtgctagtagtgtccaagaagctgactcacctgtgtctggcaaaaaatcctataggggacacaggggttaaatttttgtgcgaggggcttagttatcctgactgcaaactgcagaccctggtcctccaacaatgtagcattactaaactgggttgccgatacctttccgaggcacttcaggaagcatgctctctgaccaacttggacctatcaatcaatcagatcgcgcgaggcctctggatcctatgtcaggccctggagaatcccaattgtaacctgaagcacctgcgcctatggagctgctcactcatgcccttctactgtcagcatctcggcagcgcactgctttcaaaccagaagctggagacacttgatttaggccagaaccacctctggaaatccggtattatcaaactgttcggagtcctaaggcagcgcaccggtagtcttaagattctccggctaaaaacctacgagactaatctagaaattaaaaagctgctggaggaagtgaaggagaaaaatcctaaactaactatcgattgcaatgcaagcggggccaccgcacctccctgttgtgactttttttgctag

SEQ ID NO: 31596 - DNA, 3114 bp, Artificial Sequence
  Description of Artificial Sequence: Synthetic coding sequence
atgacctccccccagctcgaatggaccctgcaaacgctgctcgaacagctaaatgaggacgagctcaagagcttcaagagtctgctttgggcattccccctcgaggatgtcttgcagaagactccgtggtccgaggtggaagaggcagacggcaagaagctggcagagattctggtgaacactagtagcgagaactggattaggaacgctactgtaaatatccttgaggaaatgaacttgactgagttatgtaaaatggctaaagccgagatgatggaggatggacaggtccaggaaattgataaccctgagttaggagatgcagaagaggattccgagttggctaaaccaggggaaaaggaaggctggcgaaactcaatggagaagcagagtctggtatggaaaaatacattctggcagggcgacatagataactttcacgatgacgttacactgcgaaatcagcgatttatacctttccttaatcctaggaccccccggaagctaaccccttacactgtcgtccttcacgggccggccggggtcgggaagaccacactggctaagaagtgcatgctcgattggacagactgtaatctctctcctacactgcggtatgctttttatttgtcctgcaaagaactgtctcgtatgggcccttgtagctttgccgagctgatatcgaaggactggccagagctgcaagacgatatcccaagcattctagcacaggcgcaacgaatcctgttcgtcgtggatggcctcgatgagctcaaagtgccccccggtgccctaatccaggacatctgtggagactgggagaagaagaaacccgtgccggtgttactcgggtccctcttaaaaaggaagatgctcccccgcgcggccttactggtgaccacaaggccccgcgcattaagagacttgcagttgctggcccaacaacctatttacgtacgcgttgaaggatttctggaggaggatcggcgtgcttatttcctaagacacttcggagatgaggatcaagctatgcgcgcgttcgagctgatgcgctctaatgctgccctgttccagcttggatccgcaccagccgtttgttggattgtctgcactaccctgaagctccagatggagaaaggggaagatccggtgccaacatgcctgaccagaactggccttttccttagatttctgtgctctaggttccctcagggcgcccaactgcgcggcgcgctgaggactctgtctctgctcgccgctcagggactttgggcacagatgagcgttttccaccgtgaggatttggaaaggctgggcgtacaggagagcgacctcagactatttttggacggcgacatcctgcgacaggaccgagtttccaagggatgctactctttcattcatctcagctttcagcaattcctgaccgcgcttttctatgccctggaaaaggaggagggggaagatcgggacggccatgcctgggacataggcgatgtgcagaaattactctccggcgaagaacggctcaaaaacccagacctgatccaggtggggcactttcttttcggccttgctaatgaaaaaagggccaaggagctggaagccactttcggatgccgaatgagccctgatattaagcaggaactgttgcagtgcaaggcacacctacacgctaataagcccttaagtgtcactgatctaaaagaggtcctcggttgcctgtatgagagccaggaggaagaactcgcaaaggtagtggttgcacccttcaaagaaatctctatccatctgacaaacactagtgaggtgatgcactgtagctttagcctgaaacactgccaggacctccaaaagctgtcacttcaagtggcaaaaggggtcttcttagagaactatatggactttgaactggatatagagttcgagaggtgcacgtatttaactattcccaactgggctaggcaggatcttcgttctctccggctatggacagatttctgttctctgttcagctctaactccaatttgaaatttctagaggttaaacaatccttcctgagcgactctagtgtaaggattctctgtgatcacgtgacccgcagcacgtgtcatttgcagaaagtggagattaagaatgttactcctgacacagcataccgggacttctgcttggcctttatcgggaaaaaaactctgacacacttgaccctggctggacatatagagtgggagcgtacaatgatgttgatgttgtgcgatctcttacgaaaccataagtgcaatttgcagtatttgagactcggtggacactgcgccacccccgagcagtgggcagaattcttttacgtgctcaaagccaaccagtctttgaagcacctgaggcttagcgcaaatgtgttactggacgaaggggctatgcttctctataagaccatgacgagaccaaagcactttcttcaaatgctttctttggagaattgccgcctcaccgaagcctcctgtaaagatcttgccgcggtgttagtcgtgtctaagaaactcacacacctgtgcctggcaaagaacccaatcggggataccggagttaagttcctgtgtgaagggctatcataccctgattgcaaattgcaaacactggtgttacagcaatgctcgatcaccaaactcgggtgcaggtacctgtcagaagcgcttcaggaagcgtgctcactaactaaccttgacctgtcaatcaatcaaattgcaagaggcctctggatcctatgccaagctctcgaaaaccccaactgcaatctgaagcacttaaggttgtggagttgctcattgatgcctttctactgccaacatttgggaagtgctctgctgagtaatcagaagcttgagacacttgatttaggccagaatcacctgtggaaaagtggaattattaagctctttggtgtgttaaggcagagaaccggttcattgaaaattcttaggctgaagacctacgaaaccaacctcgaaataaagaaactcttagaagaggtgaaagagaagaatccaaagttgacaattgactgtaatgcttccggcgccactgccccaccttgctgtgacttcttttgttag

SEQ ID NO: 31597 - DNA, 3114 bp, Artificial Sequence
  Description of Artificial Sequence: Synthetic coding sequence
atgacttctcctcagcttgagtggacgctgcagactttactggagcagctcaacgaagacgaactgaagtcattcaaaagcctgctgtgggcattcccactcgaagacgtgctccaaaagaccccctggtccgaagtcgaggaggccgacggtaagaaactcgcagaaattctggtgaacacaagctcagaaaattggatcagaaatgcgactgttaatattctcgaggagatgaatctgacggagctctgcaagatggccaaggcggagatgatggaggatggtcaggtgcaggagatagacaatcccgaactgggggatgccgaagaggatagtgaacttgccaaacccggggaaaaagaaggatggagaaactctatggagaaacagagcctggtttggaaaaacaccttctggcagggtgacattgacaacttccatgacgatgtcacactgagaaatcagaggttcattccattcctgaaccccagaaccccccggaagctgaccccctacacagtggtcctccatggtccagctggcgtcggtaaaacaactcttgctaaaaagtgcatgcttgactggaccgattgcaacctgtcacctacactgaggtacgccttctatttgtcctgcaaagaattgagccggatgggcccgtgcagctttgcggagctcataagcaaggactggcccgagctccaggatgacatcccttccatactagctcaagcccagaggatcctgtttgtagtggacggactcgacgagctcaaagtccccccaggagccttgattcaggatatctgtggagactgggagaaaaagaaacccgtgcctgtgcttttgggctctctgctgaagcgtaagatgttaccccgagccgccttgttggtgactaccagaccacgggctcttcgagatctgcagctcctggcccaacagcccatttacgtccgcgtcgagggcttcctcgaagaggacaggagggcgtattttctgagacacttcggtgatgaggaccaagccatgagagcgttcgaactcatgaggtccaacgccgccctatttcagttagggagcgcgcccgctgtctgctggattgtctgcacgaccctgaaactgcagatggagaaaggcgaggatcctgtccctacatgtttaacaaggaccggactctttctgaggttcctctgtagcagattccctcagggcgcccagctgcggggagccctaaggaccctgtcactgttggctgcccagggtctttgggcccagatgagcgtgttccatcgcgaggatcttgagaggctgggggtgcaggagtcagacctgaggctcttcttagatggcgatatcctgagacaggatagagtgtctaaaggatgttacagttttattcacctcagctttcagcagttcctgacagctcttttctatgctctggaaaaagaagaaggggaggacagggatggccacgcctgggatattggcgacgttcaaaagcttctttccggtgaagaacgtctcaagaatcccgacttgatccaggtggggcactttctgtttggattggccaacgaaaagagagccaaggaactggaggcaacctttggctgcaggatgagtcccgatatcaagcaggaactcctgcagtgcaaagctcatttgcacgctaataagcccctctcggtgactgatctgaaagaagtattaggctgtctgtacgagtcacaggaggaggaactcgccaaggttgtggtggctccttttaaagagatcagtattcatctcacgaacaccagtgaggtcatgcactgtagtttctcattaaagcactgccaggaccttcagaaactaagtctgcaggtcgcgaaaggagtctttctggagaactatatggacttcgagttagacatcgaattcgaaaggtgcacctatctgaccatccccaactgggcacgtcaggacttgaggtcactaaggctgtggacagacttctgttctttattttcgtccaacagcaacctaaagttcctcgaggtcaagcaaagtttcctttcagacagctcagtgaggatactgtgcgaccacgtgactaggagcacatgtcacctgcagaaggtggagataaagaacgtaacccctgataccgcatacagggacttttgcctggccttcatcgggaaaaagacacttacccatctcacactggccggacacatcgagtgggagcgtacaatgatgctcatgttatgtgacttgctgcgcaatcacaagtgcaatctgcagtacttaagactcggtgggcactgtgcgactcccgagcaatgggccgaattcttctacgttctgaaagccaatcagtctctcaaacatctgaggctgagcgccaatgtactcctggatgaaggggccatgctactctacaaaactatgaccaggcccaaacatttcttacaaatgctctcactggaaaactgtcgtctgactgaggcgagttgtaaggatctggccgcggtgctcgtagtctcaaaaaaactcacccacctgtgtttggcaaagaaccccattggcgataccggagtgaaattcctgtgcgagggactgtcttatccagactgcaaactgcagactctggtgcttcagcagtgttccatcacaaaattaggctgccgatatctttcagaggccttacaagaggcctgttctctgacgaatcttgacctgtccataaatcaaatcgcccgtggactgtggatcctgtgccaggctctcgaaaatcctaattgcaatctcaagcacttacgactgtggagctgcagcctgatgcccttttattgccagcacctcggctcggccctactgtccaaccagaagttagagacactggatttaggacagaaccacctgtggaagagtggcatcatcaaactgttcggagtgctaaggcagcgcacaggaagcctaaagattttacgactcaagacatacgaaacgaatttggaaatcaaaaagctgctggaggaagtgaaggagaagaaccctaaactcaccatcgattgcaacgcatccggcgctacagctcccccctgttgcgattttttttgttag

SEQ ID NO: 31598 - DNA, 3114 bp, Artificial Sequence
  Description of Artificial Sequence: Synthetic coding sequence
atgacaagtcctcagctggagtggaccttacagactttactggagcaactcaacgaggatgagctgaaaagctttaaatcgctgctttgggcttttcccctggaggatgttttacagaagacaccttggagtgaagtggaagaggcagacggaaagaagctggctgagatcctcgtgaataccagcagcgaaaactggattcgtaacgctacggtgaacatcctggaggagatgaacttgactgaactgtgcaaaatggccaaagccgagatgatggaggatggccaagtgcaagagattgataatcctgaactcggagacgccgaggaggactccgaactggcaaagccaggcgaaaaagaaggctggagaaattctatggaaaaacagtccctggtgtggaagaatactttctggcaaggtgacatcgacaattttcatgacgatgtaacgctccgcaatcagcgcttcatccccttcctcaaccccagaacgccgcgaaaattgaccccatacaccgtagttctgcacgggcccgcgggagtcggcaaaacgacactcgccaagaaatgtatgcttgattggactgactgtaatcttagtccaacgctgcgatatgcattctatctgagctgcaaagagctgagcagaatgggtccttgctccttcgctgaattaattagcaaagactggccagaattgcaggacgacattccctccatcctggctcaggctcagcgcattctcttcgttgtggacggtcttgacgaactgaaagttccccctggggccctcattcaggatatttgcggggattgggagaagaaaaagccggtgccggtgctgctcggaagcctgctaaaacgaaagatgttgccgagggccgctcttctggtcaccacgcggcctcgtgcgcttagggacctacagctcctggcccaacagcccatttatgtgagagttgagggcttcctggaggaggatcggagggcctacttccttcggcattttggggacgaagaccaggccatgcgagcttttgagctgatgcggtcaaatgctgcactctttcagctgggtagtgcccccgccgtgtgctggattgtgtgtacgacactaaaattacagatggagaaaggcgaggatccagtgcccacatgtcttaccagaactggattgttcctgcgcttcctgtgttcccgatttccacaaggcgcccaactgcgcggggcactgcgaacgctgtctctgctggctgcccagggactctgggcgcaaatgtcagtgtttcatagggaagaccttgagcggctgggggtccaggagtctgaccttcgcctgtttctcgacggggacatcctaaggcaggaccgtgtgagcaaaggatgctacagttttatccatttgagcttccaacagtttctaactgccctgttctacgccctggagaaggaagagggggaggaccgcgatggacacgcgtgggacattggtgacgtgcagaagcttctgtcaggcgaagagcggctgaagaatccggacctcattcaggtgggtcactttctgttcggtctcgcaaacgaaaagcgcgcgaaggagctggaggcaacgttcggctgcaggatgagtcctgacatcaagcaagaattgcttcagtgcaaagctcaccttcacgccaacaaaccactctctgtgacagatctcaaggaagttctcggctgtttgtacgagtcacaagaagaagagcttgccaaagtcgtggtggcccccttcaaggagatcagcatacacttgactaatacctcagaggtcatgcactgcagtttttctctgaagcactgtcaagatttgcagaaactctccttgcaggtcgccaagggcgtgtttctagagaactacatggattttgagctagacatcgaatttgagaggtgtacttacttgactattcccaattgggcacgacaggacctgcgttcattacggctgtggaccgatttctgttccctgttttcgagcaattccaatctaaaattcctggaggttaaacaatccttcctgtctgactccagcgtgcgcattctatgtgatcatgtaacacggtccacctgtcatctgcagaaggtggagatcaaaaatgtcactcctgacacagcctaccgggatttttgtctggctttcatcggcaagaagacgctcacgcatctcacgctcgcaggtcacatcgaatgggagaggaccatgatgttaatgttgtgtgaccttctgcgtaaccacaaatgcaacctgcagtaccttagactggggggccattgcgctactcctgagcagtgggccgagttcttttacgtgttgaaggccaatcagtccctgaaacacctacgtttgagcgcaaatgtcctgttggatgagggcgctatgttgctttacaagacgatgacccggcccaaacactttcttcaaatgctgtccctggagaactgccgcttaaccgaggcaagctgcaaagatttggctgccgtgctggtcgtgtctaagaagctcacccatttatgtctcgcgaaaaatcccatcggcgatactggtgtcaagtttctctgcgagggtttgtcctacccagattgtaagctgcaaactctggttctgcagcaatgctcgatcactaagctgggttgccgctacctatccgaggcacttcaagaggcctgcagcctcaccaacttggatctgagcattaatcagatcgctagggggttatggatcctgtgtcaagcactggaaaatcccaactgcaatctaaagcatctgaggctctggagctgctcacttatgccgttctactgtcagcatctgggctctgcgctgctatctaaccagaagttagagacactagacctgggacagaatcacttgtggaagtccggcatcatcaagctcttcggcgttctgcggcagcggaccggaagtttgaagatcctacgcctaaaaacttatgagaccaacctggagattaagaaactcctcgaggaggtgaaagaaaagaaccccaagctgactatagactgcaacgcttcgggcgccacagcaccgccttgttgtgatttcttctgctag

SEQ ID NO: 31599 - DNA, 3114 bp, Artificial Sequence
  Description of Artificial Sequence: Synthetic coding sequence
atgaccagcccgcagctggaatggaccctgcaaaccctattagaacagctcaatgaagacgaacttaaatcatttaagagcttactgtgggcctttccgctggaggacgtcctgcagaagaccccttggtccgaggtggaggaagccgatggcaagaaactggccgaaattttagtcaacactagttctgagaattggatacgcaatgctaccgtcaacatcctggaggagatgaatctgacagaactgtgcaagatggcaaaggcagagatgatggaggacgggcaagtccaggaaatagacaacccagagctcggcgatgcagaagaagattccgagctggcaaagcccggagaaaaggaaggatggcgcaactccatggaaaagcagtcactggtgtggaaaaacactttctggcaaggcgacatcgacaactttcacgatgatgtgactttgcgtaaccagcggttcattccctttctgaacccaagaacgccccggaaactcacaccttacacagtggttctgcatggccctgcaggggttggtaagacaacgcttgcgaaaaaatgcatgcttgattggaccgattgcaacctcagccccaccctcaggtacgccttctacctgtcttgcaaggagctcagtagaatgggtccgtgttctttcgccgagttaatatctaaggattggccagagctacaggatgacatacccagtatcctggcccaggcccaaagaatcctgttcgtggttgacggcctcgacgagttgaaggtccccccgggcgcactgatccaggatatatgcggcgactgggaaaagaagaaacccgtccctgtgttacttggtagccttttgaaaaggaagatgcttccacgtgcagccttactagtgacaaccaggccgcgggcattacgcgacttacagctgctcgcccagcaaccaatctacgttagggtggaaggctttctagaagaggatagacgcgcttactttctgagacactttggagatgaggaccaggccatgagggcctttgaactgatgagaagcaatgctgctcttttccagctgggatccgcacctgctgtttgttggatcgtttgtactacactgaagctgcagatggaaaagggcgaggaccctgtgccgacatgtctgacccgcactgggctgtttctgagattcctgtgttcccgattcccccagggagctcagctgcgcggggccctccgtaccctttccctactagcagcacagggactttgggcacagatgagcgtgtttcacagagaggacctagagaggctgggcgtgcaggaatccgacctgagattattcctcgatggcgatattctgaggcaggaccgcgtctccaagggctgctatagcttcatccatctgtcattccagcagtttttgacagccctcttttacgcactcgagaaggaggagggagaagaccgggacggacatgcttgggacatcggcgatgtgcagaaattattgagtggagaagagaggttgaagaatccggacctgattcaggtcggacactttttgtttggacttgccaatgaaaaacgcgccaaagaattggaggctacatttggttgtcgaatgtcaccagatattaaacaggaactcctgcaatgcaaggctcacttacatgccaacaagcccctgagcgtaaccgacttaaaggaagtgctgggttgcctctacgaatctcaggaggaagaactggcaaaggtagttgtcgccccttttaaagaaatctccatccacctcaccaataccagcgaggtgatgcactgctccttctccctgaagcactgtcaggacctgcagaagctcagccttcaggtggctaagggcgttttcctggagaattacatggacttcgagctcgacatcgaattcgaaagatgtacctatctgaccatccccaattgggcgaggcaagatctccgatctctccggctgtggacagacttttgttcactgttctcatccaatagcaatctcaaatttctggaggtgaaacagtcttttctcagtgactcatctgtgaggatcttgtgtgatcatgttacacgcagtacctgccacttgcaaaaggtggaaattaaaaatgtgacacccgacaccgcctatcgtgacttttgtctcgccttcattggtaaaaagactcttactcacctaaccctcgctggacatattgaatgggagcggacaatgatgctcatgctctgcgacttactacgtaaccataaatgtaatctgcagtatctgcggctgggcggtcattgcgctacccccgaacaatgggcagagttcttttatgtcttaaaggccaaccagtctctgaaacatttgaggctctcggctaacgtgctcctggacgagggcgccatgctgctgtataagacaatgacccgccctaaacatttcctccagatgttgtcactggaaaattgtcggcttaccgaggcatcctgcaaggacttggcagctgtcctggtcgtgtctaaaaaactcacccatctctgtctggccaaaaacccaataggagatactggcgttaagtttttgtgtgagggactctcttatcctgactgtaagctacagaccctggtgctgcagcagtgcagtattacaaagctcggatgtagatacctgtctgaggcactccaggaggcctgctccctgactaatctagaccttagcattaatcagatagctcggggcttgtggattctgtgtcaagccttagagaacccaaactgcaacctgaaacatctgagactgtggtcttgctcattgatgcctttttactgtcagcacttaggctctgcactgctaagcaaccagaagctagaaactcttgatctaggacagaaccacctgtggaaatccggaattataaaattattcggtgttctgagacagcgaactggaagcctgaaaattctccgcttaaagacttacgagaccaacctagaaatcaagaagttgcttgaggaggtcaaggaaaagaacccaaagttaactatcgactgcaacgcgtctggtgcgaccgctcctccgtgctgtgactttttctgttag

SEQ ID NO: 31600 - DNA, 1080 bp, Artificial Sequence
  Description of Artificial Sequence: Synthetic coding sequence
atgaattttatcaaagacaattccagggctctcatacaacggatgggtatgaccgttattaaacaaatcaccgacgacctgtttgtttggaacgttctgaatcgcgaggaggtaaacatcatctgttgcgaaaaggttgaacaggacgctgctagaggtatcattcacatgattctcaagaagggctctgaatcctgtaatttgtttcttaagagcctgaaagagtggaattacccgctttttcaagatcttaacggccaatctgggctgaccgactctctggggaacctcaagaatctaacaaaattgatcatggataacataaagatgaacgaagaagatgccatcaaactcgcagaagggctgaaaaaccttaagaaaatgtgtctcttccacctgacacatcttagcgacattggagaaggaatggactatattgttaaaagcctctcaagcgaaccatgtgacctggaggaaattcagcttgttagctgttgtctctccgccaacgcagtcaagatactggctcagaacctacacaatctggtcaagctgtccatccttgacctctcagagaattacctggaaaaggatggcaatgaggcactgcacgaactgattgaccgaatgaacgtgttggagcagctgactgctctgatgctgccttggggctgtgacgtgcaagggtccctgtcatcactcctgaaacatctggaagaggtgccccagctggtgaagctcggactgaaaaactggcgactgacagatacagaaatacgcattctgggcgcattctttggcaagaaccctctgaagaatttccagcagctgaacttggccggaaacagagtatcatctgacgggtggctcgcattcatgggcgtgttcgaaaatctgaagcagttagtgttttttgatttcagcactaaggagttcctgcccgaccctgctttggtgcgcaaattatcccaggtcctctccaagctgactttcctgcaggaggctaggttggtaggctggcaatttgacgatgacgatctctctgtgatcaccggcgccttcaagttggtgaccgcatag

SEQ ID NO: 31601 - DNA, 5514 bp, Artificial Sequence
  Description of Artificial Sequence: Synthetic coding sequence
atggacccagttggcctgcagctaggcaacaagaacttgtggagctgcttggttaggctgctgactaaggatccagagtggctgaacgcgaagatgaaattttttctccccaatacagacctggactcccgaaacgagaccctagatcccgagcagagagtgattcttcagctgaacaagctgcatgttcagggttccgatacatggcagagtttcatacattgcgtttgtatgcagctggaggtgccactcgacttagaggtgctgttgctctccacattcggttacgacgatggtttcacctctcagctgggcgcagagggaaaaagccagccagagagccagctgcaccacgggctaaaacgccctcatcagtcctgcggaagctcacctaggcgaaagcagtgtaagaaacagcagctggaactagctaaaaagtatctacagttgctgcggacaagcgcccagcagcgatatcgttcccagataccaggctctggccagccgcatgcattccaccaggtctatgtccctcctatcctgaggcgtgcgacggcttcccttgacactcccgagggagctatcatgggagatgtcaaagtggaagacggagctgacgtgagtatttccgatctgttcaatacgagagtgaacaaaggacccagggtgacagtactgctgggcaaagctggcatgggcaaaactacgctagctcatcgcctctgtcaaaaatgggctgagggccatctgaactgtttccaggctctgttcctgttcgagtttagacagctgaatctcattacccgtttcctaacgcctagcgaactgctgtttgatctttacctgtctcctgagtcagaccatgacaccgttttccaatacctcgaaaagaacgccgatcaggtgcttctgatctttgatgggctagatgaggccctgcagccgatgggtccagacggtcccggacccgttctgaccctattcagtcatttgtgcaacggcacactgctcccaggctgcagagtgatggcaacgtcacgaccgggtaaactgcctgcgtgtttgcctgctgaggcagcaatggtgcacatgctgggattcgacggtccgcgggtggaagagtacgtgaaccacttcttcagcgcccagccttcacgggaaggcgccttggttgaactacaaaccaatggtcggctgaggagcctgtgcgcagtgcctgctctctgccaggtggcctgtctgtgcctccatcatctgctgccagatcacgcgccagggcaatctgtggctctattaccaaatatgacccaattatatatgcaaatggtcctcgctctctccccacctggacacttgccgacatcttccctgctcgatctcggagaggtcgctctgcgaggattggaaacagggaaagtaatcttttatgccaaggacatcgcaccccccctgattgccttcggcgcgacccatagcttgctcacttccttttgcgtctgtacaggccccgggcatcagcaaactggctatgcattcacacaccttagcttgcaggaattcctcgccgcacttcatttgatggcgtctcccaaagtaaataaagacacactgacacagtacgtgacgcttcactcacgatgggtgcaacgaacaaaggcaaggctcggactgagcgaccacctgcccaccttcctggctgggctcgccagctgtacatgtcggccgttcctgtctcacctggcacagggcaatgaggattgtgtaggcgcaaaacaggcggccgtggtgcaagttttaaagaagctggcgacgagaaaactgacaggcccgaaagtggtggaactctgccactgtgtagacgagacacaggagcccgagcttgcctctttaacggcccagtctctcccatatcagctaccgtttcataatttcccattgacatgcaccgatttggctacgctgacaaacattctggaacacagggaggcgccaatccatctggacttcgacggatgcccgttagagcctcattgccctgaggctttggtcgggtgtgggcaaatcgaaaacctctcttttaagagccgtaaatgcggtgatgcattcgctgaagccctttcacggtctctccctactatgggacgcctgcagatgctcggtttagctggcagcaagataactgcccgcggcatcagccacctcgtgaaagcattacccctgtgcccccaactgaaagaagtgtccttccgtgataaccagctatccgaccaggtggtgctgaatattgtagaggtgcttccgcatctgcccagacttaggaaactggacctaagttccaactctatctgcgttagcacgctgctgtgcttggctcgcgtcgccgtcacgtgtccgaccgttagaatgttgcaggcacgggaagctgacttaattttcttgttatctccgcctaccgagactactgctgagctgcagcgcgcacctgaccttcaagagagcgacggacaacgcaagggcgcacagtccaggtctctaaccctaagactgcagaagtgccagctgcaagtgcatgacgccgaggctctgattgctctcctacaggaaggaccacacctcgaggaggtggacctgagcgggaaccaactggaagacgaaggctgcagactgatggctgaagccgccagtcagctgcacatcgctagaaagttggaccttagcaacaacggattgtccgtggcaggtgttcactgtgtacttagagccgttagcgcctgctggaccttagctgagctgcacatatccctgcagcacaaaacggtgattttcatgttcgctcaggagccagaggaacagaaaggaccgcaagaaagagcagcctttctcgattcgctcatgctgcagatgcctagcgaactgccgctatcatcacgaagaatgaggttgacccactgcgggttgcaggagaagcacttggaacagctctgcaaagctctcggcggctcctgccatctgggacatctgcacctggatttttctggaaacgcattaggggatgagggagctgcccggctagcccagctcttgcctggccttggagcccttcagagcctaaacctgagcgaaaatgggcttagcttagacgccgtgctcggactagtgcgctgtttcagtactctgcagtggctgtttcgactggacatatcgtttgagagccagcatatcctgctgagaggcgacaaaacatcgcgagacatgtgggccacggggtcactacccgattttccggcagccgccaagttcctggggtttagacaacggtgtattcctcgatcactatgcctgtccgagtgccccctggaaccgcccagcctcactcggttgtgcgccactctcaaggactgccccggccccctcgaactgcagctctcttgtgagttcctttcggaccaaagcctggaaaccctgctggattgtctgccacagctgcctcagctgtccttactgcaactctcccagaccgggctgagcccaaaatcaccctttctactggccaatactttatctctctgcccccgcgtcaaaaaagtggacctccggtcccttcatcacgcgacccttcactttagaagcaatgaagaggaagagggtgtgtgctgtggccttagtgcgaatttattaggagactctggtttgcggtgtctgctagagtgtctgccacaagtcccgatctctggcttgctggatctctctcataactccatatcccaggaaagcgctctgtacctgttggaaactctgcctagctgtcctcgggtgcgcgaggcaagtgtgaacctgggatcagagcagtccttcaggattcactttagtagggaagatcaagctggaaagactttgcgattgtctgagtgcagcttccgtcccgagcacgtgagccggctagccactgggcttagcaagagcctgcagttgactgaattaactttgacacagtgctgcctcggacaaaagcagctagcgattctgttaagtttggttggtcgcccagctggactcttctcactccgagtacaagagccatgggccgatcgagctcgggtgctctctttactcgaggtatgcgctcaggcgtctggatcggtgacagagattagcatttctgagacccagcagcagctgtgtgtgcagctcgaattcccccggcaagaagagaatcctgaggcagtggcactcagattggcacattgtgacttaggcgcacaccattctctgctggtgggccagctaatggagacttgtgctagactgcagcagcttagtctgagccaggtcaatctgtgcgaggatgacgacgcaagctctctgttactgcagtctttgctgttatccctcagcgagttgaagacatttcgactgacttcaagttgcgtctccactgaaggcctcgcacatcttgcttcaggtttgggacactgccatcatctggaggaactagatctgtccaataatcaattcgatgaggaaggcaccaaagccttaatgagggccctcgaagggaagtggatgctgaaaagactcgacctctctcatttactcctgaatagcagcacactggctctgctaacacatcggctctcccaaatgacttgcctgcagtcactaaggttgaatcggaatagtattggcgatgtgggctgctgccatctgtccgaggccctgagggcggcaacctccctcgaggaactcgacctgtctcacaatcagattggggacgcaggggtgcagcatctggcgaccattcttcccggactaccagagcttcgcaagattgacttgtctggcaactctatcagctctgccggaggggtacagctggcggaatccctcgtgctttgtcgccggcttgaagaactgatgttagggtgcaatgcattgggggacccaacggcactgggtctggcccaggaactcccacaacacctaagagtgctacatctccccttttcccacctggggcccggtggtgcgctgagcctcgcccaagcgctggacggctctccacacctggaagaaattagcctggcggagaacaatctggcaggcggggtgctccgcttttgtatggaactccccctcctgcggcagattgacctcgtgtcctgcaaaatcgacaatcagactgcaaaacttttaactagctcattcaccagctgtccggccctcgaagtcatcctgctcagctggaatctgctgggtgatgaagccgcagctgagctggcacaggtactccctcagatgggacgacttaagcgggtggatcttgaaaagaaccagattacggctctgggggcctggcttctggccgaaggactggcgcaaggaagctccatacaggtgattcgactgtggaacaatcccataccatgcgacatggctcagcacctcaagtcgcaggaacctcgattggatttcgcttttttcgataatcagccgcaagctccgtgggggacatag

SEQ ID NO: 31602 - DNA, 2553 bp, Artificial Sequence
  Description of Artificial Sequence: Synthetic coding sequence
atggcatctccaaaggttaataaagacaccttgacgcaatatgttaccctgcactctagatgggtacagaggacgaaggccaggctagggctctctgatcaccttcctaccttcctggccggcttggcaagctgtacatgtcgaccatttctatctcaccttgcccagggcaacgaggattgtgtcggcgctaaacaggctgccgtggtgcaggtgttaaagaaactggccactaggaaactcacaggccctaaggtagtggagctttgtcattgtgtagacgagactcaggagcctgaactggcaagtctgacagcgcagtccctgccctatcagctgcctttccacaactttccattgacctgtacagatcttgccactctaaccaacatcctcgaacatcgtgaagctcctattcacctagattttgatggttgtcccctcgagccacactgtcccgaggctctggttggatgtggccaaatagaaaatctgagtttcaaatctcgcaagtgcggagatgcatttgccgaagccctctcccgtagcctacccacaatgggcagattgcaaatgctaggcctggccgggagcaagattacagcccggggaatttctcacttagtgaaggccctaccactgtgtccccagcttaaggaggtcagttttagagacaaccagttgtcagaccaggtggttcttaatatcgtcgaagtcctgccgcatttgccccgcctgaggaaactggatctcagttccaatagcatctgtgtttcgacactgttgtgtctcgccagagtggccgtaacctgtccgacggtacgaatgttgcaggctagagaggctgacctaatcttcctcctcagcccacctacagaaactaccgccgaacttcaacgcgcccctgacttacaggagtccgacggacagagaaaaggcgcccagtctcgatcgctgaccttgaggcttcagaagtgccagctgcaggtccacgacgccgaagccttaatcgccttactgcaggaaggtccacacttagaggaagtggatcttagcggcaatcagctcgaagacgaaggctgtcgcctaatggcagaagctgcctcacagctccatattgcaagaaaacttgacctcagcaacaacggcctgtctgtcgccggcgtccactgcgtgttaagagctgtcagcgcctgctggaccctggcagaactgcatatttctttgcagcacaagacagtcatattcatgttcgcacaggaaccagaggaacagaaaggcccccaggagagagcagcattcctggactctttaatgttgcagatgccctctgagctccctctgagttctcgacgtatgcgattaacccactgcggattgcaagagaagcaccttgaacagctgtgtaaggctttaggaggaagttgtcatttgggccatctacacctggatttctctggaaacgctctcggcgacgagggcgcggccagattagcccagctcctccctggactgggtgcgctacagtcgctgaacctgagcgaaaacgggctgagcctcgacgcggttttaggcctggtaaggtgtttctccacattgcagtggctctttaggctcgacatctctttcgaaagccagcatattctcctccgcggcgacaagacgtcttccttgtccgaatgtccattggagccaccctcactgactagactctgtgcgacccttaaggactgccctggacccctcgaattgcagctatcctgcgagttcctatccgaccagtcccttgaaacgctgctggattgccttccgcaactgccgcagttgtcattactgcagttatctcaaaccgggctgtcacccaagtctccctttctgctggcaaatacattatctctgtgtcctcgggtaaaaaaggtagatctcagatccctgcaccatgcaacactccacttccggtctaacgaagaggaggagggggtgtgctgcggctttaccggatgcagtctgtctcaggaacatgttgagagtctgtgctggcttttgagcaagtgcaaagatctttcccaggtggatctcagcgcgaacctccttggagacagtggtttgaggtgtctgctggaatgcctccctcaagttccgatttctggattgctggatttgagccacaatagcatctcacaggaatcagcactctatctgcttgagacgcttccaagctgcccccgtgttagagaggcctccgtgaatctcggttccgagcagtctttccggatccacttttcaagagaagatcaagctggtaaaacactcaggctgagtgaatgctccttccggccagagcacgtgtctcgcctagcaacagggctgtcaaagagcctgcagctgactgaacttacactcactcagtgttgtctcggacaaaagcagctagctattctgctgagcctcgtcggtcgacccgctggacttttctcgctgcgcgacagcactcgccataccgagaagctcagctttcccacccttgaggcctgcgccctgggctttaagtag

SEQ ID NO: 31603 - DNA, 4656 bp, Artificial Sequence
  Description of Artificial Sequence: Synthetic coding sequence
atggatccggtcggtctccagctgggcaataaaaatttgtggagttgtcttgtacgactcttaactaaagaccctgaatggctgaacgccaaaatgaagttcttcctccctaacaccgatctcgactcccggaatgagacactggacccagaacagcgcgttatccttcaacttaataagctgcacgttcagggcagcgacacctggcagagctttatccattgcgtctgcatgcagctcgaggtcccactcgatctggaagtgctgctgcttagcacatttggctacgatgacggatttacttcacagttgggggccgagggaaagagccagccagagagtcagctccaccacggtctgaagcgaccgcatcagagctgcggttcaagcccacgcaggaagcaatgcaagaaacaacaactggaactggccaaaaagtacttgcagctgttgcggacctctgcgcaacagcgttatagaagtcagatccccggcagtgggcagcctcacgctttccatcaggtatatgttcccccaatcctgagacgggcaacggcgtctcttgatacccctgagggggcgattatgggcgacgtcaaggtagaggatggggctgacgtcagcatctccgacttattcaataccagagtgaataaaggtcccagagttaccgttctgttgggcaaagccggtatggggaagaccactctggctcacaggctgtgccagaagtgggccgagggtcatctgaactgcttccaggcgctattcctgtttgaattcagacagcttaatcttatcactaggtttctcaccccatccgagctgctgttcgatctgtatctcagccctgaatcagaccacgataccgtcttccagtacctagagaaaaatgcggatcaggttctgcttatctttgacggcctggatgaggccctacaacccatgggtcccgacgggcctggtcctgtcttgactctgtttagccacctctgcaacgggaccctgctgccaggctgccgcgtgatggccacttctcggcctgggaaactgcctgcatgtttgccagctgaggcagccatggttcacatgttaggttttgacggacccagagtcgaggagtatgtcaaccacttcttcagcgcacagccctctagggagggcgcactggtggaactgcagacaaatggccgtctccgcagtttatgcgcagttcccgccctgtgtcaggtcgcctgcctctgtctacaccacctcctgccagatcacgcccctggccagtctgtggctctcctgccaaacatgacccaactctacatgcagatggtgctggcactttcccccccagggcacctaccgacctcttctctgctcgatctcggcgaggtggctctcaggggcctggagacggggaaggtgatattctatgctaaagacattgcccccccactgattgcatttggagcaacgcacagccttttaaccagtttttgcgtttgtacggggcccggtcaccaacagacaggctacgcgttcactcacctgtcgctgcaggaatttctggcagctttgcacctgatggcttcgccaaaggtgaacaaagacacactgacccaatatgtgactctccactctaggtgggtgcagcggacaaaggccaggctgggcctgtcagaccatttgccaaccttcttagcaggactggcctcatgtacatgcagacccttcctctcccaccttgcccagggaaacgaagattgcgtgggtgccaagcaggcagctgtggtccaggtcctcaagaagttagcgacaaggaagttgaccggcccaaaagtcgtggagctttgtcactgcgtcgacgagacgcaggaaccagaactggcgtcccttacagcccagtctctgccctaccagctccctttccataactttccgttgacttgtaccgaccttgctaccctgacaaatatccttgaacaccgggaagcccccattcatctcgattttgatgggtgtccccttgaaccccactgccctgaggcactggttggctgtggacagattgagaacttgagcttcaaatcaaggaaatgtggcgatgcgttcgccgaagctctctcccggtcattgccgactatgggcagactgcaaatgctcggcctcgctggaagcaaaatcacagccaggggcattagccacttggtaaaggccttacctctgtgtccacagctgaaggaggtcagttttagggacaatcagctgtccgaccaagttgtgcttaatatagtcgaagttctaccgcatctcccacgcctgagaaaactggatctgagcagtaacagtatttgcgtcagtacactcctgtgtctggcaagagtagcggtcacctgccccacggtgcgcatgctgcaggcccgggaggccgatctgatcttcctcctgagccctcccaccgaaacaaccgccgagcttcagcgagctcctgacctgcaggagtccgatggccagcggaaaggggcccagtcacggagcctgactctgcgactacaaaagtgtcagctacaggtgcatgacgccgaagcccttatcgcactgctccaggaagggccccacctggaggaggttgatcttagtggcaatcagcttgaagacgaagggtgccggctaatggcagaggctgcttctcagctgcacattgcccggaagcttgacctcagtaacaacggactgtctgtcgcaggcgtgcattgtgtactccgtgctgtgtctgcctgttggacacttgccgagcttcatatctccctgcagcataaaacagtgatattcatgtttgcacaggaaccagaggagcagaagggcccacaagagcgtgccgctttcctcgactcactgatgctgcaaatgcccagtgaacttcccctatcctctcgtagaatgcgccttacacactgcggacttcaggagaagcacctggagcagctgtgcaaagctcttggcggttcatgtcacctgggacacctgcatttggacttcagcggcaatgccttaggagatgagggcgcagctaggctggcccagctcttgcctggtctgggggctctgcagagcctcaacctgtctgaaaacggcttgtccctggatgccgtcctcgggctcgtgaggtgcttcagcaccctgcagtggctgttcaggttagacatctctttcgagagccaacacattctgctccgcggcgataagaccagccgggatatgtgggcgaccggatcactaccagattttcccgctgcagctaagttcctggggttcagacaacgctgtatacctagatcactttgcctctccgagtgccctctggaaccgccttccctgacccgcctgtgtgctaccctcaaggactgccccggacctctggagctgcagctttcctgcgaatttctgtcagatcagtccctggagacactgttggactgtttgcctcagcttccccagcttagccttttgcagctgagccagaccggactctcaccaaagtctccatttctcctggccaacactctgtccctttgtccgagggtgaaaaaagtagatctaagatcactgcatcatgccacacttcactttcgcagtaacgaggaagaggaaggtgtatgttgcgggcgtttcacaggatgcagtctcagtcaggagcatgtcgagtcactatgctggctcttgtctaagtgcaaggatctgtctcaggttgatctgtctgctaaccttctcggtgattccggtctgcggtgcctgctggaatgcctgcctcaggttccgataagcggacttctcgatcttagtcataattctatctcccaggaaagcgcattgtacctcctggaaactctccctagttgccctagagtgcgagaggcatccgtcaacctgggtagtgagcagtcctttcgcatccacttcagccgggaggaccaggccgggaagacactgagactctccgaatgctcattccgccctgagcacgtaagccgccttgccaccgggctgtccaagtctctgcaacttaccgagcttacccttacgcagtgctgtctgggtcagaagcagttggctatattgttaagtttggtgggtcggccagctggtctgttcagtctgcgagtgcaggaaccctgggccgatcgcgctcgtgtgttaagtctgctggaggtatgcgcacaggcatccggaagtgtgactgagattagcatctctgagacacaacaacagctgtgtgtccagttggaatttcctcggcaggaggaaaatcctgaggctgtggccctgagactggctcattgcgatctaggcgcacaccactcccttttggtaggtcagctgatggaaacgtgtgccaggctccagcagcttagcctgtcacaagtgaatttatgcgaggacgatgatgcttcaagcctgcttttgcagagcctgttactgagcctctccgagttgaaaacctttcggatccagagtagtcaggatcccggcaggctgctccctgatttgttacccttcgatcctcatcaggcagacctgcagttgtgtgaacataggggtccaaggccccctggcatatggagtggtcccctcccaccccttggaggagctgggcttgtgtag

SEQ ID NO: 31604 - DNA, 60 bp, Artificial Sequence
  Description of Artificial Sequence: Synthetic coding sequence
atggacccagtgggccttcagttgggaaacaaaaatctctggagctgcctcgttcgctag

SEQ ID NO: 31605 - DNA, 225 bp, Artificial Sequence
  Description of Artificial Sequence: Synthetic coding sequence
atggatcccgtaggactgcaattgggaaacaagaacttgtggagctgtttggtacgcctactgactaaggaccctgagtggttaaatgctaagatgaagtttttcttacctaatacagatttggacagtcggaacgagacgctcgacccagagcaacgtgtaattcttcagcttaataagctccatgtgcagggtagcgatacatggcagtctttcatccactag

SEQ ID NO: 31606 - DNA, 1968 bp, Artificial Sequence
  Description of Artificial Sequence: Synthetic coding sequence
atggccatggcaaaagccagaaagccacgggaggcactcctatgggcactttcagatctcgaagagaatgacttcaaaaagctaaaattttacctgagggacatgacactgagcgagggtcagcccccactggccaggggagagcttgaaggactgattccggttgacctcgcggaactgttgatttcgaaatacggagagaaagaggccgttaaagttgtcctgaaaggtctcaaagtcatgaatctcctggaactcgttgaccagctctcacacatctgcctacacgattatcgcgaagtatatcgcgagcacgttcgttgtcttgaggagtggcaggaagccggagttaatggcagatataatcaggttctgttggtggcaaagccgtcttcagagagccccgagagcctggcttgtccgtttcccgagcaggaactcgagagcgttacagtagaagcgcttttcgattcaggcgagaaaccctcgctggccccatccctggtggtgctccaaggaagcgccggcacaggaaagaccacgctcgctcgaaaaatggtgctcgactgggccacaggtacgttgtatcccgggaggttcgactatgtgttttacgtttcgtgtaaagaggtggtactcctactggagagcaaactggagcagctcttgttctggtgctgtggagacaatcaagctcccgtcaccgagattctgcgccagccagagcgactgctgttcatcttggatgggtttgacgagctccagagacccttcgaggaaaagcttaaaaaacgcgggctgtctccgaaggagagcctacttcacctgctgatcaggagacataccctccccacttgtagtctcctgatcaccacccgacccttggccttacgtaacctcgaacccctgttaaaacaggcacgccatgtgcacatcttggggtttagcgaagaggagagagcaagatattttagcagctatttcacggacgaaaaacaggctgaccgcgccttcgatattgtgcagaaaaatgatatcctctataaggcatgtcaggtgcccggtatctgctgggtcgtgtgctcctggctgcaagggcaaatggagcgcggcaaagttgtgctggagacaccacgtaacagcaccgacattttcatggcttacgtttccacttttctacctcccgatgatgacggggggtgctctgagctttcgcggcatcgggttttgagatcactgtgctccctggccgcagagggcattcagcaccagcgctttcttttcgaagaagccgagctccgcaagcataacctggatggtccgagactggcagctttcctgtcctctaatgattatcaattaggcttagccattaagaaattttatagcttcaggcatatttccttccaggatttttttcacgccatgagctacttagtgaaagaagaccagagtcgacttggtaaggagtcgaggagagaggtccaaaggctcctggaggtgaaggagcaggagggtaatgatgagatgaccctcaccatgcagttcctgctcgacattagcaagaaggattccttttcaaatttggagctcaagttctgctttcggatttccccatgcctagcccaggatctgaaacatttcaaagaacagatggaaagcatgaagcacaatcgtacttgggacctcgagttttctctgtatgaagccaaaataaaaaacctggtaaaagggattcagatgaacaatgtctcctttaaaattaaacactcgaatgagaagaaatcacaaagtcaaaacctcttcagtgtgaagtctagtctttcgcacggccccaaagaggagcaaaaatgccccagtgtgcacggccagaaagagggaaaggacaacatagctggcacccaaaaagaggcttcaacaggaaaaggcaggggtacagaagaaactccgaagaacacctacatttag

SEQ ID NO: 31607 - DNA, 201 bp, Artificial Sequence
  Description of Artificial Sequence: Synthetic coding sequence
atggctatggccaaggcacggaaaccccgcgaagccctgctgtgggctctaagcgatttagaggaaaacgactttaaaaaactgaagttttatctcagagacatgacgttgtccgaaggtcaaccaccactggccaggggagagctggaaggactcatccccgttgacctcgccgagttgctgatctctaagtatggatag

SEQ ID NO: 31608 - DNA, 2940 bp, Artificial Sequence
  Description of Artificial Sequence: Synthetic coding sequence
atggccgagtccgactcgacggatttcgacctcttatggtacttggagaacctgtcagataaggagttccaatcctttaaaaagtacttggccaggaaaatactggatttcaagctgccacagttccctcttattcagatgaccaaggaagaactcgccaacgtgctgcccatttcctatgaggggcaatatatctggaatatgctattctcgatattttctatgatgcggaaagaagacctctgccggaagatcattgggagacggaacagaaaccaagaagcctgtaaagccgtgatgcgtagaaaatttatgttgcagtgggagtcgcacaccttcggaaagttccactacaaattcttccgggacgtgtcctccgacgttttttatattctgcagctggcctatgattcaaccagctactatagtgcaaataatttgaacgtgtttttaatgggagagcgggctagtggtaagaccatcgtcatcaatctggccgtgcttcggtggattaagggagaaatgtggcagaacatgataagctatgtggttcacttaaccgcccatgaaatcaaccagatgacaaactccagcttagctgagcttattgccaaggattggccggacgggcaagcccccatcgccgacatcctgagtgaccccaaaaaactattattcatcctagaagacctcgataatattcgttttgagctcaacgtgaatgagtctgccttatgctccaactcaacgcagaaagtcccaatccccgtcctactggtgtctttgctgaagagaaagatggctcccgggtgctggtttctgatttcaagccggccgacaaggggaaataacgtgaagacattcctaaaggaggtggactgctgtacaaccctgcagctgagcaatgggaagcgtgagatctattttaatagcttcttcaaagatagacagcgagcctctgccgcacttcagttggtgcacgaggatgagatcctggtcggtttgtgtagggtcgcgattctgtgctggattacatgcacagtgttaaagcgtcagatggataaaggccgcgactttcaactgtgctgccaaactcccacagatctgcatgcccacttccttgccgacgccctcaccagtgaggccggtctgacagccaatcagtatcacctgggtctgctgaaaagattgtgcctccttgcggctgggggtctattcctgtctaccctgaattttagcggcgaggacctcagatgtgtcgggtttaccgaagcagatgtgtcagtgctacaggccgcaaacattctcctgccatccaacacacacaaggataggtacaagtttatacacttaaatgtacaggaattctgtacggcgattgcctttctgatggcagttccgaattatctgattccgtctggatctcgcgaatataaagaaaagcgagaacagtattccgactttaaccaggtttttacctttatattcggcttgcttaatgccaatagacgcaagatactggagacctcctttggataccagttacctatggtggactcttttaagtggtacagcgttgggtatatgaagcatctggacagggacccggaaaaactcactcaccacatgcctctcttctattgtctgtacgaaaacagagaggaagaatttgtgaagacaatagtggacgcccttatggaagtgacggtatatctccagtccgataaagatatgatggtctccctctattgtttagactactgctgccacctccgcacgctcaagctgtccgttcaaaggatattccagaataaggaaccactgattcggccaactgcccgattgagttacgtgtcaacagcttccggtttcgaggacctgctgaaggccctcgcgaggaatcggtcactgacttatctctcaatcaactgtacctcaattagtcttaatatgttttcactcctgcacgatattcttcacgagccaacatgtcagatcagccacctttctctaatgaagtgtgacctaagggcttcagaatgcgaggagattgcctcactgctgatatccgggggctctctccgtaaattgactttgtcctcaaacccactgcgcagcgatggcatgaatatattgtgtgatgctctgttacatcccaactgtacacttattagtcttgtacttgtcttttgctgtctgactgagaactgctgtagcgccctgggccgtgtcctactgtttagcccaaccttgaggcagctcgatctgtgtgtgaacaggctcaagaattacggcgttttgcatgtaacctttccattgctgttccccacctgtcaactggaggaattacatctgtcagggtgctttttctctagtgatatctgtcagtatatcgccatcgtgatcgccactaatgaaaaactgaggtcattggagatcggctccaataagatcgaggatgctggcatgcagctgctgtgcggggggttacgccaccccaactgcatgctggttaatatcggcctcgaggaatgcatgcttacatccgcatgctgtcggtcacttgcatctgtcctgacaactaataagacattagaaagactcaacctgctgcagaatcacctggggaatgatggagtggccaagcttcttgaaagcctgatttctccggattgcgttctaaaagttgtcggcctgccactgactggcctgaacacccagacacagcagctgcttatgaccgtgaaggaaaggaagccaagcctgattttcttatctgagacatggtctcttaaagaaggccgggaaatcggcgttacacccgcttctcagcctggcagcattatcccaaacagcaacctggattatatgttcttcaaatttccgcgcatgagtgcggccatgagaactagtaatacagcttcgcggcaacctctatag

SEQ ID NO: 31609 - DNA, 3102 bp, Artificial Sequence
  Description of Artificial Sequence: Synthetic coding sequence
atggcagaatcagactctaccgacttcgacctcctgtggtacttggaaaacttgagtgataaggagtttcagagctttaaaaaatacctggcacggaagatccttgacttcaaactacctcagtttcctttaatccaaatgacaaaggaagaactggcgaacgtcctacctatctcttacgagggccagtacatctggaatatgctttttagcattttcagcatgatgcgaaaggaagacctctgtcgaaaaattattggtagacgcaaccggaaccaagaagcctgcaaggccgtgatgcgacgcaagtttatgctccaatgggagagccacacgttcgggaagtttcattataagtttttcagggacgtttcctcagacgttttttacattttgcagttagcctatgacagtaccagttattactcagccaacaacctgaacgtgtttttaatgggggagagggccagcgggaagaccattgtcatcaacttggcggtacttcggtggataaagggagaaatgtggcaaaatatgatcagctatgtcgtacacttaaccgcccatgaaataaatcagatgacaaatagcagcctcgccgaactcatagctaaagactggcccgacggccaggcacccatcgccgacatcttgagtgatccgaagaagctgttgttcattcttgaggacctggacaatatccgtttcgagctcaacgttaacgaatccgcactctgcagcaattccacccagaaagtgccgatccccgtgttactggttagcctgctgaagaggaaaatggcccccgggtgctggtttctgatctcatcccgccccacccgtggcaacaatgttaaaactttcctgaaagaggtggattgctgcaccacgctgcagctgtctaatgggaaacgtgagatctatttcaactcgttttttaaggaccgccagcgggccagcgcagcactccaactcgtgcacgaagacgagattcttgtcggtctctgtcgggtggcgatcctttgctggattacttgcacagtgctaaagcggcagatggataagggtagagactttcagctatgttgtcaaacacctaccgacttgcatgcacattttctcgccgatgccctgaccagtgaagctggtctgactgctaaccagtatcacctgggcctgttaaagcgactgtgcctgctcgcggccggcggactgtttctcagcactctgaacttctccggcgaggatctgcggtgcgtaggcttcaccgaggccgatgtttcagtcctgcaggccgccaacatcttgctgccgagcaatacccataaagatcgatataagttcattcacctcaacgtccaggaattttgcactgccatcgcgtttcttatggcagtgccaaattacctgatcccaagtggctctagggagtacaaggagaaacgagaacagtacagtgacttcaatcaggtgttcacgtttatctttggccttctgaatgctaataggcgcaagatcctcgagacttcttttggctatcagctgcccatggtagactcttttaaatggtattccgtgggatatatgaaacatttggaccgggatccagaaaagcttactcaccacatgcctctgttctactgtctttacgagaaccgagaggaagaattcgttaagactatcgttgatgcactgatggaagtgactgtttatctccaatctgataaggacatgatggtcagcttgtattgcttggattattgttgccacttgcgcactctgaaactgagtgtccaacggatttttcagaataaagagccacttatcaggccaacagccagccagatgaaaagtctggtctattggagggaaatttgctccttgttttacactatggagagcctgagggaactacacatctttgacaacgatctgaacggaatttctgagagaattctttccaaagcgctggaacactctagttgtaaactgcgaacactgaaactctcatacgtcagcacagcctctggtttcgaagatctgctcaaggcgctggccagaaacaggagtctgacctatttgtcaataaattgcacatcaatctctctaaacatgttcagcctccttcacgacatccttcacgagcctacatgccagatttcacatttatcccttatgaaatgtgatctcagagctagtgagtgcgaggagatcgccagcctgttgatcagtggaggaagtctacgcaaacttaccctgtcatcaaacccactgcgctcggacgggatgaacatcctgtgcgacgctttattgcatcctaattgcactctcatatccctggtgctggtgttctgttgtctgactgagaactgttgcagtgccctggggcgggtgttgcttttcagccccacactcaggcagttagatctctgtgtgaacaggctcaaaaattacggcgttctgcatgtgacctttcctcttttgttcccaacgtgccagctcgaagaattgcatctgtctggatgcttcttttctagtgacatttgccagtatattgccattgtgatcgctaccaatgaaaagttgcggagcctggagatcgggtccaacaaaatcgaggacgctggtatgcaacttctctgcggtggtctgagacatcctaattgtatgctggtgaacataggtttggaggagtgcatgctaactagtgcctgttgtaggtccctggcttcagtcctgaccacaaacaaaactctggagcgcttgaatcttctccagaatcatctgggtaatgacggggtcgccaagctgctggaatcgttgatctcaccggattgtgtgctgaaggtggtgggcctcccactcactgggcttaacacgcagactcaacaactccttatgaccgtgaaggagagaaagccttcccttatctttctgagtgagacctggagcctgaaggagggacgggagattggagtgacaccagccagtcagccagggtccatcattcccaactccaacctagactatatgttttttaaattcccacgaatgagcgcagccatgagaacaagcaataccgcatcgcgtcagccactgtag

SEQ ID NO: 31610 - DNA, 3132 bp, Artificial Sequence
  Description of Artificial Sequence: Synthetic coding sequence
atgaacttcagtgtcataacctgtcctaatggaggaacaaatcagggattgctgccatacttgatggcgttagaccagtaccagctcgaagaatttaagctgtgtctggaaccccagcaacttatggacttctggtccgcaccccagggccactttccaaggattccatgggcgaatctccgtgcggctgatcccctgaatctgagtttcttgctggatgaacactttcccaaaggccaggcatggaaagtggtgctggggatcttccagacaatgaacctgacctctttgtgtgaaaaagtacgagccgagatgaaagaaaatgtgcaaacacaagagttgcaggaccctacgcaggaggatctcgaaatgctggaggcagccgcgggaaacatgcagacccaaggttgccaggatcccaatcaggaggaattggatgagctggaggaggaaactggcaacgtacaggcgcagggttgtcaggatcccaaccaggaagaaccagagatgctggaagaagcagatcaccggaggaagtacagagaaaatatgaaagctgagctgttagaaacctgggacaatatcagttggcctaaagatcacgtctatattagaaatacttcgaaggacgaacatgaggagctccagcgtttgcttgacccaaatcggacccgcgctcaagcccagactattgtgctggtcgggagggcaggcgtcgggaagactacacttgcaatgcaggcgatgctgcactgggccaacggtgtgctgttccagcagaggttcagctacgtgttctatctctcctgccacaaaattcggtatatgaaagagaccaccttcgccgagctgatctccctcgactggcccgacttcgacgcccctattgaggagtttatgagccaaccagagaaactgttgttcattatcgatggcttcgaggaaatcattatatccgagagcaggtcagaaagtctggacgatggtagcccttgcactgattggtatcaggaacttcctgttaccaaaatactgcatagcctgcttaaaaaggagttggtcccgctggcaaccctcctgattactatcaaaacgtggttcgtccgggatctgaaggcctctctagtgaatccttgttttgttcaaataacgggatttactggggatgatttaagggtatatttcatgcggcactttgacgactcttctgaagttgaaaagatcctacagcagctcaggaagaatgagacactttttcactcctgcagcgccccaatggtgtgttggactgtgtgctcatgtctcaagcagcccaaagtgagatattacgatctgcagtctattactcagacaactacttcgctgtatgcgtacttcttttcaaatctgttcagcactgctgaggttgatctggctgacgatagctggcctggccagtggagagcgctgtgcagtctggccattgaaggcctgtggtctatgaattttacatttaataaggaagataccgagatagaaggactggaggttcccttcattgattccctttatgagttcaacattctgcagaagattaatgattgtggcggatgcaccactttcactcacctgtccttccaggagtttttcgcggccatgtcttttgtattggaggagccgcgggagtttccacctcacagcacaaagcctcaggagatgaaaatgctcctgcaacatgtgttgctagacaaagaagcttactggacacctgtcgtgctgttcttcttcggattactgaacaagaacatagcacgcgagcttgaagacactctacactgtaagatcagcccccgggtcatggaagaattgttgaaatggggagaagagcttggtaaagccgaatccgcctcactccagttccacatactccgcctatttcattgtctgcacgaatcccaagaagaagactttactaagaagatgctgggtaggatctttgaggttgacctgaacatactagaggatgaggaactccaggcatccagcttctgtctcaagcactgtaagcggcttaacaagctgcgcctctcggtgtctagccatatcttggaaagggatctggagattctggaaaccagcaagtttgatagccggatgcatgcatggaattctatctgtagtaccttagtcacaaatgagaaccttcatgaactcgacctgtccaacagcaaactgcatgcaagctccgtgaagggtctttgtctcgcacttaaaaaccctcgatgcaaggtgcagaaactcacttgtaaaagcgtcactccagaatgggtgctccaggatttgatcatagcgctgcagggaaactctaaacttactcaccttaatttctcttccaataaactgggcatgacagtgcccttgattctgaaggcccttaggcattccgcctgtaatctgaaatacctgtgcctggagaagtgcaacctttccgccgctagctgtcaggatctggcactgtttctgacctcaatccagcacgtaactcgactatgtctcggatttaataggcttcaagacgacgggattaaactcctgtgtgcagccttgacacaccctaaatgcgctctggaaaggctggagctctggttctgtcaactcgcggctcccgcctgcaagcatctgagcgacgccttactgcaaaacagatcattgacacacctcaacctgagcaagaactcactcagagatgaaggagtgaaattcttgtgcgaggccttagggaggcccgacggcaacttgcagtctctcaatttatccgggtgctcttttaccagggaaggctgcggcgaactggcaaacgctctctcacacaaccacaatgttaagatcctggacctgggggagaacgatttacaggacgacggcgtgaagctgctgtgtgaggcacttaaacctcatcgggctctccacacgttaggcctggccaaatgcaatctgaccacagcttgctgccaacacctgttctctgtcctgagctcaagtaagtccctggtcaatctgaacctgcttggcaacgagctggacactgacggcgtcaagatgctctgtaaggcgctgaagaagtctacttgccggctgcaaaagctgggatag

SEQ ID NO: 31611 - DNA, 3282 bp, Artificial Sequence
  Description of Artificial Sequence: Synthetic coding sequence
atggcggacagttcatcatcaagtttttttccagattttggactccttttatacttagaggagctaaataaagaagagcttaacaccttcaagctgttcttgaaggaaacaatggagccagaacacggtttaacgccttggaatgaggttaagaaggccaggagagaggacttggcaaacctgatgaaaaaatattaccccggcgaaaaagcctggtctgtgtcactcaaaattttcggcaaaatgaatctcaaagacctgtgcgagagggcaaaggaggagattaactggtccgctcagacaattgggcccgacgatgccaaggccggcgagacccaggaggatcaggaagctgtgctcggcgacgggactgagtacaggaacaggataaaagagaagttctgtatcacgtgggataagaagtccctggcgggtaaacctgaggattttcatcatgggatcgcagaaaaagaccggaagctcctggaacaccttttcgacgtggacgtcaaaacaggtgcccagccccagatcgtggtacttcaaggcgccgctggtgtgggcaaaaccaccttagtccggaaagcgatgctggattgggccgagggaagcctgtatcagcagcgcttcaagtatgtgttttatctcaatggcagggagatcaatcagttgaaagagagaagtttcgcacagctaatctcaaaggactggccctccacagaggggccaatcgaagagatcatgtaccagccgtcaagtctcctgtttattatagacagttttgacgagttgaacttcgcctttgaggaacccgaattcgctctctgcgaggactggacacaggaacaccccgtgagtttccttatgtcaagtcttcttaggaaggtcatgctgcctgaagcttctctgcttgtaaccacaaggttaacaacatcgaaaaggctgaaacagctattgaaaaaccaccattatgttgaactcctcgggatgtccgaggacgcccgcgaggagtatatttatcagtttttcgaggacaagaggtgggccatgaaggtgttctcctctttgaaaagtaacgaaatgcttttctcaatgtgccaagtgccactcgtttgctgggctgcctgtacatgtctgaaacagcaaatggaaaagggaggagacgttactctgacctgccagaccacaaccgctctgttcacctgctatatatcaagccttttcacccccgtggatgggggcagcccctctttgccgaaccaagcacagctgaggagactgtgtcaagtggccgctaaaggcatctggacgatgacctacgtgttctatagggaaaacctgcgacgactgggcctcactcaatctgacgtaagtagcttcatggatagcaatattatccaaaaggacgctgaatacgaaaactgctacgtcttcacccacctgcacgtacaggaattctttgccgccatgttctacatgttgaagggatcctgggaagccgggaacccctcctgccagccattcgaggatctcaaatcattgttgcaatcaacatcttacaaagatccacacctgactcagatgaaatgctttctgttcggcttactgaacgaagaccgagtcaaacagctggaaagaacatttaattgcaaaatgtcactgaagattaaaagtaaactgcttcagtgcatggaggtgcttggaaactctgattactcaccaagccagcttggcttcctggaattattccattgcctgtacgaaacgcaagataaggcgttcatttctcaggcaatgcggtgttttcctaaggtggctattaatatctgtgagaagattcatttgctcgtaagtagtttttgtctcaaacactgccggtgcttgaggaccatacgactgagtgtcactgtcgtgttcgagaaaaaaatcctgaagaccagtctacccacgaacacctgggatggggacaggatcacccattgctggcaggatctgtgctccgtgctccacaccaacgagcacttgcgcgaacttgatctctaccacagcaacctcgacaagtcggccatgaatattcttcatcacgaactaaggcatccaaattgcaagctgcagaagctcctgctcaagttcatcaccttcccagatgggtgtcaagacatcagcacttccttgattcacaataaaaatctcatgcacctggacctaaaggggagcgatatcggcgataatggcgtaaagagcctgtgcgaagctctgaaacatcccgagtgcaagttgcagacactgagattggaaagctgcaaccttaccgtgttttgctgtctgaatattagcaatgccttgattagatcacaatctctgattttcctgaacctctccacgaacaatctgctggatgatggagtacagttgctgtgcgaggctctccgccaccctaagtgctatctggaaagactctccctggagtcatgcggcctcactgaagccgggtgtgaatacttatctctcgcgttaatctcaaataaacgtctgacacatctgtgcctcgccgacaacgtcctgggagatggcggcgttaaactgatgtctgacgcacttcagcatgcccaatgtacattgaagtcgttggtcctgcggagatgtcactttacctccctgagttccgagtacctatcaacctccctgctacataacaagtccctcactcacttggacttgggcagcaattggctgcaagataatggagtaaaacttctctgtgatgtctttcggcacccatcgtgtaaccttcaagatttggagctgatgggctgtgtgctcaccaacgcatgttgcctggaccttgcatccgtcatcctgaacaatcctaacctccgcagcctcgatctgggaaacaacgacctgcaggacgatggagttaaaatcctgtgtgacgcactgaggtatcccaactgcaatattcagcgcctgggcctggagtattgcggactcacctctctttgttgtcaggatctgagcagtgccctcatttgcaataagcgccttatcaaaatgaatcttacccaaaatacactgggctatgagggaatcgtgaaattgtacaaggtcctaaaaagccccaaatgtaaactccaagtcctcggcctgtgtaaagaggctttcgacgaggaagcgcaaaaactcctagaagccgttggcgtttccaacccccaccttatcattaaacctgactgcaactaccacaacgaagaggatgtgtcatggtggtggtgtttttag

SEQ ID NO: 31612 - DNA, 2985 bp, Artificial Sequence
  Description of Artificial Sequence: Synthetic coding sequence
atggcggcttcttttttcagtgattttggcctaatgtggtatctggaagagctgaagaaagaggagttcagaaaattcaaagaacatcttaagcaaatgacgcttcagctggagctgaaacagatcccctggactgaagtcaaaaaggcgagccgagaggagctcgcgaacctactgatcaagcactacgaagagcagcaagcctggaacattacccttcgaatcttccaaaagatggatagaaaggatctgtgcatgaaggtcatgcgcgaaagaaccggttacaccaagacgtaccaggcccacgctaagcagaaatttagccggctgtggagcagtaaaagtgtgacagagatccacctctatttcgaagaggaagtgaagcaggaggagtgtgaccatctggacaggctcttcgctcccaaagaggcaggtaaacaaccccgaacagttattattcagggtcctcaggggattggcaaaaccacccttctgatgaagctgatgatggcgtggtctgataacaagatcttccgcgacagatttctttatacgttttatttctgttgccgggagctgagggagcttcctcccacgtccttggctgacctcatcagtcgcgaatggccagatcccgctgcccccattaccgaaattgtctcccaacccgaacgccttctatttgtgattgacagctttgaggagttgcagggtggattaaacgaacccgatagcgacctatgcggcgacctcatggagaagcgacctgtccaggtgctgctgagctccctgctccggaagaagatgctccccgaggcatccttgcttatagcaatcaagcccgtttgccctaaagagctgagggatcaggtcaccatttccgagatttatcagcctagagggttcaacgagtccgataggctggtgtacttttgctgttttttcaaagatcctaagagggcgatggaagccttcaacctggtgagggagagtgagcaactcttctctatatgtcagatccctctcctttgttggatcttatgcaccagccttaagcaggaaatgcagaaaggtaaagacttggccctgacttgccagtccacaactagtgtgtactccagtttcgtgtttaacctgttcaccccagagggcgccgagggtccgactccccaaacccagcatcagcttaaggccttatgttctctggctgcagaaggcatgtggacagatactttcgaattctgcgaagacgatctgcgccggaacggcgtcgtggatgccgacatacctgcgctcttgggcacaaagatactcttgaagtacggggagagggaatcaagttatgtgtttctccatgtgtgcatccaagaattttgcgcggcactgttctatctcctaaaaagccacctggatcatccacaccctgctgtccgctgcgttcaggaacttctagtggccaactttgaaaaagcccggagagcgcactggatattcctgggttgtttcctcaccgggctgctgaacaagaaagaacaggagaagcttgatgccttttttggtttccagttatctcaggagataaagcaacagattcaccagtgtctcaaaagcctcggagagcgcggtaacccccagggccaggtggactcactggccatattttactgtttatttgagatgcaagacccagcttttgtcaagcaagccgtcaacctgctgcaggaagccaacttccatattatcgataacgtagatctagtggtttccgcttactgcctcaagtactgctcctcgctgaggaaactctgtttcagtgtgcagaatgtgttcaaaaaggaggacgaacacagctcgaccagcgattacagcctgatttgttggcaccacatctgctcggttctcaccaccagtggccaccttagagaattgcaggtccaggactccactctctccgagtcgacatttgtcacttggtgcaatcagctgcggcacccgtcttgcaggcttcagaagctggggattaataatgtcagtttctcgggtcagagcgtcctcctgtttgaggtacttttctaccaaccagatcttaagtatctgtccttcaccctcaccaaactgagccgtgatgacattaggtctctgtgtgacgcattaaattaccctgcagggaatgttaaagagttggcgctggtcaattgccacctatcgccaatcgattgtgaggtgctggctgggctcttgaccaacaacaaaaagctgacctatcttaatgtcagctgcaatcaactcgataccggggtgcccctcctgtgcgaggcgctttgtagtcccgacactgtcctggtttatctgatgctggccttttgccatctcagcgaacaatgctgtgagtacatatcagagatgctgttgcggaataagtcagtgagatacctggacctgagcgcaaacgtgttgaaggatgaaggcctgaaaacgttgtgtgaggctttgaagcaccctgactgctgtcttgatagcttgtgtttagtgaaatgctttatcactgctgcaggttgtgaggatcttgcaagcgctcttatctctaatcagaatttgaagatcctccagatcgggtgcaacgagatcggcgacgtcggcgtccagttgctgtgcagggcccttactcacacggactgcaggcttgaaattctaggcctggaagaatgcggcctcactagcacatgctgcaaggacctggcatctgtactgacatgcagtaagaccctgcagcagcttaatttaacactgaacactctggaccatacaggtgttgtggtgctgtgtgaagccctacgccacccagagtgtgcactgcaggtcctcggcttgcgcaagacagattttgacgaggagactcaggcactgctcaccgctgaagaagaacgcaacccaaaccttactattaccgacgactgcgatacgatcacacgggttgaaatctag

SEQ ID NO: 31613 - DNA, 2817 bp, Artificial Sequence
  Description of Artificial Sequence: Synthetic coding sequence
atggctgctagcttctttagtgatttcgggcttatgtggtacctcgaagaattaaaaaaggaagaattcagaaaattcaaggaacacttgaaacagatgacactgcaactggagctaaaacagattccatggaccgaagtgaaaaaggccagccgagaggagttagcgaatttacttattaagcactatgaagaacagcaagcgtggaatataactctgcgaatcttccagaagatggaccgaaaggacctctgtatgaaagtcatgcgggaacgaactggctacaccaaaacatatcaggcccacgctaaacagaaattctctcgtttgtggtccagcaaatccgtcaccgagatccacctctactttgaagaggaggtgaagcaggaagagtgcgatcaccttgatagactgtttgcaccgaaagaagccggcaaacagcctagaacagtgatcatccagggaccccagggcatcggcaaaaccaccctgctgatgaagctgatgatggcctggtccgacaacaagatatttagggatagattcttatacacattttacttttgttgccgggaactgagagaattacctcctactagcctggctgacctgatttcgagggagtggccggatccagccgctccaatcactgagattgtgagccaacccgaaaggctcctgttcgttattgatagttttgaggaactgcagggcgggctaaatgaacctgatagtgacctgtgtggcgatctcatggaaaagcggcctgtccaggttttgctgagcagtctcctaagaaaaaagatgctgcctgaggctagtctgttgattgctatcaagcccgtgtgccctaaagagctgcgcgaccaagtgaccattagtgaaatttaccagccccggggcttcaacgaatctgaccgactggtgtacttttgttgcttttttaaagacccaaagcgtgcaatggaagccttcaacctggtccgcgaaagcgagcagctctttagcatttgtcaaatcccgctcctgtgttggatactgtgcacctctctgaagcaggagatgcagaagggaaaggacttagcactcacatgccagtctaccactagcgtctacagcagctttgtctttaacctcttcacgccggagggagcagaaggtcctacacctcagacacaacatcagctgaaagccttatgctctctggctgcggagggaatgtggaccgatacttttgagttttgcgaggacgatttaaggcgcaacggagtcgttgacgcagatatcccggctttactgggcaccaagatcctactcaagtatggtgaacgtgagtctagctatgtgtttctgcacgtgtgcatccaggagttttgtgccgccctcttttacctgctgaagagccatctcgatcacccacatccagccgtgaggtgtgtacaggaactgttggttgccaacttcgagaaagcccgtagagcacattggatatttttgggatgctttctgaccggcctgctgaacaagaaagagcaggagaagttggacgccttcttcgggtttcaattgagccaggaaattaaacaacagatccaccagtgtcttaagtctcttggggagagaggaaatccacaaggacaagtagattccttagccattttctattgccttttcgagatgcaggatcccgcctttgttaagcaggctgtcaacctactccaggaggccaacttccacattatagataacgtagacctggtggtgtccgcttactgtttaaaatattgtagctctctgagaaaactttgcttcagtgtacaaaatgtgtttaaaaaagaggacgaacatagctctaccagcgactactccctgatttgctggcatcacatttgctcagtcctcaccacaagtgggcacttacgtgagctgcaggtgcaggactcaactctgagcgaaagtacttttgtcacttggtgcaatcagctacgccatccatcatgtaggctgcaaaagctggggataaataacgtgtctttctcagggcaaagtgtccttctgttcgaggtgctgttctaccagccggatctgaaatatctgtcgttcactctgaccaaactctctcgggatgatatcaggtccctgtgtgatgctttgaattatcccgccggcaatgtcaaagagctcgccctggccttttgccatcttagcgaacagtgctgtgaatatatttctgagatgttactccgcaataagtcagttcgatatctggatctcagcgccaacgtgctaaaggacgaagggttgaagaccctttgtgaagctcttaaacatccagactgctgtctggatagtctctgtctggtcaagtgcttcatcaccgctgccggctgtgaggatttagcctcggcccttatctctaatcaaaacctaaaaatcctgcagattggttgcaatgaaattggcgacgtgggggtccagctgctctgtagagcgctcactcacacagactgccgcctcgagattctcggcctcgaggaatgcgggctgacctctacatgctgtaaggatctggcctctgtcctaacctgcagtaaaacgctgcaacagcttaatctcacgctgaatactctggatcatactggcgtggtggtgctgtgcgaggctcttcgccatcccgaatgtgccctgcaggttctgggcttacgtaagacggactttgacgaagaaactcaggccctgctaaccgctgaggaggagcgcaaccccaatctcaccatcaccgatgactgcgataccatcacacgggtggaaatttag

SEQ ID NO: 31614 - DNA, 3114 bp, Artificial Sequence
  Description of Artificial Sequence: Synthetic coding sequence
atgacctcaccccagttggagtggaccctccagaccctgctagagcaattgaacgaagacgagctaaagtcatttaagtctctgctgtgggcgttccctctggaagatgttctccagaaaacaccttggtcggaggtcgaggaagccgatggaaagaaactggccgagatactggtgaacaccagctcagagaattggattaggaatgcaacagtcaatattctcgaggagatgaacctgactgagctctgcaaaatggccaaggccgaaatgatggaagatggccaggtgcaggagatagacaatccagaactgggcgacgccgaagaggactccgagctggcaaagcctggcgaaaaagagggctggagaaatagtatggagaaacagagtctcgtctggaagaacacattctggcaaggcgacatcgacaacttccatgacgatgtaacattaagaaaccagagatttatacccttcctgaaccctagaacaccgcgcaagctgaccccctatacagttgtactgcacggacccgcaggcgtggggaaaaccacactcgccaagaagtgcatgctggattggacagactgcaatctgagtccaacgctcagatatgctttctatttaagctgtaaagagctctcaaggatgggaccttgtagctttgctgagctgatctccaaggactggccggaacttcaggacgatattccaagcattctggcgcaggcccaacgtatcctgtttgtcgtggatggtctggatgaacttaaggtgcctccgggtgcacttatccaggacatctgcggagattgggagaaaaaaaaaccggtccccgttctgctgggtagcctgcttaagaggaagatgctccccagggccgccttgctcgtgactacacgccctcgagctctaagggacttgcaactcttagcgcagcagccaatttatgtgcgtgtggaaggtttcctggaagaagatagacgggcgtattttttaaggcacttcggcgacgaggatcaggcgatgagggccttcgagctcatgcggtccaacgctgccctcttccaactaggaagcgcaccagcggtgtgctggatcgtgtgcaccactctgaagcttcaaatggagaagggggaggaccctgttccgacttgtctcacccgcacgggtctgtttcttcgattcctctgctccaggttccctcagggggctcagctccgcggagcattaaggaccctgtctctactggccgctcagggcctatgggcccagatgagcgttttccaccgggaggacttagaacggttgggagttcaggagagcgacctcaggctgttcctggatggggacatactgcggcaagatcgggttagcaaaggatgctattcgtttatacacctgagcttccagcagtttctgacggcactgttttacgcactggagaaggaagagggggaggatcgcgacgggcacgcctgggacattggggatgtccagaaactcctttcaggagaggaaaggctaaaaaaccccgacttgatccaggtggggcacttcctgttcggactcgctaacgaaaagagagctaaggagctggaggccaccttcggatgccgtatgagccccgatatcaaacaggagctgcttcagtgtaaagcgcacctccacgccaataaaccattatctgttacagaccttaaagaggtccttggttgcctgtacgaatcccaggaggaggagctcgcaaaagtggtagtggcccctttcaaagagatctcgattcatttgactaatacatccgaggttatgcactgctccttcagcctcaaacattgccaagatctccagaaactgtcgctccaggtggcaaagggcgtattcctggagaattatatggatttcgaactggacattgagtttgaacgctgtacgtacctcacaattcccaactgggccagacaagacctgagaagcctgcggctctggactgacttttgcagcctattttccagcaattcgaatttgaagtttttggaggtaaagcaatcctttctaagcgattcctccgttagaattctgtgtgatcacgtgacccgcagtacctgccacctgcagaaagtggagattaaaaacgttacccccgacaccgcataccgggatttctgcctcgccttcattggcaagaagaccctaacccatctgaccctcgcaggacacatcgagtgggagcgcactatgatgctgatgttgtgtgatctcctgagaaaccacaagtgcaacttgcagtacctgcgcctcggaggccattgcgcaacgcccgaacaatgggctgaatttttctatgtactgaaggccaaccagagcttgaaacacctcaggctctccgccaacgtgctcctggatgaaggcgccatgttactctacaagactatgacacgcccaaagcacttcctgcagatgctctcccttgaaaactgccgactgaccgaagcctcgtgtaaggacctggccgcagtgctggtcgtgtccaagaaactcacacatctgtgcctagcgaaaaaccctataggagacactggcgtgaagttcctgtgtgaagggctttcctatcctgactgtaagttgcagaccctggttctgcagcaatgcagtatcactaagctagggtgtcgttacctcagtgaagcactccaggaggcttgcagtctcactaatctcgatctatccattaatcagatcgcaagaggcctgtggatcctctgccaggcattggagaaccctaactgcaacttaaagcaccttcggctgtggtcatgtagcctaatgcctttctattgccaacatctgggttctgccctgctgtccaaccagaaacttgagaccctcgacctgggccaaaatcacctgtggaagtctggtattataaagctattcggcgtactaagacaaaggaccggctcacttaagatactgcggctaaagacctacgagaccaatttggagatcaaaaaactcctcgaggaggtcaaagagaagaaccccaagcttacaattgattgcaatgcctcaggtgcaactgcacctccttgttgcgacttcttttgctag

SEQ ID NO: 31615 - DNA, 2943 bp, Artificial Sequence
  Description of Artificial Sequence: Synthetic coding sequence
atgacatctccacaacttgaatggacacttcaaacgttactggagcaattgaacgaagatgagctgaagagtttcaagtcactgctatgggcctttcctttggaggacgttcttcagaagactccatggtccgaagttgaggaggccgacggaaagaaactggccgaaatcttagtgaatacttccagtgaaaattggatccgtaatgcaactgtcaatatcctagaggagatgaatctgactgaactgtgcaagatggccaaggccgagatgatggaggacggccaagtgcaggaaatcgacaatcccgagctaggagatgcagaagaggactctgaattggccaaacccggagaaaaagaaggctggaggaatagcatggagaagcaatccttagtgtggaagaacacattctggcagggcgacatcgacaattttcatgatgatgtgactctgcgcaatcagcggttcatcccttttctgaaccctcggacgcccagaaaactgactccctataccgtggtgctgcacgggccggcgggtgttggaaaaactacactcgctaagaagtgcatgcttgactggacggattgtaatctctccccaacactgcgctacgcattttatttgagctgcaaagaactgagccggatgggaccttgttcattcgctgagttgatcagcaaggattggcctgagctgcaggacgacatcccaagcatcctggctcaggcccagcggattctgtttgtggtggatggcctggacgagctgaaggtcccgcccggggcactgatccaagatatctgtggcgattgggagaaaaagaagccagtgccagtgctgcttggcagtctgctgaaacgtaagatgctgccaagagctgcacttctcgtgactaccaggccacgggctcttcgagacctacagttgctagcacagcagccaatatacgtgcgggtagaggggttccttgaagaagaccggagggcttatttcctgcgccatttcggcgacgaagatcaagctatgcgtgccttcgaactgatgcgttctaatgccgccctgtttcagctgggctccgcgccggcagtgtgctggatcgtatgcaccactctgaaattacagatggaaaaaggggaggatcctgtaccaacatgcctgacccgaactgggctgttcttacgttttctgtgtagcaggtttccacagggggcccagcttagaggcgcccttcgaaccctctccctgcttgccgctcaaggactctgggctcaaatgtcagtgtttcaccgagaagatttggaacgcctcggtgtacaagagtcagacctgagactgttcctcgacggagacatcctccggcaggaccgcgtatctaaaggatgctatagtttcatccatttgtcctttcagcagtttctgaccgccctcttctacgcactggagaaggaagagggcgaggatagagacggccacgcctgggatattggagacgtacaaaagctcctgagcggggaagaacggcttaagaaccccgacttgatccaggtgggacactttttatttggtctggccaacgagaaaagagcaaaggagctggaagccactttcgggtgccggatgtccccagacatcaaacaagaactgttacaatgtaaggctcacctgcatgcaaataaacctttgagcgtgacagatctcaaggaagtcttagggtgcctctacgaatcccaggaggaggaacttgccaaagtggtcgtcgcccctttcaaggagattagcattcacctaaccaacacctccgaggttatgcactgcagtttttccctgaagcactgtcaggatctgcagaagctcagtctacaagtcgctaagggcgtcttcctggagaactacatggactttgagcttgacattgagtttgagcgatgcacatacctgactattccaaactgggcgcggcaggaccttcgctccttgcgtctctggacggacttctgctcattatttagctcaaacagcaatctcaagtttttggaagttaaacagtctttcctctccgatagttcagtccggatcttgtgcgaccatgtaacccggagcacatgtcacctccagaaagtggaaatcaagaacgtgacgcccgacacagcttatcgtgatttttgtctggcctttattggaaaaaagaccctaacccacctgactctggccggccacatcgaatgggaaaggactatgatgctgatgctctgtgacttactgagaaatcacaagtgcaatctgcagtatttaaggctgggtggacactgtgcaacgcccgagcagtgggctgagttcttctacgtgctgaaagcaaatcagagcctgaagcatctgagattgagcgccaacgtgcttttggatgagggagcgatgctcctttacaagaccatgacacggcccaagcattttctacaaatgctctcactggagaactgccgcttgacagaggccagctgcaaagatttggcggccgtcttagtcgtctcaaaaaagcttactcatctctgtctggctaaaaatcctatcggcgataccggagtgaaattcctgtgcgagggtctatcctaccctgactgcaagctacaaaccctggtcctgcagcaatgctccattacaaagctagggtgccggtatttatccgaggccctgcaggaggcttgctcactaacaaacctggacctctccatcaatcaaatcgcaagggggctgtggatcctatgccaggccctggagaacccaaactgtaacttgaaacacttaaggctcaaaacgtacgagacaaatctggaaattaaaaaactgcttgaagaggtaaaggagaagaatcccaagcttactatcgattgcaacgcgtccggtgctacagcccctccatgctgtgattttttctgctag

SEQ ID NO: 31616 - DNA, 2019 bp, Artificial Sequence
  Description of Artificial Sequence: Synthetic coding sequence
atgacctccccgcagctcgaatggaccctgcagaccctgctcgaacaacttaacgaggacgaactgaagtcattcaaatcattgttgtgggcctttccactggaggacgtgctacagaagactccatggtccgaggttgaagaagccgatggtaaaaaactggcagagatactggtgaatacaagttccgagaactggatcagaaacgctacagtcaatattctggaggagatgaacttgaccgagttgtgcaagatggcgaaagccgaaatgatggaggaggacaggcgggcctattttttaaggcatttcggcgatgaagaccaggccatgagagcgtttgaattaatgaggtccaatgccgccctgttccagctcgggagcgctcccgcagtctgctggatcgtttgtactactttgaagctgcaaatggaaaaaggcgaggaccccgtgcctacctgcctaacgaggactggtctcttcctcaggtttctgtgctcccgttttccccagggagcccaactgaggggagctctgcggacgctttctctactggccgcccaggggctgtgggcacagatgagtgtttttcacagggaagatctggaaagactgggtgtacaggaatcggacctgagattgtttctggatggcgacatcctgcggcaggaccgggtcagcaaagggtgctatagcttcattcatttgtctttccaacagttcctcaccgcactattctacgcactcgaaaaggaggagggggaggacagggacggccatgcgtgggatatcggggacgtccaaaaactcctcagtggcgaggagaggctgaagaaccccgacctcattcaagtcggccatttcctgtttgggttggctaatgaaaagcgggccaaggagctggaagccaccttcggctgtaggatgagtcccgacattaaacaggaactgcttcagtgcaaagcacatttgcacgctaataaacccctgtcagtcactgacttgaaagaggtcctcggatgtttgtatgaaagccaggaagaggaactcgcaaaagtggtggtggccccattcaaagagattagcattcacctgaccaacacctctgaggtgatgcactgcagcttcagcctgaagcactgccaggaccttcagaagctcagcctgcaggtggctaagggagtgtttctggagaattatatggacttcgagctcgatatcgagttcgaacgatgtacttacctgacaatcccgaactgggcccgtcaggacctgcggtctctccgcctgtggaccgacttctgctctctgtttagttccaactctaatctgaaatttctggaggttaagcagtcatttctctcagacagtagcgtcaggattctgtgcgatcatgtcacccgcagcacatgtcatctccaaaaggtagagatcaagaacgtgactccagacactgcttacagggatttctgccttgctttcatcgggaaaaaaactctgactcatctgacgctcgctggtcacattgagtgggagagaaccatgatgctcatgctctgtgacctgcttaggaaccataagtgtaacttacagtatctgcggctgggcggacattgcgccacccctgaacaatgggccgagtttttttatgtgttgaaggcaaatcagagcctgaaacacctccggctgtccgccaacgtgctgctggatgaaggggctatgctgttatataagacaatgactcgaccaaagcactttctgcagatgctttctctcgagaactgtaggctgaccgaggcttcctgtaaggatctggccgcagtactagtggtgtccaaaaaattaacacacctgtgcttggcaaaaaacccaatcggagacaccggcgttaagttcctctgcgagggactctcgtaccctgactgtaagttgcagccacacaagccaggtctggaataccagcccgactcctcatggattgtggacagtctctccggaattcgtgaatcgaagttatag

SEQ ID NO: 31617 - DNA, 3198 bp, Artificial Sequence
  Description of Artificial Sequence: Synthetic coding sequence
atgtcaagaaagcaccggctggaggcaaggcctgacctgagggagttcttttcactgaacttgagaagtcacactcgcagtaccatgacgtctccccagctcgagtggactcttcagacccttctggagcagctgaatgaagatgaactaaagtcgtttaaatctctgctgtgggccttcccactggaagatgtgctgcagaagacaccctggagtgaggtcgaggaagcagatggaaaaaaactcgctgagatcctcgttaacacgtcctctgaaaactggatccggaacgctacagtgaatatcctcgaagaaatgaacttgactgagctctgtaagatggccaaggccgaaatgatggaggacgggcaggtgcaggaaatagataaccccgagctcggtgacgccgaggaagattccgagttggctaagcccggcgagaaagaagggtggaggaactccatggaaaagcagtcactcgtgtggaaaaacactttctggcagggcgatatcgataattttcacgacgacgtcaccctgcgaaatcagagatttatcccgtttctgaaccccagaaccccccgaaagcttactccttacactgtcgtgctgcatggcccagcaggagttggcaagactacactggcgaagaagtgcatgctggattggaccgactgcaatctctctcccacgctgaggtacgcattctacctatcttgtaaggagttaagtaggatgggcccttgttccttcgcagaactgattagcaaggactggcccgagttgcaggatgacatacctagcatccttgcacaggcgcagcgtatcctgtttgtggtggacggcctggatgagctgaaagttccgccgggtgccctgatccaggacatctgcggggactgggaaaaaaaaaaacctgtacccgtcctgctggggagcctattaaagagaaagatgctgcctcgggccgcattactagttacaacccgccccagagcattacgggacctccagctgctggcccagcagccgatttacgtcagggttgaagggttccttgaggaagatagaagggcctactttctgcgtcattttggagacgaggaccaggcgatgagagccttcgagctcatgcgcagtaatgcggccttgttccagctgggtagcgcccccgcggtgtgctggatcgtttgcacaactctgaagctgcagatggaaaagggcgaggaccccgtacccacctgtctgacaagaaccggactctttttacgattcctgtgctctcgtttcccgcagggagctcagctccgtggtgcgctgcggacattgtccctgcttgcggcacagggactctgggcccagatgtcagtgttccatcgtgaagatctggagaggttaggggtgcaggagagtgaccttagactgtttctcgatggtgacatcttgagacaggatagggtttcgaaggggtgttattccttcattcacctgtctttccagcagttcttaaccgcactgttctacgcactcgagaaggaggagggggaagacagagacggccatgcgtgggacatcggggatgtgcaaaagctcctgtccggggaggagcggctcaagaacccagatttgattcaggtcggacatttcctatttggccttgccaacgaaaagcgcgccaaagagctggaggccacttttggctgcaggatgagcccagatattaaacaggagcttttgcagtgcaaggcacatctgcacgcaaataaacccctgtctgtgaccgacctcaaggaggtgctggggtgtctctacgaatcccaggaggaggagttagctaaggtggttgtggccccttttaaagagatctctatccatctgactaacacatctgaagtgatgcattgttccttcagcttaaaacattgccaggacttgcagaaactatccctccaggtcgccaaaggggtattccttgagaactatatggacttcgaattggatattgagtttgagaggtgcacttatcttacaatacccaactgggcccggcaagacctgcgctctcttcggctgtggacagacttctgttctcttttcagctctaatagtaatctgaaattccttgaggttaagcagtcttttctgtccgattcttccgtccgaattctctgcgatcatgtgacacggtctacttgtcatttgcagaaggtggagatcaaaaatgtcacgccagacacagcatatcgagatttctgtttagccttcatcggaaaaaagactctcacacacctcacattagctggacacatagagtgggaacgtacaatgatgttgatgctgtgtgatctgttacgaaatcacaagtgcaatctgcaatacttgaggcttggggggcactgcgctacacccgagcagtgggctgagtttttttatgtgcttaaggccaatcagagcctaaagcacctgaggctgagcgccaacgttctgctcgacgagggggctatgctgttgtataagaccatgaccaggccaaagcattttctccagatgttgagcttggaaaactgtcgtctaactgaggctagctgtaaagacctggccgccgtgcttgtggtatctaagaaacttacgcatctgtgcttggccaaaaatcccattggcgataccggagtgaagttcctctgtgaaggacttagctaccccgactgtaagctgcagacccttgtattgcagcaatgttccatcaccaaactgggctgcaggtatcttagcgaggctctgcaggaagcgtgctcgttgacaaatctggatctcagcatcaatcaaatcgcacgcgggctgtggatcctgtgccaagccctggaaaaccctaactgcaatctgaaacacttgcggctatggagctgtagcctgatgcctttttattgccagcatctgggcagtgccctcctatcaaatcaaaaattggaaacccttgacctggggcagaatcacttatggaagagcggaattataaaattatttggcgtgctgcgtcaacgaacagggagtttgaagattctacggctcaaaacgtacgaaaccaacctagaaattaaaaaactgttggaggaggtaaaggagaagaatcctaaacttacaatcgattgcaatgcttccggagcaaccgccccaccctgctgcgactttttctgttag

SEQ ID NO: 31618 - DNA, 3030 bp, Artificial Sequence
  Description of Artificial Sequence: Synthetic coding sequence
atgaccagtccccagctggaatggactctgcagactctactggagcaactcaatgaagatgagctgaaatcattcaaatccttgttgtgggctttcccactggaggatgtgctgcagaaaaccccatggagtgaggtggaagaagctgatggcaaaaagcttgcagagatactggtgaacacatcatccgaaaactggataaggaatgctaccgttaacatcctggaagaaatgaacttaaccgagctgtgtaagatggccaaagccgagatgatggaagatggccaagtgcaggaaatagataacccagaacttggagatgccgaagaggattccgagctggccaagcccggcgagaaggaaggctggcgcaacagtatggaaaaacagtcactggtgtggaagaacaccttctggcagggggatattgacaactttcacgacgacgtgacactaaggaaccaacgcttcattccctttctcaatcctcggacaccacgaaagctgactccttataccgtggtgctgcacggccctgctggcgtcgggaagacaaccttggcaaaaaagtgtatgctagattggactgattgtaacctttcgccaacactgcggtacgctttctatctaagttgcaaggagttgtctcggatgggcccttgctcctttgcggagctgatctctaaagactggccagaactgcaagacgacattccctctatactggctcaagcccagcggatattatttgtagtggacggtctggacgaacttaaagtacctccgggagctctcattcaggatatctgtggagactgggaaaagaaaaaaccagtccccgtacttcttgggagtctgttaaagcggaagatgctcccacgcgccgcactactggtaaccacccgcccaagggcacttcgtgatctgcagctgcttgcacagcagcctatctatgttcgggttgaaggattcttggaggaggacaggcgggcttatttcctgcgacactttggagatgaagatcaggctatgagggcgttcgaactgatgaggagtaacgcagcactgttccagctgggcagtgcccctgccgtctgttggatcgtgtgcaccactttaaaattgcagatggagaagggggaggatccagtccccacctgcttgacgcgcaccggcttgtttctgcggttcctctgcagccgcttcccacagggagcacaactgcggggagccctacggacgctgtctctcctggctgcacagggactctgggcgcagatgagtgtatttcatcgggaagacttagaacgcttgggtgtgcaggagtccgatctgcgactgttcctcgacggcgacatacttagacaggaccgggtcagtaaaggctgttattccttcatacacctgagcttccaacagtttctgaccgctctgttctacgcgctggaaaaggaggaaggagaggaccgagacggccacgcatgggacatcggcgatgttcagaaactgttgagtggagaagagcgcttgaaaaatccagacctgattcaagtcgggcactttttatttggccttgctaacgaaaagagagccaaggaattggaagcaactttcggctgtcgcatgtcaccagacatcaaacaggaactgctgcagtgcaaagctcacttgcacgcgaataaacctttgtctgtgacggacctgaaagaggttctgggctgtctctacgaatcccaggaggaggaactcgcgaaggtagtggttgcgccattcaaagagatcagcatccatttgacaaacacctctgaagtgatgcactgcagctttagtttaaagcattgccaggacttgcagaagctgtccctgcaggtggccaaaggcgtatttctggaaaactacatggactttgaactggatatcgaatttgagagctccaacagcaacctcaaatttttggaggtgaagcagtccttcctgagtgatagctctgtgcggatcctgtgtgaccacgtgacacggtctacatgtcatctgcaaaaggtcgagatcaagaacgtgactccggacaccgcctatcgagacttttgcctggctttcatcggcaagaagacactcacccacctgacgttagctggacatattgagtgggaaagaactatgatgttgatgctgtgtgacctcctgaggaaccacaaatgtaatctgcaatacctaagactcggaggccattgcgccacgccagagcagtgggctgaattcttttacgtactgaaagctaaccaaagcttgaaacacttgcggctgagtgccaatgtactgctcgacgagggggccatgttattatacaaaacgatgacccgaccaaagcactttctgcaaatgctgtcacttgaaaactgcaggcttacggaggcctcctgcaaagatttggccgccgtgttggtggtttctaagaagctgacacacctgtgccttgccaagaaccctatcggagatactggagttaagttcctctgtgagggccttagctaccccgattgtaagctacagactctggtcttacagcagtgttctatcacaaaattgggttgtcgttacctcagcgaggccttacaggaggcctgttccctcacaaatctggacctttctatcaatcagatcgctaggggcttgtggattctgtgccaggctctcgaaaacccaaattgcaacctaaaacatctgaggctgtggagttgtagcctcatgcccttctactgtcagcatctcggtagcgccctgctcagcaatcagaagctcgagaccttggacctggggcaaaaccacctgtggaaaagtggcatcattaagctctttggtgtcctgaggcaacgaacgggttccctgaagatattgagactcaaaacctacgagaccaatctcgagattaaaaagctgctcgaagaagtcaaggagaagaatcctaaactgacaatcgactgcaacgctagtggcgccaccgccccaccctgctgtgattttttctgttag

SEQ ID NO: 31619 - DNA, 828 bp, Artificial Sequence
  Description of Artificial Sequence: Synthetic coding sequence
atggaggaggtgcgagaaggccacgcccttggtggaggaatggaggctgacgggccagccagcttgcaggaattgcctccttcaccaagatcgccctctcccccaccaagcccccctcctctgccgtcccctcccagcctccccagccccgccgctcctgaggctcctgagctgcccgagcctgcacagcccagtgaggcccacgcacgccaactgctgttagaggagtggggtcctctctccggcggcttagagttgccgcagcgactgacgtggaagctgctgctcctgagaagacccttgtacaggaacttactgagatccccgaatcccgagggtattaatatttatgaacctgctcctcccactgggcctactcagcgacctctggaaacactgggtaattttcggggatggtacatacggactgagaagctccagcaaaatcaaagctggaccgtgaaacagcaatgtgtggatctgttggccgagggactttgggaggaactgctggatgatgaacagcctgccataaccgttatggactggttcgaggacagtcgcttggacgcgtgcgtctacgaactgcacgtctggctgctcgctgctgacaggagaaccgttatcgcccagcatcatgtagcccccaggacctccggacggggtcccccaggaagatgggtccaagtgtcccacgtgtttaggcattacggccccggggtccggttcatccatttcctccacaaagccaaaaacaggatggaaccaggaggtctccgcagaactcgagtgactgacagcagcgtgagtgtgcaactgcgcgaatag

SEQ ID NO: 31620 - DNA, 1413 bp, Artificial Sequence
  Description of Artificial Sequence: Synthetic coding sequence
atgggactctacgccgcagctgctggcgtactggcaggagtggaaagccggcaagggagcataaaggggctggtctacagctcaaattttcagaatgtgaagcagctgtacgctctagtgtgcgagactcagaggtacagcgccgtgttggatgcagtaatagccagcgcaggactcctacgggccgagaagaagttgaggccacatctggcaaaagtgctggtctatgagcttctgctgggtaagggattccggggtggtggtggtcggtggaaggccctcttgggccgtcaccaggccagattgaaggcggaactagccaggcttaaagttcaccgaggcgtctcacgcaatgaggacctcctggaggtggggagcagacccggtcccgcctcccaactgccacggttcgtcagggtgaacaccctgaaaacctgtagcgacgacgtggttgactattttaaacgccagggattttcatatcaggggagggccagctctctcgacgatttacgtgccctcaagggaaaacattttctgctggatcccctgatgcccgagctcttggtcttcccagcccagaccgatctgcatgagcacccactgtatagggcaggccacctgatcttgcaggaccgggcaagctgcctacccgccatgctgttggatccgccaccaggcagccatgtcatagatgcctgcgccgcccccggcaacaaaactagccacctggccgccttgctcaagaaccaggggaagatctttgctttcgatttagatgcaaagcggctggccagcatggctacgctgctggcacgagctggggttagttgttgtgagctggctgaggaagacttcctggcggtatctccatctgaccccagatatcatgaagtgcattatattctgctcgacccctcttgcagcggaagtggaatgccatctcggcaattagaggaacccggggctggtaccccgtcaccggtaaggctccacgccctggctggctttcagcagcgcgccctttgccatgctctaacattccccagcctgcagcgattggtgtactcgacatgcagtctgtgtcaagaggagaacgaggacgtcgtccgggatgcactgcaacagaatcccggggcctttcgactggctcctgcgttgcctgcttggccacatagagggctgtctactttccctggtgccgagcactgtttgagagcatctccggaaaccaccctaagcagcggatttttcgtggccgtgatagagagggtggaggtaccctcactgacaggccagagcatctctacaagaacacatacccagccgagcccaaaagaaaaggaggagacagccaaaagccgaagccgctgtctccacacagcgctgcatatcgccgaggctcccgggtag

SEQ ID NO: 31621 - DNA, 1176 bp, Artificial Sequence
  Description of Artificial Sequence: Synthetic coding sequence
atgggtctatacgcagcagcagcaggcgtgcttgctggggtggagtccagacagggctcaatcaaaggactggtgtattcatccaactttcaaaatgttaagcagctttacgctctggtgtgcgagacccaaagatattcagcagtgttggacgccgtcatagcctctgcgggcctcctgcgtgcggagaagaaactccgtccgcacctcgctaaagtgcatcgcggtgtcagtcggaacgaggacttactcgaggtgggctcacgccccggcccagccagccagctcccccgattcgtgcgcgttaacacactgaaaacctgttcagacgacgtggtggactatttcaagagacagggctttagctaccaaggacgtgcgagcagtctggatgatctgcgggcccttaagggtaagcactttctgttggacccactaatgccagagcttctcgtgttccctgctcagaccgacctccacgagcatcctctgtaccgggccggacacttgattttgcaggatcgagccagctgcctgccagcgatgttgctcgatcctccaccaggctcccacgtgatagatgcttgcgccgccccgggcaataagacgagtcatttggcggcactccttaaaaatcagggaaagatcttcgctttcgatctggacgctaagcgcctggcttcaatggctacccttttggcacgggccggcgtgagctgctgtgagcttgcggaggaagacttcctcgccgtgtcaccctccgatccgcgctatcacgaggtccattacattctgctcgatccctcctgttctggcagcggcatgccctcacgacagttggaagagcctggggccggtacgccctccccggttcgcctccacgctctcgccggattccaacaacgggcattgtgtcacgccctgactttcccaagtctgcagaggcttgtgtactccacttgtagcctttgtcaggaggagaacgaggatgtcgtccgagacgccctccagcaaaaccccggcgcttttcggctcgcaccagctctcccagcttggccacacaggggcctatctacctttcctggagccgagcactgtctaagggctagtcccgagacaactctgtcgtccggtttctttgtagcagtcatagagagagtagaagtacccagatag

SEQ ID NO: 31622 - DNA, 1023 bp, Artificial Sequence
  Description of Artificial Sequence: Synthetic coding sequence
atgctcactcaactgaaagccaagtccgagggaaaactggctaaacagatctgtaaagtggtactggaccatttcgagaaacagtattcaaaggaactcggggatgcgtggaacacggttagggaaatcctgacatccccttcctgctggcaatatgccgttctgctaaatcggtttaactacccctttgagctcgaaaaagaccttcatctgaaagggtaccacacactgtcccagggctctctccctaactatcccaaaagcgtgaaatgctatctttcacgaacccctggccgcatcccatccgaaagacaccaaattggaaacttgaagaaatattatctgctgaatgccgcatccttgttgcccgtcctggccttagagcttcgcgacggggaaaaggtcctggacctctgcgccgctcctgggggcaagtcaatagcactactacagtgcgcttgccctggataccttcactgtaacgagtatgattccctaagattaaggtggctccgacagactctcgaaagcttcatcccgcaacctcttattaatgtgatcaaagtcagcgaactggacggcaggaaaatgggggacgctcagcccgaaatgtttgataaggtgctggtggacgcaccgtgcagcaatgatcggtcttggctattttcctcagactctcagaaagcctcttgtcgaatctcccagaggagaaatctcccactgttacagattgagctactccgctcagccatcaaggcacttagacccgggggaatcttggtgtactccacttgtacccttagcaaagccgaaaaccaggatgtcatctccgagatcctgaattcacacggaaacatcatgccaatggatattaaaggcatcgctagaacatgttcccacgactttacgttcgcacctacggggcaagagtgcggacttctcgtcatccctgacaagggcaaggcttgggggccaatgtacgttgccaaactgaagaagagctggagcacagggaagtggtag

SEQ ID NO: 31623 - DNA, 1155 bp, Artificial Sequence
  Description of Artificial Sequence: Synthetic coding sequence
atggcggcactaacactccgcggggtccgcgaattactgaaacgagtcgacttagcaactgtgcctaggaggcatcgctacaagaaaaagtgggccgcgactgagcctaagttcccagcagtgcgactggccctccagaactttgacatgacttattctgtgcaatttggcgacttgtggccttcgatccgcgtttctctcttatctgagcaaaagtatggagccctggttaacaattttgctgcctgggatcacgttagcgccaagctggagcagttgagcgctaaagactttgtcaatgaagccatctcacattgggaactacagtcagaaggaggccagagtgcggctccttcccctgcctcttgggcttgctcccctaacctgcgatgttttacattcgatcgcggagacatttcacgcttcccaccggccaggcccggatcactgggcgtgatggagtactacctaatggatgcagctagcctccttccagtgctcgcactgggcctgcagccaggcgacattgtactcgatctctgtgccgctcccgggggaaagactttagccctcctccaaacaggatgttgcaggaacctggccgctaacgatctgagtccctcccgcatcgccagactacaaaagatactacactcatatgtgcctgaagaaattcgggacggcaatcaggttcgggtgacatcctgggatggacgaaagtggggagagctcgaaggggacacttacgacagggtcttggtggatgtgccatgtacgaccgacaggcattctttacatgaagaggaaaacaacatcttcaagcggtcgcggaaaaaggagcggcagattctgcctgtcctccaggtgcaactactcgcagccggcttgctcgccaccaagccagggggccatgtcgtctactcaacctgcagtctatcccacttgcagaatgagtatgtggtgcagggtgccatcgaactcctggcaaatcagtatagcattcaagtgcaggtggaagacctgacccattttcggcgggttttcatggacacgttctgtttctttagtagctgtcaggtgggcgaactggttatccccaatctcatggccaattttggacccatgtacttttgtaaaatgcgcaggctgacttag

SEQ ID NO: 31624 - DNA, 1008 bp, Artificial Sequence
  Description of Artificial Sequence: Synthetic coding sequence
atgacctactccgtgcagtttggcgatctatggcccagtattagggtgagcctgctttccgagcagaagtacggcgcactcgtaaacaactttgctgcttgggaccacgtgagtgcaaagctggaacagctgagtgccaaagatttcgtgaatgaggcaatttcgcattgggaactacaatccgaggggggtcagagtgctgcaccgtcccccgccagctgggcctgctcccccaatctgcggtgcttcaccttcgacagaggcgacatctccaggttcccacccgccagaccaggcagtctcggtgttatggaatattatctgatggacgccgcgtctttgctgccggttctcgccctgggtctccagcctggagacattgtgctcgatctgtgtgcggctccgggcggaaagaccttggccctcctccagactggctgctgtcggaacctggctgcgaatgacctaagtcctagcaggatcgctagattgcaaaagattctccacagctacgtccccgaagagatcagagatggcaatcaagtacgggtcacgtcttgggatggccgaaagtggggcgagctggagggagatacatatgaccgggtgctggtggacgtgccctgtacaacggaccgccattcactgcatgaagaagaaaacaacattttcaagcggtcacgcaaaaaagaacgccagatactgcccgtgttgcaagtacagctgctggcggccgggctacttgctaccaaacctggaggacatgtggtttattcaacttgcagtctatcgcatctgcagaatgaatacgtcgtgcaaggggcaatcgaactgctggcaaatcaatactccatacaagtgcaagtggaagacctgacacattttcgaagggtgttcatggatactttttgctttttcagcagttgccaagtgggcgagctggtgattccgaatttgatggctaattttggtccaatgtatttctgcaaaatgcgacgactgacctag

SEQ ID NO: 31625 - DNA, 1008 bp, Artificial Sequence
  Description of Artificial Sequence: Synthetic coding sequence
atgacatactctgtccagtttggtgatctgtggccaagtattcgggtcagtttattaagtgaacaaaaatacggggctctggtaaacaattttgcggcctgggaccacgtttcagccaagctcgaacagctctcagcgaaagatttcgttaacgaggccatctcacattgggaactgcagtcagaaggcggccagtctgcagcacccagccccgcctcatgggcatgttctccaaacctgcgctgctttactttcgatagaggtgacattagtcgattccctccagcaagaccaggctcactcggagtaatggagtattacctgatggacgctgcttctctcctaccagtactcgctctggggctgcagccaggggatatcgtcctggacctgtgcgccgcccccggcggcaagactctggctctcttgcagaccggctgctgtagaaatcttgccgcaaacgacctcagtccatcaaggatcgcacggttacaaaaaatactccactcttatgtgcccgaggagattcgcgacggaaatcaagttagggttactagttgggacggccgaaaatggggggagctggagggggatacttatgaccgagtgctcgtcgatgtgccctgtaccaccgaccgacattctctgcacgaagaggagaataatatttttaagcgcagcagaaagaaagagaggcaaatactgcctgtcctccaggtgcaacttctggccgccgggcttctcgctacaaaacctggcgggcatgttgtctattccacgtgttccttgtcccacctacagaacgagtacgtggttcaaggcgctattgagctattggccaatcagtattccatccaggtgcaggtggaagatttgacccatttccgacgcgttttcatggataccttctgtttcttctccagctgccaggtgggtgagctggtcatccctaatcttatggcaaacttcggccccatgtacttttgcaagatgcgccgactcacctag

SEQ ID NO: 31626 - DNA, 1290 bp, Artificial Sequence
  Description of Artificial Sequence: Synthetic coding sequence
atgggactctatgccgccgccgcaggcgtgttggccggcgtagagagtcgacagggcagtatcaagggccttgtctactctagtaacttccagaatgtgaaacagctttatgctctggtgtgtgagacacagagatattcagccgttcttgacgccgtgattgcgagcgcaggcctgttgcgtgcagagaagaagctgagaccacatctggctaaagtcctggtgtacgagttactgcttgggaagggcttccgtgggggcggcggtcggtggaaggctctgttgggtagacaccaggccaggctgaaggccgagttagctaggttgaaggtgcaccgcggggtgtccaggaatgaagatctcttggaagtgggtagtcggccaggcccagctagccagctcccaaggtttgttagggtaaacaccctaaaaacatgtagtgacgatgtcgtggattacttcaagcgacaggggttcagctaccagggaagagctagctccctggatgaccttcgagccctgaaaggaaaacatttcttgctcgaccctttgatgccagagttgctggtatttcctgcacagacagaccttcacgaacatccactgtaccgggcaggacatctcatcctgcaagatagagcaagctgcctgcctgctatgctgcttgatccgccacctggcagtcatgtgatagatgcttgtgctgcccccggcaataagacgtctcacctagccgctttgcttaagaaccagggaaagattttcgcatttgacctcgacgccaaaagactcgcatccatggcaacgctgttggctcgagccggcgtctcatgttgcgaacttgctgaggaggacttccttgccgtgtctcccagtgatccccggtatcacgaagtgcattacatccttctggatccatcttgtagtggcagcggcatgccgtccagacagctggaggaacctggagccggtactccttcccctgtgaggttgcacgcactggcaggctttcagcagagggctctgtgtcacgccctcacgtttccctctctgcagaggctggtgtactccacctgctccctttgtcaggaggagaacgaagatgttgtccgcgacgctctgcaacagaatccgggagcatttcggctggcccctgcgttgcctgcatggccccaccgcggtctcagcacgttccccggggctgaacactgtctgcgagcctccccggagacaactctgtcatccggattttttgtagcagtcattgagcgtgttgaggtgcctaggtag

SEQ ID NO: 31627 - DNA, 1401 bp, Artificial Sequence
  Description of Artificial Sequence: Synthetic coding sequence
atgggcctctacgctgctgccgcgggcgtgctcgcaggcgtggaatctagacaagggtccatcaagggcttagtttactcctccaattttcagaatgtgaagcagctgtatgctctcgtctgtgaaacccagcgatattcagctgtgctggacgccgtgatagccagcgccgggcttctgagagccgaaaagaaactgcgccctcatctcgcaaaggtcctggtctatgagctactgctggggaagggattcagaggagggggtggccgatggaaggcactgcttggtagacaccaggcaaggctgaaggcagagctggctcggcttaaagtgcacagaggtgtcagccgaaacgaggacttgctggaagtgggcagccggccaggccctgccagccagctgccgagatttgttagggtcaataccttgaaaacttgctccgatgacgtggtggactactttaaaagacaggggttcagttatcagggtagggcaagctcccttgatgatctgcgggctttgaaaggaaagcatttcttgctggaccctctgatgcctgaactcctagtattccctgcccagacagaccttcatgaacatcctttgtaccgcgccgggcacctgattctgcaagatcgcgctagttgtctacccgccatgcttcttgacccacctcccggatcccatgtgatcgacgcttgcgccgcccccggaaataaaacttcccacctggccgcactgctcaagaaccaaggaaagatttttgccttcgatctagatgccaaaagactggcatccatggcaaccctgctggctcgcgccggcgtaagctgttgcgaactagccgaggaggactttctagcagtgtccccttccgaccccaggtatcacgaggttcactacatccttcttgaccccagttgttcaggatctggcatgccttcaaggcaattagaggaacccggtgccggaactccttcacccgtcagattgcatgccctcgcggggttccagcagcgagctctgtgtcacgccctcacctttcccagtcttcaacgcctggtgtacagcacttgcagcttatgtcaagaggaaaacgaagatgtagtgcgtgatgcgctgcagcagaatcccggagctttcagactggctccggctctccctgcttggccacacaggggcctcagtacgtttcccggagcagagcactgtctccgcgccagccccgagaccacattgagcagtggatttttcgtggccgttatcgagcgtgtggaggtgcccagctctgcttcccaggcaaaggccagtgccccagagcgcacaccctctccagcgcccaagcgaaagaaacgacagcagcgagccgcagccggggcttgcacaccaccatgcacctag

SEQ ID NO: 31628 - DNA, 1410 bp, Artificial Sequence
  Description of Artificial Sequence: Synthetic coding sequence
atgagcatcttccccaagatttcgctgaggccagaggtggaaaattatctgaaagagggctttatgaacaaagagatcgttaccgcgctgggaaaacaggaggccgagcgcaagttcgagacgttactgaagcatctttcacatcctccaagttttacaacagtccgagtgaatacccacctcgcatctgttcaacatgtcaagaatctcctcctggatgaactccaaaagcagttcaatggcctctcagttcctattctgcagcaccccgacctacaagatgtgcttctgattcctgtcatcggaccccggaagaatatcaaaaagcaacaatgcgaggccattgtcggggcgcagtgtgggaatgccgtcctgcgcggagcccatgtatacgcacctgggatcgtttctgcttctcagtttatgaaggctggggacgtcatctcagtctattctgatatcaagggtaaatgtaagaagggcgccaaagagtttgacggaactaaagtgtttcttgggaacggaatttccgagttaagccggaaggaaatcttctcaggcctgccggagctcaaaggaatgggcatccggatgacggaaccagtttatctgtccccaagttttgactcagtgttacccaggtacttgtttctgcagaatcttccttccgccttggtttctcatgtgctcaatccccagccaggcgaaaaaatactggatctctgtgccgcaccagggggtaaaacaactcacatcgccgccctgatgcatgaccagggagaggtaatagcactcgacaaaattttcaataaagtggagaaaataaaacagaatgcactgctcctagggctcaactcgattcgagccttttgcttcgatggcaccaaggccgtgaagctggacatggtggaggacacagaaggtgaaccccccttcctgccggagtcttttgaccggattcttttggacgcaccttgtagcggcatgggccaaaggcctaatatggcctgtacatggtccgtgaaggaggtcgctagctatcagcctcttcagcgaaagctctttaccgccgccgtgcagctccttaagccagaaggcgtacttgtgtacagcacctgtacaatcactcttgccgagaacgaagaacaggtggcctgggctctgacaaaatttccatgtcttcagcttcaaccacaggagcctcagatcggtggcgaagggatgcgaggagccgggttaagctgcgaacagctcaaacagctgcaacggttcgatccatcggccgttccgctgccagacactgatatggactccctcagggaggcgaggcgagaggacatgctccgcctggccaacaaggactccattggcttcttcattgctaaatttgtcaagtgcaagagcacctag

SEQ ID NO: 31629 - DNA, 2157 bp, Artificial Sequence
  Description of Artificial Sequence: Synthetic coding sequence
atgctgaattccactggagaattggagttctcaaacgaggaggatccagaaataatctcacagctcacttcgttgccattgtctggcggaaaatcatccgccggggtccccgaaaaaactggctacccggactccgtgtatgttatggcagctaacattttccagggtatcagaattgaaaagagcgcccagaaggtgctgattaaatatggaaacgagccgctgagaagcctttccgaaagcgaagaccaaagcttccagaggcttagctatgaactcgcattttctgctctgaaatatcaggacattctggaaacgatcctaatagattcttgcatttttccaagcacaaccattcccgatcaccttagcagcctgatcattgtaatgttgtacgacttccaggacaggaagttccagacgagggtgctcagtgataatgaagaacctatctctgaggtgcaggaagtggaaaatttgctcaatagttttaagatcaagctcgctgctgcccttgccaggtgtcgcataaagcatgacgcactgagcatctatcacatccttccagagaccgtacgtaaacaggaactccgagcctccactttgcctttatacgcctggattaacacctgcaaaatcagcccagaggaggtctataacaatctaaaaagaaggggttataacaaagtgaagagtgtgctgcacatcgatgacaaagtctttgccgttgaccaacactgctacgacgtgctgattttcccttcccaccttaagaacgatctgatcaacatcgacctgttcaaagattataagctgatattccaggataaatcgagaagtctcgctgttcattctgtcaaagctctattgaatatggatgacgacgtgctgatggtgaataccggatcgtggtacactgtgtcccacatgagtattctaaccaacaacaacacctctaaagtgttcgtgtgtggggtgcagtctcaggctaaagatccggatcttaaaacgctgttcaccaagatcggctgtaaaaatattgagatccttcatgaaaagtttatcaatatcgagagtaaggatcatcgccttcagaaagtcaaggtcatcctcctgttgcccagatgctcaggcttaggggtgtccaacccagtggagtttattctcaatgagcacgaggacacggaattcctgaaggatcacagccagggagggatctccgtcgataaactgcatgtccttgctcagcaacagtacgagcagctaacccatgcaatgaagttcacgaaggcacaggcagtggtctactgtacttgttccgtgtttccggaggaaaacgaggccgtggttaagaaggccctggaattccaggaccttggtaataaggggcaaccgtacagactctctcccccagttttgcctctctgttcccttaaggaaattcaactctctacagataaattcttccggatggagccgtcggagatcaccaacggatgctttttgtcaatcctgactcgagagcgggatccaagcgagaccgtgtccgtgaatgacgtcctcgcgagggcagcagcaaaagggctcctggacgggatcgagctgggcaaatccagcaaacgcgaaaagaagaaaaaaaagtccaagacaagccttaccaaaggggctacaacagataatggtattcaaatgaaaattgccgagttcctcaacagagaaaccaaggcctctgcaaatctttctgagacagtgactaaaccaccacttccgcagaaaaacaccgctcaggtgggcgcttcatcacagacaagaaagcccaataagctcgccccgcacccagcagtgccagcttttgtaaagaacacgtgcccgagccggcccagagagcggcagacgcactttctgaggccacgacccgaagatcggatggtcgcactgaagccaataaaaatagttctgccgcctgtgtttatgcccttttctagcccacagggcatccgatcgagaatgcctacgcagcatctgtactgccggtgggtagccccgaaagctctggtacccacctgcctgccgacacactccctcagcagaaaagaggaaaaaccaaaagacgatacgccaagcagcctcctgaggcctccaaggaggtggctctag

SEQ ID NO: 31630 - DNA, 711 bp, Artificial Sequence
  Description of Artificial Sequence: Synthetic coding sequence
atgtgtgtgacgtaccacaacggcacgggctattgcaaatgccctgagggattcttgggagaatactgccagcatcgggacccctgtgagaaaaacaggtgccaaaacggcgggacctgcgtggcacaggctatgctcggcaaagccacttgcagatgcgcatccggattcactggtgaagactgtcagtattctacatctcatccttgcttcgtctctagaccatgcctcaatggcgggacttgccacatgctctctcgggatacctatgaatgcacctgtcaagtgggatttactgggaaagaatgccagtggactgacgcatgcctctcccacccctgtgccaatgggagcacatgcactacagtggcaaaccagttctcatgcaagtgcctcacagggtttaccggccagaagtgtgagacagatgtgaacgagtgcgatatccccggacactgccaacacggtggcacatgcctgaacctacctggatcttaccagtgccaatgtttacagggattcacggggcagtactgtgattcactgtacgtaccatgcgctccctccccttgcgttaacggaggcacttgtaggcaaacgggagacttcacattcgagtgcaactgcctgcccgaaaccgtgagaaggggcaccgaactttgggaacgcgaccgcgaagtttggaatggcaaagaacacgacgaaaattag

SEQ ID NO: 31631 - DNA, 345 bp, Artificial Sequence
  Description of Artificial Sequence: Synthetic coding sequence
atgtcacaggccgaattgtctacgtgttctgcgcctcaaacacagcggattttccaggaagctgtgcggaagggtaatacccaggaattgcaaagccttctgcagaacatgacaaattgcgaattcaacgttaattctttcggcccagagggacagactgccttacatcagagtgtgatcgacgggaacctcgagttggtaaagctcctggttaaattcggggccgatatcaggcttgctaatagagatggttggtcggccctacatatagcagcgttcggtggccatcaggatatagttctatacttgatcacaaaggcaaagtacgctgcctctggccgttag

SEQ ID NO: 31632 - DNA, 423 bp, Artificial Sequence
  Description of Artificial Sequence: Synthetic coding sequence
atgcttacgattatgtgtgggttccagatgcagtcccaccttgccgcgggggacatgaaacgtctgggttacgactttgaccacctgcttagtcccgcgttaccaatttcaacctcagtggcccgagagggtccaagtctcattaccctgcgggcaacccgggatgcagaatgcgctctttcgtctggtgccgggcaaggagctgggcggggtgagaaaaccccagcttcccccaccaaccagcacccggggctggaagagcttcagcaggccgcagatagggagtttcatcctcagccagactctcgtaattccgaggtccaggaccgtgccagctgcaggtgggagccgggcatggtaggcgctgcctccagtgcagccggggagagtgtatgcgttcaggggtgccgcgtggcatgctag

SEQ ID NO: 31633 - DNA, 1602 bp, Artificial Sequence
  Description of Artificial Sequence: Synthetic coding sequence
atgatctccagctcctcagtccattcccgtacctttaataccagcaacgccctcggaccagtttgtaagcacaagaagccactatctgcagcaaaggcttgtattagtgagattctgcctagcaaattcaagcccaggctctccgctccttcagcactccttcaggaacagaagagcatcctgctaccctctgagaaggcacaatcttgcgagaatctatgtgtatccggcagtctgaacgactcaaaaaggggtctgcctctgcaggtgggaggtagtatcgaaaatctgttaatgcgaagcagacgggattatgattcaaaatcatcaagcacaatgagcctacaggaatattctacgagcggccgtaggccctgcccccttagccggaaggcaggcatgcagttcaccatgctttacagagacatgcatcagatcaatcgttctggactgttcctgggcagcatcagcagttcctccagcgtccgcgacctcgcttctcattttgagaaatctagtctcgccctgtctcggggggagttggggccaagtcaggaggggagcgagcacatccctaagcacaccgtcagttctcggattacagcgttcgagcagctcatccagcgcagccggtccatgcctagcctagatctgtcaggccgattatccaaatctccaaccccagtgctctcaagaggttctctgacgtccgcccgaagcgctgaatctctcctcgaatcaactaagctccatccgaaagagatggatggaatgaacagttcaggtgtgtatgctagccctacatgcagcaacatggcccatcacgctctgtccttcagggggctcgtcccatccgagcctctgtcaacatgttctgacgatgttgatcgctgtagcaatatctccacagactccagagagggctctgggggaagcgtgcacggcgatttccctaagcaccgcttgaacaagtgtaaaggaacttgccccgcctcctatactagattcacaaccatccgcaaacatgagcagcagcagacatcccgccagcctgagtggaggctcgacgctcgtggcgataagtcaaccctgttgcggaacatctatctgatgtctcctctcccctttagattgaaaaaacctctgcatcatcaccctcgacaacccagtcctggagacagttctggcctactggtgggccaaaaacctgatctgccatcgcagcctcaccaagatcagccacccagcgggggcaaacccgtcgtgccgacacgcctgagttccagacataccatggctcgcctgtccaggagctccgagccatcacaggaacgccctacggcattggaggactatcctcgcgccatcaacaatggtaacagcgtcccttatagtgatcactctctagaccgcaacaacaatcctcaaagtgagctggccccctctagagggggcggaattctgtgcgtgtgcctggtgtccccagctcggccatctactctgctggctctgtcgcgacctcccctgtgtccctggtgctccttctctggactttcgttcgtcttctgtctgttctgtctcgcaataaatcatggcagctag

SEQ ID NO: 31634 - DNA, 4533 bp, Artificial Sequence
  Description of Artificial Sequence: Synthetic coding sequence
atggctacacgcgtcgaagttggatctatcaccccgctcacagcagttcccggccttggcgagatgggaaaggaggagacattaacacgaacttacttcctgcaggcaggagaggcttcaggagctccaccagcaagaatcctggaggccaagtcccccctgcggagtccggctagactgctcccgcttcctcgtctggcccctaagccgttctcgaaagaacaggacgtcaaatcccccgttcctagcctgcgcccatccagcacaggcccctcaccctcaggggggctctctgaggagccagctgccaaggacttagataatcgaatgccagggcttgttggtcaggaagtgggaagcggcgagggacctcgcactagttcacctctgttcaacaaggcagtgttcctcaggccaagctcttcaaccatgatactgttcgaaaccaccaagagtggacccgcgttgggcaaagcagtgtctgaaggggccgaggaggcgaaacttggagtgtcaggttcacgtccagaagtggcagctaagcctgccctgccaacacaaaaacccgccggtacgctgccacgctctgccccccttagtcaggataccaagccacctgtccctcaggaagaagccggtcaagaccatccaccttcaaaggcctcatctgtggaagacaccgcgcgccctctggtcgaaccgcggccacggttgaagcggcggccagtgtctgcaatttttacagagagcatccagccccagaaaccaggcccgggcgctgccgccactgtgggaaaagtgcctcccacccctccggagaagacctgggttcggaagccacgtccgctgtctatggaccttacggctcggttcgagaacaaggaggcactcctgcggaaagtggctgacgagggatcaggacccactgctggagatatggccggcctggagcggccacgggcggcctccaagttagacagagattgcctggtgaaggctgaagctcccctgcacgatcctgacctggattttttagaagttgccaaaaaaattcgggaacggaaagagaagatgctctctaaacctgaaatggggtcaccgagagctctcgtggggggaagtagtggtgtgacaccatcaaatgaccagtccccgtgggaggagaaggccaagcttgatcccgagcccgagaaggccgcggagagcccaagtccccgcctaggcaggggtctggagctggccgaggttaaatcaagggtggctgatggcgaggccgcagctggtggcgaatgggcaagccggcggtcagtccggaagtgcatctctttgttcagggaagacagcacactcgccctggcggtggggagtgagtctccgctggccacacccgcttctcctagtgctgcgccagaaccagagaaaggtgtggtatcggttcaggaaaggatcagagggtggactgccgagtcctcggaggccaagccggaggtacgtaggcgaacattccaggcccgcccactgtctgccgacctgacaaagctcttttctagtagcgcttccagtaacgaggtgaaatatgagaagtccgcggagttgtctggggaattcccaaaggagccgcgagaaaagcagaaggaaggtcactccctagacggagcctgtatcccaaggtccccatggaaaccgggaaccttaagggataagtcccgccagacagagcagaaagttagttcaaaccaggatcctgacagttgtaggggaggctcgtcagtggaagctccttgtccctccgacgtcactcctgaggatgataggagcttccagaccgtctgggcaaccgtgttcgagcatcacgtcgaacggcacactgtggcagaccagtccggtaggtgcctcagcacaaccccacctggggatatggcgcacgctagggtcagtgagcccaggccccgtcctgagatgggctcttggctggggagggatcccccggatatgacaaaactgaaaaaggaaaactcgagggggttcgataaccccgagaccgagaagttgggaccaactacattactgaatggagagctgaggccatatcatacccctttgagggacaagtaccccctgtccgaaaatcataataataatactttccttaagcacctggagaatccccctacgagccagagaattgagccaagatatgatatcgtccatgcagtaggggagagagtgcatagcgaggctatcagccccgcgccagaggagaaagcagtgacattgagaagtctgcggtcatggcttagtctgaaggatcgccaactctctcaagaggtgacccccgcagatctggagtgcggcttggagggacaggctggctcggtccagcgcgcatctctcatttgggaggctagaggtatgcctgaggccagcggcccgaagttcgggggcaactgccccttccccaaatggacaggcggggcagtggtctctagtcataaggcaaccgtggcagtaagcgaagaacactgcgcccctggtgccacatccgtgagggctattaaggcggctatatgggagagccagcacgagggcccagagggtgcgcggtcaaaacctggtgtcggcgcccgggggccgccacagggttgtcctttagaccctttgagtcgggccacaaacgggccatccgattcacaggcccgtacccacccagacgctttcgcggtgcaaaaggggccctttattgtagcagcacgtgaaggggacccaggtccagctcaggttcctcagcccgctgttcggatgagaaaggccggggcgatggatcaacggatggatcgctggagaagaaggacgctacctcctaatgttaaattcgacaccttctcatctctggtgcctgaggatagcccacacgttggccatagaagaacggattatgtgtcaccgacagcatctgcactgcgtaaaccccagttgtcccactaccgcgtggagacccaagaggtgaaccctggggcttcgagggatcagacttcacccgctgttaaacaaggatcccctgttgagcctaaagcaaccttctttgccgtcacttatcagattcctaacacccagaaagccaagggggtggtgctcagcggagctgagtcgctcctggagcattcaagaaagatcacccccccgtcatcacctcactccctgaccagcacactagttagtctgggccatgaagaggcgctagagatggcgggcagcaagaattggatgaaaggacgcgaacacgagaatgccagcattctaaaaactctgaagccaaccgataggccctcctccctgggggcttggtcgctggaccctttcaacggaaggatcatcgacgtagatgcactgtggtctcataggggctcagaggacggccccaggccacaaagtaactggaaggagagcgcaaacaaaatgtcaccaagcggaggggccccccagacaacacccactctgcggtccagacctaaagacttacccgtacggaggaagacagacgtgatctctgacacgtttcccgggaagatcagagacggatacaggtcttctgttcttgatatcgacgccctgatggcagagtatcaggagttgagcctgaaagtgccgggtgaagctcaagaacggcgctcaccaaccgtggagccctcgaccctaccccgcgagagacccgtccagttggggggagtagagcagaggcgacgcagcctcaaagagatgcccgacaccggcgggctctggaagccagcaagttcagccgagattaaccactccttcaccccaggtctgggaaagcaactggcagagaccctggagacagccatggggaccaaatctagtccgcccttctgggctctgcctccctccgctccgagcgagagataccctggggggtccccaataccagccgaccctcggaagaaaacagggttcgctgaggacgatagaaaggccttcgcctctaaacatcatgtggctaagtgtcagaactatctagctgaaagtaaacccagcggacgagaagacccggggtccggggtcagggtcagcccaaagtctccgccaaccgaccagaaaaaaggcaccccccgtaaatcaaccgggaggggcgaggaggacagtgtggctcagtggggagatcacccccgcgattgtgggagggtaccacttgacattaaaagggcttacagcgaaaagggccccccagccaatatccgggaaggtctcagcatcatgcatgaggcccgggagcgaagaagagaacagcctaaagggaggccaagtcttactggggagaacctggaagctaaaatggggccctgttggtgggagagtgggaccggcgattctcataaagtgcttcctcgtgacttggagaaggaagacgcgccacaggaaaaggaacgccctctgcaacaggtgagtcctgtggcttctgtcccctggagatcccacagcttctgtaaggatcggcgctccggcccatttgtgtag

SEQ ID NO: 31635 - DNA, 390 bp, Artificial Sequence
  Description of Artificial Sequence: Synthetic coding sequence
tgaatctcagcatatttcgctaccggttcgtctatgacttaccatttccaggaacactatacattaagtgaaaacagctcgagcctggtctccagtttacatcgcgacgtgaccctgacaagagagatgattacattatcgttccgcacaacccgtacacctagtttgctcctgtacgtgagttccttttatgaggagtacctgagcgtcatcctcgccaacaacggtagcctgcagatccgctacaaactggaccggcatcagaacccggatgcttttacattcgacttcaaaaatatggcagatggacaattacaccaagtgaaaatcaaccgtgaggaagcagtcgtcatggtggaggtcatcccccagatgcagaagtccaactag

SEQ ID NO: 31636 - DNA, 543 bp, Artificial Sequence
  Description of Artificial Sequence: Synthetic coding sequence
tagagggacgtcactttaacacgtgaaatgattacgttgtctttcaggactactcgaacaccttcgttactgttatatgtcagctcattttacgaggaatacctatccgtgatcttggcaaataacggcagtttacagattcggtacaagcttgatcgccatcagaatccagatgcgttcacgttcgatttcaagaacatggcagatggccaactgcaccaggttaagatcaatcgagaagaagcagtggtgatggttgaggtcaatcaatctgccaagaaacaagtcatcctttcctcggggacagagttcaacgccgtcaagtccctgattcttggtaaagttctcggccggtctggcccagtggatgagggcgagcctcttgtcaatgctgataggagggattccgccgtaatcggtggagtgatcgcggttgagatctttattctgctctgtatcacagcaatagcaattagaatctatcagcagaggaaactccggaaggagaacgaatctaaggtctcaaagaaggaagagtgctag

SEQ ID NO: 31637 - DNA, 873 bp, Artificial Sequence
  Description of Artificial Sequence: Synthetic coding sequence
tagatcagtgcctattttgccacagggtcatctatgacctatcactttcaggaacactacactctgagcgagaatagtagctcacttgtctctagcctacacagggacgtcaccttgactcgcgagatgattaccctgtcctttaggactacccggacaccaagtttgctcttgtatgtgtcttcgttctacgaagaatatctgagtgtgatcctggccaacaacggatcactgcagatccggtataaactcgatcgccaccagaaccctgacgcctttacatttgatttcaaaaacatggcagacggacagttacaccaagtgaaaattaatagagaggaagcggtggtgatggtggaagtgaatcagagcgctaagaaacaggtgattttaagttctgggacagaattcaacgctgtcaagagcctgatcctggggaaagtccttgaggcagcgggtgctgacccggacacccgtagagccgccacgtccggcttcacagggtgcttaagcgccgttaggttcggatgcgcagctccacttaaggcagcactgcgcccttccggaccctcccgcgtcactgtccggggacatgtggctcctatggcccgttgtgccgccggcgcagcatccggttcacctgccagagaactggcccctcgcttggctggaggagcaggcaggagtggacctgtggatgagggggagcctctagttaatgctgaccgtagggattcagctgttatcggaggagtcatcgccgtggagatcttcatcttattatgcattactgccatagccattaggatctaccagcaacgtaagcttcggaaagagaatgaatccaaggtcagcaagaaggaggaatgctag

SEQ ID NO: 31638 - DNA, 273 bp, Artificial Sequence
  Description of Artificial Sequence: Synthetic coding sequence
atgtggcactacattggcgctgccgagtgtccttatctgcaacttccgaggtgtcgcgggtcgagtacaaggtattggcataagaagtcacgggggcggttgacttggccatggctgttgatgtcacaattgcggacttgtcatatcaatagtcccttcccactggcggtgacctgcggagtcaagttcagtgaggctgccgtgcctgtgcatctgtcaggatgcgtgcagaagatgaatatctgcctacaactgcagttctctaacgattag

SEQ ID NO: 31639 - DNA, 312 bp, Artificial Sequence
  Description of Artificial Sequence: Synthetic coding sequence
atgccattggaaaaattcgtggacatggagttccttgaccagatgatactcaggggaacatgcttagaggctgacttatgtccacaatatactaacagcccctttaatgctcacactgaccaaattacccaaacgcatctgccaccacagcatctagatagctcccattccacccacacatgtcttcccgtccaccgacacatccagagacataccgacaaacaccattctaagaagatgttccctcggacccacgggcaccctaaccctcgcatcatccggcttagccaacgccatgtatgcacggcctag

SEQ ID NO: 31640 - DNA, 186 bp, Artificial Sequence
  Description of Artificial Sequence: Synthetic coding sequence
atggaggcctcgctcggtgggccagagcctaacggggtgattaacgaggaagccaaagccggagcgactggtaagcggcgaggtcgcgcccctgcgaacgggggaagagcctccggtgaaaaccgcgcatttccagtactacaactcccaggcaactggcactgtcggaggcggcaagggtgttag

SEQ ID NO: 31641 - DNA, 342 bp, Artificial Sequence
  Description of Artificial Sequence: Synthetic coding sequence
atgggctcccctttctattgcaacgggggctactggcttcagagaacagagtgctggcgtaccatgaatgagttccatttcaggagtgcccagctggcggttccaggaagacagcctcaggaattgtttaggagacaccgcgcgaccagcgcgtggtcttctcgccgtcgctcggccttggtggtcggcactatagggcctggacatggacggctgcaggacccctcctgcaccaagctaccctccccacccgcttggttcccattctttatgaatcgttctatgggtcacagccaggtgggaatgcacgtgttccatcggatgggtactacttccagctag

SEQ ID NO: 31642 - DNA, 780 bp, Artificial Sequence
  Description of Artificial Sequence: Synthetic coding sequence
atgacgatcaatatgctcaacgtcttcggcaatgaagacttcgactgccatggggacctgaagaccgaccaactaaaaatggatatcctgattaagaagttaaagcaaaagtttgacgacctgaccgctgaaaaagaagccctttcatctaagtgcgttaatctcgctaaagacaaccaagtcctgcagcaagagtttctgtccatgaagaaagtgcagcagcaatgcgaaaaactggaggaagacaagaaaatgcttaaagaggagatcctaaatttgaagacgcacatggagaataaccgcgttgaactctcaaagctgcaagaatacaagctagaactagatgaaaaggctatgcaggccgtcgagaaacttgaggagatccatctgcaggagcaggcacagtatgagaaacagctcgagcaactgtctaaggacaacatggcctccctcaataagaaagaattaaccctcaaggacgtagagtgtaagtttagcgaaatgaaaacggcctacgaagaggtgacgaccgagctggaggagtataaagaggccttcgccgccgctttgaaggccaataactccatgagcaagaagctgaccaagtccaataagaagatcgctgtgatttctatgaagctcctgatggaaaaagagcagatgaaatatttcctgagcgccctcccaaccaggcgtgaccctgagagcccatgtgtcgagaacttgacctctatagggttgaaccggaagtacataccacagaccccaatacgtatttag

SEQ ID NO: 31643 - DNA, 519 bp, Artificial Sequence
  Description of Artificial Sequence: Synthetic coding sequence
taatataagaagctcctggaaatgacaatcaatatgctgaatgttttcggtaacgaggacttcgattgccatggggatctgaagaccgaccagctcaagatggacatcctgataaagaaactgaaacaaaaagagcaggcacagtatgaaaaacaactagaacaactttctaaggataacatggccagtctgaataaaaaagaactcaccctcaaggatgtcgagtgcaaattttccgagatgaagactgcctacgaggaggtcacgactgaactggaagaatacaaggaggccttcgcagccgcattaaaggccaataatagtatgtctaaaaaacttacaaagagcaataagaaaattgcagtgatctccatgaaactgcttatggagaaagagcagatgaagtatttcctgagtgctctgccgacaagaagggatcccgaatcaccatgcgtagagaacctgacttctatcgggcttaatcgtaaatatatcccacagaccccaatcaggatatag

SEQ ID NO: 31644 - DNA, 1602 bp, Artificial Sequence
  Description of Artificial Sequence: Synthetic coding sequence
atgtcccaaacctccctgaagcagaagaaaaacgaacccggcatgcgttccagcaaagaatccctagaagccgaaaaacggaaagaaagtgacaagacgggcgtgagactgtctaatcaaggttctcaggagtcaagtctgcgaaagacagatagccgcggctatctggtgagatcccaatggagcagaatttcccgaagcccaagtacaaaggcccccagcatagatgagccacgtagcaggaatacgagtgctaaggtggagctgccatcttcctctacctcgtccaggacgccaagcacttcaccatcactacatgactcaagccctccacccctctccgggcaaccttcactgcaaccaccagcctccccccaactccccagatccttagactcccgtcctcctaccccccctgaacccgacccaggctctcggaggagcaccaaaatgcaggaaaaccccgaagcctgggcccaggggattgtacgtgaaatcaggcagactagagactcccaaccactcgaatatagcaggacatcacccactgagtggaaaagcagtagccagcgaagaggtatctacccagcatcaacacaactggatcgaaactcactctcagaacaacagcagcaacagagggaggacgaggatgattacgaagctgcctactgggcttctatgcggtccttctacgagaagaacccctcgtgcagcaggccttggccaccaaagcccaaaaatgcaataaccatagccctctcatcctgcgctctgttcaatatggtggacggcaggaaaatctacgaacaggaggggttggagaagtatatggaatatcagctgactaatgagaatgtgattctgacacccggacctgccttcagatttgtgaaagcgctgcaatatgtgaacgctagactgcgagacttatacccggacgaacaggacctgtttgatatagtgttgatgacgaataaccacgcacaggtaggcgtacgtctgatcaacagtgtgaaccattatggcctcctcatcgaccgcttctgcctaaccggggggaaagacccaataggatacctcaaagcttacctaaccaatctatacatcgcagccgacagtgagaaggtgcaggaggccatacaagagggcatagcaagcgctactatgttcgatggcgccaaggatatggcctattgcgacacacagctgcgggttgcgttcgacggggacgctgtgctcttctccgatgaatccgaacactttactaaagagcacggcttagacaaattcttccagtacgacaccctgtgtgaatcaaaaccactggcgcaggaggagccacgcctcgacgtgctgataaataatgctggaatcttccagtgcccctatatgaagactgaagacggtttcgaaatgcagttcggcgttaaccatctgggccattttctgctgaccaaccttctgctgggcttgctgaaaagcagcgcgccctcaaggatagtggtagtaagttccaaactctataagtacggcgacatcaactttgacgacctgaactctgaacaatcctataataagtccttctgttacagccgttag

SEQ ID NO: 31645 - DNA, 1809 bp, Artificial Sequence
  Description of Artificial Sequence: Synthetic coding sequence
atgagtcagacgagcttaaaacaaaaaaagaatgagcctggcatgcggtccagcaaggagagcttggaggcagagaaaagaaaggaaagtgataaaaccggtgtccggctcagcaaccagatgcgcagagcagtcaatccaaaccactctctcaggtgctgtcctttccagggacacagctcctgtaggagatgcctctgcgctgctgaaggtaccgcactcgggccatgtcacactatccgcatttacattcacatgtgccttctttgggagcagggtcaacagatcactatgatgcgaggatctcaagagagttcactacgtaaaacagactccaggggctatctggtcagaagtcagtggagcagaatttcaagatccccttcgaccaaggctccttcaattgatgagcctcgtagtaggaatacatcagccaagcttccaagctcctccacttcctctcgcacaccttcaacgagcccttccttgcatgacagtagccctccgccactgtccgggcaaccttcactgcaaccaccagcatcgcctcagcttcccaggtcattggattcacggcctcctactcccccagaaccagatccagggtcgcgccgatcaaccaagatgcaagagaatcccgaggcctgggcccagggtattgtcagagagatccgacaaactagggacagccagcccttagagtacagccggaccagccccaccgagtggaaaagttcctcacagaggagaggcatttaccccgcttccacccagctagacagaaactcgctgagcgaacagcagcagcagcaacgagaggatgaagacgactatgaggccgcatactgggcgtcgatgaggagtttttacgagaaaaacccatcttgttccaggccatggccacctaaacctaagaatgcaatcacaatagctttgagctcttgcgcgctgttcaatatggtggatggccgaaagatatacgaacaagaaggcctggagaagtacatggaataccagttaaccaatgagaatgtgatcctcactcccggacctgcattccggttcgtaaaagccctgcaatacgttaacgcacggcttcgcgatctgtaccctgatgagcaggatttgtttgacattgtgctcatgacgaataaccatgcccaggtgggggtgcgcctgatcaactccgtgaaccattacggtcttttgatcgatcgcttttgtctgactggcggcaaagaccccatcgggtacctgaaagcttacctgaccaatctatatattgccgcagactcagagaaagtgcaggaggccattcaagaaggcatcgctagcgccacgatgtttgatggcgcaaaggatatggcctactgcgatacacaattacgcgtggcatttgacggagacgccgtgctcttctcagacgaatccgaacatttcacaaaggaacatggtctcgacaaattcttccagtacgatactctttgtgagagcaaacctctcgctcaaggaccactgaaagggttcttggaagatctgggtcgacttcagaagaagttttacgcaaagaatgagcgactgttatgtccaattagaacgtacctggtaacggccaggtccgcagccagctcaggcgctagagtcctcaagacactacgtagatggggcctggagatcgatgaggccctcttcctggcaggcgcgcccaaaagtccaatcttagtgaagattaggcctcatattttctttgatgaccacatgtttcatatcgaaggcgcccagagaaaaagcctagggtggatgtcttag

SEQ ID NO: 31646 - DNA, 1887 bp, Artificial Sequence
  Description of Artificial Sequence: Synthetic coding sequence
atggagtcgctggtatttgcacgtcgatcaggacccacgccctcggctgcggagctagccagacctctcgcagaggggctcataaagtctcccaaacctttgatgaagaagcaagcagtgaaaagacaccaccacaaacataatctcaggcaccgctacgaattcctggaaacgctgggaaaagggacctacggaaaggtgaagaaggcccgagagtcttccggccgactggtagcaatcaaatctatccgaaaggacaagatcaaggacgaacaggatctgatgcatattcggcgggaaattgaaatcatgtcgagcttaaaccatccccacatcattgccatacacgaggtgtttgaaaattcaagcaaaatcgtgatcgtgatggaatatgcatctagaggcgatctgtacgattatatctccgaacgacagcagctgtctgagagagaagcaaggcacttcttccggcagatcgttagcgctgtgcattattgtcaccagaatcgagtagtacatcgagatctgaaactggaaaacattctcttggatgccaacgggaatattaaaattgccgacttcggtttgagcaacctatatcaccaaggaaaatttctccagacgttttgcggcagccccctttatgccagccccgaaattgtcaacgggaagccatataccggaccagaggtggactcttggtccctgggtgtacttttatacatcttagtccacggtacgatgccctttgatgggcacgatcataaaatcctagtgaaacagatcagcaatggggcctatagggagccgccaaagccatcggacgcttgtggtttgatcagatggctgctgatggtaaaccccactcgacgggcaactctcgaagatgtcgccagccactggtgggtcaactgggggtatgcgacgcgtgtcggtgaacaggaggcacctcatgagggtgggcatcctgggagcgactccgctagggcctccatggccgactggctccggcggagctcaaggccgctgctggagaacggagccaaagtctgctctttttttaaacagcacgcacctggcggaggttcaacaacaccaggcctggaacgccagcatagccttaagaaatctcgtaaagaaaatgacatggcacagtctctgcatagcgataccgccgacgatacagcccaccgcccaggaaaatcaaatctgaagctgcccaagggcattctgaaaaagaaagtttcagcgagcgccgagggggtccaggaggatccgcccgaattgtccccgatacccgctagtcctggccaggcggcgcctctgctccctaagaaaggcatcctcaagaagccccggcagagggagagtgggtactattccagtcccgaaccaagcgaatcaggagagctcctggacgctggagacgtgtttgtgtctggggaccctaaagagcaaaaacctccacaagcatccggattgctcttacaccggaagggaatcttaaagctcaacggtaagttcagccagacagccttggaattggccgcaccaactacgtttgggtcattagatgagttagcccccccacgccccttggctcgagcatcaaggcctagcggggccgtgtccgaagattctatactctcgtctgaaagttttgaccagctggacttaccggagcggctgcctgagccaccactgagaggctgcgtgtctgtggacaacttgaccggcctggaggagcctccctcagagggtcctggctcatgcctcagaagatggagacaagaccctctgggggactcgtgcttttctctcactgattgccaggaagtgaccgcgacgtatcgacaagccctccgggtctgtagcaaactaacatag

SEQ ID NO: 31647 - DNA, 462 bp, Artificial Sequence
  Description of Artificial Sequence: Synthetic coding sequence
atgagcaaagacctgaagatcctttgtaaggacccggccctggaacttagttgttatcgagaccatcaatttagcgggcgcaagttccagcaagagaagctactcaaggagagttcaaccctgaatatgggaaacctgtccttttataccactgaagagaagattcatgagctgttcagtcgcagcgatattagaaatatctttatgggactggataagattaaaaagacggcctgcggattttgctttgtggaatgccataaccgcgccgacgccgaaaacgccatgcgatttctcaccgggacatgcctcgacgagtggatcatttgcaccgactgggacgtgggtttccgggaagggcagcagtatggccggggcaaatccggaggccaggtgcgcgatgaatttagagaggatttccacagcggtaggggcgggtttggaaggcaaactcagatctag

SEQ ID NO: 31648 - DNA, 831 bp, Artificial Sequence
  Description of Artificial Sequence: Synthetic coding sequence
atgccaaagacatgccagtgctacgtcgggacaaaaactacaaacccctccgcctggccatcccgagagatgaagaagaagaagctgccatccgactctggtgatctggaagccctggaggggaaagacaaagagaaggaatcaacagttcatattgagacacaccagaacacttctaagaatgtggctgcggtgcagcctatgaaaagaggccagaagagcaaaatgaagaaaatgaaggagaaatacaaggaccaagatgaagaagacagagagctcattatgaagctgctgggctctgccggatctaacaaagaagagaagggcaagaaagggaaaaagggtaagactaaagatgagccagtcaagaagcagccccaaaagcctcgagggggtcaacgggtgagcgacaacatcaagaaggagacccccttcctggaagtgataacccacgagctccaggattttgccgtagacgacccccatgatgataaagaggagcaagacctggatcagcaggggaacgaagaaaacctcttcgacagtcttacagggcaaccccatccagaggacgtcctgttgtttgcaatccccatttgtgctccatacacaactatgactaattacaagtacaaggtgaagctcacacccggagtccagaagaaaggaaaagcagccaaaactgccctgaactcattcatgcacagcaaagaagctaccgcaagagaaaaagacctctttcgctccgttaaggatacagacttatctcgaaatataccaggcaaagtcaaggttagtgcccctaacctgttgaatgtgaaaagaaaatag

SEQ ID NO: 31649 - DNA, 2349 bp, Artificial Sequence
  Description of Artificial Sequence: Synthetic coding sequence
atggactctcgggtgatgtctaagtggatgaaaaacctgaaattaaagggatacattatccaaaagagggaaataaagcccagtcttgaagccgataaaccagtggaggatattcttacctatgaggagtttcaccctttcctattttcccagcacagccagtgcccctatatcgaattcgagagttttgataaggccgtcgatgagttttactccaagatagaagggcaaaaaatcgacctcaaagctctacagcaggaaaagcaagcattaaaaaaactggacaacgtgaggaaggatcacgagaaccgtttggaggcacttcagcaggctcaggagattgacaagctgaaaggggaacttatagagatgaatctgcagatcgtcgatcgggccatccaggttgtacgaagtgcactcgccaaccaaattgactggaccgagattggcttaatcgtgaaagaagcccaggctcagggagacccagtagccagcgccattaaagaacttaagttacaaaccaatcatgtgactatgctccttagaaacccctacttgctcagcgaggaggaagacgatgacgtagatggagacgttaatgtcgaaaagaacgagaccgagccccccaaaggcaagaaaaaaaagcagaagaacaagcaactgcagaaaccacagaagaataaacctttgctggtggatgtggacctctccctgagcgcctacgcaaatgccaagaaatactacgatcataagcggtatgccgctaaaaaaacccagaagacagtcgaagccgctgagaaggcctttaaaagtgcagaaaagaaaaccaaacaaacactgaaagaagtccagactgtgacgagcatccagaaggccagaaaagtgtattggttcgagaagtttctgtggtttatcagttctgagaattatctgattatcggaggtagagatcagcaacagaacgagatcattgtgaagagatacctaacccctgagggagacatttacgtgcacgccgatctgcacggcgctacaagttgcgttatcaaaaatccaacaggtgagcctattcctccgcgcaccctaactgaagcgggtactatggccttatgctacagcgcagcgtgggacgcacgggtaatcaccagcgcgtggtgggtttatcatcaccaggtgtcgaagaccgcgcccacgggcgaatacctcacgactggcagctttatgatccgcggcaagaaaaactttctgcctcctagctaccttatgatgggcttttctttcttatttaaagtagacgagtcttgcgtgtggaggcatcagggggaaagaaaagtgcgcgtgcaggatgaggacatggagaccctagcatcttgcacatccgagttgatctctgaagaaatggagcagctggacggtggtgacaccagttcggacgaggacaaagaggagcacgaaacaccagtagaagtggaactgatgacacaggttgaccaagaggacataacccttcaaagtggacgagatgaactcaacgaagaactcattcaagaggagtcaagcgaagacgagggggagtatgaagaggtgcgtaaggatcaggactccgtcggcgaaatgaaagacgaaggggaggaaacattgaattaccctgatacgacaattgacctctcccaccttcagccccaacgatctatccagaaactggcctcaaaagaggagtcctctaacagtagcgactccaaatctcagagtcggagacatctcagtgctaaggagcggcgtgagatgaagaaaaaaaagctccccagcgatagcggtgaccttgaggccctggagggcaaggacaaggagaaagaatccacagtgcacatcgagacacaccagaacacctcaaagaacgtcgccgcagtccaacctatgaaacgaggccagaagtcaaagatgaaaaagatgaaggagaagtataaggatcaggatgaagaagacagggaactaataatgaagctcctgggatctgccggaagtaataaggaagagaaaggcaagaagggaaagaaaggcaagacaaaggacgaaccggtgaaaaaacagccgcagaagccccgcggcgggcagagggtgagcgacaacatcaaaaaggagactcctttcctggaggttataacccatgaacttcaagattttgcagtggacgacccccacgatgacaaggaggagcaagatttggaccagcaggggaacgaggagaacctttttgactctcttacgggccaacctcatccagaggatgtgctgctgttcgctatccctatctgcgcaccatacacaaccatgactaactataaatag

SEQ ID NO: 31650 - DNA, 3105 bp, Artificial Sequence
  Description of Artificial Sequence: Synthetic coding sequence
atgaagtcccgattcagcaccatcgacttgagagccgtgctggccgagctcaatgccagtttgctcggcatgagagtcaacaatgtctatgatgttgataacaaaacctacttgataagactgcaaaagcctgattttaaagcaactctgttactggaatctggcatcagaatccatacaactgagtttgaatggccgaagaacatgatgcctagttcctttgccatgaagggaaacatagttttgacagactacgaatacgtcatcctcaacattttgaggtttcggaccgatgaggccgacgatgtgaagttcgccgttcgggagcgctatcccctcgaccacgcccgcgccgcagaaccattgcttaccctggaaaggctgaccgaaattgtcgcttcagccccgaaaggagagcttcttaagcgggttctcaatccactcctcccttacgggcccgcgctgatcgaacactgtctgctggaaaatggcttcagtggaaatgtgaaggtggacgagaaactggaaaccaaggacatagaaaaggtgctggtctccctgcaaaaggcagaggactatatgaaaacaacctccaacttcagcgggaaaggatacataatccagaaacgtgagatcaaacccagcctggaagctgacaagcccgtggaggatatcctgacttacgaggaatttcatccgttcctgttcagccagcattcacaatgtccctatattgaattcgagagcttcgacaaagcagtggatgaattttattccaagatagaaggccaaaagattgatctcaaggccctgcagcaggagaagcaggccctaaaaaagctggacaacgtgagaaaagaccacgaaaatcgcctcgaagccctgcaacaggctcaggagattgacaagctgaagggagaactcatcgagatgaacttgcagatagtggacagagccattcaggtggttaggagcgctctggccaatcagatcgattggactgaaatcgggctgattgtcaaggaggctcaagctcagggcgatcctgtggcatccgcaattaaggagttgaaactgcagacaaatcacgtaactatgctgttacgcaacccctatcttctgtccgaagaagaggacgatgatgtagacggcgacgtgaacgtcgaaaaaaatgaaacagaaccacccaaaggaaaaaagaaaaaacagaaaaacaaacaacttcagaaaccgcagaagaacaagcccctcctggtcgatgtcgacctgagcttatctgcttatgcgaatgcgaaaaaatattatgaccacaagcgctacgctgctaagaagactcagaaaaccgtggaggccgcagaaaaagcattcaaaagcgccgagaagaaaaccaaacaaacgctgaaggaggtgcagacagtaacttctatccaaaaagctagaaaagtgtactggttcgagaagttcctgtggtttatctctagcgaaaattaccttattatcggtggtagagaccagcagcagaatgagattatcgtgaagagatacctgacgcctggcgatatatacgtgcacgccgacttacatggggcaacctcttgtgtcataaagaatccaacaggggagcccatccccccgagaacgctcacagaagccgggaccatggccttatgctattccgcggcatgggacgcccgcgtgataacatctgcctggtgggtgtaccaccaccaggtgagtaaaaccgcccccacaggggagtacctcaccaccggatcatttatgatcagggggaaaaaaaacttcctgccaccctcttacctcatgatgggttttagcttcctcttcaaagtggatgaatcatgtgtatggagacaccagggcgaaagaaaggtgagggtgcaggacgaggatatggaaaccttagcttcttgtaccagcgaactgatctccgaagaaatggagcagctcgacggtggcgatacgtcttctgatgaagataaggaggagcacgaaacccctgtggaggtcgagctcatgacccaggttgaccaagaagatattaccctccagagtggcagggatgaactgaatgaagaattaatacaagaggagagctccgaggacgaaggagagtatgaggaggttcgaaaggaccaggatagtgtgggtgaaatgaaagacgagggagaagagactctgaactacccagacacaaccattgatctaagtcacttacaaccccagcggagtatccaaaagctcgcttccaaagaagaaagtagcaattcttcagactctaaatctcagtcacggcgccacctatccgctaaggagcgacgcgaaatgaaaaaaaaaaagcttccttcggatagtggcgacctggaggctttggagggtaaggacaaggagaaagagagcaccgtgcatatcgaaacccaccagaacactagcaaaaacgttgctgcggttcagcccatgaagagagggcagaaaagcaaaatgaagaagatgaaggagaaatacaaggatcaggatgaggaggaccgcgagttaattatgaagctgctgggctctgcgggatcaaacaaagaagaaaagggaaaaaagggtaagaagggtaagacgaaagatgagcccgtgaagaagcagccacagaaacctagaggaggccagagggtgagtgataatataaaaaaggagacccctttcctcgaagtgatcacgcatgagttacaagattttgccgtcgacgacccccacgacgataaagaggaacaagatcttgatcaacagggaaacgaagaaaatctgtttgattccctaaccggccaacctcatcctgaagacgtccttttgtttgccatccccatatgcgccccgtacaccaccatgacgaactataagtacaaggttaaactgacacctggggtgcagaaaaagggcaaagcggctaagaccgcactgaactcttttatgcattctaaggaagccaccgcccgcgaaaaagacctgtttcggtccgtgaaggataccgatctctccaggaatatcccagggaaggtgaaagtgtcagccccaaatctcttaaatgtgaaaaggaagtag

SEQ ID NO: 31651 - DNA, 3168 bp, Artificial Sequence
  Description of Artificial Sequence: Synthetic coding sequence
atgaaaagtaggtttagtactatcgacctccgggccgtgctggcagagctgaatgcctccctgcttggcatgagggttaataacgtgtatgacgtcgataacaaaacatacctcatccgactgcagaagccggactttaaagctaccttgctgctggagtctggaattcgcattcacactactgaattcgagtggcctaagaacatgatgccgtcatccttcgcaatgaagtgccgcaaacatcttaagtcccggaggttagtcagcgctaagcaactaggcgtcgacaggatcgtggattttcagttcggctcggatgaggctgcttaccacctgattattgaactgtacgaccgaggcaacatcgtcctcacagattacgaatatgtgatattaaacattctgcgattcaggaccgacgaggcagatgatgtcaagttcgccgtccgggagcgctacccccttgaccatgctcgagccgccgagccactgttgaccttagaacggctgactgagattgtggcttcagctcctaagggcgagctgcttaagagagttctcaacccgctactgccttacgggcctgcccttatcgagcactgccttttggaaaacggattctccgggaacgtgaaagtagatgagaagcttgagacgaaagatatagaaaaggttctcgttagccttcagaaagcagaggactacatgaagactacatctaatttctccggaaagggctatatcatccaaaagcgtgaaataaagccaagcctggaagccgacaaaccggtcgaagacattctgacatacgaagagtttcacccctttttgttcagccaacacagccagtgcccgtacatcgaattcgagagctttgataaggccgtggacgaattttacagtaaaatcgaagggcagaaaattgacttaaaggccttacagcaggaaaaacaggccttgaaaaagctggacaatgtgcgcaaagatcatgaaaacaggttggaagccctgcagcaggctcaagaaattgataaactcaaaggtgaacttatcgaaatgaatctgcagattgtggacagagcaatacaggtggttcggtctgctcttgccaaccagatcgactggacagaaatcggattaatcgtgaaggaggcccaggcccagggggatcccgtggctagcgcgatcaaagaactcaagctccaaaccaatcacgtcacaatgttgctgcgcaacccctacctattatctgaagaagaggacgacgacgttgacggggatgtgaacgtggagaaaaatgaaacggaacctcctaaaggaaaaaaaaaaaagcagaaaaataaacagcttcagaagccccagaagaataaacccctgctcgtggacgtggatctgagcctgagtgcatacgccaacgctaagaagtactacgatcataagcgctatgctgccaagaaaacacaaaaaacagtggaagctgctgaaaaagcattcaagagcgcagagaagaaaactaagcagacactgaaggaggtgcagacagtgacgtcaatccagaaggctaggaaggtttactggttcgaaaaattcttgtggtttatcagctctgaaaactatctgattatcggcggcagagaccagcaacaaaatgaaatcattgtcaagcgctacctcacccccggcgagcccatccccccccggacactcactgaagccgggaccatggcattgtgttacagtgccgcgtgggatgctcgggtgatcacaagtgcctggtgggtgtaccatcaccaagttagtaagacagcacccaccggcgagtatcttacaaccgggtcttttatgatcagaggtaagaagaatttcttgcctccttcctacctgatgatgggattttccttcctgtttaaagtggacgagagctgtgtgtggcggcatcagggcgaacgcaaggtgagagtgcaagatgaggatatggaaacgctagctagttgcacgtccgaactaatctcagaggagatggaacaattggatggcggggatacaagtagcgatgaagataaggaagaacacgaaacccccgtcgaggtcgagctgatgacgcaagttgaccaggaagatattactttgcagtccggacgagacgagctgaacgaagagctgatacaggaggaatcttctgaggatgagggggagtacgaggaagttagaaaagatcaagattccgttggggaaatgaaagacgagggcgaagagacgttaaattatccagatactacgatagacctttcccaccttcagccacagcggtccatacaaaaactggcttccaaggaagagtcttccaatagttcagattccaagagccaaagccggagacacctctcagcaaaggagaggagggaaatgaaaaaaaaaaagctaccctcagactctggagacctggaggcactggagggcaaggacaaagagaaagagagcacggtgcacatagagacccaccaaaacacaagtaaaaatgtggctgccgttcaaccaatgaagagaggtcagaaatctaaaatgaaaaaaatgaaggaaaagtataaggaccaagatgaggaagaccgcgaacttatcatgaagctcctgggcagtgccggatcaaacaaagaagaaaaagggaaaaaagggaaaaagggaaagaccaaggacgagccagttaagaagcagccacagaagccccggggtggccaacgggtgtcagataatattaaaaaggagactccgttcttggaagtaattacacacgagttgcaggattttgcagtggacgacccacacgatgacaaggaggagcaggacctggaccagcaaggcaatgaggaaaatttatttgatagcttgacaggccagccccaccctgaagacgtgctgcttttcgcgattcccatatgtgcgccctacaccacaatgaccaattacaaatacaaggtcaagctgactccaggcgtgcaaaagaagggaaaggccgcaaagacggccctcaattctttcatgcatagcaaagaagctactgcccgggagaaagatctgtttagatcggttaaagacactgatctgtcacgaaacatcccgggtaaagtgaaggtgtcagccccaaaccttttgaatgtgaagagaaaatag

SEQ ID NO: 31652 - DNA, 1383 bp, Artificial Sequence
  Description of Artificial Sequence: Synthetic coding sequence
atggccttccagacacaggcaggggcccagatccctattgaacgcctggcgtccgaaagggcaatcacagtgaaagtccccaataacagcgactgggcagcaagaggccaccgatcatcggccaacagtgtcgtggtgcagccccaggcctccgtcggcgcagtcgtgacacttgactcaagtaatcccgcggctgtactgcacctgcaacttaactatactctcctcgacgggaggtacctgagcgaggaaccagagccataccttgccgtatacctccactccgagcctcgacctaacgaacacaactgtagcgcctcaagacgaatccgtcccgaaagcctccagggcgccgaccatagaccctacacattctttatttcaccagggacacgcgacccagttggctcctataggttaaacctgtctagccactttcggctgagcgcactggaagtatctgtggggctgtacacctccttatgccaatacttttcagaagaagacgttgtgtggcgtaccgagggtctgttgcccttagaggagacatccccgaggcaggcagtgtgccttactcggcacctaaccgcattcggcgcgagtctgtttgtacctcctagccacgtgaggtttgtcttccccgagccgaccgcagatgtcaattacattgttatgctgacatgtgcagtgtgccttgtcacctatatggtgatggctgctatattgcataaattggaccagctggacgcttccagaggccgcgcaatccccttctgtggacagcgggggaggttcaagtatgagagcagctcccgccaggccggcgccggagcccaagtgcctcggcccacatgggcctcatgctgcatggggtggacggccggcgctgccactggaacttggatggctaccgaaccatccaccgccaccgcttggacctcctccggttcaccaccaagaactgcctgggtcgcttgcggccgctctgaatgtggtaccaccaaaggatcagccctccccggatcctgctctacctcctcatccgggacatgccgccgccacaccgcccctagttcctggtctatgaccggattccggtggcggcgacgcccaacaggagcgtggtggaggaggagatgttggcctagggtcacgcagccttgttgtgcgagcggcgcatgctggtggctcagctgttctgctgcttccctcacttccacctcagggagcccctatgggaccggacgcctggtcgctgtctctttagcatcaagagggccacctgcggcattcagtagctcggcatccagctgggcccctactccttgtgggacaggattgcttgtgacattacctactgccaggggaatgtgtccaggctag

SEQ ID NO: 31653 - DNA, 1332 bp, Artificial Sequence
  Description of Artificial Sequence: Synthetic coding sequence
atgaggttgcggttctggctgttgatctggctgctgctaggctttatcagccatcaaccgactcccgtgattaactcactcgcagtgtaccggcacagggaaaccgatttcggggttggagttcgggaccacccagggcagcacgggaagaccccttcgccccaaaaactggataacctgatcatcattattatcggcttcctccggagggacactttcacaatcctgttctgtaccagttacctttgtgtatcctttctgaagactatcttctggtcaagaaacggccacgatgggtctacagatgtgcagcagcgtgcttggagatccaataggagtcggcagaagggcctgcgttctatctgtatgcacaccaaaaaacgcgttagcagctttcgcgggaataagatcgggttgaaagatgtgataactcttcgcagacatgtcgagacaaaggtcagggctaagatcagaaagcggaaggtgaccacaaaaatcaacagacacgataaaatcaacggtaaacggaagaccgcaagaaaacagaagatgttccagcgcgcccaggagctgcggcgaagggcagaggactatcacaagtgtaagatcccgcccagcgcacggaagccactttgtaattgggtcagaatggcagcagcggaacatcggcactcctcaggcctgccttgctggccatatctgaccgctgaggcgctcaagaatagaatggggcgccagccacctcctcctacccagcagcattctattaccgataactctctgtcactgaaaacccctcctgaatgcttgctacacccactgcctccaagcgtggacgacaatataaaagagtgtcccctcgccccacttccacctagcgttgacgataacttaaaagagtatctcttggttcctctccccccctctccattgcctccctctgttgacgataacctgaaagactgcctttttgtccccttgcccccttcccctctaccaccttctgtcgacgataatcttaaaacccctcccctggcaacccaagaagctgaggccgagaagcctcccaaacccaaacgctggagagtcgacgaggttgaacaatcgccaaaacctaagagacgcagggccgacgaggtggaacaaagcccgaagcctaaacgccagcgcgaggcagaagcacagcagctccctaaacccaagcggcgtcgtctgagtaaactgcggactcggcattgcacacaagcctgggcgattcgcataaatccctgggtggaaaaaaagaaaaagattaagaagcagaacaaaacccatgcaccaaagaccaactag

SEQ ID NO: 31654 - DNA, 1983 bp, Artificial Sequence
  Description of Artificial Sequence: Synthetic coding sequence
atgtttcagcgggctcaggaactcaggcgtcgcgccgaggattaccacaaatgtaaaattccaccctccgccagaaaggctttatgcaactgggttagaatggcagccgcagagcatagacatagtagtgggttgccctattggccttacctgactgctgagaccttaaaaaacagaatgggacaccagcccccacctcctacccagcagcactccattaccgataactctctgagtctaaaaacccccccagaatgcttactgaccccacttccccctagcgccgatgataatctaaaaacgccccccgaatgcgtgctaacgcctcttcctccttcggccgatgacaacctgaagacaccgcctgagtgtgtcctaactcccctgccaccaagtgcagacgataatttgaaaacaccgcctgaatgcctgctaactccactgccgccttctgccgacgacaacttaaagactcccccagaatgtcttctcacacccctgccgccttcagccttacccagcgccccccctagcgccgacgataacctgaagacccgcgctgaatgcctgctccaccctctgccacctagcgcagacgataatctgaaaacaccatcagaacgacaactgacacctctgcctcccagcgcccccccctccgccgacgacaatatcaaaacccccgcttttcatccacaacggatgatcagtcgccatttgccctctgtgtcttcattgccttttcacccccagctgcacccacagcagatgataatatcgcggtacctgttgtcagtatgtggattcaggttccaccatcagcctatgatcatatcccgtcaccttcccagcgtgtcctctttaccttttcacccacaactgcacccacagcagatgattatctctaggcacttgctgtccgtgtgcgggggccgctttcacccagagaggatgattattagccgacatcttccgtcagtctcctcactaccttttcatccccagctccaccctcaacaaatgataattagcaggcacctaccatctgtgtgtggggggaggttccacccccagaggatgatcatatctcggcatctgccaagcgtgagttcattaccattccaccctcagctccacccacagcagatgatcatttcccgacacctcccaagtgtatgtggcggccgttttcatccccagcagatgatcatttcacggcatctcccttcggtaagttctttgccttttcacccccagctgcatccacaacagatgattatttcaagacatctcccatctgtgtgtggaggtcgatttcatccccagcggatgattatttcccgtcatctgccctcagtctcatcactcccatttcatccacaattacacccccaacagatgattatttcccgccatctgccttccgtttgtggcgaacgcctgcgcggccccctcccaccttcagccgacgacaaccttaagacccctagcgagcgacagttgactcctctgcccccttctgcaccaccctcagccgatgataatatcaaaactcctgcagagcgcttacggggccctctgcctcccagcgcagatgataatctgaaaaccccccccttggctacccaggaggcagaagccgagaagcctagaaaaccgaagagacaacgagccgcagagatggagccgccacccgagccaaaacgccggagagtaggtgatgtagagccatccagaaagccgaagaggcggagagccgcagacgtggagccctccagccccgagcccaaaaggcggcgggtcggtgatgtggaaccatctcggaagcctaaacggcgccgggccgctgatgtggaaccctcaagtcctgaacctaagaggcgcagggtcggcgacgtagagccaagcaggaagcctaagcgacgtcgcgctgcagatgtcgaaccgagcctgcccgaacccaagcgcagaaggctgagctag

SEQ ID NO: 31655 - DNA, 3189 bp, Artificial Sequence
  Description of Artificial Sequence: Synthetic coding sequence
atgcacactaaaaagcgcgtgtcatccttcagaggtaataaaatcggcttgaaagatgtgattacattgcggcgacacgtcgaaactaaagtaagggccaagatccgaaagcggaaagtgactacaaagataaatcaccatgataaaataaatggaaagcgaaagaccgcgagaaaacagaagatgttccagagagcacaagagctgaggagacgggctgaggattaccacaagtgtaagatacccccaagtgctcgtaaagccctgtgtaattgggtcaggatggccgctgctgaacacaggcatagttcaggactgccctattggccatatcttactgcagagactctgaagaacaggatggggcaccaaccacctcctccaactcaacagcacagcatcacagacaatagcctatctctgaaaaccccccccgaatgcctacttactcctctccctccaagcgctgatgataatcttaaaacaccccctgagtgtgtactgacaccattgccacccagtgcagatgacaacttgaagacaccaccagagtgtgtcctcacccctctacccccctctgctgacgacaatctaaagacacctccagagtgcctcttaacccccctgcccccatcagccgacgataatcttaagactccccccgagtgtctcctgacaccactgcctccgtcggctcttccatctgccccacccagtgccgacgacaacttgaaaacaagggccgaatgtcttcttcaccctctgcccccatccgccgacgataatctgaaaactccgtcagagcgacagctgaccccactcccacctagtgcacctcctagcgccgacgacaacattaagacaccggcagagcgcttaaggggtccactgcccccatctgctgacgacaatctcaagacaccgtccgagcggcagctgacccctctgcctcccagcgcccccccgtctgctgacgacaacatcaagactcccgcagaacgactacgcgggcccttaccaccctccgcagatgataaccttaaaaccccttccgaaagacccttgcctccttctgcgccaccatccgcagacgacaacatcaaaacacccgccgaacggctcaggggcccactccctcccagcgcagacgacaacttgaagactccaagcgaacgacatattatgccattcccttccgccgatgataacattaatactccagccgagcgattacgtggacctctgccacctagcgctgatgataatctcaagacaccgtctgagagacaactgaccccactgcccccatcggcacccccatctgcggacgataacataaagacccctgcagaaagactccgcggccctctgccacctagcgccgatgataatcttaaaacgccaagcgagaggcagctgacgcccttgccgccaagcgccccgcctagcgctgacgacaacatcaaaaccccagccttccacccccagcggatgataagccgacatcttccttctgtgtctagtctgcccttccacccccaattgcacccgcaacagatgatcatatctcgctaccttctgagcgtctgcggctttaggttccatcatcagcccatgatcatctcccgccatctgccctctgtgtcctctctcccttttcatccacagctgcacccgcagcagatgatcataagccgccaccttctgagcgtttgtggtggccggtttcaccctgagaggatgatcatatctagacatctgcctagcgtgagttccctcccctttcatccacagctccaccctcaacagatgatcatttcccgccacctgcccagtgtttgcggaggccgcttccacccccagcgcatgatcattagtaggcaccttcccagcgtttcctccctgcccttccacccacagctgcacccccaacagatgataatcagtcgacacttacctagtgtgtgtggcggacgctttcatccacagcagatgatcattagtcggcacctgcccagtgtgtcctctctcccattccacccccaactacatccgcagcagatgattatctccaggcacctgcccagtgtgtgcggaggaaggtttcacccacagcgcatgatcatctcacgacaccttcccagcgtgagttctctgcccttccaccctcagttgcacccacagcagatgatcatttccagacacctgccaagcgtatgtggggaaagattacggggcccattgccaccatctgctgacgacaacctaaagacaccgtcagagcgacagctgacacctttacctccatctgccccaccttcggccgatgataatattaagactccagcggaaagactgcggggcccgctccctccctccgctgacgataatctcaaaactccgtccgaaaggcagctgactccactccctcccagcgctccaccatcagccgatgacaacatcaagacccccgctgaacggctgaggggtccgctgccaccttctgcagacgacaatctgaagactccatctgagcgccagctgacccccctccccccgagtgctccacctagtgccgacgacaacattaaaactccagctgaacgactccggggtcccttgcccccttccgctgatgataacctgaagacaccgagtgagcggcagctgactccccttcctccatcggccccccccagtgccgatgacaacatcaaaacccccgcggagagactccggggaccactgcccccctctgccgacgacaatctcaaaacaccatccgaaaggcaactgaccccgctgcctccgtccgcccctccatcagcagacgacaacatcaaaactccagctgagcggctgagaggacctctgccgccatctgctgacgacaatctgaaaactccccctctagcaacccaagaagctgaggcggagaaaccgaggaaacccaaacggcagcgagccgctgagatggagcctcctcctgaacctaaacgccgaagggtaggcgatgtggaaccatctcggaagccaaagcggaggcgggcggccgacgtggaaccaagctcaccggaaccaaagcgacgccgggtgggtgatgtggagcccagccgcaaaccaaagcgacggcgggccgcggatgtggaacccagcctgcctgaacccaagagaagacgtttgagctag

SEQ ID NO: 31656 - DNA, 2547 bp, Artificial Sequence
  Description of Artificial Sequence: Synthetic coding sequence
atggtaaaactttctatcgtattgacaccacagtttctgagccacgatcagggccagttgactaaagaattacagcaacacgtgaaatcagttacctgtccttgtgagtacctgagaaaggttattaacaccctggcagaccaccatcatcgaggcactgacttcggcggaagcccctggctccatgttattattgccttccctacatcatacaaggtcgtgatcaccctgtggatcgtctacctgtgggtgtccttgctaaagaccatcttctggagtaggaatggccacgatgggtccaccgacgttcagcaacgagcatggagaagcaaccgcagacgacaagagggactgagatccatctgtatgcacacaaaaaaacgagtgtctagctttagaggaaataagatcggccttaaagatgtgatcactttgcgaagacatgtcgaaaccaaggtgagggctaaaatacggaagagaaaggtgacaacgaagataaatcatcacgataagatcaatgggaagcgaaagaccgcaaggaaacagaagatgtttcaaagagctcaggaactgagaaggcgcgctgaggattaccacaagtgcaagattccaccctccgctaggaaggctctatgcaactgggtgcggatggctgccgcggaacaccgccactcttccggactcccctactggccgtacctgacagcggagacacttaaaaacagaatgggccatcaacccccaccgcccacacaacaacacagcattacagataacagccttagccttaaaacccctcccgagtgtttgctgaccccattaccccctagcgctgacgacaatctgaaaacgcccccagaatgtgtcctaaccccactgccgcctagcgccgatgacaacctcaagacccctcccgagtgcctccttacacctctcccgccaagcgccctgccctctgcacctcccagcgccgatgacaacctaaagacacgcgcagagtgcctacttcaccctttgcccccttcagccgatgacaacctgaagacaccgtcggagagacagctgacaccccttcctcccagtgctccgccatctgccgatgacaacatcaagacccctgccttccatccacaaagaatgatcatttccagacacctgccaagcgtgtcaagcctgccgttccacccgcaacttcacccacagcagatgattatatctcgccatctgccgagcgtttgtgggggtcgtttccacccccagcccatgattatatctaggcacctcccctctgtttcttctctgccattccatcctcaactacacccccaacagatgatcatcagcagacatctgttatcggtctgtggcggtaggtttcatccagagcgcatgatcatctcccggcatttgcctagcgtgagctcccttccgtttcatccccagcttcaccctcaacagatgataataagcaggcatctgcctagtgtctgtggaggccggttccaccctcagagaatgatcatcagcaggcatttgccatctgtgtcatccctgccattccaccctcagctccacccacagcagatgatcatatctcgacacttgccgtcggtatgtggcgggcgcttccatccgcagcagatgatcatcagccgtcacttgccatctgtatcttcactgcccttccatccacagttacaccctcaacaaatgataatctcaagacacctgccaagtgtctgcggcgggaggttccacccacagaggatgattatttctcggcatttgccttccgtcagctcactgcctttccaccctcagctacacccacagcagatgatcatatcccgccacctgccctccgtgtgtggtgaaaggctgagggggcccttaccgccttcggctgacgacaacttaaaaacaccctcagagagacagctgacaccattgccaccatctgccccaccatccgctgacgataacattaaaacgcccgccgaaagattacggggacccctgcccccctcagccgacgataatctgaagacaccttccgaaaggcagcttacccccttacccccttccgccccaccttctgcagatgacaacattaaaaccccggcagagagactaagggggcccctcccaccctctgccgacgacaacctcaaaaccccgccactggcaacgcaggaagctgaagctgagaaacctagaaaaccaaagaggcaacgggccgccgagatggaacccccccccgagccaaagcgacgtagagtaggagatgttgaaccttccagaaagcctaagaggcgcagggctgcagatgtggagcctagctcgcccgagcctaaaagacggagggtcggcgacgttgagccatccaggaaacctaaacggcgccgagcagcagacgtggagcctagctccccggaacccaaacgccggcgggttggtgacgtcgaaccttcccgaaagccaaagaggcgccgcgcggcagacgttgaaccatctctgccagagccaaaacgtagaaggctgtcctag

SEQ ID NO: 31657 - DNA, 2949 bp, Artificial Sequence
  Description of Artificial Sequence: Synthetic coding sequence
atgtttcagcgcgctcaggaactccgacgacgcgccgaggactatcataaatgtaaaatcccaccaagtgccagaaaggcactttgcaactgggtacggatggctgcagccgagcataggcattcaagtggcttaccttactggccatacctgactgctgagacgttaaagaaccgcatgggtcatcagccccccccccctacacaacagcactctattactgacaactcattgtcgctgaagacaccgccggagtgtcttttaacacccctccctccctctgcagacgataaccttaaaacacctcccgagtgtgtactgaccccactgcccccctccgctgacgataatttgaagacccctcctgagtgcgtccttactcctttgcctcccagtgctgacgataaccttaagaccccacccgagtgcctgcttaccccattacccccgagtgctgatgataacctgaaaacccccccagagtgtttattgacaccgctccccccctccgctctcccctccgcaccaccaagcgcagatgacaatttgaaaactcgagccgaatgcctccttcatcccctgccgccctccgccgacgacaacctgaaaacaccttctgaacgacaactcacccccttacctccctccgcccccccttcggccgacgacaatattaaaacgcccgccgaacggctgcggggacctctccctccaagtgcggacgacaacctgaaaacgccaagcgagaggcagctgacacccttaccaccgtccgctcccccatccgcagacgacaacatcaaaacccctgctgaaagactaagaggccccttgccaccttctgcagacgacaatctgaaaactccttcagagcgccgaacaccccttcctccttctgcccccccttccgccgatgacaacatcaaaacacccgctgaaaggctgcgaggcccgctgcctccgagtgcagacgataacttgaaaacaccatcagaaagacacataatgccccccccctccgctgacgacaatataaacacacctgctgagcggttgcgagggcccctccctccgtctgcggacgacaacctgaaaaccccaagcgaacgacagctgactcctctgcccccgagtgccgacgacaacatcaagactcccgctgagcgcctccgcggacccttaccacccagtgcagacgataacttgaagacccctagtgagcgacagctgacccctcttccccctagtgccccgccctctgcggacgacaatattaagatccctgcggaaagactgcgcattcccctaccaccttccgctgatgacaatctgaaaactccatcggagcgccagctcacccccttgcccccttccgccccaccatccgccgacgacaatattaaaacccccggcttccacccggaacgaatgatcatcagccgccacctgccctcagtctcttccctgccctttcacccccaactgcatccacagcagatgattattagccgccatctccctagtgtctgtggtggccgctttcaccctcaaagaatgattatcagtcggcatctccctagtgtttcatcgttgccatttcacccccaactgcacccacagcaaatgatcatttccagacacctgcccagcgtgtgtggaggacgtttccatccccagcagatgatcatatcccgccacttaccctcagtcagcagtttgccctttcatcctcagttacaccctcagcagatgattatcagtcgccatctcccaagtgtgtgtggaggacgcttccatccccaaagaatgatcatcagcaggcacctgcctagcgtgagcagcctccccttccaccctcaactgcatccccagcagatgattatctccagacacctgccatccgtgtgcggcgggaggttccatccccagaggatgataatcagccgacaccttcctagcgtatcaagcttacccttccacccacagctgcaccctcagcagatgattatctctcgacacctgccatcagtatgcggtcccctcccaccgtccgcagacgataatttaaagacaccgtccgaaagacagctgacccctctaccaccctccgctcctccttctgctgatgacaatataaagacccctgctgagcggctacgcggccccctacctccatcggcagatgataacctcaaaacacccagcgagcggcagcttaccccactgcccccctccgctcccccctcggcagatgataatattaagacacccgccgagcgcttgcgagggcctcttccaccgagcgcggacgacaacctaaagactccctcagagagacagctcacccccctgccacccagcgcccccccaagtgccgatgacaatattaagacccctgccgaacgtcttcgcggccccctgcctccttctgccgacgacaatcttaaaacgcccagtgagcgccagttgactccacttcctccttcagctcctcctagtgccgacgataatataaagacgcccgcggagcgcctaaggggacctctgccccccagcgcggatgacaatctcaagacgccaccactggctacccaagaggcagaggccgagaagcctcgaaaacctaaaagacagagagccgcagagatggaaccgcctcccgagcctaagcgccggcgggtcggcgatgttgagccctccagaaaacccaagcggagaagagcagctgacgtggagccatcaagtcccgagccaaaacgacgtagggtaggggatgtggaacccagtcgtaaaccaaagagacgccgagccgcagatgttgagccctcgtcccctgagcccaaacgccgacgcgtgggagatgtggagccatctcgcaagcctaaaaggagacgagcagctgacgtcgaaccctctctgccggagcccaagcgcagacgcctctcctag

SEQ ID NO: 31658 - DNA, 1263 bp, Artificial Sequence
  Description of Artificial Sequence: Synthetic coding sequence
atggccgcagcagagcacagacacagctcagggctgccatactggccctacctcactgctgaaacgttaaaaaataggatgggtcaccagccacctccccccactcagcaacattccattacagacaactccttgtcattgaagacaccgcccgaatgtttgctgacacccttgcccccatctgccgatgataatctcaagacccctcccgagtgcgtactgacccctctgccaccgagtgcggatgacaaccttaagacacctccggagtgcgtgctcacccccctgccacccagtgcagatgacaacctgaaaacacctcccgaatgtttactgacccccttgccgcccagtgccgacgataacctgaagacccctccagagtgtttattgacaccattacctccatctgcactgccatccgcgcccccttccgccgatgataatcttaaaacgagggcggagtgtctgctacaccccctccctccgtccgctgatgacaatctcaagacacctagcgagaggcaattgactcccctgcctccctccgcccccccaagcgccgatgacaatattaagactcccgccgaacgcctcagaggccctctgcccccttcggcagacgacaacctgaaaacaccatctgaacggcagctgactccactgccacctagcgcaccaccttcagctgacgataatattaagacaccagccgaaaggctgcgtgggccgctaccgccctccgccgatgataacttaaaaacacccagtgaacgtcagctaacaccattgcccccctccgcaccacctagtgcagacgataacataaagacacctgccgaaaggctgcgcggaccactgccaccctccgccgacgacaatctgaaaacgcctccacttgccacacaggaagctgaagccgaaaaacctcggaaacccaagcgtcagcgcgcagccgagatggagccaccccctgagcctaagaggcgccgtgttggtgatgtagaacctagtcgcaagcccaagaggcgcagggccgcagatgtcgagccttcctctccagagcccaagcggagaagagttggagatgtagagccatcaaggaaacctaagagacgcagggccgccgacgtggagcctagcagccccgagcctaagcgccgtagggtgggagatgtagaaccatctcggaaacccaagcgacgccgtgctgcagatgttgagcccagcctccccgagcccaaacggcggaggctctcgtag

SEQ ID NO: 31659 - DNA, 462 bp, Artificial Sequence
  Description of Artificial Sequence: Synthetic coding sequence
atggctgccgtagaacatagacactcttcaggattgccatattggccctatttgactgcagaaacgctgaagaatagaatgggacaccagccacctccccctacacagcagcatagcataattgataactccctctccctcaagaccccgtcagagtgcgtgttgtatccgctgcctccgtctgccgatgacaacctcaagacacctccagaatgcctgctgaccccgcttccacctagtgcactgcctagcgcagatgataatctgaaaacccccgcagagtgtctactgtaccccctgccgccctcagcagatgacaatctcaaaacccctccagagtgtctgctgactcctctgccgccatccgccccgccctcagcagatgataatctgaaaacccctccagaatgcgtatgttctctcccattccaccctcagcggatgatcatttcacgaaattag

SEQ ID NO: 31660 - DNA, 528 bp, Artificial Sequence
  Description of Artificial Sequence: Synthetic coding sequence
atgaaagtcactacaaaagtcaatagacatgacaagatcaacggcaaacggaagaccgctaaggaacacctgcgtaaactgtccatgaaagagcgggagcatcgggaagaagaacggcaggtcagtgaggcagaggagaatggcaaactcgacatgaaagagattcacacttatatggagatgttccagcgtgctcaggctttaaggagacgcgcggaagattattacagatgtaagattactccctcagcccgcaagccattgtgcaacagggtgagcctgctggttttcctggctttcggccatagcctacccggacaagatatggatactttcttctcactcagactctgcgctcaggccctgcaaagagagatggccgaacgcaaagctgcatataagcaccactcccccattccggtcggaaactgcgttgcacagaagcatctgcatccccatcctgtgggaccccctagcaacattttgtcggtccgtgggtctgtgtttgtgatagctaacgggccatag

SEQ ID NO: 31661 - DNA, 1062 bp, Artificial Sequence
  Description of Artificial Sequence: Synthetic coding sequence
atgcggctgaggttttggctcctgatctggttgctgctgggttttatcagccaccagcctacccccgtgagcttcttaaaaaccatattctggtcaagaaatgggcatgatggttccatggacgtgcaacaaagggcgtggaggagtaacagaagccggcagaagggccttagaagtatatgcatgcataccaagaaaagggtgtcttcgttccgagggaataagatcgggctcaaggacgtgatcaccttgcgtcggcatgtagaaacgaaggtgagggctaaaatcaggaaaaggaaggtgactactaaaatcaatcgacatgacaaaatcaacggtaaacgcaaaaccgcgcggaagcaaaagatgtttcagcgcgcccaggaacttcgccggcgggctgaggattaccataagtgtaagattcctcctagcgcacgcaagccattgtgcaactgggtcaggatggcagccgccgagcaccgacactctagcggtcttccctattggctgtatcttaccgccgaaaccctgaagaacaggatgggaaggcagcctcccccccccacacaacagcatagcattacagataatagcttgtctctgaaaacgccaccagaatgccttctaacgccactgccgccatccgtggatgataacattaaggagtgtcctctggctccccttccaccatcacctctaccaccgagcgtggatgataacctgaaagaatgcctcttcgtacccttacctccttccccgctgccgccttctgtggacgacaatctgaaagagtgtctatttgtacccttgccaccttccccactcccacccagcgtggacgataatctgaaaactccccccctggctactcaagaagccgaagtcgagaagcctcctaaacccaaacgttggagagttgatgaggtcgagcagtcacctaagcccaagaggcagcgagaggctgaagcgcagcagctaccgaagcccaaacgcagacgactatctaaactgcgcactagacattgtacacaggcgtgggccattcgtatcaatccatag

SEQ ID NO: 31662 - DNA, 294 bp, Artificial Sequence
  Description of Artificial Sequence: Synthetic coding sequence
atggaggctccagccgaaagggcgctgccgaggcttcaggccctggcacgcccacccccacccatcagctacgaagaggagctttatgattgtctggactactattacttacgtgacttccccgcctgcggggcagggcgctccaaagggagaactagacgcgagcaagccttgcgtaccaactggccagcacctgggggccatgaacgcaaggttgctcagaagctgctgaacggccagagaaaacggcggcaacggcagttgcaccccaaaatgcgaacccggctgacctag

SEQ ID NO: 31663 - DNA, 1845 bp, Artificial Sequence
  Description of Artificial Sequence: Synthetic coding sequence
atgaacacctttcaggatcaaagcgggtcctcctcgaatcgggaacctttattgaggtgctccgacgctcggcgagaccttgagcttgcaatcgggggggtcctgagagcagaacaacaaataaaggacaatcttagggaggttaaggcgcagattcactcgtgcataagcaggcatctcgaatgtctacgctctcgggaggtctggctgtacgaacaagtggatctgatttatcaattgaaggaagaaaccctacagcagcaggcccaacagttatactccctcttggggcaatttaactgtcttacacaccagcttgaatgcacacagaataaggaccttgccaatcaggtgtcagtgtgcctggagcggctgggcagcttgaccctgaaacctgaggactccaccgtgctactctttgaagccgatactatcaccctaagacagaccatcactacgttcggctcacttaaaactatccagatcccagagcatctgatggctcacgcctccagcgcaaatataggtccttttctagaaaagcgcggctgtatttccatgcctgagcagaagagtgccagcggcattgttgctgtacctttctccgagtggctgctggggagtaaacccgcatccggctaccaagcgccctatattcccagtactgatcctcaggactggctcacacagaaacagaccctggagaattcacagacgtcgagcagagcgtgtaattttttcaataacgtgggcggcaacctgaaaggtctggagaactggctgctcaaaagcgagaagtctagttatcaaaaatgcaactcacactccactacgtcaagctttagtatagaaatggagaaagtcggcgaccaagagcttccagaccaggatgagatggatctcagcgactggcttgtcaccccccaagaaagccacaaactccgaaagccggagaacggtagcagagaaaccagcgagaaattcaaattgcttttccagtcctacaacgtgaacgattggcttgttaaaacagatagctgcacaaattgtcaaggtaatcaacctaagggggtggaaatcgagaatcttggaaatctgaagtgtctaaacgatcatctggaggccaagaagcccctcagtaccccctccatggtcaccgaggactggctcgtccagaaccaccaggatccctgcaaggtagaggaggtgtgcagggccaatgagccctgtacttcattcgctgagtgcgtgtgcgacgaaaattgcgaaaaagaagctctctataagtggctgctgaagaaagaaggtaaggacaagaacgggatgcccgtggaacctaagccagagcctgagaaacataaagattccctgaacatgtggttatgccctcggaaagaagtaatagaacagacaaaggcacccaaagcgatgaccccatcgaggattgctgattctttccaagtcattaagaacagccccctttccgagtggctgatccggcctccttacaaagaaggatcaccgaaggaggtaccgggtacggaggaccgagcaggcaagcagaaattcaagagcccaatgaataccagctggtgtagctttaataccgcggactgggtcctgccaggcaaaaagatgggtaacctcagtcagcttagcagcggcgaagacaagtggctcctaagaaaaaaagcgcaggaggtgctcctgaatagtccccttcaagaggagcataactttcccccagatcactacgggttgccggccgtctgcgacctgttcgcttgtatgcagctcaaagttgacaaggagaagtggctgtaccggactccactccagatgtag

SEQ ID NO: 31664 - DNA, 1845 bp, Artificial Sequence
  Description of Artificial Sequence: Synthetic coding sequence
atgaacacattccaagatcagagcggcagttcaagcaaccgcgaacccttgcttcgctgctctgacgccaggcgcgacttggaactcgcaatcgggggtgtcctcagggccgagcagcagattaaagacaacctgcgcgaggtgaaagcgcagattcatagctgtattagccggcatctcgagtgtctgaggtcgcgcgaagtgtggttgtatgagcaggtcgatctcatctaccagttgaaggaggagaccctgcagcagcaggcccagcaactttatagtctccttggacaatttaactgcctcacacatcagttggagtgcacacagaataaggaccttgcaaaccaggtctcagtgtgcctggaacgtctggggtcactgaccctgaaacccgaggatagtactgttctcctgttcgaggctgacaccatcaccttgcgacagacaatcaccacttttggctcattaaagaccattcagatccccgagcacctgatggcacatgcaagttcagcaaacatcggcccctttctcgaaaagagaggctgtatctccatgcccgaacagaaatcggcgagcggcatcgtcgctgtgccattttcagaatggctcctgggaagtaagcctgcatcaggctaccaagcaccatatattccaagtactgaccctcaagattggctgacccagaaacagacattggagaactcgcagacctctagccgcgcgtgcaattttttcaataacgttggcggcaatttgaaagggctcgagaattggctcctgaagtctgagaagagcagttaccaaaaatgcaactcacactctactacttcttccttctctatcgaaatggagaaagttggcgaccaggagctgccagaccaggacgaaatggatctctccgactggctagttacacctcaggagagccataaactcaggaagcccgagaacggatcccgtgagacctctgaaaagttcaaactcctttttcagagttacaatgtcaacgactggctggtgaagactgacagctgtaccaattgtcaagggaaccagcccaagggcgtcgagatcgagaacctgggcaatttgaaatgtttgaacgaccatctggaagccaaaaagcccctgtcgactccatctatggtgaccgaggattggctagtgcagaatcaccaggatccctgcaaggtggaggaggtgtgtagagcaaacgaaccctgtacttctttcgcagagtgcgtgtgtgatgagaactgcgagaaagaggccttgtataagtggctgctcaagaaggagggcaaagataagaacggtatgcctgtggagcctaaacccgagccagagaaacacaaagatagcctgaatatgtggctctgtcctcgtaaagaagtgatcgagcagacgaaggcacctaaagcgatgacccccagcaggattgccgatagcttccaggtgattaaaaacagcccattgagtgaatggctaattagacctccatacaaagagggatctcccaaagaagtgcccggcacagaggaccgggctggaaagcaaaaatttaaatcgccaatgaatacatcttggtgttcttttaatactgcagactgggtgctgcccggcaagaaaatgggaaacctttcccagctatccagtggggaagataaatggctgctcaggaagaaggcgcaggaggtactactgaatagcccgttgcaggaggagcacaacttcccgccagatcactacggtttgccagcagtgtgcgatctgtttgcctgcatgcagctgaaagttgataaagaaaagtggctttatcgtactcctttgcagatgtag

SEQ ID NO: 31665 - DNA, 1845 bp, Artificial Sequence
  Description of Artificial Sequence: Synthetic coding sequence
atgaacactttccaggaccagtccggcagctcatccaatcgtgaacccctcctcaggtgtagcgacgccagaagagatctagagctagccataggaggagtgctgcgcgcggagcagcaaatcaaagataacctccgtgaggttaaagcacagatccactcctgcatatcccgtcacttggaatgcctgcggtccagagaggtttggctttacgagcaagtagatctgatttaccagctgaaggaagagacactccagcagcaggcccagcaactgtattcgctcctgggacagttcaactgtctgacccatcagcttgaatgtacacagaataaagacctggccaatcaggtctctgtttgcttggaacgcttaggctccctgacattgaaacctgaggattctaccgtgctcctgtttgaagcagatactattactttgagacaaacgatcaccaccttcggaagcttgaagacgatacagattcccgaacacctcatggctcacgcatcatccgcgaacataggccccttcctggaaaagagaggatgtatctccatgcccgagcagaaaagtgcgagtggcatcgtggctgtcccttttagtgaatggctgttgggtagcaaaccagcttcaggataccaggccccgtatatcccttctaccgatccacaggattggcttactcaaaagcagactctcgagaattctcagacgagttcacgtgcatgcaattttttcaataacgtgggtggtaacttaaaagggcttgagaactggctattaaagagcgagaaatccagttaccaaaaatgcaatagtcacagtacaacatcttccttctcaattgagatggaaaaagtgggcgaccaggaactgccagatcaagatgaaatggatttgtccgattggctggtgacccctcaagaatcacataaactgagaaaacctgaaaacggtagccgcgaaactagcgaaaagttcaaactgctgttccagtcgtataatgttaatgattggctcgtaaaaacagactcttgtacaaattgtcagggtaaccagccgaaaggtgtagagattgaaaatctggggaatcttaagtgtctgaatgaccacctagaggcgaaaaaacctctgagcaccccttctatggtgaccgaagactggctggttcagaatcatcaggatccatgcaaagtagaggaagtgtgtcgagcgaacgagccctgcacgtcatttgccgaatgcgtctgtgatgaaaactgcgaaaaggaggcactgtacaagtggctgctcaagaaggagggcaaagataagaacgggatgccagtggaaccgaagcctgagcccgagaagcacaaggactctttgaatatgtggctgtgccctcgcaaggaggtcatcgaacaaaccaaggccccgaaagcgatgacaccttcaaggattgctgattcctttcaggtgattaagaattcaccgcttagcgagtggttaatccgcccaccgtataaggaggggagccccaaagaggttccagggactgaggacagggccgggaagcagaagttcaaatcccccatgaacacgagctggtgttcttttaacaccgctgactgggtgctgcctggcaagaaaatgggtaatttgagccaactctccagtggagaagacaagtggctgttgcggaagaaggcacaggaggtgctgctgaatagccctctccaagaagagcacaatttcccccccgaccattatgggctacccgcggtctgtgacctcttcgcctgtatgcaactaaaggtggataaggaaaaatggctatatagaaccccactgcagatgtag

SEQ ID NO: 31666 - DNA, 1209 bp, Artificial Sequence
  Description of Artificial Sequence: Synthetic coding sequence
atgcctcattcagcaggagggaccgccggcgtcggcctggaggcagccgaaccaactgctctactgacacgggcagagcctccgtcggagccaactgagatccgacctcaaaagagaaagaagggtcccgcaccgaagatgctcggaaacgaattatgttccgtatgcggcgataaagcctccggattccactacaatgtcctgtcctgcgaaggctgtaagggcttctttagacgatcagttatcaaaggcgcgcactatatttgtcacagcggagggcactgtcccatggatacatacatgaggcgcaaatgccaggagtgcaggctgcggaagtgccgccaggctggcatgcgggaggagtgtgtgctgtcagaggaacaaattaggctaaagaagctgaaaagacaagaggaggaacaagcacatgccacatcgctgccgccccgtgcctctagcccacctcagatactgcctcagctcagtccagagcaactgggtatgatagaaaaattggtcgctgcccagcagcaatgcaatagaaggtcattttccgataggctgagggtcacgccctggcccatggctcctgaccctcactccagagaagcgcggcagcagagattcgcacatttcacagagctggccatcgtttcagtgcaggagatagtggatttcgctaagcagctgcccggttttctgcagctgagccgggaggaccagatcgcccttctaaaaaccagtgccattgaggtgatgctgctcgaaacttctcggcgctacaatcctggctcggagtccatcaccttcctgaaggatttttcttacaatcgggaagattttgctaaagccggcttacaggtggaatttataaaccccatcttcgagttttccagagctatgaacgagcttcagctgaatgatgcagaatttgcactattgatcgcgatctccattttttccgcagaccggcccaatgtccaggaccagttacaggtggaaaggctgcagcacacttatgtagaggcactgcatgcatatgtgagtatccaccatcctcatgatagactcatgttcccacgtatgctaatgaagttagtgagtttaaggaccctgtctagtgtgcattccgagcaggtgttcgccctgcgactccaggataagaaactgccaccactactgagtgaaatttgggacgtccacgaatag

SEQ ID NO: 31667 - DNA, 1164 bp, Artificial Sequence
  Description of Artificial Sequence: Synthetic coding sequence
atgtcgctgtggctcggggcaccagttccagacataccacccgactcggctgtcgagctatggaagcccggggcccaggacgcttccagccaagcccaaggaggaagctcgtgtatccttcgcgaagaggcacgtatgccacacagcgccggggggaccgccggcgtcgggctggaggccgctgagcccacagcacttctgacccgagccgagccccctagtgagcctacagagattaggccccagaagcgtaagaaggggcctgccccaaaaatgctcggtaacgagctctgcagcgtctgcggggataaggcaagtggcttccactacaacgtcctgtcttgtgagggctgcaaaggctttttccgccgatcggtcatcaaaggcgcgcactacatctgccactctgggggccattgtccaatggacacttatatgaggcggaagtgccaggagtgcagactgaggaagtgcagacaagccgggatgcgggaagagtgtgttctatctgaggaacagataagattgaagaagctgaagcgccaggaagaagaacaggcacacgccacctcattgccaccgcgcgcctccagccctcctcagattctaccccagttgagtcctgagcagctcggcatgatagagaaacttgtcgccgcccagcagcagtgtaaccgacgcagtttttccgaccgcttgagagtgaccgtcatgcttctcgagactagtagaagatataatcctggcagcgaatccatcacattcctgaaggacttctcatacaatagagaggattttgcaaaggcaggcctccaggtagaatttattaatccgatcttcgagttctcaagagctatgaacgagctgcagctgaatgatgccgaatttgcactgttaatcgctatttctattttctctgccgacaggccaaacgtgcaagatcagctgcaagtagagcggctccagcacacctacgtcgaagctctccatgcatatgtgagcatccaccacccacatgatcgcctcatgtttcccagaatgctcatgaagctagtgtcactcagaactctgtcctccgtgcattctgaacaggtgtttgccttacggttgcaagacaagaagctgccccccctactgtcggaaatctgggatgttcacgaatag

SEQ ID NO: 31668 - DNA, 1164 bp, Artificial Sequence
  Description of Artificial Sequence: Synthetic coding sequence
atgtccctatggcttggtgcccccgttccagacattcctcccgactctgcagtggagttgtggaagccaggcgcacaagatgccagttcccaagctcagggcggctcaagctgtatcctcagggaggaggcccgaatgcctcacagcgctggcggcactgcaggcgttgggctggaggccgctgaacccaccgcactgctcactagagcagaacctccctcagaaccaaccgagataagacctcaaaagagaaagaaagggccggcacctaaaatgctcggcaacgagctgtgcagcgtgtgtggggacaaagcctcggggttccattacaacgtgttaagttgtgaaggatgcaaaggattctttcgcaggagcgttataaagggcgcccactatatttgtcattctggcggccattgccccatggatacatacatgagaagaaagtgtcaggagtgtagattgcgcaaatgccgccaggccggcatgagagaagaatgcgtcctatcagaggaacagatccgtctgaagaagcttaaacggcaggaggaagaacaagcccacgccaccagcttgccgcccagagcctcaagtccccctcagattctgccacagcttagcccagagcagttgggtatgattgagaaactcgtcgcagctcaacagcagtgtaacagacgcagtttctccgatcgtttgcgggtgaccgtcatgttactggagaccagtagaagatataatcctggcagcgagtcaataacgtttcttaaggacttttcatataaccgtgaggacttcgccaaggcaggcctgcaggttgagttcatcaatcctatattcgagtttagtcgggctatgaacgaactccagctaaacgacgccgagttcgctcttcttatcgcgatttcaattttttccgctgacagaccaaatgtgcaggaccaactgcaggttgagaggcttcaacacacctacgtggaggcgctgcacgcctatgtttccatccatcatcctcacgaccgcctgatgtttcctaggatgttaatgaagctggtgagtctaaggactctgagttctgtgcattctgagcaagtctttgcccttcggctccaagacaaaaagctgcctcctctgctatcagagatctgggacgtacatgaatag

SEQ ID NO: 31669 - DNA, 609 bp, Artificial Sequence
  Description of Artificial Sequence: Synthetic coding sequence
atgtccctctggctgggtgcccccgttccggatatcccccctgactcagctgtagaattgtggaagcctggggcccaagacgccagcagtcaggcacaaggtggttcttcctgcatcttacgtgaggaggctagaatgccccacagcgccggggggactgccggcgttggcctggaagccgcagaacctacagctcttctaacccgggcagagccccccagtgaacctacagaaatcagaccccagaagcgcaagaaggggccggctcccaaaatgcttgggaatgaactgtgcagcgtgtgtggtgataaggcgagcgggtttcactacaatgtgctcagctgtgaggggtgtaagggcttcttcaggaggtcagtgattaagggcgcacactacatctgccacagcggcggccactgtccgatggatacatatatgagaagaaaatgccaggaatgcagacttcgaaagtgtcggcaggcaggcatgagggaagagtgcgtactcagcgaggagcagatccgcctcaagaaactgaaaagacaggaagaagagcaggcccacgcaacctccctgcctccaagggctagttcccccccccagatttag

SEQ ID NO: 31670 - DNA, 207 bp, Artificial Sequence
  Description of Artificial Sequence: Synthetic coding sequence
atgagcttgtggttaggagcaccagtcccagacattccacccgactctgcagtcgagttatggaaacctggggcacaggacgcctctagccaggcccaaggtgggtcctcatgcatcctccgggaagaagccaggatgccccattctgccggtggaaccgctggtgttggccttgaagccgccgagccaacagcccttttgacctag

SEQ ID NO: 31671 - DNA, 1344 bp, Artificial Sequence
  Description of Artificial Sequence: Synthetic coding sequence
atgtctctctggttaggtgctcccgtgccagacatcccccctgactctgctgtggagctctggaaaccaggggcacaggatgcatcttctcaagcccagggggggagctcttgcattctcagggaggaagcccgtatgccccatagtgctggaggtacagcaggagtagggcttgaggcggcagagcctaccgcactgctgacacgggccgaacctccctccgagccaaccgaaatccggccccagaagagaaaaaaaggacctgctcccaagatgctagggaatgaattgtgctccgtctgtggtgacaaagcatccggcttccattacaacgtgttatcttgtgaaggatgcaaaggcttctttcgtcgatcagtgataaagggcgcacattacatctgtcatagtggagggcattgcccaatggatacctacatgcgacgaaagtgtcaagaatgtagactgaggaaatgtaggcaagccgggatgagggaagagtgcgtcctcagtgaagagcagatcagactgaagaaactgaagaggcaggaggaggagcaggcacatgctaccagcctgcccccacgtgcctcatcacctccgcagatactccctcagcttagcccggagcaacttggtatgatagaaaaacttgtcgcagcgcagcaacaatgtaatcggcggagtttttccgacagactgcgggtgaccccgtggcccatggctcccgatccacactcccgggaggccagacaacagagatttgcccactttaccgaattggctattgtgagcgttcaggagattgttgattttgccaaacagctccctgggtttctgcaactgtctagggaagatcagatcgcattactgaagacaagcgccatcgaagtcatgctcttagaaacaagtcgtcgttacaatcccggcagtgagtcgataacattcctcaaggacttttcttataatagagaagatttcgccaaggcgggactccaagttgagtttattaacccaatattcgagttctcccgggccatgaacgagctccaacttaatgatgctgagttcgccctactcattgctatcagtatcttttccgcggatagacctaacgtgcaggaccaactgcaggtggagcggcttcaacatacttacgtcgaggcgctgcacgcttatgtgtccatccaccatccccatgaccggctgatgttcccacgcatgctcatgaagttggtgagtcttaggactctttctagcgtccacagtgaacaggttttcgctctgcgactgcaggacaagaagctccctccacttctgagcgagatctgggatgtgcacgaatag

SEQ ID NO: 31672 - DNA, 585 bp, Artificial Sequence
  Description of Artificial Sequence: Synthetic coding sequence
atgagcctctggctgggtgcgcctgtgcccgacatcccacccgactcagctgtcgagctgtggaaaccaggggcacaggacgcgtccagccaggcccagggaggcagctcatgtatactgagggaggaagcacgcatgccgcacagcgccggagggactgctggagtaggccttgaagctgcggaacccaccgctcttctcaccagagccgagcctccatccgaaccgaccgagataaggccccagaagagaaagaagggaccagctccaaaaatgttgggcaatgaactgtgctccgtgtgcggggacaaggcgtccgggttccattataatgtgctgagctgcgagggctgcaaaggtttttttcgccggtctgtgattaagggggcgcactatatatgccactctgggggtcactgccccatggatacttatatgcggagaaaatgtcaggagtgccgccttagaaagtgccggcaggcgggaatgagggaagagtgcgtcctctccgaagagcagatcagactgaaaaagctcaagcgccaggaagaagagcaggcacacgcaaccagtctccctccctag

SEQ ID NO: 31673 - DNA, 618 bp, Artificial Sequence
  Description of Artificial Sequence: Synthetic coding sequence
atgagtctgtggctcggtgctccagtgccggatatcccccccgatagcgctgtagagttgtggaagcccggcgcacaagacgcttcatcccaagcccagggtgggtcctcgtgtattctgcgggaggaggcccgaatgcctcatagcgccggcggcaccgcaggcgtggggctcgaggctgccgagccgacagctctacttacgcgcgcagagcccccgtccgaacccacagaaattcgcccacagaaacgtaaaaagggccccgcgcccaaaatgctcggtaatgaactctgctcagtttgcggggacaaggcctccgggttccactacaatgtcttgtcctgtgaggggtgcaaaggtttttttcggcgctccgtcatcaaaggcgcccactatatctgccactctggcggtcactgtccgatggacacctacatgaggcgcaagtgtcaggaatgcagacttcgaaagtgccggcaggctggcatgcgggaagaatgcgtcttgagcgaggagcagattcgcctgaaaaagctgaaacggcaggaagaggaacaggcccacgcaacatcactgcccccaagggcatcaagccctccccagatcctcccgcaatag

SEQ ID NO: 31674 - DNA, 234 bp, Artificial Sequence
  Description of Artificial Sequence: Synthetic coding sequence
atgtccctgtggttaggcgcccccgtgcccgatattccccctgatagcgctgtggagttgtggaagccaggggcccaggacgcctctagtcaggctcaggggggatcctcgtgcattctcagggaggaggcccgtatgcctcacagcgcaggcggcactgctggcgtaggtctggaagctgctgagccaaccgctctcttgacacgggcagaacccccttctgaacccacatag

SEQ ID NO: 31675 - DNA, 1344 bp, Artificial Sequence
  Description of Artificial Sequence: Synthetic coding sequence
atgagtctgtggctgggggcccctgttcccgatattcctcccgactcggccgtggaactgtggaagcccggggcccaggatgcgtcctcccaggcccaggggggatcgtcatgcatcctgagagaggaagcccggatgccacactccgccggagggactgccggagtgggactggaggccgccgagcccaccgccctgctcactcgagcagaaccacctagtgaacccaccgagatcagaccgcagaaacgaaaaaagggtccagccccaaaaatgctggggaacgaactctgttctgtttgcggggataaagcctccggcttccattacaatgtgctcagctgcgaaggctgcaagggcttctttaggagatccgtcatcaagggcgctcactacatatgtcacagcggaggccactgcccaatggacacttatatgaggaggaagtgtcaggagtgccggctccggaagtgccgtcaagccgggatgagagaagaatgtgtcctgagtgaagagcagatccggcttaaaaagctgaagcgccaagaggaagaacaggcacacgccactagtctgccccctcgggcctcaagtccaccccagatcctgccacagttatcccccgagcagctcggaatgatcgaaaaactggtggccgcccagcagcagtgcaatcggcgcagcttttccgataggctgcgagtcacaccctggccaatggcccccgaccctcatagtagagaagcaagacaacagagattcgctcacttcaccgagctggccatagtgtccgtccaggagatcgtcgacttcgccaaacagctgccaggtttcctccaactgtcgcgcgaagaccagatagcgctgctgaaaacgtcagctatcgaggtaatgctcctggaaacctctaggcggtataaccctggatcagagtcaatcaccttcctcaaagatttttcatataatagggaggatttcgcgaaagcaggtctacaggttgagtttataaaccccattttcgagttctcgagagcaatgaatgaactccaactcaatgatgccgagtttgcattgctcattgcaatttctatattctccgctgatagacctaatgtccaggaccaactgcaggttgaacgtctgcagcacacgtacgtggaagctctgcacgcctacgttagtattcatcatccccatgacaggcttatgttcccgcgcatgttaatgaaacttgtcagccttcgcacactttcttccgtgcatagtgaacaggtgtttgccctgaggctgcaagacaagaagctcccacccctgctgtccgaaatctgggacgtgcatgaatag

SEQ ID NO: 31676 - DNA, 1881 bp, Artificial Sequence
  Description of Artificial Sequence: Synthetic coding sequence
atgtgcagcacccttaagaaatgcgggacctaccgtaccgaggtggctgaatgccacgaccacggctctacattccagggccgcaaaaaaggcgggtcgagctttcgggacaactttgacaaaaggtcctgccattacgagcacggaggctatgagaggccaccctcccattgccaggagaacgacgggtcagtcgagatgagggacgtacacaaggaccaacagctgagacacacaccatactcaatcaggtgcgagaggcgtatgaaatggcacagcgaagacgagattcggataacaacctggcgaaataggaaacctcctgagaggaagatgtcacagaacacacaggatggttataccaggaattggtttaaagtcacgatcccttacggcattaagtacgacaaggcttggctcatgaatagcattcagtcccactgcagcgaccggttcactccggtggactttcactatgtgcgcaaccgtgcttgcttctttgtccaggacgcaagcgctgcatctgcgcttaaggatgtgagctataagatctatgatgatgagaatcaaaaaatctgtatattcgtgaatcatagtaccgccccctacagcgtaaagaacaaactcaaacccgggcaaatggagatgctgaagctcacgatgaataagcgctacaatgttagccagcaggctctcgacctgcaaaatctgaggtttgacccagatttgatggggcgcgacatagatatcattctcaatagaaggaattgcatggctgcaacccttaagatcattgagcgcaatttcccggagttattgtctctaaatctgtgtaacaacaagctgtaccagttagacggactgtccgacattactgaaaaggccccgaaagttaagacactgaatctctccaaaaacaagctggagtctgcctgggagcttggtaaagtgaaaggactcaagctcgaggagctgtggctggaaggaaacccattgtgtagcaccttttccgatcagtctgcctacgtaagcgccatccgcgactgcttccccaagctcctgcgtctagatgggcgggaactctcggcgccggtcatcgtggacatcgacagttcggagacaatgaagccctgcaaagaaaatttcaccggctcggaaaccctcaagcacttagtccttcagttcctgcagcaatattactccatctatgattccggcgaccgtcagggattgctgggggcctatcacgacgaagcatgcttcagcctcgcaatcccttttgaccccaaggactccgctcccagtagtctttgcaagtacttcgaagatagtagaaacatgaaaactcttaaggatccatacctgaagggcgagttgctcagaaggacgaagagagacatagtggactccctgtctgctctcccgaagactcagcatgacctcagttctatcctggttgacgtttggtgtcagactgaaaggatgctctgtttttctgttaatggggtgttcaaggaggtggaaggtcaatcccagggttccgtcctggcctttactaggaccttcatagctacgcccggaagtagtagcagtctctgcattgtgaacgacgaactgtttgtgagggacgcatcaccccaggagacccagtccgccttctcaatccccgtgtccacattgtccagctcgtccgagccgtcactaagccaggagcagcaagaaatggtgcaggccttcagcgcccagagcggaatgaagctggagtggtcccagaaatgtctgcaggacaacgaatggaattacactcgtgctgggcaagcgttcacaatgctccagaccgagggaaaaatcccagctgaagcctttaagcagatctcttag

SEQ ID NO: 31677 - DNA, 1881 bp, Artificial Sequence
  Description of Artificial Sequence: Synthetic coding sequence
atgtgctctactctgaaaaaatgcggaacgtatcgtaccgaggtggcagagtgccacgaccacggcagcacctttcaagggaggaaaaaaggcggcagctcgttccgggacaacttcgataagaggtcctgccattacgagcacggcggttacgaaaggccaccttcccactgccaggagaacgacggctccgtggagatgcgtgacgtgcacaaggatcagcaactgagacacaccccctacagtattaggtgtgagagaaggatgaagtggcactcagaagatgagatccggatcaccacttggcgaaaccgcaaaccacctgagaggaaaatgtcacaaaacacacaggacgggtatactcggaactggttcaaagtgacaataccgtacggaattaagtacgataaagcgtggctcatgaactccattcagagccattgctctgaccgctttacacctgtcgactttcactacgtgcgtaaccgggcatgctttttcgtgcaggacgcctccgccgcatccgcactaaaggatgtgagctataaaatttatgacgacgagaaccaaaaaatttgtattttcgtgaaccatagcacggccccctatagtgtgaaaaataagctgaagccagggcagatggagatgttgaagctgactatgaataaacgttataatgtgtctcagcaagctctggatttacagaatctccgtttcgatcctgatctgatgggcagggacattgatattatactgaaccgccgcaactgcatggccgccacattgaagatcatagaacggaacttcccggagctactctccctcaacctttgcaataacaagctgtatcagctcgacgggcttagtgacattaccgagaaggccccaaaagtcaaaactctgaacctgagcaaaaataaactggagtccgcttgggagctgggaaaggttaagggattgaaactggaggaactgtggcttgagggtaatcccctttgtagtaccttcagcgatcaaagcgcctacgtgagcgctatacgcgattgttttcctaaacttctacgcctcgacgggcgcgagctgagtgctcccgtgatcgtggacatcgatagcagcgagaccatgaaaccctgcaaggaaaacttcacaggaagcgaaacactgaagcacttagttcttcagtttcttcagcagtattacagcatctacgactccggagatcggcagggcctgttgggcgcttatcatgacgaggcgtgtttctctctggccattcccttcgaccctaaggattccgcaccctctagtctctgcaagtattttgaagactctagaaacatgaagacactgaaggacccttatctcaagggggaactccttcgtagaaccaagagagatattgtggattctctttctgccctgcctaagacgcagcacgaccttagttcaattttggtggatgtatggtgtcagactgagcgaatgttatgctttagtgtgaatggcgtgttcaaggaggtggaaggccagagccagggatcagtcttggccttcacaagaactttcatcgccacccctggtagtagttcatccctttgtatcgtcaacgatgagctcttcgtgcgagacgcatcccctcaggaaacccagtccgctttcagcatccccgtgagcaccctttcttcaagttccgagccttccctctcccaagaacaacaggaaatggtccaggcctttagcgcccaatcaggcatgaaacttgagtggtcccagaagtgcttgcaggacaacgagtggaactacactcgggctggccaggcattcaccatgttgcagactgagggcaagatccccgccgaggctttcaagcagatctcctag

SEQ ID NO: 31678 - DNA, 471 bp, Artificial Sequence
  Description of Artificial Sequence: Synthetic coding sequence
atggttgatattctaggtgagcgccaccttgtcacgtgcaaaggcgccacagttgaagcggaggccgctctgcagaataaggttgttgctctttatttcgcagccgctagatgcgccccctcaagagatttcacaccactcctatgcgatttttacacagcgctggtggcagaagctagacgcccagcaccctttgaggttgttttcgtgagtgccgatggctcctcacaggagatgttagattttatgcgagagttgcacggagcctggttggccctaccattccatgatccctaccggcacgagctccgaaagcgctacaatgtgaccgctatccccaaactcgtcatagtcaagcagaatggcgaggttataacgaacaaggggaggaaacagattagggaacgtgggctcgcctgctttcaggattgggtggaggcagctgatatctttcaaaacttctcggtgtag

SEQ ID NO: 31679 - DNA, 408 bp, Artificial Sequence
  Description of Artificial Sequence: Synthetic coding sequence
atggtggacatcctgggggagagacacctggtcacctgtaagggagccaccgttgaggctgaggcagccttgcagaataaggtagtcgctttatacttcgcggccgctcgctgcgcaccctccagagacttcactccgctcctgtgtgatttctataccgcattggtggcggaagctcgtcggcccgctcccttcgaggtggtgttcgtgtctgccgatggctctagtcaggagatgctggacttcatgcgggaactgcatggtgcatggctggcgctcccttttcacgatccttataggcagagatcacttgctctgttgccccggctggaatgttctggggtcattctggcccactgcaatctgtgtctattgggatcctccgactccctggctcttgcatcttag

SEQ ID NO: 31680 - DNA, 687 bp, Artificial Sequence
  Description of Artificial Sequence: Synthetic coding sequence
atggccaggcacgtcttcctgaccggacctcccggcgtggggaaaaccacactgatccataaagcatccgaggtattgaagtcctccggcgtgccagtagacggtttctacactgaagaagtgagacaggggggtcgtaggattggttttgacgtggttacccttagcggcacaaggggcccactgtcccgcgtcggactcgaacccccccctggaaagagagagtgtcgggtgggccagtatgtggtagacctgacctcattcgagcagcttgcgttacctgtactgcgcaatgccgattgcagttcaggacccgggcaaagagtgtgcgtcatagatgaaattggtaaaatggaactgtttagtcagctattcattcaagcggtacgccagacactgtctaccccaggcacaattattttaggcacaattcccgttccaaagggcaaaccacttgcactagtggaggagattaggaatcggaaggacgtgaaagtgtttaacagtccatactgcgtcattgaggaccagtctaaattctcctcttgtgtatcacaatctaccttgaccgagcctggttggcgccaaaagctgcttcaatctctcctaaactctgagtggaaaaagcgggcacccgtagtgccaaccagtgtgagcccacctttctacctccggtggatcccatag

SEQ ID NO: 31681 - DNA, 573 bp, Artificial Sequence
  Description of Artificial Sequence: Synthetic coding sequence
atggctcggcatgtctttctgactgggccacctggagtgggaaagacaactctcatccataaggcaagcgaggtcctgaaatcaagcggggtgcctgtggatggattctacacagaagaagtgcgtcagggcgggagacgtataggcttcgatgtggtcaccctgtctggcactagaggtcctttgagtcgggtgggcttggaacctcccccgggaaagcgcgagtgccgtgtgggtcaatacgtggtcgatctcacctccttcgagcagttagccttgcccgtgcttagaaacgctgactgtagtagtggcccagggcagcgcgtttgcgtaatcgacgaaattggaaaaatggaactgttcagtcagctgtttattcaggccgtcaggcaaacattgtctactccagggacaattatcctggggactatcccggttcccaaaggtaagcctctagctttggtggaggaaatacggaacagaaaagacgttaaagtcttcaatgttactaaggagaatcgaaaccacttactaccagacattgttacttgcgtccaatcctcccgcaaatag

SEQ ID NO: 31682 - DNA, 324 bp, Artificial Sequence
  Description of Artificial Sequence: Synthetic coding sequence
atgatggaagggctgggcgaacactcaaccgcaggggagatgggcccactgctcggtgctgtggccgctactgcttcccctcagtccctcatggaatactcttctgatgcagatttcattgagagccttcctctagtggtcaaataccgggtttacacactaaagaagctacaggccaagtgcgctgttttagaggccaagtatcttagggaattccacagcgtggaacggaaatttgctactatctatggtccactccttgagaaacgacggcagataaccaacgcactctacgagccgaccaaagaagagtgcgagcgatag

SEQ ID NO: 31683 - DNA, 3042 bp, Artificial Sequence
  Description of Artificial Sequence: Synthetic coding sequence
atgtgttcacaggaagctttccaagctcaacgctcacagctggtggagctactagtgtcagggagtctggagggttttgaatctgtcctggattggctgctcagttgggaagttttgtcttgggaagattacgagggctttcacctgcttggccagccgttgtcacacctggcccgacgcctgctggatactgtgtggaacaaggggacgtgggcctgtcagaagctgatcgcagctgctcaggaggctcaggcggactctcagtcacctaaactacacggatgttgggatccacattctctgcacccggcccgcgatctgcagtcacatagacctgctattgtgcgcaggttgcatagccacgtggagaacatgttagatttggcctgggaaaggggtttcgtctcccaatacgagtgcgatgaaatacggttacccatctttacaccgtcccagcgcgcgcggcgcctactggacctggcaactgtgaaagcaaatggcctcgctgccttcctgctgcagcatgttcaggaattgccagtccccctggcactgccattggaggcagctacctgtaagaaatatatggcgaaattgcgaaccactgtgagcgcccagtctcgattcctctccacatatgatggagctgaaacattatgcctcgaagacatttacactgagaacgttctggaagtgtgggctgacgtgggtatggcaggaccacctcagaagagcccagccactctgggtctggaggaactgttcagcacaccaggccacctgaacgacgacgcagacaccgtgctggtggtcggtgaagccggctctggcaaaagcactcttcttcagcgcctgcacttgctctgggctgccggtcaagatttccaggagtttctgttcgttttcccattttcttgcagacagctgcaatgtatggcaaagccactgtcagtccggacacttctttttgagcactgctgctggccggacgtgggccaagaagatattttccagctgctcctggatcatcccgaccgggttcttctaacctttgacggcttcgacgagttcaaatttcgcttcaccgatcgagagcgccactgcagcccaacagatcccacgtccgttcagaccctcctctttaatttgttgcagggaaacctgctgaaaaatgcccgcaaggtcgtgacttcccgacccgcagctgtctccgccttcttgagaaagtatattaggacagagtttaacttgaagggcttttccgagcaagggatagagctgtaccttcgtaaaaggcaccacgagccaggcgttgccgaccggttgattagattgctccaggaaacttccgccctccacggcctgtgtcacttaccggtgttttcatggatggtgtctaaatgtcaccaggagcttctgttacaggagggcggttctcctaaaactacaaccgatatgtacctgctcatcctccagcactttctgctgcacgccacaccccctgattctgcatcacaaggccttggcccatcgctgctccgcgggcgcctgcccactttgctccatttggggcgcctagccctgtggggcctgggaatgtgttgctacgttttctccgcacagcagttacaagccgcccaggttagcccagacgacattagcctggggtttctcgtacgtgctaaaggagttgtgcccggatccacagccccccttgaattcttacatatcacattccagtgcttcttcgcagccttttatctagctctgtccgcagatgttccaccagctctgctccgtcacctttttaattgtggaagacctgggaactctccgatggctcgccttctaccaacaatgtgcatccaagcgagcgagggcaaggatagctccgtggccgctctattacagaaagccgagccgcacaatctccagatcaccgccgccttcttggccggcctcttaagccgagagcattggggcctgttggccgaatgtcaaacgtcagagaaagcgctgctgcggagacaggcttgtgctaggtggtgcctggccaggagtctgagaaaacatttccattcaatcccccctgcagccccgggagaggcgaaatccgtccacgccatgcccggcttcatctggctcattcggtctttatatgagatgcaggaagaacgactggcccgcaaggcagctaggggtctgaacgtggggcacctcaagttgacattctgttccgtgggtcccaccgagtgcgctgctctcgctttcgtgttgcagcatctacggcggcccgtggcactacagctggactataacagcgtgggagacattggcgttgaacagcttctgccctgcctgggtgtgtgcaaggcgctttatttgcgagataacaatatctccgatcgcggcatatgcaaactgattgaatgcgccctccactgcgagcagcttcaaaagttggcccttttcaacaacaagctaaccgatggctgcgcccattctatggcaaagctcctggcttgtcgccaaaattttttggctctgaggctggggaataactatatcactgcagccggggctcaagtgctggccgaaggtctccgcggtaacacttcgctacagttcctgggtttctgggggaacagagtcggcgatgaaggggcccaagcattagccgaagccctcggggaccatcagtccctcaggtggcttagtctagtcggaaacaacatcgggagcgtcggcgcacaggcccttgccctcatgttggcaaagaatgtgatgctagaagagctctgcctagaggagaaccacctacaggacgagggcgtgtgttctcttgcggaaggactaaaaaagaacagctctttgaagatcttgaagcttagtaataactgcatcacctatttaggggcagaggccctgcttcaggcattggagcggaacgatacaattctcgaagtgtggttacgagggaatacctttagtcttgaggaagtggacaagctgggctgtagggacacccgcctgctcctgtag

SEQ ID NO: 31684 - DNA, 441 bp, Artificial Sequence
  Description of Artificial Sequence: Synthetic coding sequence
atgtgtagccaggaagccttccaggctcagagaagccagctggtggagctcctcgtgtcgggctctctggagggctttgagtccgtcttggactggcttctttcttgggaagtgcttagttgggaggattatgaaggcttccaccttctaggacagccactgtcccatctagctcgcagacttcttgacactgtttggaataagggcacttgggcctgccagaagttgatcgccgcagcacaggaagctcaggcagatagccagtctcctaaactgcacgggtgctgggatccacatagcttacaccctgctagggacctgcagagtcatcggcctgccattgtgagacgcttacattctcacgtggagaatatgctggacctggcctgggagcggggcttcgtgtcacagtacgagtgtgatgagatacgtctgccgtag

SEQ ID NO: 31685 - DNA, 1752 bp, Artificial Sequence
  Description of Artificial Sequence: Synthetic coding sequence
atggaggtggcagccaactgctctctgcgggtcaaacgccccttgctggaccccaggtttgagggttataaactgtccctggagcccctgccctgctatcagctggagctggatgctgcagtcgccgaggtaaaactgagggatgaccagtacactctagagcatatgcacgctttcggaatgtacaactacctgcactgcgattcctggtatcaggatagcgtgtattacattgacacactaggtagaatcatgaatctgactgtgatgttggacaccgcactgggaaaaccacgcgaggtcttcagattacctactgatttaacagcctgcgacaatagactgtgtgcaagcattcacttttcttcctctacgtgggtgaccctgtccgatggtaccggccgactctatgtcatcgggaccggggagcgcggaaactctgccagcgagaagtgggaaatcatgttcaatgaagagctaggagacccttttattatcattcattcaattagccttctcaatgctgaggagcactccatcgctaccctgctcctgcgtattgaaaaggaggaactcgacatgaagggaagcggcttttatgtttctcttgagtgggtgacaatttcaaagaaaaatcaagataacaagaagtacgagattattaaaagggacatactgcgtggcaaatccgtgcctcactacgccgcaatagagcccgatggaaacggtttgatgatcgtatcctacaagtcactcaccttcgttcaggcaggccaggatctggaagaaaacatggacgaagacatctctgagaagatcaaggaacctctctattactggcagcagaccgaggacgatctcacagtcaccattaggctgccggaggacagcacgaaagaagacatccagattcagtttcttccagatcatattaacattgttctgaaagaccatcaatttctagaggggaagctctactccagtattgatcacgagtcaagcacgtggattatcaaggagtccaattcgctggagatctctctgattaagaaaaacgagggacttacgtggcccgagcttgtgattggagataagcagggcgaattgattcgggacagtgctcagtgcgcagctatagctgaacgcctcatgcatctaacctcagaagagctgaatcccaaccctgataaggagaagccaccatgtaatgcgcaggagctcgaggagtgcgacatcttcttcgaggagtcctcatccctgtgcaggtttgatggtaataccttgaagactactcacgtggtgaacctggggtcaaaccaatatctgttcagcgtgattgttgaccccaaggaaatgccatgtttttgtcttcggcatgatgtggacgctctcctgtggcaaccacactcgtctaagcaggatgacatgtgggaacacatagctacgtttaatgcactggggtacgtccaggctagcaaacgcgacaagaagttttttgcatgcgcccctaactactcctacgccgctctctgtgagtgcctcaggcgggtgtttatctatcggcaacctgccccaatgtcaacggtcctttacaatcggaaggaaggcagacaggtcggacaggtcgcaaaacagcaagtggcttctcttgaaaccaatgaccctatactcgggtttcaagccacgaacgagcgactgttcgtgctaacaactaagaatctctttctgatcaaggtcaacacagaaaattag

SEQ ID NO: 31686 - DNA, 1665 bp, Artificial Sequence
  Description of Artificial Sequence: Synthetic coding sequence
atgctgtacctccagggctggtctatgccagctgttgcagaagtgaagctgcgggatgatcagtatacccttgagcacatgcacgcgttcggaatgtataactatctgcactgcgacagttggtatcaagatagcgtgtattacattgacaccctcggccgaattatgaatctcaccgtgatgcttgatacagccttggggaagccacgcgaggtctttcgcctgcctactgatcttaccgcctgcgataacagattgtgcgcctcaattcatttttccagctccacttgggtaactctctctgacggaaccggaaggctctacgtgattgggactggcgagagaggcaattcagcctcagagaagtgggagattatgttcaacgaggagttaggagatcccttcattattattcacagtatcagtctgctgaatgctgaggaacattcaattgctactctcctgttgcgcattgagaaggaggagctggatatgaaaggcagtggattttacgtgagcctcgaatgggtcaccataagcaagaaaaatcaggacaacaagaaatatgaaattataaagcgcgatatcctaaggggaaagagcgtccctcactatgccgctattgaaccagacgggaatggcctaatgatcgtgtcttataaatctctgacttttgtccaagccggccaggatctggaggagaatatggacgaggacatatctgagaagattaaagagccactctattattggcagcagacggaagacgatcttacggtgaccatccggttgcccgaggattccaccaaggaagacatccaaatccagttcttacccgatcatataaatattgtgctgaaggaccaccagttcctagaaggtaagctgtattccagcattgatcacgaatcttctacctggatcataaaggaatccaattccctggaaatctctctgatcaagaagaatgaaggcttaacgtggcccgagctggtgatcggggacaaacaaggagaactgattagagattccgcccaatgcgccgcaatcgccgagagactcatgcatctgacaagtgaagagctgaacccaaatcccgacaaagaaaagccaccctgcaatgcccaagagctggaagagtgcgacattttttttgaagagtctagctccctgtgtcgattcgacgggaatacactgaaaaccacacatgtcgtgaacctgggttctaaccaatacctcttcagcgtaatcgtggaccctaaggagatgccttgtttttgtctgcggcatgatgtggatgccctcctgtggcagccgcatagttcaaagcaggacgacatgtgggagcacatcgctacatttaacgccctgggatatgtgcaagcttcaaaacgggacaagaagtttttcgcgtgcgccccaaattattcatacgctgccctgtgtgaatgcctaagaagggtgttcatctatagacagcccgcacctatgagcaccgtcctgtataatcggaaggaggggcgtcaggtcggccaggtagctaaacagcaagtggcttcgctggagaccaacgacccaatccttgggttccaagcgaccaatgaacgactttttgtcctgacaaccaagaatctgtttttgattaaagttaacactgagaactag

SEQ ID NO: 31687 - DNA, 474 bp, Artificial Sequence
  Description of Artificial Sequence: Synthetic coding sequence
atgtctgctccttttgaggaacgctctggagtggttccatgtggaactccctgggggcagtggtaccaaacattggaagaggtcttcattgaagtgcaggttccccccggaacgcgggctcaggacatccagtgcgggctgcagagccgccacgttgccctgtccgtgggcgggcgggagattctaaagggaaaattatttgacagcacaatcgcagacgagggcacttggacactggaggatcggaagatggtgcgaattgtattgacaaagacaaagcgggacgccgcaaattgctggacctcactcctggagagcgagtatgctgctgatccttgggtgcaggaccagatgcagcggaagctcaccttggagcggttccagaaggagaatccaggtttcgacttctccggagcagaaataagcgggaactacacgaagggcggtcctgatttttccaatttggaaaagtag

SEQ ID NO: 31688 - DNA, 1086 bp, Artificial Sequence
  Description of Artificial Sequence: Synthetic coding sequence
atggagacaggcgccgcggaactttacgatcaagctctgctgggcattctgcagcatgtaggaaatgtgcaggacttccttcgggtgctgttcggtttcctataccgaaaaacagacttctacagacttctccgccacccttcggatcggatgggctttccccctggcgcagctcaggcactagttcttcaggtgtttaaaacctttgatcacatggctcgtcaggatgatgaaaagagaagacaggaattggaggagaagataagaagaaaggaagaggaagaggcgaagactgtctctgctgccgccgccgagaaggagccggtgcccgtgcccgttcaggaaatcgagatcgacagtacaacggagctcgatggacaccaagaagtggagaaggtgcagccgcccggacctgtcaaggaaatggctcatggttcccaggaagccgaagcccccggggccgtggctggggccgctgaggttcctcgggaaccccccatactcccaaggatccaagaacagtttcagaagaaccctgactcgtacaacggcgccgtaagagagaattacacatggtctcaagactacacagacctggaagtacgcgtaccagttcctaagcatgtcgtcaaaggcaaacaggtctccgttgccctgagttcatcctcgatccgcgttgcgatgcttgaggaaaatggtgagagggttctgatggaagggaagcttacccataagatcaatactgagagcagcttatggagcctagaaccagggaagtgcgtcttggtcaatctctccaaagtgggggaatactggtggaacgctattctcgagggagaggaaccaatcgacattgataaaatcaacaaggagagaagtatggccactgtggacgaggaggagcaggctgtcctggaccggctcacctttgattaccatcagaagcttcagggcaaaccccagtctcacgagttgaaagtacacgagatgctgaagaagggctgggacgccgaggggtcaccattccgggggcagagatttgaccccgccatgtttaacatctctccgggagccgtgcagttctag

SEQ ID NO: 31689 - DNA, 495 bp, Artificial Sequence
  Description of Artificial Sequence: Synthetic coding sequence
atgaaatgcaaacccaatcaaacaaggacttatgatcccgaaggctttaaaaaacgagcagcctgtctgtgcttccgatcagagcgtgaagatgaggtccttctcgtgtctagctcacgctatccagataggtggatcgttcccggcggtggcatggaaccggaggaagagcccggcggagcagcagtccgggaagtctacgaggaggcgggcgttaaggggaaactgggacgcctgctgggagttttcgagcagaaccaggatcctaagcatcgaacctatgtatatgtgctgaccgtgaccgagctgcttgaggattgggaagactcagttagcataggaagaaagcgcgaatggtttaaggtggaagatgcaatcaaagtcctgcaatgccacaagccagtgcatgccgaatatctggaaaaactgaagctcggagggtcgccaactaatgggaatagcatggccccctcctcccctgacagcgacccttag

SEQ ID NO: 31690 - DNA, 495 bp, Artificial Sequence
  Description of Artificial Sequence: Synthetic coding sequence
atgacagcatcagcccagcctcgggggcgacgccccggagtaggtgtgggtgtggtggttacgagttgcaaacatcctcggtgtgttcttctaggtaagcgcaaggggagcgtgggggccggatcattccagttgcccggcggccatctagaatttggagaaacctgggaggagtgcgctcaacgggagacatgggaagaggcagcacttcatctcaagaacgtgcactttgcttccgtcgtgaactccttcatcgaaaaagagaactaccactatgtgactattctaatgaagggagaggtggacgtaacccatgactccgaacccaagaatgtcgagccagagaagaacgagtcatgggaatgggtgccctgggaggagttacctcctctggaccagttattctgggggctgcgctgtctgaaagaacaggggtacgaccccttcaaggaagatctgaaccatctggttgggtacaaaggtaaccacctgtag

SEQ ID NO: 31691 - DNA, 987 bp, Artificial Sequence
  Description of Artificial Sequence: Synthetic coding sequence
atggcagaggtgcgagtgcagcttctccttagccgccgacctgagagtgtgagctttgcaaggtcagtttgcggtctcctgggcgcggggcctggactgggaacatggcctatccactgctctctcaaacgcgggcggctagtgctatcatcaaggcccttccctggcgccagcgcccgcctccccttgcagaggccccctttttgcccgttcgctgcccttgaggagcgtcctcgagtgcctggcgctgaactgcccacagaccgcggagtcgatttgggcgttgccgtcatacttcaatcctcggacaaaacagtactgttgactaggagagccaggacactctctgtaagcccaaacctgtgggtgccacctgggggacatgtcgagttggaggaagagctccttgatggcggacttcgcgaactatgggaggagtctggcctgcacctgccacaggggcagttcagctgggtgcccctgggtctctgggaatcggcctatcccccccgcctgtcctggggcctgcccaagtaccatcacatcgtgctgtatctgctagtgatatcacaagagtcccagcaacagctgcaggcaaggatacagccgaatccaaacgaggtgagcgccctgatgtggctgacacctgacgtcgcagcggcagtggccgctgcagaagacggcacagagaccccaggcctcctgcctcaggacctccctccatccgtattggctgtggaacttgaagaggacggcagggccagacccctggtgctccacatgtcaacactgcttagaatgatccccaccatggccgaggacaaggagcgcgtctcaacggggacaaaatttgccctcaaattatggctgcagcatctcggcagaacacctccgccatgtaaaagcgccgcatatcttgatccaggacccgccaaggaagagtggaacatggatcccttgccaccaaaccagggcagcggcaaatag

SEQ ID NO: 31692 - DNA, 555 bp, Artificial Sequence
  Description of Artificial Sequence: Synthetic coding sequence
tgagccgtgatcctgcagagcagtgacaagaccgttttgttgaccagacgggctagaactctcagcgtctcccccaatttatgggtcccgcctggaggcctgagagagctgtgggaggagtccgggctgcatctgccgcaggggcagttctcgtgggtgcccctcggcctatgggaaagcgcttacccgcccaggctatcctggggactccccaaataccaccatattgtgttatatctgcttgtgattagccaggagagccagcagcagctgcaagctagaatacagccgaatcccaacgaggtgtctgcccttatgtggctaacacccgacgtggcagccgctgtggctgctgcagaggatggcacggagacaccaggactgcttcccaggacgagagggggatggaagagccccacctcgggaccggcccacgttcacccacccgcagacgacccaaatcatggccgcggccagcgagaatcccaacactggaaccaagtctgccctcaggccctcgccgccactagcggtcagaacacacctaccgtctag

SEQ ID NO: 31693 - DNA, 972 bp, Artificial Sequence
  Description of Artificial Sequence: Synthetic coding sequence
atggccagtgagggactggcaggcgccttggcaagtgtcctggctggccaaggctctagcgttcacagctgcgactctgccccggcaggggaaccacctgccccagtccggctgcggaagaatgtttgttacgtcgttcttgctgtgtttctatccgagcaagatgaggtgctgctgattcaggaagccaaaagagaatgccggggtagttggtatttgcccgcggggcgaatggagccgggagagactatagtagaagccctgcagagagaagtgaaagaggaggctgggctccattgcgagccagagacacttttaagtgtcgaggagaggggaccgagctgggtcaggtttgtttttctggctcggccaactggggggatcctgaaaactagcaaagaggccgatgccgagagcttgcaggcagcttggtacccccggacgtcactgcctacacccctgcgggcccatgatatccttcacctggtggagttagctgcccagtatcgacaacaggcaaggcacccccttatccttccccaggaactcccctgcgacttggtctgtcaaagattggtcgccacttttacctcagcccaaactgtgtgggtgttagtgggcactgtgggaatgcctcacttacccgttaccgcctgcggactggatcccatggagcagagaggagggatgaagatggccgtgttacgactgttacaggaatgcctcaccctccatcacttagttgtagaaattaagggcctgcttgggctccagcatcttggaagagatcacagcgacggtatctgcctgaatgtactcgtaaccgttgctttcagatccccgggcatccaagacgagcctccgaaggttcggggcgagaactttagctggtggaaggtgatggaggaggacctgcaatcgcaactactgcaaaggctccagggaagcagtgtagttcccgttaacagatag

SEQ ID NO: 31694 - DNA, 180 bp, Artificial Sequence
  Description of Artificial Sequence: Synthetic coding sequence
atggcctccgagggacttgccggagcgttggcttccgtgttggccggacaggggagcagcgtccactcttgcgattcagcacctgcaggggagccacccgctcctagagcaggttgcggcaggacttgcgctacctggtgttggccatgcagcagcgctagccgtatgaggtgttactag

SEQ ID NO: 31695 - DNA, 741 bp, Artificial Sequence
  Description of Artificial Sequence: Synthetic coding sequence
atggagccaggagaaaccatcgtagaggccctacagcgcgaggtcaaggaggaagccgggttgcattgtgaacccgaaaccttgctgtcagtagaggaaagagggccctcttgggtacgcttcgtgttcctggctagaccaacagggggaattctgaaaaccagtaaagaggctgacgccgaaagcctccaggcggcctggtaccccagaactagcctaccaacccctctccgcgcacatgatattctgcatctcgtggagctggcggcacaataccgccagcaggcgaggcatccgctgatcctcccacaggaactgccatgtgaccttgtgtgtcaacgtttggtggcaacatttacctctgcccagacagtctgggtgctggtgggtacggtgggaatgccacaccttcccgtcacagcctgcggtctcgacccaatggagcagaggggtggcatgaagatggccgtcctccgactcctgcaggagtgtctgactctgcatcacttggtggtcgaaattaaaggacttctaggattgcagcatttgggaagagatcactctgatggtatttgtctgaatgtgcttgtcactgttgcctttagaagccccggcatccaggatgagcccccaaaggttcggggcgaaaactttagttggtggaaagtgatggaagaggacttgcagtcgcagctccttcagagattacagggttctagcgtagttcccgtaaacagatag

SEQ ID NO: 31696 - DNA, 1128 bp, Artificial Sequence
  Description of Artificial Sequence: Synthetic coding sequence
atgtcatcgtcattgaggccaggacctagccgatggcgaagggccgcgtctatcgtgctggccgccggctggtctcggcctgaaacagccaccccaccttcccgcccacccccagctgagggattcagactgctgctactgcagcggtcacctcatcagggatttatgccaggtgcccacgttttttccggaggcgttctggatgccgctgatcgcagcgccgactggctcggactcttcgctccccaccacggcccgccaaggtttgggcttgggcctgctccctttagtaggacggcttttcccagcttgcccgataccgacgatcacaagacagataataccggtacccttcccgaggacgttgctttcaggatttgcgccgtcagggaagcatttgaagaagcaggcgttctattgctgcgtccaaggacttccccacctgggcctgcccctggtccaggcctggcgttggagccaccccccggtttggctagctggagggacagggtgcgccaggaccctcggcatttcctgaggttatgtgctcacctagactgtaccccagatatctgggctttgcacaactggagcgcatggctgaccccttttcttcggggaaccacccgtcgtttcgatacagctttctttctgtgttgtttgagggaaccgcctcccgtatacccagatctcgcagaagtcgtgggttaccagtggagctcgccttccgaagccacagagtccttcctcagtaaagagatctggttgccacccccacagttttatgaggttaggcggttagccaatttcgcatccctctcagatttacacaaattctgtctggggagagcactcgaggggttggagaggtggctacccatcatcctgctgacagctgatggcatggtgcacctgctgcctggggatgagctctatctcgaagattcagactttttagaaaatcttatgagtactgagaagaaaaccgaagaaatcatgaaggaggggaagcaattccacaggattgtgacatatcatcggcatctctacgacatacacgtcacagttcagccaaaatacaaacacgtataccccaaaaatagcgtggtcagaaaatctcatctctag

SEQ ID NO: 31697 - DNA, 912 bp, Artificial Sequence
  Description of Artificial Sequence: Synthetic coding sequence
atggaccctgaggtcacactgcttctgcaatgtcctggcggaggtctacctcaggaacagatccaggcagaattatcccccgcgcatgataggcgccccctgccggggggagatgaggctataacagcaatctgggaaacgcggcttaaggcgcaaccatggctgttcgacgcacccaagttcaggctgcacagtgcaacattagctcccatcgggtcaagagggcctcaactgcttttacgactgggccttaccagttatagggatttcctgggcacaaactggagtagcagcgcagcctggctgaggcagcagggcgctacagattggggagatactcaagcataccttgctgacccattgggagttggggcggccctagcaacagccgatgatttcctggtttttttgcgaaggagcagacaggttgcggaggcacccggcttagtggatgtccctggtggccatcctgaaccccaagctttgtgtcccggcgggtcgccacagcaccaggacctggcagggcagctcgtggtgcacgagttattctctagtgtgctccaagagatctgtgatgaggtgaacctgcccctactgacactgagtcaacccctgctgctgggtatcgctaggaacgaaacctccgccggacgtgcttccgcagagttttacgtgcagtgtagtcttacctctgaacaggtccgcaaacattatctgagcgggggcccagaagcacatgagtctactgggatcttctttgtagagacgcagaacgtacaaaggctactcgagacggagatgtgggcagaactatgcccctctgcaaagggtgcgattattttgtataacagggtacaaggctcacccacaggcgccgctctaggaagccccgcacttttgccccccctctag

SEQ ID NO: 31698 - DNA, 813 bp, Artificial Sequence
  Description of Artificial Sequence: Synthetic coding sequence
atggaccctgaagtcaccctgctcctgcaatgtcccgggggtgggctgccgcaggagcagattcaggccgagctctctcctgcccatgatcgacggcctcttcccggcggagatgaggcgattactgcaatttgggaaacacgactcaaagcacagccgtggctgtttgatgcaccaaagtttcggctgcactcggccactctggctcccattggtagcagaggcccacaactcttactccgtttaggactgactagctacagggatttcctcggaactaattggtcctcttcggccgcatggctccggcagcagggagccacagactggggagacacacaggcgtacctagctgatcccctcggcgtgggcgcggccctcgccaccgccgacgacttcttggtgttcctccggaggagtcgccaggtggcggaggcaccgggattggtggacgtacccggaggccaccccgaaccccaggtgaatcttccacttctgaccctgtcccagccactgttgctgggaattgccagaaatgaaaccagcgccggccgggcctccgcagaattctacgtacagtgtagcttgaccagcgagcaggttcgaaagcactatctgagcggtggccccgaggctcacgaaagtacggggatatttttcgtggagacccagaatgtccagaggctactggaaacagagatgtgggcagagctgtgtccgagtgcgaaaggggccattattttatacaaccgcgtgcagggctctccaaccggtgccgctttgggatctcccgcgttgctgccgcccctgtag

SEQ ID NO: 31699 - DNA, 639 bp, Artificial Sequence
  Description of Artificial Sequence: Synthetic coding sequence
atggatccagaagttacactccttctgcaatgtccgggcggcgggctgccacaggagcaaatccaggccgagctgtcacccgcccatgacaggcggcccttgccagggggcgatgaggcgatcacagccatatgggagacacgcctcaaggcccagccttggctgtttgatgcccctaagtttcgcctccacagtgctactctggcccccatcggatctcgcggtcctcagctgctcttgcgattgggcctgacgagttacagggatttcctcggaaccaactggtcatcatccgccgcatggctgcgtcagcaaggtgctaccgactggggcgacacacaggcctatctcgcagatccactgggtgtgggcgcggcgctcgccaccgctgatgactttctcgtctttctaaggagaagcagacaggtcgccgaggccccgggactcgtcgatgtgcccggggggcacccagaaccgcaggttcgcttccaggctggacataaggacccagatagctctcgcgaactccaactgtccactctgccgatattaccagcattagttagttcactgaagggaaaacttgcttggtacttttccggctccctgctgagggccgttcatctgccaccacactag

SEQ ID NO: 31700 - DNA, 375 bp, Artificial Sequence
  Description of Artificial Sequence: Synthetic coding sequence
atggatcccgaggtcactttgctcttgcagtgcccgggcggggggttgccccaagagcagatacaggccgagctgagtccggcccacgataggcgtcctcttccagggggagatgaagctatcacagctatttgggagacccggctcaaggctcagccttggctgttcgatgcccctaagttccgactgcactccgcaacactcgcacccatcgggagccgcggtccccagttacttctccggcttggactgacaagttacagggatttcctgggaacaaattggtcctcctctgcagcctggctgcggcaacaaggtgcgactgactggggggatacacaagcctacctggctgatccactgggggtcggctag

SEQ ID NO: 31701 - DNA, 546 bp, Artificial Sequence
  Description of Artificial Sequence: Synthetic coding sequence
atgatgaagtttaaaccgaaccagacacggacttatgatcgcgagggctttaagaaacgggccgcctgtctttgttttaggagcgagcaggaggatgaagttctgttggtgagcagtagtcggtaccctgatcaatggatcgtgcccggcggcggtatggagccggaagaggagcccgggggcgctgccgtgcgcgaggtatatgaagaagctggagtgaaaggcaagctgggaaggctgctcggcatttttgaacagaaccaagatcgcaaacacaggacgtatgtatatgtgctcactgtcacagagatacttgaggactgggaagattcggtcaatatcgggcgtaaacgcgagtggttcaaagtcgaggatgccattaaggtccttcagtgtcataaaccagtgcatgcagagtacctggagaagcttaagctgggttgttcacccgctaatggcaattccaccgtgccaagcctgcccgataacaacgcactttttgtcacagccgctcaaacttctggactccctagctccgtgagatag

SEQ ID NO: 31702 - DNA, 543 bp, Artificial Sequence
  Description of Artificial Sequence: Synthetic coding sequence
atgatgaaattcaagccgaatcagactaggacatatgatagagagggcttcaagaagcgtgctgcctgtctgtgcttccgatcagagcaggaggacgaggtattgttggttagctcctctagatatcccgatcaatggatcgtgccaggaggggggatggagcctgaagaggagccagggggcgcagccgtgagagaagtgtacgaagaagctggtgtgaagggcaagctgggccgcctgctgggaatctttgaaaatcaggacagaaaacacaggacctatgtttacgtgttgacggtcactgagatcctcgaagactgggaggattctgtcaatattggcaggaagagagaatggtttaaggtggaagatgcaattaaagtcctccagtgtcataaacctgtccacgcggagtatctggaaaaactgaaactggggtgttctcctgccaacggcaatagcaccgtgcccagcctgcctgataataacgccttatttgttacagccgctcagacctccgggcttccatcatccgttcgctag

SEQ ID NO: 31703 - DNA, 390 bp, Artificial Sequence
  Description of Artificial Sequence: Synthetic coding sequence
atggaacccgaagaggagccagggggcgccgctgtaagggaggtgtatgaggaagctggggtcaagggtaagttgggtcggcttctgggcatatttgagcaaaaccaggatcgcaagcatcggacatatgtgtacgtcctaacggtgaccgaaatccttgaagactgggaggactctgtgaacattggacgcaaaagggaatggttcaaggtggaggacgccattaaagtgctgcaatgtcataaacccgtacatgctgagtacctggaaaagctgaaacttggctgtagcccagctaatggaaactctacagtcccaagcctgccagacaacaatgctcttttcgtgactgccgctcagacctcaggactgccttcctctgtaagatag

SEQ ID NO: 31704 - DNA, 543 bp, Artificial Sequence
  Description of Artificial Sequence: Synthetic coding sequence
atggagtcacaagaaccgacagagtcctctcagaatggaaagcagtacatcatcagtgaagaacttatatccgaggggaagtgggtgaaactcgagaagactacgtatatggatcctactgggaagacaaggacatgggagtccgtgaaacgcaccaccagaaaagagcagactgcagatggtgtggccgtgatccccgtgctccagcgaacgttgcattatgagtgcatagtcttagtgaagcaattccgtccgcctatggggggatattgcatcgagtttcccgccgggcttatagatgacggagaaacaccagaagccgccgcactgcgggagctcgaagaggaaactgggtacaagggtgacatcgccgagtgttctcccgccgtgtgcatggatccagggctttccaattgtaccatacatatcgtgaccgttacaattaacggggatgatgctgaaaatgcccggcctaaacctaagcccggagatggaggaatgttctgtaacagctggtggccgtctgtgtacgatttggtttag

SEQ ID NO: 31705 - DNA, 699 bp, Artificial Sequence
  Description of Artificial Sequence: Synthetic coding sequence
atggaatcccaggaaccaaccgagtcctcacagaacgggaaacagtacattatttcagaggaactgatttctgaaggaaagtgggtgaaattagaaaagaccacatacatggacccaacggggaagactagacgaaataaggagaagaccactaccctgctgattctgcggacttgggagtccgttaaacgcaccacccgtaaggaacaaaccgccgatggcgtggccgttattcctgtactccagagaaccctgcattatgagtgcattgtgctggttaaacaattcaggcctccaatgggggggtactgcattgaatttccagccggcttaatcgatgatggggagaccccagaggccgccgccttgcgcgagttggaggaggagaccggttataagggagatattgccgagtgctctccagccgtgtgcatggaccccggtctctctaactgcacaattcatattgtgacagtgaccatcaatggagacgatgccgaaaacgctcgacctaagcctaagcctggcgacggggagtttgtggaagtcattagcttgcctaagaacgatctgctgcagcgactcgatgcccttgtcgctgaagagcacttgacagtcgacgccagagtgtacagttatgctctcgcactcaagcacgccaacgcgaaacctttcgaggtcccatttctcaagttttag

SEQ ID NO: 31706 - DNA, 561 bp, Artificial Sequence
  Description of Artificial Sequence: Synthetic coding sequence
atggagagccaggagccaaccgaaagctcccagaacggcaagcagtacattatctctgaagagttgatctcagagggtaagtgggtcaagctagagaagacgacctatatggatcctaccggcaagacccgaacgtgggagtcagtgaaaaggactacaagaaaggaacagaccgcagacggagttgccgtaatccctgttctccaacggaccttgcactacgaatgcattgtgctggtaaaacagttcagaccccctatgggaggttattgcatcgagtttccagccgggcttatcgacgatggggaaacacctgaggcggccgcgctcagggaactggaagaggaaactggttacaaaggagacatcgcagagtgttcgcctgccgtttgtatggatccaggcctttcgaactgtaccatccacatcgtgacggtgaccatcaacggtgatgatgccgagaacgcacgacccaagcccaagcctggcgatggcgagttcgtggaggttattagtctgccaaaaaatgatctgcttcagcggctcgacgaaaccctgtag

SEQ ID NO: 31707 - DNA, 297 bp, Artificial Sequence
  Description of Artificial Sequence: Synthetic coding sequence
atggaaagccaggagcctaccgagtcaagccagaatggtaaacagtacattattagcgaagagctcatcagtgagggaaagtgggttaagttggaaaaaacaacgtacatggacccgacgggaaagaccagaacatgggagtccgtgaaacgtacgacccgcaaggaacagaccgccgatggtcggtccgccaacctgtttcaaccttttcgcaaggaggtgtccacctgtgacagggttgctgtcatccccgttttgcaacgcactctccattatgaatgtattgtcctcgtttag

SEQ ID NO: 31708 - DNA, 660 bp, Artificial Sequence
  Description of Artificial Sequence: Synthetic coding sequence
atggagtcacaagaacctacagaaagcagccagaatgggaaacagtacattatcagtgaagagctcatttctgagggtaaatgggtcaaacttgagaaaaccacctatatggatccgacgggcaagacccggacgtgggagtcagtgaagaggactacaagaaaggaacagactgcagacggcgtcgcggtcatcccagtgctgcagaggacattgcactacgaatgtatcgtcctggtaaaacagttccgacctccgatgggcggctactgcatcgagtttcccgcgggcctgattgacgacggtgagacccctgaggccgccgctctgcgcgaacttgaagaagaaacgggttacaagggggacatcgccgagtgctcacccgctgtctgtatggaccccggactgagtaattgcaccatacacatagtgactgtaacaatcaatggagatgacgctgagaacgcccggcccaagccaaagcccggcgacggggagttcgtagaggtgatctcattacctaagaatgacttgttgcagcggctggacgccttggtagccgaagagcatctgactgtagacgcaagggtttactcatacgccctggccctcaagcacgccaatgctaagcctttcgaggtcccattcttaaaattttag

SEQ ID NO: 31709 - DNA, 660 bp, Artificial Sequence
  Description of Artificial Sequence: Synthetic coding sequence
atggagagtcaggaaccaactgaatccagccagaacgggaaacagtacattattagcgaggaattgatctccgaaggaaagtgggttaaactagagaagactacctacatggacccaacagggaagaccagaacatgggagtccgtcaaacggaccacaagaaaagaacaaacagctgacggtgtggccgtgatcccagtcttacagaggacccttcactacgagtgcatcgtgctggtgaagcaatttaggccgcctatgggcgggtactgtatcgagttccccgctgggctgattgatgatggcgagacccccgaagccgctgccctcagagagctggaggaggagaccggatataaaggagacattgctgagtgcagtcccgctgtctgtatggacccaggactatccaattgtacgatccacatagtgacggtgaccattaacggggatgatgctgaaaatgcgagaccgaaacctaagccgggtgacggtgaatttgtagaagtaattagtctcccgaaaaacgatcttctgcagcgcctcgatgcattggtagccgaggagcacctcaccgtggacgctagagtgtactcttacgcactagctttaaagcatgccaacgcaaagcccttcgaggtaccttttctgaaattttag

SEQ ID NO: 31710 - DNA, 717 bp, Artificial Sequence
  Description of Artificial Sequence: Synthetic coding sequence
atgtcccgcttaggactgccagaagaaccagtccgcaattccttgctcgatgatgcaaaagcacgactgagaaaatatgacataggcggaaaatattcgcatctgccctataataagtactctgttctgctgccactcgtggctaaggagggcaaactacatctccttttcactgtcaggtccgaaaagcttcggcgggctcccggggaagtctgttttccaggtgggaagagggacccaaccgatatggacgacgccgccacagcgttgagagaggctcaggaagaggtggggctgcgaccacaccaggtcgaggtagtgtgctgcctggtcccctgtctgatcgacactgacacactgattaccccctttgtgggtcttatcgaccacaattttcaggctcagcctaacccggccgaggtcaaagatgtctttctggtccccctcgcttactttctacacccccaggtgcacgaccagcactatgttactcgcttaggacatcggtttattaaccacatattcgagtacaccaatcccgaagatggcgtgacgtaccaaatcaagggaatgacggccaatctggcagtgctcgtagcctttatcatccttgaaaagaagccaactttcgaagttcagtttaatctgaatgatgtgctggcgtccagtgaagagctgtttctgaaggtgcataagaaggccacgagccggctctag

SEQ ID NO: 31711 - DNA, 558 bp, Artificial Sequence
  Description of Artificial Sequence: Synthetic coding sequence
atgtccagactgggattacctgaagagcctgttcgaaattcccttttagacgatgcaaaagccagattacggaagtacgatattggcggaaagtattcccatctgccctacaataagtatagcgtgctccttccgctggtggcaaaagagggtaagctgcatcttctgtttaccgttcgatctgaaaaaacggacaccctgataactccattcgtgggcctgatcgaccataacttccaggcccagccaaatcccgccgaagttaaagatgttttcctggtccccctggcctattttctgcatccacaggtgcatgatcagcactacgtcacccggctgggccatagattcatcaaccatatcttcgagtacacgaacccagaggacggcgtgacttaccaaataaaaggcatgaccgccaatctagccgtcctggtggcattcatcatcctggaaaagaaacccacgtttgaggtgcagtttaatctcaacgacgtcttagcatcaagcgaagagttgttcctcaaggtgcacaagaaggccacaagccggctctag

SEQ ID NO: 31712 - DNA, 513 bp, Artificial Sequence
  Description of Artificial Sequence: Synthetic coding sequence
atgagcaggctcggcctgccagaggagcctgtccggaatagcctgttagacgatgcaaaggcccgcctgcggaaatacgacattggtgggaagtatagccatttgccttataataagtacagtgtacttttgcctctggtggcaaaggagggcaaactgcacttgctttttacagtgcggtccgaaaaattgcgacgcgcgcccggagaagtgtgcttccccggaggcaagagggatcctacagacatggacgacgctgcgactgcactccgcgaagcacaggaagaggtggggctgcgcccccatcaggttgaggtagtgtgctgtctcgtcccctgcctgattgaccgatggggctcccgctacgtagacgaagcgggcctggaacttctcgcgtccagcgacccgcctacgtccgcgagccagagcgccggcattacagatcgttacattgataatagcatttgcggcttcaaccgcccacagctgccggggcctgccgaatcctgctag

SEQ ID NO: 31713 - DNA, 822 bp, Artificial Sequence
  Description of Artificial Sequence: Synthetic coding sequence
atgaggttacctggcgtgcccctggcgaggcctgccctgttgcttttacttcccttgcttgccccacttctggggacgggtgctccggctgagctgcgggttcgagtgaggctgcccgacggccaagtcacggaagaatctctgcaagctgatagcgatgcagattctatttctctggagcttcggaagccggacggcacactagtttccttcacagccgactttaaaaaggacgtgaaagtcttccgcgccttgatactgggggaactggagaagggtcaaagccagtttcaggcactgtgcttcgtgacacagcttcagcacaatgagatcataccaagcgaggcgatggcgaagcttcggcagaaaaatcccagggccgtgcgccaggcagaggaggtgaggggcctagaacatttacacatggacgtggccgtaaatttcagccagggcgctctgctgtccccacacctgcacaatgtctgcgccgaggcagttgacgcaatctacacaagacaggaggacgtgcgcttttggctggaacagggcgtagacagctctgtctttgaggcattgccgaaggctagcgaacaggctgagctgccacgatgtcggcaggtcggagatcatggaaaaccatgcgtgtgtaggtacggcttaagtttggcatggtacccctgtatgctgaaatattgccattcaagggatagaccgaccccatacaaatgcggaatacgatcttgccagaagtcgtattcgtttgacttctatgttcctcagcgacaactttgcctgtgggatgaggatccatatcccgggtag

SEQ ID NO: 31714 - DNA, 2205 bp, Artificial Sequence
  Description of Artificial Sequence: Synthetic coding sequence
atgagaccagcggtgttgggctctcccgatcgcgccccacccgaggacgaaggccccgttatggttaagttggaagattccgaagaggaaggagaggccgccctgtgggacccgggacctgaggcagctcgtctgcgctttcgctgcttccggtacgaagaggcgaccggaccccaggaggcattggcccagctgcgtgagctgtgccgacagtggctgagacccgaggtgcgttctaaggaacaaatgctggaactccttgtcctggaacagttcctgggtgccctgccccctgagatacaggctcgagtacagggtcaacggcctgggtcgccggaggaagccgccgcactcgtggacgggctacggagagagcccggcgggccaagacggtgggttacagtccaggtgcagggccaggaagtactcagcgaaaaaatggaacccagttcctttcagcccttgcctgagactgagccaccaacccccgagcctggtcccaagactccgccccgcactatgcaggaaagccctctggggctccaggttaaggaggagagcgaagttacagaagatagtgacttcctggagagcggaccattagctgccactcaagaatcagtgccaacactcctaccagaggaagcccagcgctgtgggaccgtgttggatcagatttttccccactccaagacaggacctgagggaccctcgtggagagaacaccccagggccctctggcacgaggaagcagggggaatctttagccctggttttgcactgcagctggggagcattagtgccggaccaggctccgtgagtccccacctgcacgtgccttgggatctgggaatggccggactaagcggtcagattcagtcccccagccgagaggggggatttgcgcacgccctgctgctccccagcgacttgagatctgagcaggatccgaccgacgaagacccatgccgcggagtgggccccgcactgattacaacacgatggagaagtcccagggggcgcagccggggccgcccgagtactggggggggagttgtccgcggtggcaggtgcgatgtatgcggcaaagtgttcagccagcgaagtaacttactcaggcaccagaaaattcatacaggcgagcgcccgttcgtttgtagcgagtgtggacgtagctttagtcggtcgtcacacctgctgcgacatcaactgacccataccgaagagcggcctttcgtgtgtggggactgtgggcaaggcttcgtgaggagcgctagactcgaggaacaccgccgcgtgcatactggcgagcaacccttccgctgcgccgaatgtgggcagtccttccgccaaagaagcaatctgctccaacaccagagaatccacggagatccacctgggcccggagcaaagcctcctgcgccgcctggagcccccgagccccccggtcccttcccatgttccgaatgtcgcgaatcctttgcccggcgggctgttttgcttgaacaccaagcagttcatactggggacaaaagcttcggatgcgtggagtgcggggaacgattcggccgcagatcagtccttctccagcaccggagggttcacagcggtgaacgacctttcgcatgtgctgaatgtggccaatcatttagacagcggtctaatcttactcagcacaggagaattcatacgggggagcggcctttcgcgtgcgcggagtgcggaaaggcgttccggcagcggcctactttaacacaacacttgagggtacatacgggcgagaagcccttcgcctgccctgagtgcggacaaagattttcccagcgactgaaactgacacgccaccagaggacgcacacaggggaaaagccatatcactgcggggaatgtggtctgggctttactcaggtcagcaggttgactgaacatcagcgcatacacacaggagaaagaccatttgcatgcccggaatgtgggcaaagcttccggcagcacgctaaccttacccagcatcgtaggatacatactggtgagagaccttatgcatgcccagagtgcggcaaggcattcaggcaacggcccacccttacacaacatctccgcactcacaggcgcgaaaagccattcgcctgccaagactgtgggaggagatttcaccaaagtacaaaattgattcaacatcagagggtccatagcgcagagtag

SEQ ID NO: 31715 - DNA, 135 bp, Artificial Sequence
  Description of Artificial Sequence: Synthetic coding sequence
atggggatgtatccgccccttctactgaaaatatatctgagtaggcatattagcatccttttttacctgaaaattctgtacaagagcgggattatttggctgagctggtactcattcatacttcttgtgctttag

SEQ ID NO: 31716 - DNA, 957 bp, Artificial Sequence
  Description of Artificial Sequence: Synthetic coding sequence
atggaaagaggcgatcagcccaagcgcacacggaacgagaatatatttaactgcctgtacaagaatcctgaagccaccttcaaactgatctgcttcccatggatggggggaggctcaactcacttcgctaaatgggggcaggatacccacgacttgttagaggaaacggcctctcaccacgtagctaaggcaggcctcaagctgcgacgcagctctgatcctcccgcctcagcctatccgtgtgctggtgtctctcaccgacggcgggagccaccctgtcttgctaagattctcgggctgttctggatcttgatcttcttcatgcacagtcttcgcctccccgggcgagagtctcgtgttgaagagccactggaaaatgacatcagtcagttggtggatgaggtggtgtgtgcattgcagcctgtgatacaagataagccgttcgccttctttggccactcaatgggatcttatattgcattcagaaccgcccttgggttgaaggaaaacaatcaacctgagccactgcacctttttttgtcatccgctacaccagttcattccaaagcttggcaccgaatcccaaaagacgatgagcttagcgaggagcagatcagtcactatctgatggagttcggtggcaccccaaagcatttcgctgaggcgaaggaatttgttaaacagtgctcacccattatccgggccgatctcaatatcgtgcggagctgcacttcaaacgtaccgtcaaaggccgtgctttcctgtgatctgacttgctttgtagggagtgaagatatcgctaaggacatggaagcctggaaggacgtgacatctgggaacgcaaaaatctaccagctcccagggggccacttctacctgttagatccagccaatgaaaagctcatcaagaactacatcattaagtgcctggaagtctcatccataagcaatttttag

SEQ ID NO: 31717 - DNA, 414 bp, Artificial Sequence
  Description of Artificial Sequence: Synthetic coding sequence
atggagagaggcgatcaaccaaaaaggactcggcaggcaaccccttgcgccacaagattatttctgcaccctcgagggtctgacaccctccccctgaacgagaatattttcaactgtctatataagaacccagaggccacctttaagctgatctgcttcccctggatgggtggtggtagcacacacttcgccaagtggggccaggacactcatgacttgttagaagtgcattcattaaggttgccaggacgagaatctagagtggaggagccactggagaatgatatctcacagctggttgatgaggttgtgtgcgccctacaaccggttattcaggacaagcccttcgctttcttcggtcatcggtacctcatcagtgtgctcaaggatttcagaggtgtcagctctatttag

SEQ ID NO: 31718 - DNA, 798 bp, Artificial Sequence
  Description of Artificial Sequence: Synthetic coding sequence
atggagaggggcgaccagcctaaaagaactaggaacgagaacatcttcaattgtctctataaaaaccccgaagcgacattcaagcttatctgtttcccatggatggggggcggctctactcacttcgcaaaatggggccaggatacacacgacttgctggaggtgcacagtttgcggctgcccgggagagagtctcgagtggaggaacctctggagaatgatataagtcagcttgtggatgaggtggtgtgtgctttgcagccggtgatccaggataagccttttgccttttttggacatagcatggggagctacatcgcttttagaaccgctttgggactgaaggagaataaccagccagaaccattgcacttgttcttgtctagcgcaacgcccgtgcatagcaaagcttggcacagaattcccaaagacgacgagctcagcgaggaacagatttcacactatctgatggagtttggagggacgcctaaacacttcgcggaagctaaagaattcgttaagcagtgcagtcctataattagagcagatctgaacattgttcgctcctgtaccagcaacgttccctccaaggcggtcctttcttgtgacttgacctgttttgtagggtcggaagacatagcaaaggacatggaagcctggaaagatgtgacttcaggcaacgcaaaaatttatcaactgcccggtgggcacttctacctcttggaccctgctaacgagaagttgattaaaaattacattattaagtgtctcgaagtgagcagtatatcaaacttttag

SEQ ID NO: 31719 - DNA, 291 bp, Artificial Sequence
  Description of Artificial Sequence: Synthetic coding sequence
atggaaagaggggatcagcccaagcggacccgcaatgaaaatattttcaactgtttatacaaaaatcctgaagccactttcaaactgatttgtttcccatggatgggagggggaagtacacattttgctaaatggggacaggacacccatgatcttctcgaagagacagcttcccaccatgtcgccaaggccggcctcaaactcaggcgatccagcgatccacccgcctcagcatacccatgcgccggagtgtctcatagacgccgcgagcccccctgtttggcaaagtag

SEQ ID NO: 31720 - DNA, 432 bp, Artificial Sequence
  Description of Artificial Sequence: Synthetic coding sequence
atggagcgcggtgaccagcccaagcgaacacgcaatgaaaatatcttcaattgtctgtacaagaacccagaggccaccttcaagcttatctgtttcccatggatggggggagggagcactcactttgctaaatggggacaggatacccacgatctactggaagtacatagcctcagacttcccggaagagagtcccgcgttgaagaaccgctggagaacgacatttcacagctagtggacgaagttgtgtgcgcgttacaacccgtaatccaagataagccatttgctttctttgggcactccatgggcagctatattgcattccgaacagctctgggcctgaaagaaaacaatcaacccgaaccactgcatttgttcctgtcatcggccaccccagtccacagcaaggcatggcaccgaataccgaaatag

SEQ ID NO: 31721 - DNA, 546 bp, Artificial Sequence
  Description of Artificial Sequence: Synthetic coding sequence
atggaacgtggggatcaaccaaaacgcactcgaaacgagaatatcttcaattgtctctataagaatccagaggcaacgtttaagttaatatgtttcccttggatgggcgggggatcaactcatttcgctaaatgggggcaggacacacacgacttacttgaggtacacagcctaaggctccctggacgggagtctagggttgaggagccgctcgagaatgatatatcacagctagtggatgaggtggtatgtgcattacagcccgtgatccaggacaaaccattcgcttttttcggccactccatggggtcttatatagctttccgcactgcccttgggttgaaggagaataaccagcctgaacccctacatctcttcctcagtagcgccacgcccgtccactctaaagcttggcacagaatacctaaggacgacgaactgagcgaggaacagatttctcactacctcatggaatttgggggcacacctaaacactttgcagaagccaaggagtttgtcaagcagtgttcccccatcattcgatag

SEQ ID NO: 31722 - DNA, 957 bp, Artificial Sequence
  Description of Artificial Sequence: Synthetic coding sequence
atggctgccgccgcactcccgccgcgccctctgctgttgctgcccctcgtcctcttattatctggccgccctaccagggccgactcaaaagtatttggcgatctcgaccaggtgcgcatgacttcagaggggtctgattgtagatgcaagtgtattatgagacctttgtccaaggacgcatgctctcgggttcgaagtggccgtgcgcgggtggaagatttttacacagtggaaacagtcagctcaggaactgattgccgctgcagttgcacagctccgccatcttctctgaatccgtgtgagaacgaatggaaaatggaaaagctgaagaaacaggcacccgagctcctgaagagcattaaagcaaacttgtcgagggagaatgaggtcgtaaaggattctgttcgtcatctatccgaacagctcaggcattacgaaaatcactctgccataatgctcgggattaagaaggaattatccaggctgggactccaacttctgcaaaaagacgccgctgccgctcctgcgacgccagctacaggcactgggagtaaggcacaagatacagctcgaggaaagggaaaggatatttccaagtacggcagcgtgcagaagtccttcgccgaccggggtctgcctaaaccaccaaaagaaaagctgctgcaggtggaaaaactgagaaaggaaagtggaaagggaagcttccttcaacctacggcaaagccaagggctctggctcagcagcaagccgtgatcagagggtttacttactataaagccggcaagcaggaggtaaccgaggccgtcgccgacaatacactacaggggacaagttggttagagcagctccctccgaaagtagaaggcagaagcaacagcgctgagccaaattcagccgagcaggacgaggccgagcctcgttccagcgaaagagtagacctcgcctcaggtacatag

SEQ ID NO: 31723 - DNA, 987 bp, Artificial Sequence
  Description of Artificial Sequence: Synthetic coding sequence
atgaaactctggatggagtctcacctgatagtgccagagacaagacctagtcccaggatgatgtcaaaccaaaccttggtgactgagttcatacttcaaggcttttcagaacaccctgaatatcgtgtttttctgttttcatgctttctatttctctattctggcgctctgaccggcaacgtccttatcacgttggcgatcactttcaatccgggcctccatgctcccatgtacttcttcctgttgaacctggctaccatggacattatctgcacctcatccatcatgcccaaagcgctagcaagtcttgtcagcgaggagtcttcaattagctatggcgggtgcatggcccagttgtactttctgacgtgggctgcatcctctgagttgcttctgcttacagtcatggcatacgatcgctatgcagcgatctgccatcctttgcattattcctccatgatgtcaaaagtattttgttctggactggcaactgcagtctggctgctctgcgcggtcaatacagctatccataccgggctgatgttacgcctggacttttgtggtcctaacgtcattatccattttttctgtgaagtgccgcctcttctcttgctgagttgcagtagtacatatgtgaacggcgtaatgattgtgttagccgacgccttttatggtattgtgaatttcctcatgactatcgcctcatacggattcattgtcagctcaatcctcaaggtcaagactgcatggggacgccagaaggccttttctacatgcagctcccatttaacagttgtgtgtatgtactatactgcagtgttttacgcatacattagccctgtctctggatactcagcaggaaaaagcaaactggctggcttgctctacacagtacttagccccactctgaacccgctgatttacaccctgaggaacaaagaagtgaaggctgcgttgagaaaattgttcccctttttccgaaactag

SEQ ID NO: 31724 - DNA, 903 bp, Artificial Sequence
  Description of Artificial Sequence: Synthetic coding sequence
atggggcagaatcagacctctatatccgactttctcttgttaggcttgccaatacagcccgaacaacagaatctctgctatgcgctgttcctcgccatgtatttgaccaccttgctcggtaatctactcatcattgtcctgattaggttggactcccacctccacacaccagtgtatctgttcttatcgaacctttcgttttccgacctgtgtttctcatcagttaccatgcctaagttgctgcaaaacatgcagaatcaagatcctagcattccttatgccgactgtctaactcagatgtatttttttctgtatttctctgacctggaatctttcctgctggtagctatggcctatgatagatacgttgccatttgctttccgatgcactatactgccattatgtccccaatgctctgcttgtctgtcgtcgctctgagttgggttctaaccacatttcacgccatgctgcatacccttttaatggcccggctctgtttctgtgcagataatgtgatcccccacttcttctgtgatatgtcggcccttctgaagttggcctgctcagatacccgagtaaacgagtgggtgatctttattatggggggactcatactggtcattccttttttattgatcttgggctcctacgccagaattgtgagttcaatactgaaagtgccttcctcaaagggaatctgcaaggccttctcaacttgcggctcccatctaagtgttgtgtctctattttatggcaccgtcatcggcctctacctctgcccatctgccaactcctctacgctgaaggacactgtgatggctatgatgtacacagttgtgaccccaatgttaactccgttcatctatagcttaagaaatagggatatgaagggggccctgtag

SEQ ID NO: 31725 - DNA, 948 bp, Artificial Sequence
  Description of Artificial Sequence: Synthetic coding sequence
atggaaatcgtgtctaccggaaatgagaccataacagagtttgtgttactgggtttctacgacattccagagctgcatttcctgttcttcattgtgttcactgccgtctacgtgttcataattataggtaatatgctcatcatagtggcggttgtctcttctcagaggctgcataaacctatgtacatctttctggccaatctatcctttctcgacatcctctacacatcagcggtcatgcctaagatgctcgagggttttctccaagaagctacgatctcggtggcaggctgcctgctacagttcttcatctttggcagtttggcaaccgctgagtgcctgcttttggccgtgatggcttacgatcggtacttggccatctgttaccccctgcattacccccttctgatgggtccccgaaggtatatgggtctcgtcgtgactacatggctctcgggcttcgtagttgacgggctggtggtggccctggtcactcagcttaggttttgtggtcccaaccatatcgaccagttttactgtgacttcatgctctttgtggggctggcatgcagcgaccctcgcgtggcacaggtaacaacactgatcctgtctgtgttttgcctcaccataccattcgggttgattctcacatcatatgcaagaattgtggtggccgtcttgagggtgcccgctggcgcctcaaggagaagagccttctctacctgctcctcgcacctggcagtagtgaccacgttttatgggaccctcatgattttttacgtagccccttccgccgtgcacagtcagctgctgtccaaggtgtttagtctgttatacactgtggtcacaccacttttcaatccagtcatttacaccatgaggaataaggaggtgcaccaggcactgcggaaaattctatgcataaaacagacagagaccctggattag

SEQ ID NO: 31726 - DNA, 948 bp, Artificial Sequence
  Description of Artificial Sequence: Synthetic coding sequence
atggagattgtgtctacaggcaacgaaacgatcactgagtttgttctgctggggttctatgacattcccgaactgcacttcctcttctttatcgtatttacggcggtctatgtcttcatcattataggaaatatgctgataatcgttgccgtagtgtccagccagcggttgcacaagcctatgtacatttttctggccaatctttctttcctagatattctgtacacatctgccgtgatgcccaagatgctcgagggattcttgcaagaggctactatttcggtggcagggtgtttgcttcagttttttatctttggcagtcttgccactgctgaatgtctgttgctcgcagtgatggcatacgataggtacctcgccatctgctatccccttcactatccgctgctcatgggaccacgtagatatatgggcctggttgtgaccacatggctgagcggctttgtcgtggacggcctggtggttgcactcgtgacccaactaaggttctgtggcccaaaccacattgaccagttttactgcgattttatgctgtttgttggtcttgcctgttctgacccgagagtcgcgcaggtgacaactctgatcctctcagttttctgcctgaccatccccttcggattaatattgactagctatgcccgcatagtggtcgcagtccttagggtccctgcaggcgcctcgaggcggcgcgctttctctacctgcagcagccacttggctgtcgtcaccaccttctacggcaccctaatgatcttctacgtggcgccatcagcagtgcactcccagctcttatccaaggtattctctttgctatacaccgtggtgacccctctgtttaatcccgttatttacacgatgcgcaataaagaagtccaccaggctctgagaaagatattgtgtatcaaacagaccgagactctggactag

SEQ ID NO: 31727 - DNA, 948 bp, Artificial Sequence
  Description of Artificial Sequence: Synthetic coding sequence
atggagattgtgtctaccggaaatgaaacaatcacagaatttgttctgctaggcttctacgatattccggagttgcacttcttgttctttattgtctttactgccgtgtacgtattcatcattatcggcaatatgttgattatcgtcgcagtggtctcttcccagcgcctacataagccaatgtacatttttctggccaacctgtcctttctggacatcctgtacacttccgctgtgatgccaaaaatgctcgaaggattcttgcaagaggcgactatttcagtcgctggttgccttctgcagttttttatctttggatccctggccacagcagagtgcctgcttctcgccgtcatggcctatgatcgctatctggctatatgctatccactgcactaccctctcctgatgggacctagacgatacatgggtctggtggttaccacgtggcttagcggttttgtcgtcgatgggttagttgtggccctggtcactcaactccgcttttgtggccccaatcacatcgatcaattctactgcgatttcatgctgtttgtgggcttagcctgcagcgatccacgtgtcgcccaggtgactacgctgatcttatccgtcttctgtctaaccataccgttcggcctaatcctcacgtcttacgcccgcatagtggttgcagtgttgcgagtgcctgctggcgcctctagacgcagagccttcagcacctgtagctcccacctggccgtggtcacaacgttttacggtacactcatgatcttttatgttgcgcccagtgctgttcatagccaactgttatccaaagtcttttcgctgctgtacactgtggttacgccgctctttaatcccgtaatttacaccatgagaaacaaagaggtacaccaggccctacgcaaaatattgtgcattaagcagaccgaaactctggattag

SEQ ID NO: 31728 - DNA, 924 bp, Artificial Sequence
  Description of Artificial Sequence: Synthetic coding sequence
atgttgaacacgacctcggtcacagaattccttctgctgggtgtgaccgacattcaggagctccagcccttcctgttcgttgtgttccttacaatctatttcatctccgtgactgggaacggggccgtcctaatgatagtgatttcagacccaaggcttcactctctgatgtactttttccttgggaacctatcgtatttagatatttgctactctacagtgaccctcccaaaaatgctccagaacttcctgagcactcacaaggctatctcatttcttggatgcatctcacaactgcatttcttccactttctcggatcaactgagagcatgctctttgccgtaatggctttcgacctgtctgtggcaatttgtaaaccattgagatatacagttattatgaacccccaactctgcacccaaatggctatcactatctgggtcatcggatttttccatgcactgctacatagcgtcatgactagcagactgaacttctgtggctctaacagaattcaccattttctgtgcgatataaagcctttgctgaagctcgcctgcggcaacacagaactcaaccagtggcttctgtctacggtaacaggcacaatcgccatggggccgttttttctgaccctgttatcttacttctacatcataacctatctcttttttaaaaccagatcttgtagcatgttgtgtaaggccctgagcacttgtgcctctcactttatggtcgttatcctgttttatgccccggtgctgtttacttacatccacccagcactggagagctttatggatcaggatcgcatcgtggcgatcatgtacaccgtcgtgactccagtgttaaaccccctcatctacacactgcggaacaaggaggtgaagggagccttggggcgggtcatcaggcggctgtag

SEQ ID NO: 31729 - DNA, 924 bp, Artificial Sequence
  Description of Artificial Sequence: Synthetic coding sequence
atgttaaacacaacgagcgtcacagaattcctgctcctgggggttaccgacatccaagagctgcagccctttctgttcgtcgtgttcctgacgatctacttcatctccgtgacgggaaacggagccgtcctcatgatagtgatttctgatcctagactgcactctctgatgtatttttttctggggaatctgtcgtatctggacatatgttacagtacggtcactttacctaaaatgcttcagaatttcctttcaacccataaggcaatatcatttctggggtgtatatctcagctccactttttccactttttggggagtaccgagtctatgctgttcgccgtcatggccttcgacctctccgttgcaatctgcaagcctctccgctataccgttatcatgaacccccagctatgcacacagatggcgatcacaatatgggttatcggctttttccacgccctgctccacagcgtgatgacttctagattgaacttttgcggctccaacagaatccaccactttctgtgcgacattaagcctctgctgaaactggcgtgcggcaataccgagctaaatcagtggttgttgagcaccgtgaccggcacaatcgctatgggcccgttttttctgacactgctgagctatttctatattatcacataccttttcttcaaaactcggtcgtgcagtatgctctgcaaagctctgtctacatgcgcctctcactttatggtggttatcttattttacgccccagtgctgttcacctatattcaccccgccctagagtctttcatggaccaggatagaatagtggcaatcatgtacactgtggtgaccccagtcctgaacccactgatctacaccctgcgcaataaggaggtgaaaggtgctttgggccgtgtcatcagaaggctgtag

SEQ ID NO: 31730 - DNA, 924 bp, Artificial Sequence
  Description of Artificial Sequence: Synthetic coding sequence
atgctgaacactactagcgtcactgagttcctgcttctgggggtcaccgatattcaggagcttcagccgtttctattcgttgtgtttctgactatatattttatctctgtgacggggaacggcgcagtgcttatgatcgtgatttccgacccacggctgcatagcctgatgtactttttcttaggtaatctgtcgtatctcgacatttgttactctactgtgactctgccaaagatgctgcagaattttctctccactcacaaggccatcagttttctgggttgcattagtcagctccactttttccactttctcgggagtacggaatccatgctgttcgcagtgatggccttcgatctgtctgttgcaatctgcaaaccgctgcggtatactgtcataatgaatccccagttatgtacacagatggcaatcactatttgggttattggcttctttcatgcactcctccactctgttatgacatcaaggctgaatttctgcggatcaaaccggattcatcatttcctgtgcgacattaagcccctgctaaagctagcctgcggaaacaccgagctgaatcaatggttgctttccaccgtgacgggaacaattgccatggggccgttcttcctcactctattatcgtatttctatattattacttacctgtttttcaaaactcgaagctgtagcatgctctgcaaggccctcagcacttgcgcctcccattttatggtggtgatactgttttacgccccagtgctattcacgtatatccacccggctctggagtctttcatggaccaagacaggattgtggcaatcatgtatactgttgtgactccagtcctgaatcccctgatctatacgctgcgcaacaaagaggtgaaaggagcactcgggcgcgtgattagaaggctttag

SEQ ID NO: 31731 - DNA, 951 bp, Artificial Sequence
  Description of Artificial Sequence: Synthetic coding sequence
atggaaaacgtgaccacgatgaacgagtttctgctgcttgggctgacgggagtgcaagaattgcagcctttctttttcggcatattccttattatatatctcatcaatctcattgggaacggctccattctggtcatggtcgtgttagaaccgcagctgcatagcccaatgtatttctttctgggaaatctaagctgcctagacatctcctactcatcagtcactctgccaaagttactagttaacctggtatgttcacgacgcgccattagctttctggggtgtattatccagctgcatttttttcactttctcggctccaccgaagctattttactcgccatcatggcctttgataggttcgtggcaatctgcaacccactccgctacacagtgatcatgaacccacaggtttgtatattgttagctgccgctgcatggcttatttcgtttttctacgccttgatgcatagcgtcatgacggcccatttaagcttttgtggaagtcagaaactcaatcacttcttttacgacgtcaaacccctcttggaattggcctgttcagacacactcctgaatcagtggcttctcagcatagtgaccgggtccatttcaatgggggcattttttttgacccttttgtcgtgtttctacgttatcggttttctgctgttcaagaataggtcctgcaggattctccataaggctctgagcacctgcgcatcacactttatggttgtgtgtctgttctacggaccggtcggctttacctatatccggccagccagcgcaaccagcatgatccaagacagaataatggccatcatgtatagcgctgtaactccagttctcaatcctttgatatatactctgcggaataaggaagtgatgatggctctgaagaaaatctttggccggaaactctttaaggattggcaacagcaccactag

SEQ ID NO: 31732 - DNA, 951 bp, Artificial Sequence
  Description of Artificial Sequence: Synthetic coding sequence
atggagaatgtcaccaccatgaatgaatttcttcttctcggcttgactggcgtccaagaactccagccctttttctttgggatttttctgatcatctacctgatcaaccttattgggaacggctcaatactcgtgatggtcgtccttgaacctcagctacattccccaatgtacttcttcctgggcaacttgagctgtcttgatatatcctatagcagcgttaccctgccaaaattgcttgtcaacctggtgtgctcccggcgggccatatcctttctgggctgcattattcagctgcatttctttcattttctgggatcaactgaggctatcttactggcgatcatggcattcgatagattcgttgcaatctgtaatccattgcggtacaccgtgattatgaacccacaggtatgcatcctgctggccgcggccgcctggctcatcagctttttctatgcactgatgcacagcgtgatgaccgcgcacctgtccttctgtggatcacagaaactgaatcacttcttctacgacgtcaaacctctactggaactcgcctgttcagataccctccttaaccaatggttgttatccatagtgaccgggagtattagtatgggggcattttttctgaccctgctgtcctgtttctatgtgatcgggttcttactcttcaagaaccgaagctgcaggattctgcacaaagccctgtctacatgtgcttctcacttcatggtggtctgcttgttctatggaccggtgggcttcacctacatccgccccgccagcgcaacttccatgatccaagataggattatggcgatcatgtactccgccgtcactcccgtcctgaatcctctcatctacaccctgaggaacaaggaagttatgatggctttaaagaagatttttgggagaaaactctttaaagactggcagcaacatcattag

SEQ ID NO: 31733 - DNA, 951 bp, Artificial Sequence
  Description of Artificial Sequence: Synthetic coding sequence
atggagaatgtgaccacaatgaatgaatttctattgctggggttgactggcgtccaagagctccagccttttttttttggcatatttctcataatatacctgatcaaccttataggaaatggatctatcctggtgatggtggtgctagaacctcagctccattcccccatgtatttcttcctgggaaacctcagctgtctagatatcagttatagttcagtgactctcccaaaacttcttgtgaacctggtttgcagtcggcgggcaatctccttccttgggtgtattatccaacttcatttcttccatttcctgggatccacagaggctattctcctcgcaattatggccttcgatcgctttgtcgctatctgtaaccctttacgatacacggtgattatgaacccgcaagtctgcatcctgctcgctgctgccgcctggttgatatcttttttctatgctctgatgcattccgtgatgacagcacacttatctttctgcgggtcacagaaactcaatcatttcttttatgatgtgaaaccgttactggagcttgcgtgctcagacactttgctcaatcaatggctcctttcgatagtgacgggcagtatctccatgggtgctttctttctgactctcctgtcatgcttctatgtgatcggctttcttctgtttaagaaccggagctgccgtatcctccacaaggctctgagcacctgcgccagccatttcatggttgtctgcttgttctacggccctgttggattcacatacattaggccagcatctgccactagtatgattcaagatcgtattatggctattatgtattcagcagttactcccgtgttgaaccctcttatttatacattgcgcaataaagaggtcatgatggcactgaagaaaatttttggacgtaaactcttcaaggattggcagcagcaccactag

SEQ ID NO: 31734 - DNA, 951 bp, Artificial Sequence
  Description of Artificial Sequence: Synthetic coding sequence
atggagaatgttactacaatgaatgagttcctcctactgggcctcacgggagtccaggagcttcaaccttttttttttggcatcttcttgatcatatatctaatcaacctgattggtaacggcagtatactcgtgatggttgtcctggagccacagttgcactctccaatgtactttttcttaggaaacctcagctgcctggacatttcatactccagtgtgactctgcctaagttactagtgaacctggtctgctcacggcgggccataagctttctcggttgtatcattcagctccatttctttcactttctcggatctacagaggctattctgctggccatcatggccttcgaccgatttgtggctatttgcaatcccctgcgctatactgtgataatgaatcctcaagtatgcattttgctggctgccgctgcctggctgattagtttcttctacgcactaatgcatagcgtgatgacggctcacctgtcattttgtgggtctcagaagctgaaccatttcttctatgacgtgaagcccctcctggagctcgcctgcagcgatacgctgctcaaccagtggctgctcagcatagttaccggttctatcagcatgggtgcattctttcttacactgttgtcatgtttttatgtcattggcttcctgctttttaagaatcgaagctgccgcatccttcacaaggccctatccacctgtgcgtcccatttcatggtcgtttgccttttttatgggcccgtcgggttcacatatattcgcccggctagcgctacgagcatgattcaggacaggatcatggcaattatgtactcagctgtgactcccgtcctcaatcctctcatttataccttacgcaacaaagaggtgatgatggccctgaaaaagatctttggaagaaaactcttcaaagattggcaacagcaccactag

SEQ ID NO: 31735 - DNA, 936 bp, Artificial Sequence
  Description of Artificial Sequence: Synthetic coding sequence
atggacaacctcactaaagtcaccgagttccttttgatggagttctcaggaatctgggaattacaagtcctacatgcaggacttttcctgctgatctacctggcagtgctcgtcggcaatcttctcattattgccgttatcacgcttgatcaacatttgcatactccgatgtacttctttctcaaaaacctatcagtgctggacctgtgttacataagcgttacagtcccgaaaagtataaggaatagcctgacccgtcgcagcagcatcagctatttgggctgcgtcgcccaagtgtacttcttctcagcatttgcgtcagctgaattagcatttctgaccgtcatgtcatacgaccgctacgtggccatttgccatcccctccagtatcgcgcagttatgacttcaggaggatgttatcagatggcagtgacaacctggctctcatgctttagttacgcagccgtgcatactgggaacatgttccgggagcacgtgtgtcgcagctctgtgatccaccagttctttagggatattccccacgttctcgcacttgttagctgtgaagtgttcttcgtggaattcctgaccttagcactgtcgtcttgcctggttctgggctgttttatcttgatgatgatttcttacttccagatctttagcacggtcctgaggatcccgtcgggccagtcgagggcaaaggcatttagcacatgcagcccccagctgattgttattatgctgttcctcacgaccgggttgttcgcagccttagggcctattgcgaaggctctgtccatccaggaccttgtgattgctctgacttatacggtcttaccacccttcttaaaccccattatctactccctgcgcaacaaagagatcaagactgcgatgtggagactgttcgtcaaaatatactttctccagaagtag

SEQ ID NO: 31736 - DNA, 966 bp, Artificial Sequence
  Description of Artificial Sequence: Synthetic coding sequence
atggttaaccttacttcaaccagcggtttcttgctgatggggttctccgatgagcggaaactccagatcctccacgcattagtttttcttgtgacatacttgctggctctgacaggcaatctcctcatcatcaccattatcaccgtagaccgtagactgcatagtcccatgtactactttctcaaacatctaagtctacttgatctctgtttcatctctgtgactgtgcctcagtcaatagctaactcgctcatgggaaacgggtatataagtttggttcagtgcatcctccaggtattcttcttcatagcactggcctcctctgaggtcgccatattgaccgttatgagttatgaccgctacgccgctatttgccagcctctgcactacgaaactatcatggaccctagggcatgtcggcacgccgttatcgctgtatggatagctggagggctttcaggattgatgcatgccgccattaatttcagcatcccactttgtgggaagagagtgatccaccaatttttctgtgatgtgccacagatgctgaagttagcctgttcatacgagtttataaacgaaatcgcacttgccgctttcacaacgtccgccgccttcatttgtctgatttccatcgtcctcagctacatacgcattttctctaccgtcctcagaatccctagcgctgaggggagaaccaaagtgtttagtacatgcttgccccatttgttcgttgcaacattttttcttagtgctgccgggtttgaattccttcggctgccatcagacagtagtagcactgtggacctggtgttttccgtgttttatacagtgatcccccccaccttaaatcctgtcatctactctctgcgaaacgatagcatgaaggctgctttgcgtaaaatgctgagcaaagaggaactcccgcagcggaaaatgtgcttgaaagccatgttcaagctctag

SEQ ID NO: 31737 - DNA, 966 bp, Artificial Sequence
  Description of Artificial Sequence: Synthetic coding sequence
atggtcaacctcacttctacgtctgggttccttcttatgggcttctctgacgagcgcaaacttcagatcttacacgctttggttttcctcgtaacatatctgttagccctcaccggaaatctgttgatcataactatcattaccgtggaccgcaggttgcactccccaatgtactatttcctaaaacacctgtcgctgctcgatctctgtttcatatcagtgaccgtaccgcagagcatcgcgaactctctgatgggcaacggctatatcagcctagtgcagtgtatcctgcaagtattcttctttatagctttggcctcatccgaggtcgccatccttacagtaatgtcctacgatagatacgctgctatttgccagccacttcattacgagaccattatggaccctagagcatgtagacatgccgtgatcgccgtatggatcgccggtggtttgagtggattgatgcatgctgccattaattttagtatcccactctgcggcaagcgcgtaatccaccagttcttttgtgatgtgcctcagatgttaaaactggcttgttcatacgagttcattaatgagattgcacttgccgcgtttactacctcggccgcttttatctgcctcatttcaatcgtgctctcttatattagaatcttcagcaccgtcttacggatacccagcgccgagggccgaaccaaggtgttcagtacatgcctccctcacctctttgttgctactttttttctaagtgccgctggcttcgaattccttcggctccctagtgactctagcagtactgtagacctggtcttcagcgtgttctatacagttatccccccgacattaaatccggtcatctactccctaagaaacgattccatgaaggcagctctgagaaagatgttgtcgaaagaagaattgccacaacgcaaaatgtgcttgaaagccatgttcaagctgtag

SEQ ID NO: 31738 - DNA, 966 bp, Artificial Sequence
  Description of Artificial Sequence: Synthetic coding sequence
atggtgaatttaacctcaacctccggctttctgctgatgggcttctccgatgaacggaagttacagatcctacacgccctagtgtttttggtaacttatctgttagcgctgaccgggaacttgctgatcatcaccatcataacggttgacaggcgtcttcactctcccatgtattatttcctaaaacatctttccttgttagatttgtgtttcatcagcgtcactgtgcctcagtccatcgccaattctttgatgggaaacggatacatatcactggttcagtgcattctgcaggtgttcttctttatcgccctggccagctcagaggtcgcaatccttaccgtcatgtcttacgaccgctacgcagccatttgtcagccgctacactatgaaacaatcatggacccgagggcttgtcggcatgccgtcattgccgtctggatcgccggggggctttccggactcatgcacgcggctattaatttctcaattccgctgtgtgggaaaagagtaatccaccagttcttctgtgacgtcccccaaatgctgaagcttgcctgttcctacgagttcataaatgagatagccctagccgcctttaccaccagcgcagcttttatttgccttatctcgatcgtcctctcttacatcaggatttttagcactgtacttcgtattccaagtgcggaggggaggacaaaagtgttctccacctgcctcccacacctttttgtggccacattttttctgagcgccgccggatttgagttcctacggctgccaagcgactcatccagtaccgtcgatctagtgttttctgtgttctataccgttattcctcccactcttaatcccgtgatctactcgttgcgaaacgactctatgaaagccgcattacgaaagatgttgagtaaggaggagctgccacagagaaaaatgtgtctgaaagcgatgttcaaattatag

SEQ ID NO: 31739 - DNA, 966 bp, Artificial Sequence
  Description of Artificial Sequence: Synthetic coding sequence
atggttaatttgacatctacatctggttttttgttaatgggtttttcagatgagagaaaactccaaatcctgcacgccttagtttttctggtcacctacctgctggctctaacaggcaacctgttgatcattactatcatcaccgtggatcggagacttcactcgcctatgtattatttcctgaaacatctaagccttctggacctgtgttttatcagcgttactgtgccccagtctatcgccaactcactgatggggaatgggtacattagcctggttcaatgcattttacaggttttctttttcatagctctggcctcctcagaggtggctatcctcacggtgatgagctatgatcgatacgccgccatctgccagccgctgcactatgaaacaattatggatccgcgggcctgccggcacgcagttatcgccgtctggatagccggggggctgtcaggcttgatgcacgccgctatcaatttctccatccctctctgcggcaagagagtcatccaccaatttttttgcgacgtccctcagatgcttaagctggcttgctcctacgaattcattaatgagatcgctcttgccgccttcaccacctcagccgcctttatttgcctgataagtatagtgctgtcatacatccgtattttcagcaccgtgctaaggattccatccgcagagggacgcacaaaagtctttagcacgtgtctcccccacttgtttgttgctaccttcttcctttcagctgctgggttcgaatttttgcgcctcccttctgacagcagctcgacagttgaccttgttttcagcgtgttctacacagttatccccccaaccctgaatccggtgatctacagcctcagaaatgattctatgaaagccgcactgcggaaaatgctgagcaaagaagagttgccccagagaaagatgtgcttgaaggcaatgtttaagctctag

SEQ ID NO: 31740 - DNA, 939 bp, Artificial Sequence
  Description of Artificial Sequence: Synthetic coding sequence
atggtgaaccagtcgagcactcccggtttcctgctgctgggctttagcgagcaccctggccttgagcggacactctttgtcgtggtattcacatcttatctgctcacactggtgggaaatacactgattatactgcttagtgtactggacccaaagctccacagcccaatgtacttttttctttctaacctgagctttctggatctgtgctttacgactagttgtgtgccccagatgctggtaaacctttggggcccgaagaaaacaatttccttcctcgattgtagcgtgcaaattttcatatttctcagccttgggacaaccgaatgtattcttctcaccgtaatggcctttgaccgctatgttgccgtctgccagcccctgcactacgccacaataatccatcctcggctgtgctggcaactggcctcagtggcgtgggtgatcggactggtagaaagcgtcgtgcagacccccagcacactgcaccttcccttttgtcctgacaggcaggtcgacgacttcgtgtgcgaggtgcccgcacttatacggctcagctgtgaagacacaagctacaacgagattcaggtcgccgtcgcctccgtgtttatcctggtagtgcctctgagcctgatcctcgtcagctacggggcgatcacctgggccgtacttaggattaatagcgccaagggtagacggaaagcattcggcacttgtagttcacacttaaccgtggtcacattattctacagctccgttattgcagtgtatctgcaaccaaagaacccctacgcccaggaaaggggcaagttcttcggccttttttacgctgtgggcaccccatcactgaacccactcatctataccctgaggaacaaggaggtgacccgggctttcagacgactgttgggaaaagaaatgggactgacccaatcatag

SEQ ID NO: 31741 - DNA, 939 bp, Artificial Sequence
  Description of Artificial Sequence: Synthetic coding sequence
atggtcaatcaatctagcacccctggttttctcttactgggcttcagtgaacaccctggactagagcggacgcttttcgttgtggtgtttacatcctatctactgactctggtcgggaacactctgataatcttgctttccgcactcgaccccaagttacactctccaatgtacttcttcctctccaacctaagcttcctggatctttgtttcacaacgtcctgcgttcctcagatgctggttaatctgtgggggccaaagaaaactatttcctttcttgattgttctgtccaaattttcatctttctcagcctcggaacaaccgagtgtatcctgttgacagtcatggcttttgaccgatacgtagcagtttgtcagcctctccattacgctaccattattcacccccggttgtgctggcaactcgcttcggtggcatgggtcatcggtcttgtggaaagcgtagtccagactccttctaccttacacctacctttttgtccggaccgccaggtagatgatttcgtgtgcgaagttcccgcactgatacgcctttcttgtgaagatacgtcttacaatgagatccaggtggctgttgccagcgtcttcattctggtggtgcccttgtcactgattttggtgagctacggcgccattacttgggcggtactgaggattaactccgccaagggaaggcgcaaagcatttgggacttgcagctcccacctaactgtggtcaccctgttttactcatccgtgatcgctgtttacctccagccaaaaaacccatacgcgcaagagagaggaaaattctttggcctgttctatgccgtgggaacaccaagcttgaatcctttgatctatactcttcgaaataaggaagtcacccgtgcttttcggagactactcggaaaggagatggggctgacgcagtcttag

SEQ ID NO: 31742 - DNA, 939 bp, Artificial Sequence
  Description of Artificial Sequence: Synthetic coding sequence
atggttaaccaaagctctactcccggattcctgttgcttggattttcagaacaccctgggctggaaaggacgctctttgtagttgtatttacctcctatctgctgactcttgtcggtaacacacttatcattttattaagtgtgctggacccgaagctgcactcacccatgtactttttcttatccaatctgtcctttctggacctttgtttcacgacaagctgtgtgccacagatgttagtgaatctatggggaccaaaaaagacaatctcctttttggattgttctgttcagatctttatctttctatctttggggaccacagagtgtattctgcttaccgttatggcattcgaccgctacgtggcagtgtgccagcccctacattatgccactataattcacccacgtctctgctggcagctggcttctgtcgcttgggtgattggcctggttgaatcagtggtgcaaacaccatccacgttgcacctccccttctgtccagatcgccaggttgacgattttgtgtgtgaagtgcctgcactcatccgtctgagttgcgaagacaccagctataacgaaatacaggtggccgtggcctcggtgtttatactggtagtacctttgtctttgatcctcgtttcatacggagcgatcacatgggccgtgctgcggataaattctgcgaagggacggagaaaagcctttggcacatgcagttctcacctcacagtagtgaccttgttttacagttctgttatcgccgtgtacttgcaacccaagaacccctatgcccaagaaagggggaaattttttggtctcttctacgccgttggaactcctagcctgaaccctttaatttatacactacggaataaggaagttacgcgcgcttttaggagattactggggaaggaaatggggctgacacagagttag

SEQ ID NO: 31743 - DNA, 939 bp, Artificial Sequence
  Description of Artificial Sequence: Synthetic coding sequence
atggtgaatcagtccagcaccccaggctttttactcttgggcttcagcgaacatccagggcttgaaagaaccctgtttgtggtcgtgtttacgtcctatctgcttacactggtcggcaacacccttatcattttgctgtctgtgctggatcctaaacttcattcgcccatgtatttttttctgtcaaacctgagcttccttgatctgtgctttactaccagctgcgttcctcagatgcttgtgaatctgtggggacccaagaaaaccatctcctttctggactgctccgtacagattttcattttcctcagcttaggaaccactgaatgcattctgctgacagtgatggcctttgacaggtatgtggccgtgtgccaacctctgcattatgctacaatcatccatcctagactctgctggcagctcgcctctgtggcctgggtaatcggtctggtagaatccgtggtgcagactccatccacactccacttgcctttttgccctgacaggcaggtggatgacttcgtgtgcgaggtccctgcgttgatacgtctctcttgtgaagataccagctataatgaaattcaggtcgccgtcgcaagtgtgtttatccttgtggtccccctaagtctgatacttgtgagttatggcgccatcacatgggctgttcttcgtattaacagcgcaaagggccggcgaaaagccttcggtacgtgctcttcgcacctaactgtggtaactctgttctactcatccgtaattgccgtatacttacagcctaagaacccctacgcccaggaaagaggcaagttcttcggcctgttttatgcagtgggcactccttcactcaacccgctaatctacactctcaggaacaaggaggtgacgcgtgcattccgccgattattggggaaggagatgggtctgacccagtcatag

SEQ ID NO: 31744 - DNA, 939 bp, Artificial Sequence
  Description of Artificial Sequence: Synthetic coding sequence
atgttaatgaagaagaacgcctcttttgaggacttcttcatcctcctcggcttttcaaactggccccacctcgaagtggtgctcttcgtggtaatattgatcttttatctgatcactctcatcgggaatctgttcatcatcatcctctcttatcttgatagccacctgcatacccctatgtactttttcttatcgaatctgtctttcctggacctttgttatactacgagcagcatcccccagctacttgtcaatctgtgggggccggaaaaaacgataagctatgccggctgcacggtacagctttatttcgtgctggcgttgggaaccgctgagtgtgttctgctggttgtcatgagttacgacaggtacgctgccgtctgccgccctctgcactatacggtgctgatgcaccccagattttgtcgcttgctggccgcagcgtcttgggtgtcgggatttaccacctcggcactgcactccagctttactttttggatacctttgtgccgccacagattagtggaccatttcttttgcgaggtacccgcacttttacgcctctcatgtgtggatacccaggctaatgaacttacactgatggtcatgagttcaattttcgttcttatcccactgatcctcatcctgacttcttacggcgccatagcaagagctgtgctaagcatgcagagtacaaccggcctgcagaaggtcctacgcacttgtggagcccaccttatggtggtatctcttttctttatcccggttatgtgtatgtacctgcagcctccctccgagaatagccaggaccaggggaagttcattgcgttgttctacaccgtggttacaccctcactgaatcctttgatctacaccttccgaaacaaagacgtacgaggcgcagtcaaaaggctgatgggatgggaatgggggatgtag

SEQ ID NO: 31745 - DNA, 939 bp, Artificial Sequence
  Description of Artificial Sequence: Synthetic coding sequence
atgatgatcaagaaaaatgcctcttctgaggacttcttcattctcctgggtttctcaaactggcctcagcttgaagtagttttgttcgtagtcatcttaattttttacctaatgacgttgaccgggaatctgtttatcatcattctgagttatgtcgatagccacttgcataccccgatgtatttcttcctgagcaacctgagctttctggacctttgctatactacgagttcaatcccccagcttctcgtaaacctgaggggccctgagaagaccatcagttacgctgggtgtatggttcagctgtactttgtacttgcgctcggaatcgcagaatgtgtactgttggtcgtcatgagttatgataggtacgtggccgtgtgcagacctttgcactatactgtgctcatgcatcctcgattctgccatttgctggtcgccgcctcatgggtgataggctttacgatcagtgctctgcactcctcttttactttttgggttcctctgtgcggacaccgattggtggaccacttcttctgcgaagtccccgcactcctgaggctgtcttgcgtcgacacacatgcaaatgagctgacgctcatggtgatgtcctcgatcttcgtgctgatccccctgattctaattctaactacctacggcgctatcgccagggccgtgctgagcatgcaaagtaccaccgggcttcagaaagtgttccggacgtgtggggcgcacctcatggtagtttctctgttcttcattccagttatgtgcatgtatctgcagccccctagcgaaaacagtcctgatcaaggcaaatttatagctctgttttacacggtggtcacacccagtttgaatcctctgatctacacccttagaaacaagcatgtaaagggagccgcaaaacgactgctggggtgggaatgggggaaatag

SEQ ID NO: 31746 - DNA, 939 bp, Artificial Sequence
  Description of Artificial Sequence: Synthetic coding sequence
atgatgataaagaaaaacgcaagtagcgaggatttctttatcctgctgggatttagtaactggccgcagctagaagttgtgctatttgtggtgatattgatattttatttgatgacattaacaggaaatctgttcatcatcatcttgagctatgtagacagccatttgcatacacctatgtacttttttctctcgaatctgagcttcctcgatctctgttataccaccagctccattccacagctgctggtgaaccttcgagggcctgaaaagaccatttcatacgctggatgtatggtgcagctgtatttcgtcttggctctgggcatcacagaatgtgtcctccttgttgtcatgagttacgacagatacgtcgcagtttgtcgaccgcttcattatacagtgttgatgcacccacgattttgccacctgctggtagccgcatcatgggtgatagggtttactatctccgccctgcactcttcatttacattctgggttcccctctgtgggcatcggctggtagatcactttttttgtgaggtgcctgctttactccgcctttcttgtgtcgatacacacgctaatgagttgactctgatggtaatgtccagcatctttgtcctcattcccctgatcctcattctgacaacttacggagccattgcccgagccgtcttgtctatgcagtccacaaccggcctgcagaaagtatttaggacatgcggggcccatttaatggttgtctctctgtttttcattcccgtgatgtgtatgtatcttcagccgccaagtgaaaattccccagaccaagggaaatttattgcactgttttatacagtcgtcacacccagtctcaatccccttatttacaccctgcgcaataaacacgttaagggggcagcaaagcggctcctcggatgggagtggggtaagtag

SEQ ID NO: 31747 - DNA, 939 bp, Artificial Sequence
  Description of Artificial Sequence: Synthetic coding sequence
atgatgatcaagaagaatgcgtcttctgaggatttttttattctactcggatttagcaattggcctcagctcgaggtggtcctcttcgtggtgatcttgatcttttatctgatgaccttgactggcaatctgttcattattattctgtcctacgtagattcccatcttcatacaccaatgtactttttcttgtctaatttatccttcctagatctttgttatactacctcaagcatccctcagctactggtgaatttaagaggccctgagaagactatctcctacgccggctgtatggtgcagttgtattttgtgctggcactgggcatagcagaatgcgtcctgctggtcgtcatgagttatgatcgatacgtagcagtatgtaggcctctccactatacagttcttatgcatccccgattttgtcacctcctcgtggccgcctcttgggttatcggtttcactatttcagccctccacagcagtttcaccttttgggttcctctctgcggacacagactggtcgatcactttttctgtgaggtcccagccctgctgaggctcagctgtgtggacactcatgctaacgaactgacattaatggtaatgagcagtatctttgtgctcatccctctgattttaatcttgaccacctacggcgctattgctcgggccgtgcttagcatgcagagcactaccggtctccagaaagtgttccggacctgcggagcgcatctgatggtagtgtccctgtttttcattccagttatgtgtatgtatctgcagccaccatccgagaatagcccagaccaggggaagttcattgcgctgttttatacagtcgttacgccctccctgaacccattaatttacacgctgcgaaacaagcacgttaaaggtgccgccaagcggctactgggttgggagtggggaaaatag

SEQ ID NO: 31748 - DNA, 936 bp, Artificial Sequence
  Description of Artificial Sequence: Synthetic coding sequence
atgaatgatgatgggaaagtgaacgcctcgtcagaaggctatttcatccttgtgggtttcagtaactggccccaccttgaggtagtcattttcgtagtggtgctgatcttctatcttatgacattgattggcaacctatttattattatcctcagctatctcgactcacatctgcacactcccatgtattttttcctgtcaaatcttagctttctggatctgtgctataccacaagcagcattccccaactgctggtgaatctgtggggcccggaaaaaaccatttcttacgcagggtgcatgatacagctctactttgttcttgcccttggcaccacagagtgcgtcctgctcgtggtgatgtcatatgaccgctacgctgccgtctgccggcctctgcactacaccgtcttaatgcatccacgtttctgtcatctgctcgccgtggcctcctgggtgtcaggctttacaaattcggctctgcacagcagtttcacgttttgggtgccactctgcgggcaccgccaagtagatcacttcttttgcgaagtgcccgccctgctgagactgtcctgcgttgatacgcacgtaaatgaacttactctgatgatcacctctagcatcttcgtactcatccccctgatcctgatcctgacttcatacggcgcaatcgtccgcgcgatccttaggatgcagtccacaaccgggctgcagaaagtctttggcacatgtggcgcccacttgatggcggtgagtttgttctttattcctgccatgtgcatgtatctgcagccaccttcaggaaattctcaggatcagggtaagtttattgccctcttttataccgtcgtgacgccctcccttaaccctcttatttatacactgcgtaacaaggtggttcgcggagcagtgaagcgactgatgggttgggaatag

SEQ ID NO: 31749 - DNA, 939 bp, Artificial Sequence
  Description of Artificial Sequence: Synthetic coding sequence
atggaaaacggctcctacacctcctatttcattctgcttggtttgtttaaccatacacgggcacatcaggttctcttcatgatggtgttaagcatcgtgctcaccagtctgtttggtaactccctgatgatattactaattcattgggatcatagattgcacacacctatgtacttcctcctgagccagctttctctcatggatgttatgctagtgtctacaactgtgccaaaaatggctgccgactatctgactgggtctaaagctattagtagagccgggtgcggggcccaaatcttttttctgcctaccctaggtgggggtgagtgttttttgcttgccgctatggcgtacgatcggtatgccgccgtgtgccatccgctgaggtacccaactcttatgtcctggcagctgtgcctgcgcatgaatttgtcctgctggctcctgggcgcagcagatgggctactgcaggccgtagcaacactctcctttccatattgtggagctcacgaaattgatcatttcttctgcgagacacctgttcttgttcgactggcctgcgcagacactagcgtgtttgaaaatgccatgtacatatgctgtgtgttgatgttactggtaccattctccctcatcctgagtagctatgggcttatcttggcggccgtgctccacatgagatcaactgaggcacgcaagaaagcgttcgcaacgtgtagtagccatgttgccgtggttgggctgttctacggagcggccattttcacttatatgaggccaaaatcccatcgtagcaccaaccacgacaaggttgtatccgctttttataccatgtttactcctctgctcaacccattgatctacagcgtgaaaaacagtgaagtgaaaggagcgttgacaaggtgtatgggccggtgcgtagcactgagccgcgaatag

SEQ ID NO: 31750 - DNA, 930 bp, Artificial Sequence
  Description of Artificial Sequence: Synthetic coding sequence
atggagaatagtactgaagtgactgagttcattctcctaggcctgaccgatgatccaaacctccagattcccctgctcctagctttccttttcatttatctcattactctgctcggcaacggcgggatgatggtgattatacactccgactcccacctacacaccccaatgtattttttcctctccaacctctcactagtggatcttggctactcttctgccgtagcgcccaagaccgtggcagcactgaggtcaggtgataaggcaatctcctacgacgggtgtgccgcccagttcttctttttcgttggctttgcaacagtggaatgttacctgctggcttccatggcatacgatcgacatgctgctgtgtgcaggcccctgcactacacgacgactatgacagcaggagtctgcgccctcttagccacaggtagttatgtgtccggatttctcaacgcgagcatccatgccgcgggcacctttagactctcattctgtggctctaacgaaattaatcattttttctgcgacatcccaccactgctcgctctgtcttgtagcgacactcggatttcgaagctggtggtgttcgtcgcgggcttcaatgtgttcttcacgttacttgtgattctgatatcatatttcttcatctgtattacaattcaacgcatgcatagtgcagaaggccagaaaaaggttttttctacttgtgcctcacatctcaccgctctcagtatcttttacggcaccattattttcatgtatttacagcctaactcatctcagtctgtggacactgataaaatcgccagcgtgttttacaccgtggtgatcccaatgcttaatccgctaatctactctttgagaaacaaagaagttaagtctgcgttatggaaaatcctaaacaagctttatcctcagtactag

SEQ ID NO: 31751 - DNA, 942 bp, Artificial Sequence
  Description of Artificial Sequence: Synthetic coding sequence
atggaggaggagaacgcaacccttctcactgaattcgtgctgactggcttcctgtatcagccgcagtggaagatccctctctttttggcctttcttgtaatctacctgataactattatgggtaacctgggccttatcgctgtgatctggaaagatccgcatttgcacatcccgatgtatttgctgttaggcaatcttgctttcgtggacgcttggatctcttcaacagtgacacctaaaatgctgaacaacttcttggcgaaatctaaaatgataagcttgtcagaatgcaagatccagttttttagcttcgcgatcagtgttacaaccgagtgctttctgctagctaccatggcttatgaccggtatgtcgcgatctgcaagccactcctttacccagctatcatgacaaacgggctatgcattaggctactgattttgagctatgtgggcggcattttacacgcactgattcacgagggattcctgtttcgcctcactttttgcaactcaaacattgtccaccatatttactgtgataccatcccactttctaaaattagctgcaccgactcgtcgattaactttctgatggtcttcatttttagcggctctatacaagttttttcgatcgtcactatcttggtcagctacacgtttgtacttttcgccatcctcaaaaagaaatccgacaaaggtgttagaaaagcttttagtacatgcggcgctcatctcttttcagtgagcctgtattatgggcccttgctgttcatttatgttggccccgccagtccgcaggccgacgaccaagatatggttgaaccactattctacacagtcataatccctttgctaaatccaatcatctatagccttcggaacaagcaggtgactgtatcattcactaaaatgctcaaaaagcacgtgaaggtgtcatattag

SEQ ID NO: 31752 - DNA, 942 bp, Artificial Sequence
  Description of Artificial Sequence: Synthetic coding sequence
atggaggaggagaacgccacactgctgaccgaatttgtcctgacagggtttctctaccagccacagtggaagattccactctttctagcattcctggtgatttatttgatcacaattatggggaaccttggcttgatcgccgtcatatggaaagatcctcatttgcacataccgatgtaccttctcctcggaaacctggcgtttgtggacgcctggattagctcaacagtgacgccaaagatgctcaacaactttctcgccaagagtaagatgatctcgctgagcgagtgtaaaattcaatttttctccatcgccatcggagtgactacagagtgttttttgcttgctacaatggcgtacgatcgttacgtggctatatgcaagccgctgttgtacccggccatcatgacgaatggactgtgcatcagactgctgatcctgtcttatatcgcagggattctccacgccctcattcacgaggggtttctctttcggctgacattttgcaacagcaatatcgtgcaccatatctactgcgatacgatccctctgtcaaagatatcatgcaccgacagcagcatcaatttcttgatggtgttcatattcagtggctccatccaggtgttttcaattgttaccattttaatctcctataccttcgtgctgttcacagtcctggaaaagaagagcgataaaggcgtgcgcaaggccttctctacctgtggagcccaccttttttcggtctgtctgtactacggcccactgctactgatgtatgtggggccagccagtcctcaggccgatgggcagaatatggtggaaccactgttctatacagtgattattcccctgctcaaccctatcatctatagccttaggaacaaacaggtgatcgtctctttcattaaaatgctcaagcgaaatgtcaaagtgtcctattag

SEQ ID NO: 31753 - DNA, 933 bp, Artificial Sequence
  Description of Artificial Sequence: Synthetic coding sequence
atggaggaagagaacgccacacttctgactgaattcgtactgacaggctttctgtatcagcctcaatggaaaattcctttgtttctcgcctttcttgtcatatacctcatcaccataatgggaaacctcgggctgatcgccgttatctggaaagatccccacctgcacattcccatgtacctgcttctcggcaaccttgccttcgtggacgcatggatatcttctacagtcaccccaaagatgctcaataactttctagctaaatccaaaatgatttctttatccgagtgtaaaatacagtttttctctattgcaatcggggtgaccaccgagtgtttcctgctggccaccatggcctacgacaggtacgtggccatctgcaaacccttgctgtatccggccatcatgactaacggcctgtgcattaggctgctaattttgtcttatattgccgggatcctccatgctttaattcacgaaggttttctttttcggctgactttctgcaactccaacatcgtgcaccacatatattgtgacaccattccgctctccaaaatcagctgcactgattcctccattaacttcctgatggttttcatcttttcaggcagcatccaagtattttccatcgtgacaatactaatctcatacaccttcgtcttgtttaccgtgctggagaagaaaagcgataagggcgtgcggaaagccttctcaacttgtggggcccatcttttcagcgtttgcctctactacggaccactcctgctgatgtacgttggcccagcatctccgcaagctgatgggcagaatatggtcgagcccctgttttatacagtgatcatccccttgttgaatcctattatctactccttgaggaacaaacaagtgatcgtgtccttcattaagatgttaaagaggaatggaatttag

SEQ ID NO: 31754 - DNA, 966 bp, Artificial Sequence
  Description of Artificial Sequence: Synthetic coding sequence
atgaacaaagagaaccactcactgatcgccgaatttatcctgaccggatttacttatcatcccaaactcaagacagtgctgtttgttgtgttctttgccatatacctgattaccatggtcggtaacattggtctcgttgccttaatctatattgagcagcggctgcacaccccaatgtacatttttctcggcaacctagtccttatggacagctgttgtagctctgccattactcctaagatgctggagaattttttttcagaagacaagcggataacactttacgagtgcatggcacaattctacttcctgtgcctggcggagacaaccgattgctttttgcttgctgccatggcctacgattgctacgttgccatctgtaatcccctgcagtatcatactatgatgtcaaaaactctttgcatccagatgaccgctggggcctacctcgctgggaacctgcatcccatgattgaagtcgagtttctgctccgactgaccttctgtgggtcccatcagattaatcatttcttttgcgatgtgctgcctctgtaccgactcagctgcatcaatccttacattaatgagctcgtcctcttcatcctggctggatcaatccagattttcactatagttttagtcagttacttctacatcctgttcaccatcttcacaatgaagtctaaggaaggcagggggaaagcgctatccacatgtgcatcacactttctgagcgtatccatcttttgcgactccctgttattcatgtacgcacggccaggcgccgtgaacgaaggagacaaggacatccctgttgctatattctataccctggtcataccgcttttgaaccctttcatctacagcctgcgtaataaagaggttattaacattatgaagaagattatgaaaaagcgcaaattctgccatattctcaagcaaatgagcagtcctctggccacatag

SEQ ID NO: 31755 - DNA, 966 bp, Artificial Sequence
  Description of Artificial Sequence: Synthetic coding sequence
atggtaaacctaacatcgatgagcggattcctccttatgggcttttcagacgagcgcaagctacagatccttcacgctctggtcttcttggtcacctatctgctggcactcacagggaatctcctcattattaccattatcaccgtcgaccgtagacttcactcacctatgtactatttcctgaaacacctgagtctgctagatctgtgtttcatcagtgttacagtacctcaaagcattgctaattccctgatgggcaatggctatataagcctcgtgcaatgtatattgcaagtcttttttttcatcgctctggctagctcagaagttgccattctcacagtgatgtcctacgataggtacgcggccatctgccagcccttgcattacgagaccattatggacccccgggcttgtagacacgcagtcattgctgtttggattgcgggggggctctccggcttaatgcacgccgccatcaatttttctatacctctctgcggtaaacgtgttatccaccaatttttctgcgatgtgccccaaatgctgaaattggcctgtagttacgaattcattaacgagatagccctcgccgcattcaccacctccgcagccttcatctgcttgatctctatcgtactcagctatatacgcatcttcagcaccgtactccgcatcccttctgctgaggggaggacaaaagttttttcaacgtgtctgccacacctgtttgtggccaccttctttctcagcgcagccggcttcgagtttctgaggctgccgagtgacagcagtagcacagtcgatctggtgttctcagtgttctacacagtgatccctcctacactaaacccggtgatctacagtctgcgaaacgattcaatgaaagcagctctacgcaagatgctctcgaaggaggagctcccccaacgcaaaatgtgtctgaaagccatgttcaagttatag

SEQ ID NO: 31756 - DNA, 966 bp, Artificial Sequence
  Description of Artificial Sequence: Synthetic coding sequence
atggagcgcaaaaaccaaacggcaattacagagttcataattctcggctttagtaatctgaatgagtggcaattcttactgtttaccatctttttcctcacctatttctgtacgctgggcggcaacattttaataatcttaacgacggttaccgaccctcatctgcatactccaatgtactattttcttggaaacctcgcctttattgacatttgttacactacttccaacgttccacagatgatggtccatctgctcagcaaaaaaaagtccatcagctatgtgggctgcgtggttcagctcttcgcttttgtttttttcgtcggcagtgagtgcctcctgctggcggccatggcgtacgaccgttatattgctatctgcaatccactgcggtattcagtgatcctcagcaaagtcttgtgcaatcaactggcagccagttgctgggcagccggtttccttaatagtgtggttcatacggtactgactttctgtctccccttctgtggcaataatcagataaattacttcttttgtgacattcccccattgctcattctgtcttgcggaaatactagcgtgaatgagctggccctgctgagtaccggagtgttcattggctggacaccgttcctgtgtatcgtgctctcttacatctgcataatctccactattctgagaattcagagctcagagggacgccggaaggctttctccacatgcgcctcccacttagcaatcgtctttttgttctatggctccgctatctttacatacgtgcgcccaatctcaacatattccctcaaaaaggatcgcttggtcagcgtactgtacagtgtggtcacccccatgctcaacccaattatctatactcttaggaacaaggatatcaaagaggctgtgaagactatagggtctaagtggcagccccccatctcctcgctggattcgaaattgacctactag

SEQ ID NO: 31757 - DNA, 966 bp, Artificial Sequence
  Description of Artificial Sequence: Synthetic coding sequence
atggaacgaaaaaaccaaaccgctatcaccgagtttattatcctgggcttctcaaatctcaacgagctgcagttcctactgttcaccatctttttcctgacctatttctgtacactgggggggaacatcctcatgattctgactaccgtgaccgaccctcacttacacaccccaatgtattacttcctcggcaacctggcttttattgacatatgttacacaaccagcaacgtgccccagatgatggtacacctgctgagtaagaagaagtccattagctatgtgggctgcgtggtccaactgttcgccttcgtgttttttgtgggcagcgaatgcctgctgttggccgctatggcgtatgacagatatattgctatctgcaacccgctacgatacagcgtcatcctttcaaaagttctctgtaaccaactcgccgcctcctgttgggccgccggattcctcaattctgtggtgcacaccgtgctgaccttctgtttaccattctgtggtaacaatcagatcaactactttttctgcgatatcccccccctcctgatcctgtcttgcggaaacacatcagttaatgagcttgccctactgtctactggcgtatttatcggctggaccccattcctgtgcatcgtgctgtcctacatctgtataatctcaactattctccggattcagtcgtccgagggccgccgtaaggcgttttctacttgtgcgtctcacttggctatcgtcttcctgttttacggctccgcaatctttacgtacgtgagacctatcagcacatattctcttaagaaggatagattggtcagcgtgctgtacagtgtggtaacccccatgctgaatccaattatttatactttgaggaataaggatataaaagaggctgttaaaactattggctctaagtggcaaccacctatcagctctctggattctaaactgacgtattag

SEQ ID NO: 31758 - DNA, 966 bp, Artificial Sequence
  Description of Artificial Sequence: Synthetic coding sequence
atggaacggaagaatcagacagctattaccgagttcattattctgggctttagcaatctgaacgagcttcagtttctcttgttcaccattttcttcctcacctacttttgcaccctgggtggtaatattctgatgatcctcacaactgtcacagatcctcatctgcacactcctatgtactacttcttggggaacctggcctttatcgacatctgttacactacgtcgaatgtgccgcagatgatggttcacctgctttccaaaaagaagtccatctcttatgttgggtgcgtggtccaactgttcgcatttgtatttttcgtggggtccgagtgcctcttgctggctgccatggcgtacgaccgctacatagccatctgcaatcccctccggtactctgttattctgagtaaagtgctgtgtaatcaattggccgcttcttgttgggctgccggctttttgaactctgtagttcatactgtcctcacattttgtctcccattctgcggaaacaaccagatcaattactttttctgcgatattccccctctcctgatcctgtcttgcggtaataccagcgtcaacgaactggctctgctgtccacaggggtttttatcggctggaccccattcctctgtattgttctctcctacatctgtatcatcagcacaatcctgcgaattcagtcttccgaaggtcggcgcaaagctttttccacatgtgcatcacatctggcgattgtctttcttttttatggatccgccatattcacctatgtgcggcctatctctacatacagtctgaaaaaagatcgcctggtgtcggttttgtacagtgtcgtaacacctatgctaaatccaattatctacaccctgaggaacaaagatatcaaggaggccgtcaaaactatcggctcaaaatggcaaccaccgatttcatctctcgatagtaaactgacatactag

SEQ ID NO: 31759 - DNA, 966 bp, Artificial Sequence
  Description of Artificial Sequence: Synthetic coding sequence
atggaacgcaagaaccaaactgcaattacagaattcatcatccttggtttctcaaacttaaatgagctgcaatttttactgttcaccattttctttctaacttacttctgtaccttgggaggcaacattctgatgatactgacaaccgtgacagaccctcatctgcacaccccgatgtattacttccttggcaatcttgcctttatagacatatgttacacaacatctaatgtgccccagatgatggtccacttgctctctaagaagaaatcaatctcctatgttggctgcgttgtgcaactgttcgcatttgtgtttttcgtaggatctgaatgtctccttctggctgctatggcttatgatcgatatatagccatttgcaaccccctccggtactccgtaattctctccaaagttctttgcaatcagcttgcggctagctgctgggcagccggtttcctgaactctgttgttcatacagtactgaccttttgtcttcccttctgtggtaataatcaaattaactactttttctgtgatatcccaccgctactgattctctcatgtgggaacacaagcgtgaacgaattggccctgctgtctactggtgtgttcatcggatggaccccgttcctctgtattgtgctatcctatatctgcataatcagcaccatcctgagaattcagtcatctgaaggccgccgcaaagcgttcagtacctgcgcttcacacttagcgattgtgttcttgttttacgggtcagccatcttcacatatgtccgccccatctcaacctattctctaaaaaaggaccgtttggtctcagtgctctactctgtggtaacacccatgctgaaccccattatttataccctcaggaataaagatattaaggaagccgtaaagactatcggttcaaagtggcaaccacccattagctcgcttgatagcaagctgacatattag

SEQ ID NO: 31760 - DNA, 939 bp, Artificial Sequence
  Description of Artificial Sequence: Synthetic coding sequence
atggagattctctcgaatagtacatctaagttccccactttcttgctaacggggatcccaggccttgagtctgctcacgtgtggattagcatacctttttgttgtttctatgccatcgccctctccggcaactccgtgattctctttgttattattactcaacagagcttgcacgagcctatgtactacttcttgttccggctcagcgcaactgatctaggtctcaccgtatcgagcctttctaccaccctcggtatactgtggtttgaggctcgggagatcagtctctattcttgtatagtgcagatgttcttcctccacgggttcacattcatggagtctggggtcctggtcgccactgcttttgacaggtatgtcgccatctgcgatcctttacggtataccactattttgactaattcccggatcatccaaatggggctcttaatgatcacacgcgccatcgttctaattctccccctcttgttgttattaaagcccctgtatttttgccgaatgaatgccttgtcacacagctactgctaccacccagacgtgattcagctggcatgctccgacataagggccaatagcatttgtggacttatcgatttgattttgacaaccgggattgacacaccatgcatcgtgctgagctacattctgattatccactcagtcctcagaatcgcatcaccagaggagtggcataaagtcttcagcacatgtgtgtctcatgttggggccgtggctttcttttatattcacatgctctctttaagcttggtgtatcgctatggcaggagcgcccccagggtcgtacacagcgttatggcgaacgtgtaccttttacttccacccgttctgaaccccatcatagattccgtaaaaacaaagcagattcgaaaggccatgctgtcattgttactgaccaaatag

SEQ ID NO: 31761 - DNA, 960 bp, Artificial Sequence
  Description of Artificial Sequence: Synthetic coding sequence
atgcttcagaaccaagacaccatggaaattctcagtaattccacgagtaagtttccaacctttttactgacaggtatcccgggcttggagtctgcacatgtctggattagcattccattctgctgtttttatgccattgctctttctggcaactccgtcatcttgttcgtgatcataacacaacagagcctccacgaaccaatgtactattttctcttcaggttgtccgcgaccgacctgggcctgactgtgagtagcctgagcaccacactgggtattttgtggtttgaggcacgggaaattagtctctattcttgtatcgtgcaaatgttttttctccacggattcacatttatggaaagcggagtcctggtggcgaccgcatttgacaggtatgtcgcaatctgcgatccgctacgatatacaaccatcctgacaaacagtcggatcattcaaatggggttgctcatgatcacccgagctatagtgctgatcctccccctgttgctgctgctaaaacctctctatttctgtaggatgaatgccctgtctcattcgtattgctatcacccggacgtcatccagctagcctgtagcgacatccgggccaatagcatttgtggactcattgacctcatccttaccacagggatcgacactccctgcattgtgctatcatacattctaatcatacacagcgtactcagaattgcctcacctgaggagtggcataaagtttttagtacatgtgtgtctcacgtgggcgctgtagccttcttctatattcacatgctgtccttatctctcgtgtaccggtacggacggtccgccccccgcgtggtgcactccgtaatggccaacgtttatctactccttccgcctgtgctgaatcctattatcgacagcgtcaaaacaaaacagattagaaaagccatgctgtccctgctcctcaccaagtag

SEQ ID NO: 31762 - DNA, 981 bp, Artificial Sequence
  Description of Artificial Sequence: Synthetic coding sequence
atgtctgtacaatattccctgagccctcagtttatgcttctgtcaaatataactcagttttctcctattttttacctgacgtccttccccggcctcgagggcatcaagcactggatcttcattcctttcttcttcatgtacatggtcgccatcagtggaaattgtttcattctcatcattattaaaaccaacccgcgattgcacacccccatgtactacctgcttagtctgctggcgctgacagatctgggcctgtgcgtgagcaccttgccaacaacgatggggatcttctggtttaactcccatagcatatacttcggcgcctgccagatccagatgttttgtatccactccttctctttcatggaaagctccgtgctgctgatgatgtctttcgatcggttagtggcaatttgtcatccgctgcggtactctgtgataataacaggccagcaagtagtaagggccggcctgatcgtcatcttccggggcccggtggctactatccccatcgttctactgctgaaagcgtttccctactgcggctcagtggtgctgagccactcgttttgtctgcaccaggaagtaatacagctggcatgtacagacattactttcaacaacttgtatggactcatggttgtcgttttcacagtcatgctggacctggtgctgattgccttgagttatgggctgattctgcacaccgtggccggtttggctagccaggaagaacagcgcagagcgtttcagacgtgtactgcccccctttgcgctgtgctggtgttcttcgtacccatgatggggcttagcctggtccatcgctttggaaaacacgcccccccagccatacatctactaatggcgaacgtgtacttgtttgtacctcctatgctcaatcccatcatatattccattaaaactaaagaaatccatcgggctattatcaagtttctcgggctgaaaaaggccagcaaatag

SEQ ID NO: 31763 - DNA, 945 bp, Artificial Sequence
  Description of Artificial Sequence: Synthetic coding sequence
atgaagaacaaatccatggagatcgagtttattctgctggggcttacagacgatccacaattgcaaattgtcatttttctgtttctgttcctcaactacactctatcactcatgggcaatctcatcatcattattctgaccctgttggacccccggctgaaaacacccatgtacttttttctacgcaacttttcttttctggaagtgatttttacgacggtctgcattcctaggttcctcattactatcgttactagggacaaaacaatctcttacaacaattgtgcgacccagctattctttatcttactgcccggggtgacagaattttatcttttggctgctatgtcatatgacagatacgtggctatctgcaagccgcttcactaccccattattatgtctagtaaagtgtgttaccagctggtgctgagctcatgggttactggcttcctcatcatctttccgccgctggtgatgggacttaagctcgacttttgcgcctctaaaacaatcgatcacttcatgtgtgagactagcccaattctacagatatcatgtaccgatacccacgtgctcgagctcatgagctttactttggcggtggtaactctggtagtgaccttggtactggtcattctgagttacacttgcataattaaaacgattttgaaattcagcagtgcgcagcagagaaataaggctttttccacatgcacctctcacatgattgtagtaagtatgacttatggcagctgcatttttatgtacattaagccatctgccaaagagcgggtcactgtttccaaaggggtggccctactctacacgtccattgctcctcttctcaatccttttatctacacgctgcgaaaccagcaagtgaaggaggtgttctgggatgtcctgcaaaaaaatttatgcttctcaaagcggccattttag

SEQ ID NO: 31764 - DNA, 939 bp, Artificial Sequence
  Description of Artificial Sequence: Synthetic coding sequence
atgaaaaaccgcacctccgtgactgatttcatactactcgggctgacagacaaccctcagctacaggtcgtgatattttcgtttctctttcttacgtacgtcttatctgtcactgggaatctcacgattatcagtctgaccctgcttgactcacacctcaagacacctatgtacttcttcctgaggaacttttccctggagatttcctttacatctgtgtgcaatccccggttcctcatctccatcctgaccggcgataagtccatctcatacaacgcctgtgccgctcagctcttctttttcatcttcctcggcagcaccgagtttttcctactggcctccatgtcttacgattgttacgtggccatctgcaaacctctccactacaccacgatcatgagcgatcgcatctgttaccaacttataatcagctcttggttggctgggtttctcgtcattttcccgcccctagcaatgggtctgcagctggatttttgtgacagtaatgtgattgaccactttacctgcgactccgcccccttgctgcagatcagttgcactgatactagtacactcgagctaatgtctttcattctagccttgttcactctgatctctacccttatcctggtgattctctcttacacttacattattcgcactatccttcgaatcccatctgcacagcagcggaagaaagccttcagcacatgctcatcgcatgttatagtggtgtccatctcgtacggcagctgcatcttcatgtatgtcaaaacatccgccaaagaaggcgtagcactgaccaagggtgtcgccatcttgaacacatcggtagcccccatgctgaatccattcatctacacgctgcggaaccagcaagttaagcaagcattcaaagacgtgctgcggaagattagccacaaaaagaagaaacattag

SEQ ID NO: 31765 - DNA, 114 bp, Artificial Sequence
  Description of Artificial Sequence: Synthetic coding sequence
atgattaccgacgtccagttggccattttcgctaacatgctaggtgtgagtctgttcctgctcgtagtcctctaccactatgtcgctgtgaacaacccaaaaaagcaagagtag

SEQ ID NO: 31766 - DNA, 330 bp, Artificial Sequence
  Description of Artificial Sequence: Synthetic coding sequence
atgagcattaccgacgtcctctcagccgatgacatcgccgcagccctccaggaatgtcaggaccctgacacgtttgaacctcagaagttttttcagactagcgggctgtccaagatgtcagcctcccaagtgaaagacgtgttcagattcatagacaatgaccaaagcggctatttggatgaggaggagcttaagtttttcctgcaaaaatttgaaagtggggcccgcgagttaaccgagtctgagacgaaaagcctgatggccgctgctgataacgatggggacggaaaaattggcgcagaagagttccaggagatggtgcatagctag

SEQ ID NO: 31767 - DNA, 372 bp, Artificial Sequence
  Description of Artificial Sequence: Synthetic coding sequence
atgaaaaccatacttggatttaagggactcttttacctgcatagtctcatttggacgtgtgcaggcgactggagtgcaatccaggtgcattgtacgcagttctggttcttcgcccgcattaaacctactatcttctacaacctatacgtgaatcccgatgaggtgttccttggggatggctgtcatgtaactcatgtgcttcctaatgtgtattatgaattcttctaccacccacatgactgcggcatcgtgacccaaccactgcaggaagtcttgctcctaaaaaccaaaattcgatacatctcgcgggacagtaccgtgagaagtgagatgccactgagctgcgtcgtacataagcagaaatgtcagtag

SEQ ID NO: 31768 - DNA, 1356 bp, Artificial Sequence
  Description of Artificial Sequence: Synthetic coding sequence
atggggaacctgttgggaggagtgagttttcgtgagccgaccactgttgaggactgcgatagcacctggcagactgatagcgagcctgagccggaagagcccgggcctggggggggatctgagggcccaggccaagaaagcgaacaacccgctcaaccacctgagcaggccggagggaggcctggtgcttcccccgccccagatgaggatgccgaggccgccggggcagagcaaggcggagacagtacagaggccacagctaagcctaagcgaagtttctatgccgcgcgagacctgtataagtaccgtcaccagtatcccaattttaaagacatccggtaccagaacgatttgtccaatctccgtttctacaagaataaaatccccttcaagccagacggtgtctatatcgaagaagttctgtccaagtggaagggagattacgagaagctggagcacaaccatacatacatccagtggctcttcccactgcgggagcagggtctgaatttctatgccaaggagctcactacatatgaaatcgaggaatttaaaaagaccaaggaagccatccggcggttcctgctggcatacaagatgatgttggaatttttcggaattaagttgaccgacaagacaggcaacgttgcccgagccgttaattggcaagaacgcttccagcacttaaatgagtcccagcacaattacctcagaataactcgtatcttaaagtcactgggcgagcttggctacgagagcttcaaaagccccctggttaaattcattctgcacgaggcactagttgaaaataccattcccaatatcaaacagagcgctcttgagtatttcgtatacaccatcagggatagaagagaacggcggaagctcctccgctttgcccagaagcactatacaccctccgagaacttcatctggggacctccccgcaaagaacagagcgagggttctaaggcccaaaaaatgagctcacctctcgcttcatcacataatagtcagacatcaatgcataagaaggccaaggattctaaaaactcaagttccgcggtccatctgaattctaagacagccgaggacaagaaggtcgcacctaaagagccggtggaagagacagatcggccatcccctgagccttccaacgaagcagccaaaccaaggaacacagagaaagacagtaatgccgagaacatgaattctcagccagaaaaaacggttacaacacccacagaaaagaaggagtccgtgagcccggagaataacgaagaggggggcaacgataatcaggataatgagaatcccgggaacactaattgccatgacgtcgtcctggtgcagtag

SEQ ID NO: 31769 - DNA, 570 bp, Artificial Sequence
  Description of Artificial Sequence: Synthetic coding sequence
atgataaacacccaggattcctcaatacttcctttaagcaactgtccacaacttcagtgctgcagacacattgtccctggtccactttggtgctctgatgctccccaccccctgagtaaaatcccgggtggtcggggggggggccgggaccccagtttgtctgccctcatttataaagatgagaagctcactgtgacacaggatctgccagtaaatgatggcaagccacatattgtgcactttcagtacgaagtgacagaggtcaaagtgagttcttgggatgcagtgctcagcagtcagagcctatttgtggaaattcccgatggcctgttagccgacggcagcaaagagggcctgctggccctgttggaattcgccgaagagaagatgaaagttaattacgtattcatctgcttccgcaaggggagagaggatagggccccactcttaaagactttctcattcctaggttttgagattgtgcgccccggccacccgtgcgtgccctctagacccgatgtcatgtttatggtgtaccccctggaccagaatctgagcgacgaggactag

SEQ ID NO: 31770 - DNA, 7035 bp, Artificial Sequence
  Description of Artificial Sequence: Synthetic coding sequence
atgattccttggtctattttcttactgcatgttctcctcttctccctgcaggagtacatttgcgcctccagcatactgatgggaacctcaaagaacgggttcaacgagaatagacagaaacgcgcactcctggcggcacagttcgaagccacatcccccagatacttcttccacgatgcaatcaattggggggaatcgaagattaaaggtagttgcccttacgagtgcctgaatggggcattttgcagcaagaccgggacatgtgattgtcaaatctttcaggcgctcggcacacgctgtcagataattcccaacatgggtaatggccgggacggcatctgtaagacctggggacagtaccattttgagacctttgatggcatctactactactttcctgggaactgtagttacatctttgctaaggattgcggggacctggaacccaggtatactgtgtgggtacacaactcgccaaagtgtcttggaagcgtgtactcatgttaccgctcgatcagcttgttctttagcaatcaggaagagatccgcatttacgggcatgagattaaaaagaacgggatcagcttgacgcttccccaaactattggtcagatatttattgagaagcttgcagactatattctggtcaagactacttttggcttctccctggcatgggatgggatctcgggaatatacctcaagctgtcagaggaccacaaaggcaagtcctgtgggctttgtggcaactataatgacattcagtccgatgacttcattatactgcaggaagattatactgaagatattgctatgttcgctaatagctggtctgtgcagaccccagatgatactaagtgcgtacttacacctagcgatttcccaaatccctgctccagcggcatgcccgcctttgaggcaatctttttcaagtgccagatactcctgcagtttccattcctgagctgtcacgagtatattgatccctatttgtatatcgcttcttgtgtgaatgatctctgtaaaaccgacgacgatgaaacttattgtcgcgcggccacggagtatgctcgggcgtgctctcacgctggttatccaatccaagattggagggatgacttccctgcctgtacagataaatgcgacgacagtttcgtgcacagggactgtattagttgctgtccaccaacctgtaccttcgagaagcagtgtctcggaagtaacctgcactgtctggacggatgttattgccccgacggcctcgtgatggataacggcacttgtatttccttggagaattgcccttgcggctttcatggactcgcgtatagcgttggatccaagattgaacaggagtgcacagagtgcgtctgcgtgggaggcgtgtggaactgtaccgaacaggactgccctgtccagtgctcggtagtcggagattctcattttacaacttttgacggcaggcattactcattcatcggaatgtgccagtatatcctggtaaagggaaccggaaaagacaagttcactattacactccagaaggcaccgtgcgagcagaaccttgggctggtatgcttgcagagtattacactcatccttgaggacgacttcaataagcaagtgacacttggacgcggcgggcagattctgacatctcccaatcagggttttaatttgaatggaatcgtggaaatccagaccctctcctccctatttatactcttgaaaacaactttcgggttaaagattctgttcgccatcgatggtgaacggatctacatccaattgacaagcgcatggaagagaaggacactcgggctctgtgggacttttaacgggaacatccgagacgatttcctgtctcctagcgggatgattgaaggcaccccccagttacacgccaatgcctggcgggtgagctcgacttgctttgcgccagtgcatgtccccgtggtcgatccatgtaacattaatcagcagaatatcggatatgccgcgcactgcgatgtcatccatcaagagctcttcgctccctgtcatatctacatcagccccgggctttactatcaattgtgtaggcacgatgcttgcaaatgcggctcctcttgtctgtgtaacgccctggcacactacgcctatctttgcggtcagcatggagtgcccatcgatttcagaactcaaatttctttctgtgccgtggtgtgtcagaaaggtatgctatatcatcattgctcaagtttctgtctgcattcttgcatcagcctgtcatctcctgaacagtgcagtgatgattgtgctgaaggctgtaactgtccggagggtaaattctacgaggacaccctcaacttttgcgttcccatttttcactgtagatgccactataggggctctgtttatcaacccggggagcttattcccactccatccgggctttgccagtgctcaaacggcactgttaagtgtgacgaactggcgacccccagcgctgtgcacatctgtcctgaagggaaggaatatttcgactgccgctttcctgatccggagctccccgccggtggtgtaaactgcgagactacgtgtgcaaacctcgcaatgaactttacatgcactccatcgtccccatgtataagtggctgcgtatgcgcccccgggatggcggaacacaggggcaaatgctacgtgcctgaatcgtgcccatgcatctggaaggattgggaatatctctccggcgaagtgattgccacaccatgctatacttgcgtctgccgccggggcatgttcaattgtacttactatccttgcccggctgtttgcacaatctacggagatagacactactatagctttgacggccttgagtatgactatataagcgattgccaggtgtttctgataaagtcggctgatgacagtgacatttccgtgatcgcccaaaataaaaagtgttttgataacgacatcgtttgttctaagagtgtattgatttctgtgggggatactgaaatttacctaaatgacacgccatacaagcagaagcagtccgggttcttcctggagaacaagtccacctaccagctttggaaggccggatattacatcgtggtgtacttcccggaaaaagacatcaccatcctgtgggacaggaagactaccatacatatcaaagtgggtccccagtggaagaacaagttgagtggtttgtgcggcaacttcgacaaatgcacatccaacgatatgaccacttcaaataacctagaggtgcggaatgctcgcgtgtttggggacagctgggcgttagggcaatgcgaatcgccagacgagactatcaagccatgcgaagcccatcagaataaattcccttatgccaagaaggagtgttcgatcctgtactccgatatttttgcaagctgtcgcaacgtaatcgacgtgacttcctttgccaagaattgtcacgaagatacatgtaactgtaacctcggaggggattgcgaatgtctctgtaccagcatcgccgcatacgcttacaaatgttgtcaagagggcatttcaattcactggcgctcgtccactgtgtgtagtttggactgcgagtattacaatgaggggctcggagagggcccatacatgctagcttcatacggtcagtccggcctggtgctcggtgccaacatgacatcccggtccgttttttgtttgcccaggagttccgtccataccagtctctttttttatttcatgataacaccaggactgttcaaggagaaggtatccagcctcgcactagttagccttgagtctgcggaacgacctaattactttctctacgtgcatgacaatgacaccctgtccttggaactttgggaggcaaatagcgcgtttcacaggcgagcgactttctttcatcaccagggactttggattcccggctattcggccttcgagctctatagcaaaaaggggttttttattatcttcactgactcatcagtgaaggcttctaagtatgacgactccgaggagtttaaacactcctccagcttttccatagaggagatacaggcagccgttccctaccgcaagatgtgtgaatggagatacgaaccctgcgcaaccccttgttttaaaacctgcagcgaccctgaggccctggcctgtaaatttctgcctcctgtggaaggctgcctgccctactgccccaaaaatatgattctggatgaggtcacgctgaaatgcgtgtatccacgggactgcatcccggtgatccctacggagccaactctcatgcccccagctaagccgacagtccctatgttcaccgtgtgggaaatgataaccccgtccgacataaccgtgttcgatatgctgacacctaccactggacttgagtgcgagccgcagaaattcgaccccgtgtacgactgctcccagtacatttgtctgaatatggagtggcagctctacaactggtctctgaattgtcctaaggatgttgaaatgcccgactgtgggttccgaggaagacccgttcaggtgaactctgatatctgctgtcccgaatgggaatgcccctgccgctgctcgatgctgagcgagctgtctatcattacttttgatgggaacaacgcagccctgtattctatggcaagctatatccttgtccgcatacctggagagattattgtggctcatatcgagaagtgctccatgaatcagaacggcaattcactgaaaaagctggccccgtccggtaggataagcggactgtgtttcaaaaagctcaacgtgaccacacccatacataagatcatcgtaaacagactggcgcggaaggtggaggtggattcaattgttgtacctcttccatttagctcccaggaactgtccatcgaggatagtggctcaatgtacgtaataaccacacccgcgggactcatcatcaaatggagccacctgaccggaattattgacatccacttcggtttcagattcaacctcagctcatacacagaggggttatgcggaatctgcaacgaggaccctgacgatgatctaagaatgcagaacggaacgattattactaacatggaagacatcggtctgttcatcgagtcctgggaaattgaaaagtccttcgaagtcaccatgcggaggccggtacgtaattgcaccgaacacgactgtagccagtgcatcgacctcctgaacagaaggatcttcattccctgtcacgacaaggtgtcccccgaggatttttgtgagaagatgtggattaattacacctatttctggaattatgagtgcgatgccttatcagcctacgtggctttgtgtaacaaatttgatatatgcatacagtggcgcactcctgactactgcagtctcagctgcccagaggggaaggagtaccagccctgcgtccggccatgtgaggcaagaacctgccttaatcaatggttttatggacataccagctgcttaaatcttcgagaagattgcgtgtgtaaagtggggactatcttgcatcggcctcacagtgctcaatgtattcccgaaaaggagtgcgcatgcacggatagcgaggaccagcctaggactgccggcgagatttggaatggagggattgacgaatgtactctctataaatgtctcgagaacggttccattatcccaatcgaaccggactgcgacgaggagcctactcccgtatgcgagcgcgaggccgaagtggtgatgggcatcatcgacaagtggacgtgttgttccaaagaagtgtgtgggtgtgacaccaccttgtgcgaaacatctatcccgacgtgcaccaatagtcagaagcttattgtggggcactcaccgctgtcatgttgcccacaatacaagtgtgagtgcgaccccttgaaatgcccaagcatcagcacacctgagtgcagggaggatcagttcatgattcaagtacgccaggaggaaccatgttgtttctctcctttttgcgtgtgcgagagctgcacaaaacctgtcccgctgtgccacgacggcgagtttctcactgttgacctcaatagtacccatttctgctgtccacagtattattgcgtctgcgagcccaacttgtgccccatgcccctgctcaattgtgccgaagacatgaacctggttaaggaaaatgtgagcgggcagtgctgccctacatggcactgtgagtgtaactgcgaaaacctcatcatgccgacctgcgaagttggggagtttacggcaattgaccacaacttccagtcggactgtggttgtatacagtacctgtgcgagaaggatgacgtgtgcgtcttccaggaggtcagtgtgctcaaccccggtcaatcaatgattaaatacttggaggaggatttttgttatgctatagagtgcctagaagaaaaggacaaccatacggggttccacacgttgaatttcactctggttaattgtagtaagaagtgtgatgtccatcaggtatatacacccagtcccagtgactatggttgttgtggaacctgtaagaatgtctcatgcaaatttcacatggaaaatggaacgtccgttgtatacgcagtgggcagtacctggcactacaactgcactacctacgagtgcgtcaagactgatgagggcgccattattctcaattacaccatggtatgtcctcctttcaatgagacagagtgtaaaatgaatgagggaatcgtcaaactctacaatgaaggttgctgcaaaatctgcaagagagaagaacgcatatgccaaaaggtcatcatcaaaagcgtgatccgcaagcaggactgcatgtctcaatcccccattaatgtcgccagttgcgatggaaagtgtccatcagcaacgatttataatatcaacatcgagagccacctgagattttgcaaatgctgcagggagaatggagtgaggaacctttcagtacctctctactgctcaggcaatgggaccgagattatgtacacactccaagagcctatcgactgtacgtgccagtggaactag

SEQ ID NO: 31771 - DNA, 1434 bp, Artificial Sequence
  Description of Artificial Sequence: Synthetic coding sequence
atgtggatgttttcgtggctctgcgccatattgatcatccttgcgatcgctgggatgaatacaattgccaagaccactccccacactaagtttacaaaaaaatcagaggaaagagagatgcccaaaggcctgaaacctagttccggtccacctcctgaggaggaagagacattgttcactgaaatggccgagatggctgagccaattacaaagccctctgccctggacagtgtgtttggcaccgctaccctttcccctttcgaaaacttcactctggaccccgctgatttttttctcaactgttgcgattgttgcagtcctgtgcccggacagaagggggagcccggagagactggtcagcctgggcccaaaggcgaagctgggaacctcggaatcccaggccccccaggcgtcgtgggtcctcagggtccccggggctataagggtgagaagggcctcaagggcgaacgtggagaccaaggcgtgcctggataccccggtaagccaggagcccaaggtgagcctggccctaagggcgacaaaggcaacatcggactgggtggcgtcaaggggcaaaagggatccaaaggagacacgtgtggaaactgtacaaaaggtgaaaaaggagaccaaggtgcaatgggtagccccgggttgcatggcggccctggcgctaaaggagagaaaggtgagatgggcgagaagggagagatgggtgacaaaggctgctgcggtgatagcggcgagcgaggcggtaagggccagaaaggggagggcgggatgaaaggggagaaaggaagcaagggggattcaggtatggaggggaagtccggacgcaatgggctcccaggcgccaaaggagatccaggcattaagggcgagaaaggggaactggggccgcctggtctgttgggaccgacaggcccgaagggagatatcggaaataagggagtcagaggaccaactggaaagaagggatctagggggttcaaagggtctaaaggcgaactggcaagagtccctcgttctgccttcagcgccggactttccaaaccgtttccgccgccaaatatccccataaaattcgagaaaatcctgtacaacgaccagggcaactacagcccagtgaccggcaaattcaactgcagcatacctggcacttatgtcttttcctaccacattacggtgcggggacggccggctcggatctccttggttgcacagaacaagaagcagtttaagagcagagagacactgtacggacaagaaattgaccaggcctccctgttggtcattctgaaactctccgctggagatcaggtgtggctggaggtatccaaggattggaacggcgtctacgtctcagctgaggatgactccattttcaccggctttctgttatatccagaagaaacctccggaatctcaccctag

SEQ ID NO: 31772 - DNA, 1716 bp, Artificial Sequence
  Description of Artificial Sequence: Synthetic coding sequence
atgacgatcctgcccaagaaaaagccgcctccaccagacgccgaccccgccaatgagcctccccccccgggacccatgccaccggcaccacgaaggggcggcggcgttggcgtcgggggcgggggaacaggagtgggcggaggagatagagacagagacagtggtgtggtgggagctcgcccacgcgcctcccctcccccgcaaggccctctgccaggcccaccaggggctctgcacagatgggctctggctgtcccccctggtgccgtggctgggcctcggccacagcaggcttccccacccccatgtggaggccccggtggacctggcggaggccccggcgacgccctaggtgctgctgcagccggcgtaggagcagcaggggtggtcgttggcgtagggggggctgtgggcgtgggcggatgttgttctggaccgggccacagtaagaggcgtaggcaggcccccggagtgggagctgttggggggggatcccctgagcgcgaggaagtgggcgccggatataatagcgaagacgagtatgaagccgcagccgcccggatcgaggccatggaccctgccaccgttgagcagcaagagcattggtttgagaaggctctgagggacaaaaaggggttcatcattaagcagatgaaagaggatggagcttgcctttttcgggccgtggcggaccaggtgtatggtgatcaagacatgcacgaagtggtgcggaagcactgtatggactacctcatgaagaatgctgattacttctctaactacgtgactgaggacttcacaacttacattaatcgcaaaagaaaaaacaactgccatggtaatcacattgaaatgcaggcaatggctgagatgtacaatcggcctgtagaagtttaccagtatagtacaggtacgtccgctgtggagccaatcaatacttttcacggaatccaccagaatgaagatgaaccgattagagtgagttaccaccgcaacattcactacaattccgtcgtcaaccccaacaaggccaccatcggtgtgggcctcggcctgccatctttcaagcccggatttgccgaacagtcactcatgaagaacgctatcaaaacgtcagaggagagttggattgaacagcagatgcttgaggataagaaacgcgctactgattgggaagccaccaacgaggcaatcgaggaacaagtcgcccgggaaagttatcttcagtggctccgcgatcaggagaaacaggcccgccaggtgcggggcccaagccagccacggaaggcctccgccacatgtagctcagctactgccgctgcttcctctggcctcgaggagtggacaagtaggtcccctcgccagcgttcaagcgctagcagtcccgaacaccccgagcttcacgctgaactaggcatgaagccccccagccctggaactgtcctggccttggccaagccaccatcaccctgcgccccaggcaccagctcccagtttagcgccggtgccgatagggcaacttcgcctctggtgagcctgtatcccgcgttggaatgccgggccctcatccagcagatgagtccgtccgcatttggcctcaatgactgggacgatgatgaaatcctcgctagtgtcctcgccgtgtcacaacaggagtatctggacagcatgaagaagaacaaggttcaccgcgacccaccgcctgataagagctag

SEQ ID NO: 31773 - DNA, 1701 bp, Artificial Sequence
  Description of Artificial Sequence: Synthetic coding sequence
atgacaattctcccaaaaaaaaagccccccccccctgacgcggacccagctaacgagcctccacctcccggacctatgcctccagccccccgcagaggcgggggagtgggagttgggggaggaggtactggcgtgggaggcggagacagagacagagacagcggggtggtaggggcccggccacgggcaagccctcctccccagggcccactgcctggcccccctggggctcttcaccgatgggcactggccgtcccacccggcgctgttgctggaccccggccacaacaggcatcccctcccccctgcgggggaccgggcggtcccggaggcggaccaggcgatgcccttggggcagccgccgccggcgttggagccgccggcgtggtcgtgggcgttggaggtgccgtaggcgtgggcggatgctgttccggtccaggtcacagcaaaaggaggcgccaggcacccggggttggagccgttggcgggggtagtcccgagagggaagaggtgggagcggggtacaatagtgaagatgagtatgaggccgcggctgcacgcatcgaggccatggatcccgcaactgttgagcaacaggagcactggttcgaaaaggcattgcgggacaagaaaggttttataattaaacagatgaaggaagatggcgcctgcttgttcagagctgtggctgatcaagtgtacggggaccaggacatgcatgaggttgtgcgcaaacactgcatggattatctcatgaagaacgccgactacttttctaattatgtgacggaggacttcacaacttacattaatagaaagaggaagaacaattgccatgggaaccacattgagatgcaggcaatggctgaaatgtataataggccagtggaggtttaccagtattctactgagccaatcaacacgtttcatggaatccatcaaaacgaagatgaacccattcgcgtcagttaccacaggaatatacactataactcggtagtgaaccctaacaaagccacaatcggcgtcggactggggttaccaagctttaagcccggctttgccgaacagagtttgatgaagaacgccattaaaacttccgaggagtcatggattgagcagcagatgttagaagacaagaagagagccacagactgggaagctaccaacgaggccatagaggagcaggttgccagggagtcctatctgcagtggctgcgtgatcaagagaaacaggctcgccaggttcgtgggccgtcacagccacgtaaagcatccgctacatgttctagcgctactgccgctgccagctcgggccttgaagaatggacgtctagatctccaaggcaaagaagcagtgcctccagccccgagcatcctgaactgcacgccgagctgggaatgaagcctccttccccaggcactgtactggctcttgctaagccgccctccccttgtgcccctgggacatcgtcgcaattttctgctggcgcggacagagccacgtctcctctcgttagtttataccctgcacttgagtgtcgggccctgattcaacagatgtcacccagcgccttcggcttgaatgactgggatgacgacgagatcctcgccagtgtgttggctgtctctcagcaagagtacctagactctatgaagaagaacaaagtgcaccgggaccctccccccgataagagttag

SEQ ID NO: 31774 - DNA, 762 bp, Artificial Sequence
  Description of Artificial Sequence: Synthetic coding sequence
atgggttctgacgcctgggtaggcctgtggcgtccacatcgaccacgtggccccatcgccgcccactatggaggccccggtcccaaatacaagttaccacccaatactggctacgccctccacgacccgtctaggccgcgggctcctgccttcaccttcggagcccgtttcccaacacagcagactacctgtgggcccgggcccggacatctggtacctgcacgcatgaccgtccggggaacggacggagcccctgcttattcaatttatgggcggcctagacggagcgcaccttttctcacccccggacccgggagatacttcccagaaagggccggtaacgccacttatccaagtgccccccgccatactatcgctcctagaaattggggagtgcaggcagaacagcagagcccgggtcctgccgcgtatactgtcccctccctgttggggccacgggtaattggcaaagtctcagctcccacctgctcaatctatggtcgcagagccgcagggagcttttttgaagatttatctaaaacacccgggccgtgtgcctatcaggtcgtcagccccggtgtctacaagtcccgggccccccagtttactattcttgcccgtaccagcctcccacaggacaataccaggaaaccgggccctgccgcctataacgtagaccagcacagaaagccacgagggtggtcatttgggatcaggcatagcgattatttagccccacttgtcaccgacgccgacaactag

SEQ ID NO: 31775 - DNA, 762 bp, Artificial Sequence
  Description of Artificial Sequence: Synthetic coding sequence
atgggatccgatgcctgggtgggcctgtggcggccacatcgaccaagggggcccattgctgctcattatggtggcccaggacctaagtataaattgcctccgaatacagggtatgcacttcatgacccaagtcggcccagggcccccgccttcacatttggtgcacggtttccaacgcaacagacaacatgcgggccgggtcccggacacctcgtccctgctcgaatgactgtgcgcggtactgacggtgccccagcctacagtatctacgggcggcctagaagaagcgctcctttcctgacacctggtccgggcagatatttcccagagagagctggcaatgccacatatcctagtgcgcctagacatacgatagctccccgcaactggggagtgcaggcagagcagcagtccccaggcccagcagcatatacggtgccttcgctgctcggtccccgggtgatcgggaaagtgtcagccccaacttgtagcatttatgggaggcgggctgcaggaagcttcttcgaggatctgtctaagactccaggcccttgcgcctaccaggtcgtgtctcctggcgtctataaatctcgagcccctcaattcaccattctggctcgaacctcactgccgcaagataacacacggaagcccggtcctgccgcttataacgtcgatcagcacaggaaacctagaggatggtcctttggcatacggcatagtgactaccttgcaccgctagtgacagatgcagataattag

SEQ ID NO: 31776 - DNA, 465 bp, Artificial Sequence
  Description of Artificial Sequence: Synthetic coding sequence
atgctgcccggatacgctctacaccctgtggctgctgcccgacccagacttcatctccgaagagcccttccccacgcagctgacgatgtgcggccaagggcccgtcccccgggtgcgcgatcacacgaccgggcaaggcaccgccggcggccgcgcctgctgcacctccgacccccaactcccctcagcgctctcccccactcaggtacctggtcaggccctcccggcccctggccacctcagcgaaggacagctagtagagaggcccatctgggtacgcccgatctgaacccagaaagcccttccgacaccttgacctatagtgtcccaccttatcctgacctgaagtctcaaacgccccctcgcgggttcgacaaatcgtggctgaggctgccgacgtctccacgaaccccgtccagggtgccaactcggttaccaagatcttcctccccaccccatccttag

SEQ ID NO: 31777 - DNA, 825 bp, Artificial Sequence
  Description of Artificial Sequence: Synthetic coding sequence
atgaagctccctaaagggaccaggtcctctgtatatttcgcgcagcaccctgagaaggaaccactaccctcaagacaagaggtgaaacaaactcccgtaattatggcaaagatcaagggccccggtcccgcgaagtatctgcgtccttcttgtactggatatatcgatcacgacatttctatgtttaaagccccggcttatactcttcatagcagacatagtgaaaagaggatggtgtgtcattcttcccccggcccctgctatttactcgatcccaagatcaccagatttggtatgtcctcttgcccccaggtgccaatggaagagagaatctctaatctccgcttgaacccgacattagcatcttgccagtactattttgaaaagatccatccccccggggaacggagagcccctcagtacacttttggctaccgtcggccctatcgcgtgatggacctcaaccccgcacctaatcagtaccagatgccacttctgctcgggcccaatacccctgtgtcacgggcggccccgtgttacagcctcgccagccgcgacaagaattggttctacaaggaagacgtcgccggagggccaggacccaccacttacgcccgtcccgaaccctctatctatcagaatagaagtccaacctatagcatggccaagcggtttgcctacccactggatctgaccccacggcctggccctggatctcatgaggtgcagcaggttacggttcacaaacctcatatccctgcatttactatgggcatcaaacattccctccatctgtgtccccttgttatcgacattcgggattag

SEQ ID NO: 31778 - DNA, 870 bp, Artificial Sequence
  Description of Artificial Sequence: Synthetic coding sequence
atggggactctgtcttgtgattccaccccacgcctcgctaccgctcctttaggccgtcgagtgacagaggggcagatcccagagaccggtctcagaaagagctgcggtaccgccacacttgagaatggatcaggccctgggctctacgtcctaccgagcaccgtcgggtttataaatcatgattgcacccgagtcgctagcccggcctatagcttagtgcggcggccaagcgaggcccctccacaggacacgtcgccagggcccatctatttcctggatccaaaagtgacaagatttggacgcagttgtacgcccgcatactccatgcagggacgcgccaagagccgaggccccgaggtgaccccggggcctggggcctatagtcctgaaaaggttcccccagtacggcatcgcacgccacctgcattcactctgggttgtcgcttgcctttaaaaccgctagacaccagtgcgccggcacctaacgcatatacgatgcctcctctttggggcagtcagatattcacaaagccctcctcacccagttatactgtggtgggaaggacaccccccgctcgccctcctcaggacccagcggaaattccagggcccggccagtacgatagtcctgatgctaacacgtatcggcagcgtttgcctgcattcacgatgcttggaaggccccgagcaccgcgacctttggaggagactcccggtcctggggcccattgccccgagcaggtaaccgtcaacaaggcaagggcccccgctttctcgatggggatccgccactctaaaagggcctcgacaatggccgccaccacacccagccgacccgcgggccatagactgcctggtaggtgctgttag

SEQ ID NO: 31779 - DNA, 762 bp, Artificial Sequence
  Description of Artificial Sequence: Synthetic coding sequence
atggggacactctcgtgcgattcaactccaagactggcaaccgcacccctgggtcggagagttaccgagggtcagattccagagaccgggctgaggaaatcatgtggcactgccaccctagaaaacgcccccccccaggatacctccccaggacctatctatttcctcgaccccaaggtgaccagatttggcagaagctgtaccccagcttactcaatgcaaggtcgagcaaaaagcagaggccccgaagtgacgcccggacctggtgcttactcgcctgagaaagtacctcccgtacgccaccgcacgccccctgccttcaccctggggtgtagactaccactaaaaccactggatacctccgcacctgccccaaatgcttataccatgcctcccttgtggggcagccaaatattcacgaaacctagcagccctagctataccgtggttggtaggacccccccggcccggcccccacaggacccggctgagatacccgggccaggacagtatgacagccctgatgccaacacctacagacaaagactcccagcctttactatgctcggcaggccacgggcccctcggccgctcgaagagacaccaggacccggcgcacactgcccggagcaggtgaccgtcaacaaggcccgcgcgcctgctttcagtatgggtatccggcacagcaaacgcgcctcaaccatggcggcgaccaccccaagcaggcctgcaggtcaccgcctgcccggacgttgctgttag

SEQ ID NO: 31780 - DNA, 3405 bp, Artificial Sequence
  Description of Artificial Sequence: Synthetic coding sequence
atgggactcttggccagcgcaggtcttctattactgctcgtcatcgggcacccccgctctttaggactcaagtgcggtattagaatggtgaatatgaagtccaaggaacctgccgtggggtcgcggttctttagccgcatctcaagctggcgtaattccacagtgaccggacacccttggcaggtctcattaaagtcagatgaacaccacttttgtgggggaagtctgatccaggaagatagagtcgttaccgcagcacattgccttgacagcctgtctgaaaagcagctaaagaacatcactgtaaccagtggtgaatatagtctatttcagaaggataagcaggagcagaatatccccgtatcaaagattatcacccaccctgaatacaactctagagagtatatgagtccagatatagctttactgtacctgaaacacaaggtcaagttcgggaacgctgtgcagcccatatgcttgcccgactccgatgataaagtagagccagggattttgtgtctttcctctggatggggaaagatctcaaaaacgagtgaatattctaatgtcctacaggagatggaacttccgattatggacgatcgggcatgcaataccgtgttaaaaagcatgaacctgccaccgctggggcggactatgctctgtgctggttttcccgactgggggatggatgcttgccagggagatagcgggggtcctctcgtctgtaggaggggaggaggcatctggattctcgccggcatcacgagttgggtagccgggtgtgccggagggtccgtgcctgtcagaaacaaccatgttaaggcatccttagggatcttttcaaaggtgtccgagctgatggatttcatcacgcaaaacctcttcacaggactcgaccggggacagcccctctctaaggttggctcccggtatatcaccaaggccctgagctccgttcaagaagtcaatgggtcacagcggggcaagggcatccttgacatggaaaagcaggtgggctgcgatcacgactacgtgtccttgcggtcttcctctggcgtcttgttcaaccaacgctctctgatggaggacgacggaaaacagaataagcgagtctgcggaaaaattctcccatctccacttctggcagagacctctgaggctatggtccctttcgtgtccgataccgaagacagcggtagcggctttgaattgaccgtgactgccgtgcaaaaatcagaggccggtagcggttgcggtagcctggctatactggtggaggaaggcacgaatcacagtgcaaaatatccagatctctacccttcgaacacgcgttgccactggttcatatgcgctccggagaagcatataatcaagttaacatttgaagattttgcggtgaagttctcaccgaactgtatctacgatgctgtcgttatctacggcgactccgaggaaaaacataagttagccaagttgtgtgggatgcttaccatcacatccatcttctcgtctagcaatatgacggttatatactttaaatctgacgggaaaaacagactacagggttttaaggctcgcttcaccatccttccatccgaatcactgaacaagttcgagcccaaactgcctccacagaacaatcccgtgagtaccgtgaaggcaatcctacacgacgtttgtggcatcccccccttctctcctcagtggctaagccgacgaatcgccggtggtgaagaagcatgccctcattgctggccttggcaggtgggcctgcggttccttggcgactatcagtgcggaggcgctatcatcaaccccgtatggattctgaccgctgcacactgcgttcagctcaagaacaacccactcagctggactattatcgcaggggatcatgacaggaacttaaaagagtctactgaacaggtgagaagggcgaagcatatcatcgtgcacgaggacttcaatacactgtcctacgactctgatattgcgctgattcaactgtctagtcctctcgagtacaatagcgttgtgcgtcccgtttgcctgccacacagcgcggaaccactgttctcaagtgaaatctgcgcagtgacagggtgggggtcaatctcggccgatggaggactggcttcacgcttacaacagatccaggtacacgtgctcgaaagggaagtgtgtgagcatacctactactcagctcacccaggtgggattaccgaaaagatgatctgtgctggcttcgctgcgtccggggagaaagacttttgccagggtgatagtggggggccgctggtgtgtcggcacgagaatgggccgtttgtgctctacggcatcgtaagctggggcgccggttgcgtgcaaccttggaagcctggggtcttcgccagggtgatgatctttcttgattggatccaaagtaagattaatgggcccgcatctctccaaactaataataaatgcaaaaccttaaagcagcagctgcctcccccaaccccttctcccgactctgcaagctggcccggttgctgttcagaagccgaactggaaaagcctagaggattcttcccaacgccacggtatctcttggattaccgcgggcgcctggaatgttcctgggtcttgcgcgtgtccgcatccagcatggccaaattcacaatcgagtatttaagcttgctgggatcccctgtctgccaggatagcgtcctgataatctacgaggagcgacacagcaagcggaaaacggctggcggtctgcatggtagacggctgtatagcatgacattcatgtcccctgggccactcgtccgggttacctttcacgctctagtccgaggagccttcggtatctcctatatcgtcctgaaagtgctggggccgaaagacagcaaaattacccggctatcccagtcttccaatagagaacacctggtgccttgtgaagacgtactactaactaaacccgagggcattatgcagatcccaaggaatagccacaggacaaccatgggttgtcaatggcgactagttgccccactgaatcacattattcagcttaacattattaacttccctatgaaacccacgacttttgtgtgccatggacacttacgagtgtatgagggattcggtccagggaagaaactcattgcctccttcgcgggcactcttgccatgatcctaacaaaggacatcctgaaacgggagaaactgaacttcataaatacctatattatgcacatttgggagaactcggtttatgataatgtcagatccgtaggcaaacggaagcagaaaaagttcgccagtaacctgtcatactcaatggaggccgagaaatctagaatacaggtcccggcagatctggttccagcaaagggctccctgtctgggtcttag

SEQ ID NO: 31781 - DNA, 1695 bp, Artificial Sequence
  Description of Artificial Sequence: Synthetic coding sequence
atgcttatcagccggaacaaacttatactgcttctcggcattgtgtttttcgagcgcggtaaatcagccacactctcactccccaaagccccatcttgtggtcagtctctagtgaaagtgcagccatggaactacttcaacatcttttccagaatcctcggagggagtcaggtggagaaaggcagctacccctggcaggtgagtctgaagcaacggcagaagcatatctgtgggggctcaatcgtgagccctcagtgggtgattaccgctgcccattgtatagcaaatcgaaatatagtgtccaccctgaatgtaactgcaggggagtacgatctctcacagaccgatcctggagaacagaccctgaccattgaaaccgtaataatccacccccacttctccaccaaaaaacctatggattatgatattgcgcttctgaaaatggcgggtgcctttcagttcggtcacttcgttggacctatttgtctccctgaactgagggagcagtttgaagctgggttcatatgcactactgccggctggggcaggttgactgagggcggcgtgttgtcacaggtcctccaagaggtcaacctgcccatcctaacgtgggaagaatgcgtggccgcccttctgacactgaaacgacctattagcggaaagacctttctgtgcacgggatttccagatggcggcagggacgcatgccagggagattcgggcggtagcctgatgtgccgcaataaaaaaggtgcttggacccttgccggagtgacctcttggggccttggatgtgggcgcggctggcgcaacaacgttcgtaagtcagatcagggtagcccagggatttttactgatatatcgaaggttctaccctggatccatgagcatattcagactgggaatagaagaaagagtagcagagcctggtgctccgagcaggatgtgatcgtgagtggtgccgaagggaagctccattttcccgagtccctgcatctctactacgagtcaaagcagaggtgtgtctggacacttctggtgccagaagaaatgcacgtgctgctctccttttcgcacctcgatgtcgagtcctgccatcacagctatcttagcatgtactccctagaggatagacccattggcaaattttgcggggagtccctgccttcctccatactcattggctcaaattcgctgcgtcttaagtttgttagcgatgccactgacaacgctgccggcttcaacctgacctacaaggctttaaagcccaactacatcccggactctggctgcagctacctcaccgtgctgttcgaagaggggctgattcagagtctgaattaccccgaaaattattccgataaggctaactgtgactggatctttcaggcaagcaagcatcatctgataaagctttcctttcaatcactggagattgaggagtctggggattgtacttccgactacgtgactgtccacagcgacgtcgaacgtaaaaaagaaattgcccggctttgcggatacgatgttcccactcccgtgctgagcccttcaagtataatgcttatctctttccagagcgatgaaaacgggacctgccgagggttccaggctacggtgtcatttattccaaaagccgggaaaaagattgaactccctacgttgtggtttccagtgctgattctcgtgatgtag

SEQ ID NO: 31782 - DNA, 756 bp, Artificial Sequence
  Description of Artificial Sequence: Synthetic coding sequence
atgccccgcgcctttctggtgcgatcacgccgaccccagcctccaaattggggccaccttccggaccagctgaggggcgatgcgtacataccagactgttcttccctgggagggcctcccgcccagcagtctagctccgtacgggacccatggacagcagtgagtgttctggggacctgcccaccgttgctcctctgcgtgggtaatgcttctccctttctggtcgctcctggacctgcagctaccggtatctcaagttccggcgcccaggatagttctccacatgtggatgatcccctgtacttatgcatgcattggcgcaaagagagtgcaagtcgaaaccagcctacccagggaaacttgacctccgccccacggggacccgggaccctcggctgccccctgtgtccaaaggccttcccactgcagaggatgctgaccaggcacttgaagtgccatagtccagtccgccggcacctgtgtcgctgctgtggtaagggatttcatgacgccttcgacttgaaacggcatatgaggacgcacactggcatacggccctttaggtgctcggcttgcggcaaggcctttacccaacgttgttcactggaagcacatctggccaaagtgcatggacagccagcatcttatgcctatagagagcgccgcgaaaagcttcacgtgtgcgaggattgcgggttcaccagcagccgccccgacacttatgctcagcacagagcgttacatagagctgcttag

SEQ ID NO: 31783 - DNA, 1683 bp, Artificial Sequence
  Description of Artificial Sequence: Synthetic coding sequence
atgggcaagtggagacccagaggctgttgcagaggaaacatgcagtgtaggcaggaggtgcctgctacgctgacgagtagcgagcttttctctacgaggaaccagccccaaccacagccccagcctctgctggcagatgcgcccgtgccatgggccgttgccagcagaatgtgcctcacccccggacaaggatgtggacaccagggtcaggatgagggtccattacccgccccttcccccccgcctgccatgtccagctctcggaaggaccacttaggcgccagcagctctgaaccactccccgttattattgtcggaaacggtccaagtggaatttgcctgagctacttactgagcggatatacaccctataccaagccagatgccatccacccacaccccctattgcaacggaagctgacagaggctcccggggtgtcgatacttgaccaggatctggattacctgagcgagggcctagagggccgctctcaatcaccagttgctctactattcgatgcactcttgaggccagacactgacttcggaggcaatatgaagtccgttctgacgtggaagcatagaaaggagcacgcaatcccccacgtggtactggggaggaatctgcccggtggtgcctggcacagcatagagggttcgatggttattctttcccaaggacagtggatgggcttgcctgatttggaagtgaaagactggatgcagaaaaaaaggcggggacttcggaactccagggcgacggcgggggatattgctcactactacagggactacgttgtgaaaaaagggcttgggcataacttcgtgtccggggctgtcgttaccgctgtggagtggggcactccggacccatcttcttgtggagcccaagactcctctcccctgtttcaagtgagtggctttttgacgcggaaccaggcccagcagccgttttctctctgggcaaggaatgtcgtcctggctactggtaccttcgatagccctgctcgcctgggaatccctggggaagctctaccattcatccatcatgagttatcggcgttggaagcggccacccgcgtgggtgccgtgacccctgcgtctgaccccgttctgatcataggcgccggtctgtctgccgctgacgccgtcctatacgctagacattataacattcccgtgattcatgcgtttagaagggctgttgacgatcccggcctcgtgtttaaccagctgcctaagatgctctatccagagtaccataaagtgcatcaaatgatgagggagcagagcatcctatctccctctccgtatgaaggctaccgcagccttccacgccaccagctgttgtgttttaaagaagattgtcaggccgttttccaggacctagaaggcgttgaaaaagtctttggggtgtcattggtactggtgctcatcggatctcatcccgacctctcatttctgcctggggccggggctgatttcgctgtcgatccagaccagcccctgagtgccaagaggaatccaatcgacgtggacccatttacatatcagtccaccagacaggagggtctgtatgctatggggccacttgccggcgataacttcgtgcggttcgttcagggcggggctctcgcagtggcctcctccttactaaggaaggagactcggaaaccaccctag

SEQ ID NO: 31784 - DNA, 1434 bp, Artificial Sequence
  Description of Artificial Sequence: Synthetic coding sequence
atgtctagctcccgcaaggatcatctgggagcctctagttctgaaccactgcctgtcattatagtcggcaacggtccttcagggatttgtttatcttatctcctgtcagggtacaccccctataccaaacctgatgccattcaccctcatccattgttgcagcgcaagctgactgaggcccccggggtgtcgattttggatcaggatctcgactacctgagcgaaggcctagagggaaggagccagtcccctgtggcccttctcttcgacgcgctgttgcggccagacacagatttcgggggaaacatgaagtcagtgcttacttggaagcataggaaggagcatgccatccctcatgtcgtgttaggccgaaatttgccaggaggagcctggcattcaatcgaaggttccatggtgattttgtcgcagggccagtggatgggtttaccagacctcgaagtaaaagactggatgcaaaagaaaagacgtggactcaggaactctcgggctacagctggcgatattgctcactactatcgtgactacgtggtgaagaagggactcggacacaacttcgtctctggggccgtggtgacagcagtggagtggggcacccccgacccttcaagttgcggagctcaagatagcagccccctgtttcaggtgtcgggattcttgacgcgcaaccaggcacagcagcccttctccctgtgggctcggaatgtggtgcttgcaactggtactttcgacagtcctgcgcgtcttggaattcctggcgaggcgctaccattcattcatcatgaattgtccgctctggaagcagctaccagagttggcgccgtgaccccggctagcgatcccgttcttatcatcggggccggactttctgcggccgacgccgtgctgtacgcacgtcactacaacattcccgtgatccatgccttcagacgagcggtggacgatccaggactggtgttcaaccagctgcccaaaatgctgtatccagagtatcataaggttcaccagatgatgcgtgagcagtccattctctctccatctccttatgagggttacagaagcttaccgcgacaccagcttctctgcttcaaagaagactgtcaagcagtctttcaagaccttgaaggtgtggaaaaagtcttcggagtgtcactggtattggttttaatcggctcccacccagacctttcttttctgccaggcgcaggcgcggactttgcggtggatccagaccagccgcttagtgccaagagaaatccaattgatgtggacccatttacatatcagagcactcggcaagaagggctttatgcaatgggtcctctggcgggcgacaattttgttcggtttgtccaagggggggccttggcagttgccagctcattactcaggaaagaaacacggaagccaccctag

SEQ ID NO: 31785 - DNA, 1434 bp, Artificial Sequence
  Description of Artificial Sequence: Synthetic coding sequence
atgtcctccagccgaaaggaccatttaggtgcgtcctctagtgaacccttaccagtaatcatcgtgggaaatggcccctcagggatctgcctttcgtatctcttatccggatataccccttacactaaaccggatgccatacatcctcacccgttgctgcaacggaaactcacagaggcacctggagtctccatactcgatcaggacctggactacttaagcgaaggactggaagggagatcccagagtccagttgcgctgcttttcgatgcactgttgcgccccgacaccgattttggcggcaacatgaagagtgtcttaacgtggaagcataggaaggagcatgctattcctcacgtcgttttgggacggaacctccctggcggagcctggcactccattgaaggatctatggtcatactatcgcagggacagtggatgggactgcccgacttggaagtgaaggactggatgcagaagaagaggcggggactgcgcaactctagagccacagccggagatattgcacattactacagggactacgtggtgaaaaaggggttgggccacaacttcgtgtccggcgccgtcgtcaccgcagtcgaatggggtacacccgacccctctagttgtggagcccaggacagctctccactttttcaggtgagtggcttcttgaccagaaatcaggcccaacagccctttagcctgtgggcccgcaatgtggtgctcgccacaggaacgtttgatagtcccgcccgcctcgggatcccaggcgaggctctgccctttattcatcatgaattgagcgctctagaggcggcgacgcgcgtgggtgcggtgacgccagcgtctgaccctgttttgatcatcggcgcgggcctttctgccgcagacgctgtgctgtatgccaggcattataacatccccgtcatccacgcgtttcgcagagccgtagatgacccgggacttgtgtttaaccagctaccaaagatgctgtaccccgagtaccataaggtgcaccagatgatgcgagaacagagcatcctttcaccttcgccgtatgaaggatacaggtcactaccacgccaccagctgctgtgcttcaaggaggattgccaagcagtcttccaagacctcgagggcgtggagaaagttttcggcgtgagcctcgtcctggtcctcataggaagccacccggacctgagcttccttccgggggcgggcgctgacttcgccgtggatcctgatcagcccctgagcgcaaaacgaaatcccatcgatgtcgacccgttcacctaccaatcaacacggcaggaagggctttacgccatggggccactggctggcgacaactttgttagatttgtccagggaggcgcactcgctgtggcctcatccctcctgaggaaggaaacccgcaagcccccttag

SEQ ID NO: 31786 - DNA, 1518 bp, Artificial Sequence
  Description of Artificial Sequence: Synthetic coding sequence
atgcctctggtggaggagacatctctcctggaagactcatccgtaactttcccagttgtgataatcggaaacggaccgtcaggcatatgtttatcatatatgctgtctggatacagaccttatctaagctctgaggccattcatcccaacacgatactgaattctaagttagaggaggctaggcatttgtccatcgttgaccaagatctagagtatttgtccgaaggcctggagggacggagttccaatccagtcgcggtcctgttcgacacactcctgcacccagacgccgacttcggatatgattatccctctgtcctgcactggaagttagagcagcaccattacatccctcacgtcgttttaggcaaggggcctccggggggtgcttggcacaatatggaggggtctatgctcacaattagctttggtagctggatggagctgccgggcttgaagtttaaggattgggtttctagcaagaggagaagcctcaagggagatcgagtaatgccggaggagattgcgcgctactataagcactacgttaaagtcatgggcctccagaagaatttccgggaaaacacctacattacttctgtatctcgcctctaccgggaccaggacgacgacgatatacaggacagagacatttccacaaagcatttgcagatcgaaaaaagtaacttcattaagcgtaactgggaaattcgaggctatcaaaggattgctgacggaagccatgtgcctttttgtctgttcgcagagaacgtcgctctggccactggcaccctggacagtcctgctcacctggaaatcgagggtgaggattttccatttgtgttccacagtatgccagagtttggcgccgccatcaataaggggaagctccggggaaaagtggaccccgtgctaatcgttggtagcgggctgaccgccgccgacgcggttttatgtgcatataactctaacatccctgtgattcacgttttccgaaggagagttaccgaccccagcctgatattcaaacagcttcccaaaaaactttaccccgaataccataaagtgtaccacatgatgtgtacacagtcgtactccgttgacagcaacttgctttctgattataccagtttccccgagcaccgagtcctgtcttttaaatccgacatgaaatgtgttctccagtccgtgtccggcctcaaaaaaatttttaaactctctgctgctgtggtactgatcggaagtcacccgaatctgtcttttttaaaggaccaaggatgttatctggggcacaaatccagccagcccatcacttgcaaaggaaatcccgtggagatcgatacctacacatatgagtgcatcaaggaagccaacttattcgcactgggccccctggtgggggacaatttcgttcgcttcctgaaaggcggggctttgggggtcacacgatgcctagccacgcgacagaagaagaagcacctctttgtggaaagaggcggaggagacgggatcgcttag

SEQ ID NO: 31787 - DNA, 1650 bp, Artificial Sequence
  Description of Artificial Sequence: Synthetic coding sequence
atgcctgtgtggtgttgcagatgctctctagcaggccacttccgcaattacagtgacaccgagactgaaggagagatcttcaatagtctggtgcagtacttcggagataacctgggtcggaaagtaaaggccatgcccctggtggaggagaccagcctgctggaggacagcagcgttacattccccgtggtgataatcggtaacgggccaagcggtatctgcctttcctatatgctgtcgggctacagaccttatctatctagtgaagccatccatccaaatacgattctgaacagtaaactcgaagaagcccggcacctgtcgattgtcgatcaggacctggagtatctgagcgagggcctggagggacgcagctccaatcccgtggcagtgctgttcgataccctgctgcacccagatgcggacttcggttacgattatccaagcgtgctgcattggaagctggaacaacaccattacatcccgcatgtggttctgggtaaagggccgccaggtggtgcctggcacaatatggagggttcgatgctaaccatcagcttcggatcgtggatggagctgcctggcttaaaatttaaggattgggtctcttcaaaacgacgctcccttaaaggggatcgtgtgatgcccgaggagattgcacgttactataaacactatgtaaaggtgatgggcctgcaaaaaaatttcagagagaacacatatatcacctcggtgtcaagactctacagggatcaggatgatgacgatatacaagatagagacatcagcaccaaacatcttcagatcgagaaatcgaactttataaaaaggaattgggaaataaggggctaccagcggatcgcagacggttcccacgtgcccttctgtctatttgccgagaacgtggccctcgccacgggaacgctggatagccccgcccatctggagatcgagggcgaggacttccccttcgtgttccacagtatgcctgaatttggtgcggccatcaataaaggcaagctccgcggcaaagtggatcccgtgttgattgtggggagcggacttacagctgcagacgcggtactctgcgcctacaactcaaacattccagtgatacatgtctttcgaaggcgcgtcactgatccatcacttattttcaagcaattgcccaagaagctgtacccagagtaccacaaggtgtatcacatgatgtgcacccagtcctactccgtggatagtaacctgctcagtgattatacaagcttccccgaacatagggtcctcagttttaagagcgacatgaagtgtgtcttacagtccgtatccggccttaagaagattttcaaactgtcagcagcagtggtgctcatcggctcccacccaaacctcagcttcttgaaagatcagggttgttatctcggtcataaaagcagccagcctatcacctgtaagggcaacccagtagaaattgacacatatacctacgaatgcattaaggaggctaacctgtttgcactgggaccactggtgggcgataattttgtcaggtttttgaaaggcggagccctcggggttaccagatgtctcgcgaccaggcagaaaaagaaacatctgttcgttgaacggggtggaggcgatgggatcgcctag

SEQ ID NO: 31788 - DNA, 1584 bp, Artificial Sequence
  Description of Artificial Sequence: Synthetic coding sequence
atgagcgaagattcttccgccctcccatggtccattaaccgggacgattacgagctgcaagaggtgataggaagtggcgccactgccgtggttcaggctgcctattgcgcacccaagaaggaaaaagtggcaattaaacgcatcaacttggaaaagtgccaaacatccatggacgaactgcttaaggaaatccaggctatgtctcagtgtcaccacccaaatattgtctcttattacacctcctttgttgtgaaagacgagttgtggctcgtgatgaagcttctgtccggcggaagcgtcctcgatatcattaagcatatcgttgctaaaggcgagcataaaagtggtgtactggacgaaagtacaatagctaccatcctgcgtgaggtactggagggactcgagtacctgcacaagaacgggcaaattcatcgcgacgtgaaggccgggaatatcctacttggcgaggacggatccgtgcagatagcagactttggagtatccgcattccttgcgacagggggcgatattaccagaaacaaagtccgaaagacattcgtgggcacgccgtgctggatggccccagaggtcatggaacaagtcagggggtacgactttaaagccgatatttggagcttcggcatcacagctatagagctggctacaggcgcagccccctatcataaatatcctccaatgaaggtgctgatgctgacgttgcagaatgatcccccgtcactcgaaaccggcgttcaggataaagagatgcttaagaaatacggcaaatcctttcggaaaatgatcagtctgtgcctccaaaaagaccctgagaagcggcccacagccgccgagctcttaaggcacaagttcttccagaaggccaagaacaaggagttcctgcaggagaagacattgcagcgcgctcccacgataagcgagagagcaaagaaggtgcggcgcgtccctggtagtagtggacgcctccacaagactgaggacgggggatgggaatggtcggacgatgagtttgacgaagaatcagaagaaggaaaggccgcaatctcacagctgagaagtcctcgagtgaaggagtctatatctaatagcgaactcttccctacaacggatcccgtggggacactactgcaggtcccggagcagattagcgcacatctgccacagcctgcaggccaaattgcgactcagcctacccaggtatccttgcctccaacggccgagcccgcaaaaaccgcgcaggccttgtcctccgggtcaggcagtcaggagacgaaaattcctattagcttggtgctgagactcagaaactcgaagaaagaattgaatgatatccgcttcgagttcactcccggtcgcgacaccgctgagggggtttcccaggaattaatttccgcaggcctcgtggatggtcgcgatttggtcatcgttgcagccaatcttcagaaaatcgtcgaggagcctcaatcaaaccggtccgttacattcaaattggcctcaggggtggagggcagtgatattccagatgatgggaagctgatagggttcgcccagttgtcaatcagttag

SEQ ID NO: 31789 - DNA, 309 bp, Artificial Sequence
  Description of Artificial Sequence: Synthetic coding sequence
atgagcgctcgggttcgctcacgctctagaggcagaggggacgggcaagaggctccggatgtagtcgccttcgtggctccaggagagagtcagcaggaggaaccccccactgacaatcaggatatcgaacctggacaagagagagaagggactccccccattgaagaaagaaaggtggaaggggactgccaggagatggacttggagaagactcgctctgagaggggtgacggttccgacgtgaaagagaagacaccgccaaatcccaaacacgccaagaccaaggaagcaggcgacggtcagccgtag

SEQ ID NO: 31790 - DNA, 336 bp, Artificial Sequence
  Description of Artificial Sequence: Synthetic coding sequence
atgtcagagcatgtcaggacccgatctcagagctccgagaggggtaacgatcaggaatcatctcaacccgtagggtctgtcattgtccaagaacccaccgaagagaaaagacaagaggaggaaccccctacggacaaccagggcattgctccctcaggtgagattgagaacgagggtgctcccgccgttcagggaccggatatggaggcatttcagcaggagttagcgttgttaaagattgaggacgagcctggggatggacctgacgtgcgcgaaggaatcatgccaacctttgacctcaccaaggtgctagaagccggggacgcccagccttag

SEQ ID NO: 31791 - DNA, 285 bp, Artificial Sequence
  Description of Artificial Sequence: Synthetic coding sequence
atgagcgaacacgtgcgtacgcgttcccaaagcagcgagagaggaaacgaccaggagtcctcacagcccgtcggttcagtgatcgtgcaagagcccaccgaggagaaaaggcaggaggaagagccgccaacggacaatcagggtccggatatggaagcctttcaacaggagctggcattgctgaagatcgaagacgagccaggagacgggcccgacgttcgtgagggaattatgccgacttttgatcttacaaaggtcctggaggctggcgatgctcaaccgtag

SEQ ID NO: 31792 - DNA, 393 bp, Artificial Sequence
  Description of Artificial Sequence: Synthetic coding sequence
atgcaggctccttgggctggaaatcgcggctgggcgggcaccagggaagaagtgcgcgacatgagtgaacacgttactagaagtcaaagctccgaacgagggaatgatcaagagagcagccagcccgtgggccctgttatcgttcagcagccgacagaggagaagagacaagaagaggaaccgccaaccgacaaccagggcatagcccctagcggggaaatcaagaacgagggtgccccggcagtgcagggtacagacgttgaggctttccaacaggagttggccctactgaagattgaggacgcaccgggtgacggtcctgatgtgcgagaaggaacactccctaccttcgaccccactaaagttttggaggcaggtgagggacagttgtag

SEQ ID NO: 31793 - DNA, 282 bp, Artificial Sequence
  Description of Artificial Sequence: Synthetic coding sequence
atgagcgaacatgtcaccagatcacagtcctccgaaagaggcaatgatcaggagagttctcagcctgtgggaccggtcatagtacaacagcctaccgaggaaaaaagacaggaggaagagcctcccaccgataatcaaggaacagacgtcgaagcgtttcagcaagaactcgcgctgctgaaaattgaagatgcgccaggtgatggcccggacgttcgggaaggaacgctgcctacttttgaccctacaaaagtgctggaggccggagaaggccaattatag

SEQ ID NO: 31794 - DNA, 333 bp, Artificial Sequence
  Description of Artificial Sequence: Synthetic coding sequence
atgagtgaacacgtgacacgctctcagtcgtctgaaaggggaaatgatcaagagagttcccagcctgtgggacctgtgattgtccagcagccaacagaagagaaacgccaggaagaagaaccacccactgacaatcagggcattgcaccctccggcgaaatcaaaaacgagggcgcccctgctgtccagggaacagacgtcgaagctttccagcaggagctggcccttctgaagattgaagacgctcccggagacgggccagatgttcgcgaagggacgctccctacattcgacccaacgaaggtcctcgaagctggggagggacagctttag

SEQ ID NO: 31795 - DNA, 3273 bp, Artificial Sequence
  Description of Artificial Sequence: Synthetic coding sequence
atggccgaagccgagttgcataaagagaggctacaagcaatcgccgagaagaggaaacggcagacagaaattgagggaaaacgccagcagctggatgagcaaatactgctgctccagcacagtaagtcaaaagttttgagggaaaagtggctgctacaaggtatacctgccgggacagctgaggaggaggaggcacgacgaagacagtcagaagaggatgagtttcgggtcaaacagttagaggacaacatccagcgcctggagcaagaaatacagactctagagtctgaggagtctcaaattagtgctaaagagcagattattcttgagaagttaaaggagactgaaaagtcatttaaagattttcagaaaggcttttcttcaactgatggtgatgccgtgaactacatctcaagccaacttccagatttgcctatactgtgttccagaaccgccgagccatcccccggtcaagatggcacttctcgggcggccggcgtcggctgggaaaatgtgctactcaaagagggtgagtccgcctcaaacgcgactgagacaagcgggccagatatgactataaaaaagccgccccagctgtccgaggacgatatttggctcaagtccgagggcgacaactacagcgccaccctactggaacccgctgcgagctctctcagcccagaccacaaaaacatggagatcgaagtctcagtagccgagtgtaagtctgtgccaggcattacgtccactccccacccgatggatcatcccagcgctttttatagccccccgcacaacgggttactcaccgaccaccacgaatcattggacaacgacgttgctagggaaattagatacctggatgaggtgctggaagcaaactgctgcgacagtgccgtggacgggacttacaacgggaccagctctccagagccgggtgctgtggtgctcgtcggtgggttgagcccacccgtccacgaagccacacagccagagcctaccgagcgaacggcctccaggcaggcaccaccccatatcgaacttagcaatagctccccggatccgatggccgaggctgaacgcactaatggacactctccttcccagccccgggatgctcttggggattctctccaggtgccagtctctccttcatctaccacaagctccagatgctcctctcgggatggtgagttcacactcaccacactgaagaaagaggcaaagttcgagctccgggcctttcacgaagacaagaaaccaagtaaactcttcgaggacgacgaacacgaaaaagagcagtactgcattcgcaaagtacgaccttctgaggagatgctggagctcgagaaggagcgccgcgagctgattcggagccaagccgtcaaaaaaaacccaggtatcgccgcaaagtggtggaaccccccccaggagaagaccatcgaagaacagttagacgaggagcacttagaatcccacaagaaatacaaagaacgaaaggagaggagagcccaacaggagcagctactgcttcagaagcagttacagcagcagcagcagcagcctccatcccaattgtgcaccgctccagcgtcatcacacgagagagcttccatgattgataaagcaaaggaggacattgtcactgaacagattgatttcagtgccgctagaaaacagtttcagctcatggagaactctaggcaagccgtggcaaaaggacaatctacgccaagactattttccattaagccattctataggcccttgggaagcgttaactcagacaagccattgacaaatcctagacccccgtcagtcggtggccccccggaagatagtggagctagtgctgcaaaggggcaaaaatcgcctggggcccttgaaaccccctctgcagctgggtctcagggcaatacggcctcccagggaaaagagggaccctatagcgagcccagcaagcgaggtcccctctctaaactttgggcagaggacggcgagttcactagtgccagggcagtccttacggtggtcaaagacgatgatcatggaatccttgatcagttctctcgttccgttaacgtcagcttgacacaggaggagctggacagtgggctggacgaactgagcgtgcggtctcaggacacaaccgttctggaaactttaagcaatgatttttctatggataacattagtgattcaggagcatccaacgaaacaaccaatgctcttcaggagaattctctggcagacttcagcctgccacaaacgccccagactgataacccctccgaaggccggggggaaggggttagcaagagctttagcgatcacggtttctactcaccttctagtacacttggggactcccccctagtcgacgatcctttggaataccaggccggtctgctggtccagaatgccattcaacaggccattgccgaacaagtggacaaagccgtctcgaaaacaagccgggacggcgctgaacaacaggggcccgaggccaccgtggaggaggctgaggccgcagcgttcgggagcgagaaaccacagtcaatgttcgaacctccacaggtatctagccctgtgcaggaaaagagagacgtcctccctaagattcttcctgcagaagaccgggctctcagagagcggggaccgccccagccactcccagctgtccagccaagtgggcctatcaatatggaggaaacccggcccgaaggaagttatttctctaaatattctgaagctgccgaactccggtcgactgctagtctgctggctacccaggagtctgatgtcatggtgggaccatttaagctgcggtcacgcaaacaaagaacactgagcatgattgaagaggagattagagcggcacaggagcgcgaggaggagctgaagagacagcgccaagtgcttcagtctacacagagtcccagaaccaaaaacgcaccatcgctgcccagccggacatgttataagactgctcctgggaaaatcgagaaagtgaagcccccacctagccccacaaccgaagggccaagtctgcagccggacttagccccggaggaggctgccggaacacagcgccccaagaacctgatgcagactctgatggaggactacgagacacacaagtctaaaagaagggagagaatggacgactccagcgtgctggaggccacaagagtgaatcggcggaagtcggctctagccctacggtgggaggcaggcatatatgccaaccaagaggaagaggacaacgaatag

SEQ ID NO: 31796 - DNA, 3312 bp, Artificial Sequence
  Description of Artificial Sequence: Synthetic coding sequence
atggccgaggctgaattgcacaaagagcgactgcaggccatagccgaaaagagaaagcgccagacagagattgagggcaagaggcagcaactggatgagcagatcctactgcttcagcactccaagagcaaggtcctgcgcgaaaaatggctgctgcagggcattcccgcaggcaccgccgaggaggaagaggctcgtcgcaggcagagcgaggaggacgagttcagagtgaagcagctcgaggacaacatccagcgcctggaacaggagattcaaaccctcgaatctgaggagtctcagatctcagccaaagaacagattatattagagaagctgaaggagaccgagaaatcattcaaagatttccagaagggattttccagtacggacggggacgcggtgaactacatcagctcccagctgcccgatctccccatcctctgctctagaacggctgaacccagcccaggacaggatggtacctccagagccgcgggagttggctgggaaaatgtgctgttgaaagagggggaatccgcatccaacgccacagagacttcagggcccgacatgaccatcaagaagcccccacagttgtctgaggatgacatttggctgaaatctgaaggggacaactattccgcaactttactggagccggctgcttccagcttatctccagaccataaaaatatggagattgaggtgagcgttgctgagtgtaaaagcgtccctggaatcaccagcacaccacaccctatggatcatccatccgctttctatagtcctccgcacaatggcctgctgacagatcaccacgagtccttagacaatgatgtggccagggaaattaggtatttggatgaagtcctggaggcaaattgctgcgattccgctgtggatggcacatacaacggcacctcatcaccagagcctggcgcggtagtgctggtgggtggactgtcgccccccgtgcacgaggccacacaacccgagcctacagagcggaccgctagcaggcaggcccccccccacattgaattaagcaattcatcccccgacccaatggccgaggctgaaaggactaacggtcactctccctcccagcccagagacgcgctgggagattcgctgcaagtgcccgtttcaccatcatccaccaccagttctcggtgcagtagcagggatggcgaatttacactgaccaccttaaagaaggaagcgaagttcgaacttagagcattccatgaagataagaaacccagtaaattatttgaggatgatgaacatgagaaagagcagtactgtataaggaaagtgcgcccgtcggaagagatgttagaacttgagaaggagcgccgtgagctgatcagaagccaggcggttaagaaaaaccctggcatcgcggccaagtggtggaacccacctcaggaaaaaactatcgaggagcagctagatgaggaacatttggagtcgcataaaaagtataaagagaggaaggagcgccgtgcacagcaagaacagctgttgctgcagaagcagttgcagcagcaacaacagcagccacctagccagctctgcacagcccctgccagctcgcacgagagggcgtctatgatcgataaagcaaaggaggacattgtcacagaacaaattgatttttcagccgcccgaaaacagttccagctaatggaaaacagtcggcaggcagtcgctaaaggccagagcaccccaagacttttctccattaaaccattttacagaccactgggctccgtgaacagtgacaaacctttaacgaacccgaggccgccctccgtgggcggaccacccgaagatagtggtgcaagcgccgctaagggccagaagagccccggggcccttgaaactccttccgcggctggcagtcaaggaaataccgcaagccagggtaaggagggcccctacagtgaacctagcaagagaggtccactctctaagctttgggctgaggatggcgagtttacttccgcccgtgcagtcctgaccgtcgtgaaagatgacgaccatgggattctggaccagttctctcggtccgtgaacgttagcctgacccaggaggagctcgacagtggactggacgaactttcagtgcgcagccaggacacaaccgtgcttgagacattgtcaaatgacttttctatggacaacatatctgactccggagccagcaacgaaacaactaacgcattacaggagaattcccttgccgatttttcgctgccacagactccgcagacagacaacccgagtgaaggtaggggagagggagtgtccaagtcattctccgaccatggcttctattcacccagctcaaccctgggggattcacctctcgttgatgatcccctggagtaccaggctggtctccttgtgcagaacgctattcaacaggcaattgctgaacaggttgacaaggcagtatccaagacttctcgggacggggctgagcagcagggtcctgaagccacagtggaagaggctgaagctgcagcattcgggtccgagaaacctcagtccatgtttgaacctccccaggtgtcttctcctgtgcaagagaaacgcgacgtgttacccaagatcttaccagcagaagatagagctttgagagagagaggtccaccacaacccttaccagctgtgcaaccatcaggtcctatcaacatggaagagactcggcctgagggaagctatttcagtaagtactccgaggctgctgaactgcgctcaaccgcgtcccttttggctacgcaagagtccgatgtcatggttggacccttcaaacttcggagcaggaagcaacgaaccctgtcaatgatagaagaagagattcgagctgctcaggagcgggaagaagagctcaagcgacagaggcaggtcctccagtcaacccagtccccccgcacaaaaaatgcaccaagtcttccatcaagaacctgctacaagactgctccgggaaagattgaaaaggtgaagcctcccccatccccaaccacagaagggcccagcctgcagccagacctagcacccgaagaagccgcagggacgcagcgcccaaagaacttaatgcagacccttatggaagactatgagacccataaaagcaagcggagggagcgaatggatgattcatcctatacatctaaactcctcagctgcaaagtgacttcggaagtattagaggctacgagagtcaacagaagaaagtccgcactcgccctaagatgggaggccggcatctatgccaatcaggaggaggaggacaatgaatag

SEQ ID NO: 31797 - DNA, 1302 bp, Artificial Sequence
  Description of Artificial Sequence: Synthetic coding sequence
atggctgaagctgaactgcataaagagcggcttcaggccatagcagagaaaagaaaacgccagactgagatagaaggaaaaagacagcagctggacgagcaaatacttctcctccagcactctaaatcgaaagtgctacgcgagaagtggttattgcagggaatccccgcgggaaccgccgaggaagaagaagcccgtcggaggcaaagcgaggaagatgagttcagagttaaacaactggaggacaacatccaaagactggaacaggagatccagaccctagagtctgaggaaagtcagatctccgctaaggagcaaatcatcctagagaagctcaaggaaactgagaagtcttttaaggacttccaaaagggtttttcttcaacagatggggacgccgtgaattacatatcctctcaactccctgacctgccaatactgtgctcccgcactgcagaaccttcaccagggcaggacggcacctcacgggcggccgctgtttacgcgatggaaatcaacgtggagaaggataaacagaccggagagacaaaaattctttctactagcacaattggccctgaaggagtgcaccaaaagggagtgaaagtttatgatgacggcacgaaggtggtgtacgaagtaagaagtgggggcaccgtggtcgaaaatggggtgcataagttaagcaccaaggatgtggaagaactaattcaaaaggccggccaatctagtctcgggggcggccacgtatcggagagaaccgtgatcgctgatggtagtcttagccatccaaaagaacacatgctttgcaaagaggctaagctggaaatggttcacaagtcccgaaaggatcactccagcggaaatcccggacagcaggcacaggcaccttccgctgccggaccagaggcgaacctagatcaacccgtcacgatgatattcatgggctatcagaacattgaggatgaggaggagactaaaaaagtgctgggatacgacgagaccattaaagctgaattggttctgattgacgaagacgacgaaaaaagccttcgcgagaaaacggtgactgacgtcagcaccatcgacggcaacgctgcagagctagtgtctggccgtccagtcagcgatacaactgaacccagctcccccgaaggcaaagaagagtcccttgcaacagagcccgcccccggcgtcggctgggagaatgtgctcctcaaagagggagagagtgcctcaaacgctactgagacctcgggccccgacatgactatcaagaaacccccccagctatctgagtag

SEQ ID NO: 31798 - DNA, 1404 bp, Artificial Sequence
  Description of Artificial Sequence: Synthetic coding sequence
atgctgatcttttggaccattaccctctttctgctgggggccgccaaggggaaggaggtttgctacgaagacctgggctgcttttcagataccgagccatggggcgggacagctatccgacccctgaagattctaccttggagtcccgaaaaaatcggaactagattcttgctgtacactaacgagaaccctaacaattttcagattctgctgctgtctgatcccagcaccattgaggcatctaactttcagatggacagaaagacccggtttataatccacgggttcatcgataagggagacgaatcttgggtgaccgacatgtgcaagaaactgtttgaggtggaagaggtgaattgcatttgcgtggattggaagaaagggtcccaggcaacttatactcaagccgcaaacaacgttagggtcgttggcgctcaggtggcacagatgttggacatcctcctgacagagtactcttaccctccctctaaggtgcacctcatcgggcactccctaggcgcccacgtagctggcgaggccgggagcaaaactcctgggctgtctagaattacaggcctggatcccgtggaggcttctttcgagtctacgccggaagaggtgaggctggacccgtccgatgccgatttcgtagacgttattcacactgacgcagcacctctgatccccttccttggttttggaacaaatcaacagatggggcacctggacttctttccaaacggcggtgaatcgatgccaggatgtaagaagaacgctttgagtcaaatcgtggacctggatggcatctgggcgggaacaagagatttcgttgcttgtaaccatctaagatcttacaagtattacttggaatcgatcctgaacccagacgggttcgctgcatatccatgcacatcctataagagttttgaaagcgacaagtgttttccttgtccagatcaagggtgcccccagatggggcactacgctgataaatttgccggcagaactagcgaggagcaacagaagttctttctcaacacaggcgaggctagtaacttcgctcgctggcggtacggcgtgtctatcactctgagcggcaggactgcaacaggacaaattaaggtcgccctattcggcaataaaggtaatactcaccagtactccatattccgtgggatcctgaagcccgggtccacacactcctatgaattcgacgctaagctggatgttggaaccatagagaaagtgaagtttctgtggaacaataacgttataaaccccacccttcccaaggtaggggctaccaagatcacagtccagaagggggaagaaaagacagtctataacttttgcagcgaggacacggtacgtgaagacacgttgctgacactgacgccctgttag

SEQ ID NO: 31799 - DNA, 1407 bp, Artificial Sequence
  Description of Artificial Sequence: Synthetic coding sequence
atgttgcccccatggacccttggcctcctgcttctggccacagtccggggacggaaggtctgctatgggcagcttggctgttttagtgatgagaagccttgggcgggtacactgcagaggccagttaaattgttaccctggtcaccggaggacatagataccagattcctgctctacactaacgagaatcctaacaactttcagttaatcacagggaccgagcccgatactatagaggcctcaaacttccagcttgatcgcaaaacaagattcattatccacggattcctcgacaaggccgaagattcctggccatccgacatgtgcaaaaaaatgttcgaagtcgagaaagtgaattgcatttgcgtggactggcgacatggaagcagagctatgtacacccaagcagttcagaacatccgggtggtaggagcagagaccgccttccttatccaggcactgagcacacagctcggatacagcctggaggatgtccacgtgattggccattccctgggggcacacacagccgcagaggccggccggagactgggggggagagtgggcaggatcacgggattagaccctgccggcccctgttttcaagatgagcctgaggaggtacggttggacccaagtgacgcagtgtttgtagatgtgatccacacagattcctcccccatcgtgccttcactgggctttggtatgtcacaaaaggtgggtcacctggactttttcccaaatggcggaaaagagatgcctggttgcaaaaagaatgttcttagcactataacagacatcgacgggatctgggaaggcatcggtgggttcgttagctgtaaccacctccggagcttcgagtactacagctccagcgtcctcaaccccgatggctttttggggtatccatgtgccagttacgatgagtttcaggagagtaaatgcttcccgtgccctgccgaggggtgcccgaagatggggcactatgcagaccagttcaaaggcaaaacctcagctgtcgagcagaccttttttctcaatacaggtgaaagcggaaactttacttctaaatacaaaatcagcgtgaccttgtcaggaaaggagaaagtcaacggatatattaggattgccctgtatggctccaacgagaattcaaaacaatacgaaatcttcaaaggcagcctcaagcctgacgcctcccacacatgcgctattgacgtcgatttcaacgtcggcaaaattcaaaaggttaaattcctatggaataagcgaggtatcaacctttccgaacctaaactgggagcctcccagatcacggttcagagtggcgaggacggcacagagtacaatttctgctcaagcgataccgttgaagagaacgtcctccaatctttatatccctgctag

SEQ ID NO: 31800 - DNA, 423 bp, Artificial Sequence
  Description of Artificial Sequence: Synthetic coding sequence
atggccgccatcccgagctcaggaagtttggtcgctacacacgattattaccgtcggcgccttggaagtacttccagtaattcttcttgctcgagtacagaatgccccggggaagctattccacatccccctggtgagtgccgtatcgccccgttcagtccaaggagctctaggtcctggcagcaccaggatcctacaagcctcttgagtgggctacctaaagcagacccaggtcattggtgggcaagctttttctttggtaagtccactctcccattcatggcgacggtgctggagtccgcggagcacagcgaaccaccgcaggctagttcaagcatgacggcctgcggtctcgcaagagacgcaccccggaagcagcctgggggccaaagctccacagcttcagccggaccaccatcctag

SEQ ID NO: 31801 - DNA, 213 bp, Artificial Sequence
  Description of Artificial Sequence: Synthetic coding sequence
atggcggccattccctcttccggaagtctcgtggccacccatgactactaccggcggcgtttgggctctacctcgtcaaatagctcatgctcatccacggagtgccctggcgaagcaatcccacatccacctgggctcccaaaggctgacccgggccactggtgggcaagttttttttttgggaaaagtactctcccccctccaacactatag

SEQ ID NO: 31802 - DNA, 345 bp, Artificial Sequence
  Description of Artificial Sequence: Synthetic coding sequence
atggcggccatcccatcatccggatccctggttgccacacacgattactaccgaagaagactcggaagcacttcaagtaattcatcttgttccagtacggagtgtccaggcgaggctattccacaccctccaggtttgcctaaagcagacccaggccactggtgggcttcctttttctttgggaaatcgacccttccctttatggctacagtgctagagtcggccgagcacagcgagcccccacaggcctcaagtagcatgactgcctgcggactggcacgggatgcaccaagaaagcaacctggcggacagtcttcgacagcctctgcggggcctccatcctag

SEQ ID NO: 31803 - DNA, 1860 bp, Artificial Sequence
  Description of Artificial Sequence: Synthetic coding sequence
atgtatcgtagtggagagaggcttttagggagccatgccctccccgctgagcagagagacttcctgccactcgaaaccaccaacaacaataacaatcaccatcagcctggcgcctgggctagacgagctgggtcgtcagcaagcagccccccaagtgcatcgagctcgccacaccctagcgcagccgtgccggccgctgaccctgccgattcagcttctgggtcaagcaataagcgaaaacgtgataataagccaagtggcggccgggcagccggtgggggtcgcgcagacggcgggggagttgtgtattctggcacaccttggaaaaggaggaattacaatcagggagttgtgggactgcatgaggagatctcagacttctacgagtatatgagccctcgccccgaggaagagaaaatgcgaatggaagtcgtgaatcgaatcgaatcagtcattaaggaactgtggccctccgctgatgttcaaattttcggctccttcaagactgggttgtatctgccaacgtcggacatcgatctggtggtttttgggaagtgggaaaatctgcccctatggaccctagaagaagccctgagaaagcataaggttgctgatgaagactctgtgaaggtcctggacaaggctactgtccccatcatcaaactcacggactcgttcacagaagttaaggtggatatcagctttaacgtacaaaatggagtgcgtgcggcagacctcatcaaagacttcaccaagaaataccccgtgctcccgtatctggtgctcgtgcttaagcaattcctgctgcaaagggatcttaacgaagtgtttaccggcggtataggctcctactcactgtttttgatggcagttagttttttacagctgcatccacgggaagatgcttgtattccaaacacaaattatggagtgttactgatagaattcttcgaactatacgggcgtcactttaattaccttaagacggggatccgcattaaagacggcgggtcttatgtggcaaaggatgaagtgcagaagaatatgctggacgggtataggcccagtatgctgtacattgaagacccgcttcagcccggaaacgacgtgggacgcagctcttatggcgcaatgcaggtgaaacaggcctttgattatgcgtatgtggtcttgtcacacgcggtgagtccgatcgccaaatactaccctaataacgagaccgaatccattctgggccgtatcattagagtcactgatgaggtggccacctaccgggattggatttctaagcagtggggcctgaagaacaggccggagccctcctgtaatggaaacggtgtcacactcattgtggatacgcagcagctggataagtgtaacaataaccttagcgaggagaatgaagccctgggcaagtgccggagcaaaactagtgaaagtttaagcaaacattccagtaacagtagttctggacccgtaagttcatccagcgcaactcagtcctcctcgtcagacgtcgactccgatgccaccccatgtaagaccccaaagcagctactctgccgccctagcactggcaatagggtcggctcacaggatgtgtccctcgaatcttcgcaagcagtaggcaagatgcaaagcacccagaccactaacacctccaactctaccaacaagtcacaacacggttcagctcgtttgttcagatcaagcagcaaaggcttccagggcacaacccagacatcacatgggtccctaatgaccaacaagcagcatcagggaaagtcaaacaatcagtattaccacggaaaaaaacggaaacacaagagggacgcccctctgagtgacctttgccggtag

SEQ ID NO: 31804 - DNA, 2097 bp, Artificial Sequence
  Description of Artificial Sequence: Synthetic coding sequence
atgaggcctcggccaaggagcgcccctggtaagccacgcaggaggtcccgggcacgccttaggtcttcccgcacaccctcaggcggtgcatctggtgggggggggagctcctctagctccagcacagctaccggcggcagcggtagtagcactggatctcccgggggggcagctagcgcccctgcccccgcccctgccgggatgtatcgtagcggagagcggcttctgggcagccacgccctgcctgctgagcagcgtgatttcctgcccctcgagactacaaataataacaacaaccaccaccaaccaggggcctgggcgcgcagagctggctcttccgccagttccccccccagcgcttctagctctcctcacccctccgcggcagtcccggcagcagatccagccgactctgctagtggaagctccaacaagcgtaagagggacaataaagccagcacgtacgggcttaattactctctgctacagccgtctggggggcgggcagccggcggaggtcgcgcagatgggggtggtgtcgtttattctggcacaccttggaagcgcagaaattacaaccaaggggtcgtgggcctccacgaagagataagcgatttctacgaatacatgagtcccaggccagaggaagagaagatgcggatggaagttgtcaaccggattgaaagcgtaattaaagaattatggccaagcgccgacgtgcagatattcggcagtttcaaaactggcctgtacctccctacctccgatattgatttagtcgtgttcggcaaatgggaaaatctccctttatggacactggaggaagcactgcgaaaacacaaagtagccgacgaggatagcgttaaagtgctggataaggctacagtgccaatcataaagctgactgatagtttcaccgaggttaaggtcgacatctccttcaatgtgcagaacggcgttcgagctgcggatctgatcaaagacttcacaaaaaagtaccccgtgctcccgtatctggtactggtgctgaaacagttcctactgcagagagatctgaacgaagtctttaccggaggtattggctcctattcacttttcctcatggccgtttcttttctccagctgcacccccgagaagatgcatgcatccctaatacaaattatggagtgctgctaatagagttcttcgagctatatggcagacatttcaactacctgaaaacggggatcagaatcaaggacgggggatcctacgtggcgaaggatgaagtacagaaaaatatgttagatggatatcgcccttcaatgctgtatatagaggatccattgcagcccggtaacgatgtgggtcgtagctcatacggcgccatgcaggtcaagcaggcttttgattacgcctatgtcgtattgtctcacgccgtatcaccaatcgccaaatactaccccaacaatgaaacagaaagcatcctgggccgaatcatcagagtgacagatgaagtggccacctaccgagattggataagcaagcaatggggccttaagaatcgccctgagccgagctgtaatggtaatggagtgacgctgatcgtggatacgcagcagctggacaaatgtaataacaacctctcagaggagaacgaggcgctggggaagtgccggtctaagacaagcgaaagtcttagcaaacactcgtctaactctagctcaggccccgtatctagctctagcgccacacaaagcagtagttccgacgtggactcggatgccaccccttgcaagaccccgaaacagctgctgtgcaggccatcaaccgggaaccgcgtggggtcacaggacgtgtcccttgagtccagccaggcggtaggaaaaatgcagagtacacaaactactaacacaagcaattcaacaaacaaatcccaacatggcagcgcaaggctctttaggtcctccagcaaaggcttccaggggacgacacagacaagccacggatccctcatgacaaataagcaacaccagggcaagtcgaacaatcagtactaccacggcaaaaaaagaaagcacaagcgggacgctccactcagtgatctgtgccgctag

SEQ ID NO: 31805 - DNA, 522 bp, Artificial Sequence
  Description of Artificial Sequence: Synthetic coding sequence
atggatatcgaaaaggtcaacagcatggatctcggtgaatttgtcgacgtatttggcaatgctactgagcgctgcccactgattgccgcagcggtgtggtcacagcgacccttcagcgatcttgaggatctggaaaaacacttttttgcttttatcgacgctcttgcccagtctggccaggaaggaattttgagatgccacccagatcttgcaggatctgagctccagaggggcactctgactgcggagtcacagcgggagcagtccggcgccgggctgcgaagcctcggggccgacgagcgtctgaggctggccgagctgaacgcacaatatcgtgcgcggtttgggttcccttttgtgttagcagcaaggttctctgaccgcaccgcagtgccgcgggaacttgcacgtcgattgctgtgtccctccgcccaagagttacgcacagcactgggtgaagtgaaaaaaatcgggagcctgcggttggccgacttgttgcgagctgatccagcaaaattatag

SEQ ID NO: 31806 - DNA, 2022 bp, Artificial Sequence
  Description of Artificial Sequence: Synthetic coding sequence
atggctgagtcctccttgtaccgacaacgccttgaggtgattgctgagaagcggcggttgcaggaggaaatcagagcagccaggcgcgaggtggaggaagagaaactgagggtggaacgcctcaaacgcaagtccctgagggagcgctggctcatggacggcgctgcagccgtgcctgaaccctcagaagacccgacgagcaaggacccacagagtcctgaaggtcaggcccaagcccgaatccggaacctcgaagacagcctatttacactacagagccagctccagctgctgcaaagcgccagcaccggcgcgcagcacaagccgtctggaagacccagctggagaaggcagggccaccgcccattgtctcaaagcattgtcgaagccggctctgtggggcagacagacctgaacaagcgtgcatctctgcctgccggattggtagggacaccccccgaatctccttctgagcccagagaggatgtcctcggcttcctgcctggccctaggcaggtgcctggagctgcaggagatagcagcgaggcaaatgggccctgtcccagtcccatccccactccggaacaaggactttctcaacgcgcagtgccaagtgagggaagggtgggcgaagccaagggcggtggtgtggtttctgtggtttgggagggcttacgggctacagaggactgtgccaccggggcaactgggcctgaactggaggctaaggtggaggaggtggtcctggaagccatcggcgataggaaaggggccggaagtctggaactcccagcctgggtaaaggaagatcgcggtatcgtggaggtagtgtgggagggggttgggggctccgatgctgaagccatgggggaaattggacgcgttcccgaagtcgttcaaacatcttctccccgacttcaggagaggctggaggccgccgctagtattgaaggcgaggatgtgccacagggatcaccagaaggtgatggacagggcgggagtggcggggaggagggctccttcatctgggtggagagggtgaccctttccgaagagtgggaggaacttctcgtggagggactggaaggtcctgaggtcgccggccgggagcgcggcgacgagagtcccctcggcgccgagggcgccaaaactggaggcggcgaagaaacttgggaagccgaaaagcggaaagcagaggagtcaatggggatcggatctgaggaaaaacccggcaccggcagagatgaggccgagatgagccctgtggtggagagaaaagggggcgagaagaagttggaactggaatccagagggagcgccgaaaagctcggaacagaaagagagggtggagaagaacctttgggaatcgagcgtaaggtggaaggccacctgcgagcagagaaagagggcgacgaagagaaacgtggcgccgaggaggaggaggtcgaagaaccactcggtgtcgagaaaaaaggcggggaagaggaaccagaagctacaaaggaacccctcgaggccgaacgcaaaggcggggaggagacactggaggcagagaaacggggcggcgaggagtctctcgagactgagaagacacaggggactgagggcgatctgaacctggagcagggtagcagagaaggaagtgagtcccaagcagaagagatgaacgaagcgggtccacccctggaggccaacacggagactcgtcccgagaaagagggcccacagccgcaggagaagccggtgggagctctggaggaggaaggagtgaaaccacagactgccgccgaaggtcagggaccactaggcgatgctacacccttgcttgctgagacccctgccccagaacagccagcagaatgccaacctctgctgcagggggagggcccatccgccaatccgtcggcgcaccctgttcccacgtacgcacccgctagacagcctgagccatctgctcccacagaaggagaggaggccagcgggcctaagcaaaagacctgccaatgctgcgctgtgatgtag

SEQ ID NO: 31807 - DNA, 1347 bp, Artificial Sequence
  Description of Artificial Sequence: Synthetic coding sequence
atggccttgactctgcttgaagactggtgcaagggcatggacatggacccgagaaaagccctgctcatcgtcgggatcccaatggagtgttctgaagttgaaatccaggacactgtgaaagcgggcctccagcctttgtgtgcctaccgtgtactcggaaggatgtttcgccgcgaggataatgccaaggccgtcttcattgagctggcagacacggttaattatactactctgccctcccatattcccggcaagggaggctcgtgggaggtcgtcgtcaaaccgcgaaatcctgacgatgaatttctatcccggctgaattacttccttaaggacgaaggtcgaagcatgacggacgttgcgcgagccctgggctgctgctccttgccggccgaatctctggatgctgaagtgatgcctcaggttcgaagccctccattagaaccaccgaaagaaagtatgtggtatcgaaaactgaaggtcttttccggaacagctagcccctctccaggagaggagacttttgaggactggctggagcaagtgaccgagattatgcccatctggcaggtgagcgaagtcgagaagagaaggaggctgcttgagagccttcgcgggcctgccctgagcatcatgcgagtgctgcaggctaacaatgacagtatcaccgttgagcaatgtctggacgcacttaaacagatcttcggcgataaagaggacttccgggcttcacagttcagattcttacaaacatctcctaaaattggagaaaaagtatccaccttcctcttgcggctggagccactgctgcagaaagccgtgcataaaagccccttgagcgtccgtagtaccgatatgatccgcttaaaacacctgcttgctcgagtagccatgacacccgctctgcggggcaagttggagctgttggatcagagaggatgccctcctaactttctcgaactgatgaagttaatcagggatgaggaggaatgggaaaacactgaggccgtgatgaagaataaagaaaagccaagtggaagaggacgcggagctagcggacggcaggcacgggccgaagctagtgtctctgcgcctcaggccaccgttcaagcccgcagcttttctgattcctccccccagacaatacaaggcgggctccccccgctggtgaagagacggcgtctgctaggatcggaaagcaccaggggcgaagatcatggccaggccacctatcctaaagccgagaatcagacccccggtcgggaaggcccgcaagccgccggggaagaattaggtaacgaagccggcgctggcgccatgagccatccaaagccttgggagacgtag

SEQ ID NO: 31808 - DNA, 423 bp, Artificial Sequence
  Description of Artificial Sequence: Synthetic coding sequence
atggccctcacactgcttgaagattggtgtaaagggatggacatggatccccggaaggccctcctgattgtcggcatacctatggaatgttccgaggtagagatccaggacaccgtcaaagctggcttgcagcctctctgcgcgtatagggtgctggggaggatgttcagacgtgaggacaatgcaaaggccgtttttattgagctcgctgatacagtcaactacacaaccctaccatcgcacattcctggaaaggggggctcatgggaggttgtcgtaaagccgcgaaatcctgatgacgagtttctcagtagactgaattactttcttaaggatgagggacggagcatgaccgacgtggctcgggccctgggctgttgcagtctgccagcagagtctctggatgccgaagttatgccgtag

SEQ ID NO: 31809 - DNA, 1347 bp, Artificial Sequence
  Description of Artificial Sequence: Synthetic coding sequence
atggcactgactctgctcgaggactggtgcaaaggtatggatatggaccccagaaaggccctgctcatagtcggcattccaatggaatgcagcgaagtggaaatacaggacaccgtgaaagctggacttcagcctctctgtgcatacagagtgttaggccgcatgttcaggcgggaggataatgccaaggctgtctttatagagctggcggatactgtcaactatactactttgccgagtcacattccaggcaagggcggatcttgggaggtggttgtgaagccccgcaaccccgacgatgagttcctctctaggttgaattattttttaaaagacgaaggcaggtctatgactgacgtagcaagagcactgggatgttgctcactccccgctgagtccttggatgcagaggtcatgccgcaagttagatctcctcccctggagcctcctaaggaatccatgtggtacagaaaattaaaggtgttctccggaactgcctcgcctagccccggcgaggagacctttgaggactggctggaacaggtcaccgagataatgccaatttggcaggtgtcagaggtcgagaaacgcagaagattacttgagtctcttaggggcccagctctgtccatcatgagggtgcttcaggccaataacgacagcatcactgtggaacaatgcttggatgctctgaagcagatctttggagataaagaagacttccgggcttcgcaatttaggttcctgcaaacttctcctaagattggtgagaaggtgtctacgtttctgttacgcttagagccattgctgcagaaggcagtacacaagtctcctctctccgtgcgctccaccgacatgattaggctgaaacatctgctcgctagagtagccatgacgcctgctctacgcggaaaactggaactcttagatcagagaggatgcccaccgaatttcctggaattaatgaaattaattcgagacgaggaggaatgggaaaacactgaggcagtaatgaagaataaggagaagccgtcgggccggggtcgcggggccagcggtagacaggcccgtgccgaagctagcgtgagcgcgcctcaggccactgtgcaggccaggtctttctcagactcctctcctcagaccatccagggtggattgcctcctctggtgaaacgacgcagattgctgggatccgaatccacacgaggtgaggaccacggccaggctacctacccaaaagccgaaaatcagacaccgggccgagaagggcctcaagccgcaggtgaggagctcgggaacgaggccggtgcaggagccatgtcccatcccaaaccgtgggaaacgtag

SEQ ID NO: 31810 - DNA, 1347 bp, Artificial Sequence
  Description of Artificial Sequence: Synthetic coding sequence
atggctctgacattgctggaggactggtgtaagggtatggatatggacccccgtaaggcacttctgatagttgggattcccatggagtgctcagaggttgagatccaagacaccgttaaggccggcttacagcctctgtgcgcataccgggtcctgggaaggatgtttcgtagagaagacaatgcgaaggccgtatttattgaactcgcagacacagtgaactacactaccctcccttcacacatccccggtaaaggcggaagttgggaggtggtggtaaagcctaggaatccggacgatgagttccttagccggttaaattactttctcaaagatgaaggacggtcaatgacagatgtagcaagagctcttggttgttgcagcttgccagcggaaagcctggatgcagaggtgatgccacaggtgcggagccctccacttgagccccccaaggaatccatgtggtatagaaaattgaaagtgttcagtggaacagcatctcctagcccgggggaagagaccttcgaggactggcttgagcaggtgaccgagattatgcccatctggcaggtctcagaagtggagaagcgaagacgcctgctggaatcgctgcggggaccggctctctccatcatgagagtcctccaggctaataacgattctattactgtggagcagtgccttgatgcactgaagcagatctttggagataaggaggatttccgcgctagccagttcagatttcttcagacaagtcctaagattggagaaaaggtaagcaccttccttctccggttagaacccttgttacagaaggccgtgcataaatcccctctgtccgttcgatctacggatatgattagattgaaacacctcctggcaagggtcgcgatgacacccgcgctccgcggcaagttggaactactggaccaaagggggtgcccacccaatttcttagagctgatgaagctcatccgcgacgaagaagaatgggaaaacaccgaggcagtcatgaagaacaaagaaaagccaagcggccgtggtcgcggcgctagcggaagacaggcccgagctgaagcatctgtctcagctccacaggccaccgttcaggccagatccttcagtgactcctctccgcagacaattcaaggcggactgcccccactggtgaagaggaggcgacttctggggtccgagtcaaccagaggcgaagaccacggtcaagccacctacccaaaggccgagaatcaaaccccagggagggagggcccgcaggctgccggagaggaactgggcaacgaggccggggccggagctatgagccatcctaaaccgtgggagacgtag

SEQ ID NO: 31811 - DNA, 1347 bp, Artificial Sequence
  Description of Artificial Sequence: Synthetic coding sequence
atggcactgaccctcctggaagactggtgtaagggtatggacatggaccctcggaaggccctgttaatcgtggggattcccatggaatgctctgaagtcgaaatccaggacactgtgaaagcagggcttcagccgctatgcgcctacagagttcttggcagaatgttcagacgggaggataacgccaaggccgtgttcatcgagcttgcggatactgttaactatacaacacttccctcacacatcccaggcaagggggggtcctgggaagtggtggtgaagccaagaaatccggatgatgaatttctgagccgcctgaattacttcctgaaggatgaaggtagatctatgactgacgtagcacgggctcttgggtgctgttccctccctgccgagagcctggatgccgaagttatgccccaggtgcgcagccctcctcttgaaccccccaaggagtctatgtggtaccgtaagttaaaagttttctcaggtacagcctcacccagccctggggaagaaacttttgaggattggctcgaacaggttaccgagatcatgccaatttggcaggtgagcgaagtagagaaaaggcgccggctgttggagtctctccgcggccccgctctgtctattatgcgggtgctgcaggccaacaacgatagcattaccgtggagcagtgcttggacgcattaaagcaaatctttggcgataaggaggacttccgcgcctctcagttcaggttcctgcaaactagccctaagattggtgaaaaggtgtctacctttctactcaggctggaaccactcctgcaaaaagccgtccataagagtccccttagcgtgcgaagtacagatatgatccgcctcaaacatttactagcccgcgtggcaatgactcctgcgctcagggggaaactggagttgctcgatcagcgcggctgccctccaaacttcctggagctgatgaagttaattcgggatgaggaggagtgggagaacacggaagccgtgatgaagaacaaggaaaaaccgtctgggaggggcaggggggcctctggaaggcaggccagggcggaagcgtctgtgtccgctccacaggccacagtccaggcaagaagtttcagcgattccagtccccagactatccagggtgggctgcctccattagttaagcggagacggctgcttggttccgagagcacgaggggcgaggaccacgggcaagcaacttaccccaaagcggaaaatcaaacacctggcagagagggaccccaagccgctggtgaggagttaggaaacgaagcgggggccggcgccatgtcccacccgaagccatgggagacctag

SEQ ID NO: 31812 - DNA, 1200 bp, Artificial Sequence
  Description of Artificial Sequence: Synthetic coding sequence
atggcagtgacaatgctccaggattggtgccgatggatgggggtgaacgcccggcggggcctgctgattttggggataccagaggactgcgacgacgcagaattccaggaaagcctggaggcagctttgcgcccaatgggccactttaccgttttgggaaaagtgtttcgtgaagaggacaacgccacggcagccctggtggaacttgacagagaagtgaactacgctctcgttccccgggagattcctgggaccggggggccatggaatgtggtcttcgtgccccggtgttccggtgaggaatttctgggcttgggacgggtcttccatttcccggaacaggaaggtcagatggtggaaagtgtcgccggagcactcggggtcggtttacggcgcgtgtgctggctcaggtccatcggccaagcggtccagccatgggtcgaggccgtccggtaccagagcctaggcgtttttagcgggagagaccagcctgcacctggggaggagagctttgaagtgtggttggaccacactacggagatgctacacgtgtggcagggggtcagcgagcgagagcggaggcggcggttgcttgagggccttcgaggcacagcgctgcagctggtgcacgccctgcttgccgaaaacccggcccgaacagctcaagattgcctggctgctttggcccaggtgttcggcgacaacgagtcgcaggcaacgattcgagttaaatgcctgactgcgcagcaacaaagcggtgaacggttgtctgccttcgtgcttcggctcgaagtgttactacagaaggccatggaaaaggaggccctggcccgagcttctgcagatagagtcaggctgagacaaatgctgactcgcgcacacctgaccgaaccactggatgaagcattgcgaaagctccgcatggccggcaggtcaccttcattcctggaaatgctaggcttggtacgagagtccgaggcgtgggaggcctcactggcaaggtcggttcgtgcgcagacacaagagggtgccggggccagagccggggcgcaggctgtcgctcgagcttctaccaaagtggaggcagtaccaggtggtcctggacgcgagccagaaggcctaagacaggccggcgggcaggaggcagaggagcttctgcaggagggcctaaagcctgtcctcgaggagtgcgataactag

SEQ ID NO: 31813 - DNA, 1200 bp, Artificial Sequence
  Description of Artificial Sequence: Synthetic coding sequence
atggccgtgacaatgctgcaggattggtgcaggtggatgggagtgaatgcgcggcgaggcctcctcatcttaggcataccagaagattgcgatgacgcagaattccaggaaagtctagaagcagccctgcgcccaatgggccattttacagtgctgggcaaggtattcagagaagaggataacgccacagccgcacttgtggaattggaccgggaggttaattacgcacttgtgccccgcgaaatccctggtaccggcggcccgtggaacgttgtgttcgtccctcgctgttccggcgaggagtttctggggctggggagggtgtttcattttcctgagcaggaaggccaaatggtcgaatccgtagccggcgccctcggtgtaggtctgaggcgggtgtgctggctgcggtcgatcggccaggcagtccagccctgggtggaggctgtgcggtatcagtcactaggagtgttcagtggtagagatcagcctgctcctggagaagaaagtttcgaggtgtggttggaccacaccaccgagatgctacacgtgtggcagggggtgagcgagcgggagagaagaaggcggttgctggaaggcctgcgggggaccgcgctgcagctcgtgcacgcactgctggccgaaaacccagcccgcacggctcaggactgcctggctgcattagcacaggttttcggtgacaacgagtcgcaggccaccatacgcgtgaaatgtctgactgcccagcaacagtccggggagcggctgtctgccttcgtgttgagactagaagtcctgctccaaaaggctatggaaaaagaagccttagcccgtgcttccgcagatcgcgttaggcttcgacaaatgcttacaagggcacatttgaccgagcctctggatgaagccctacggaaactgcgaatggctggccgatctccatcctttttagaaatgctgggcctcgtgagggagtccgaagcctgggaggcgtctctagcgcgctcggtgcgagcacagacccaggagggcgccggggccagagcaggggcccaggcagtggcccgcgcctcgaccaaggtggaggccgtgcccggtggcccaggtcgggagcccgaggggctgaggcaggcaggggggcaggaagcagaggagctgctccaggaaggcctcaagccagtcttggaggagtgtgataattag

SEQ ID NO: 31814 - DNA, 1200 bp, Artificial Sequence
  Description of Artificial Sequence: Synthetic coding sequence
atggccgtcaccatgcttcaagattggtgcaggtggatgggcgtgaacgcccgccggggcctcttgatacttgggattcccgaagactgtgatgatgctgagtttcaggaaagtctggaggcagcccttcgcccgatggggcattttactgtactaggtaaggtttttcgggaggaagacaacgcgaccgccgcactggtggagctcgatcgtgaagttaattacgctctggtgccgagggaaatcccaggaaccggaggcccttggaacgtggtcttcgtccctcggtgctctggcgaggagtttctgggccttggccgtgtatttcatttccccgagcaggagggacagatggtggaaagcgtcgcaggcgccttaggggtcggcctgcgacgcgtgtgctggctgcggagcatcgggcaagcggtacagccctgggtagaagctgtgcgctatcagtctctcggagtgttttcaggtcgcgatcagcccgcccctggcgaagaatctttcgaggtatggctggaccacactacggaaatgctgcacgtctggcaaggtgtgtctgagcgggaacggagacggcgcctccttgaaggcctccgcggtacggccctgcagctggtccatgcccttttggccgaaaatcctgccagaaccgcccaagattgcctggcagcccttgcacaggtgttcggggacaatgaaagccaggcgacaattcgcgtgaaatgcctcacagctcagcagcagagtggcgagagactgtccgcttttgtgctccggcttgaagtgcttctccaaaaggctatggaaaaagaggctctggcaagagccagtgccgatcgtgtgaggctgcgacagatgctgaccagagcccatctcacagaaccactggacgaagcacttcgaaagcttagaatggccgggagaagcccctcattcctggaaatgctgggattagtcagggagagcgaggcctgggaagcatccctggcccggtctgtgagagctcaaacccaggaaggagcaggagcgagggcaggcgctcaggcagtggctagggctagtactaaagtcgaggccgtaccggggggccccggaagagagccagaaggtctgaggcaagccggagggcaggaggccgaggagctgttacaggagggcctgaaacctgttctcgaagagtgtgataactag

SEQ ID NO: 31815 - DNA, 1200 bp, Artificial Sequence
  Description of Artificial Sequence: Synthetic coding sequence
atggccgtcacgatgctccaggattggtgccgctggatgggggtgaacgccaggcggggccttctaatcctgggcatccccgaagactgcgatgacgccgagtttcaggagagcctcgaggccgctctgcggccaatgggacacttcaccgtcctgggaaaagccttcagagaagaggataacgctacagccgcccttgttgaactggaccgggaagtgaattatgcattagtgcccagggaaatccccgggaccggtggaccctggaacgttgttttcgtgccccgctgtagtggagaggaatttcttggcctgggacgagtcttccacttccccgagcaggagggtcagatggttgaatctgtggccggtgcactcggggttggccttcggcgggtttgctggctgaggagcattggccaggcagtgcagccgtgggttgaagccgtccggtgtcagagcctcggtgtgttttccggtcgtgaccagcctgcacccggagaagagtcctttgaggtgtggctggatcacaccactgagatgttgcatgtttggcagggtgttagcgaacgggaaagaagaaggcgattactagaaggcctcagaggaacagcgcttcagctcgtgcatgctctattagccgaaaacccggcccggactgcacaggattgcctcgccgccctggcccaagtatttggagacaacgagtcgcaggccacgatccgagtgaagtgtctgacagctcagcagcagtccggagagagactgtccgcgttcgtcttgcgactagaagtcttgctccagaaggccatggagaaggaagccctggctcgcgccagcgcagaccgtgtgcgactgagacaaatgctgacccgggctcacctgacggagccccttgacgaggctctgcggaagctgcgcatggccggccgttctccaagctttctagaaatgctgggactggtgagagaatcagaagcctgggaagcctcgctcgctcgttccgtgcgcgcacagacccaggaaggcgcaggagcccgcgcaggagcccaggccgttgcacgggccagcactaaggtggaagccgtgcccggcggccctggccgagaaccagagggattactccaagccggtgggcaggaggccgaagaactgctccaggaaggactgaagccagtgctggaggaatgtgacaactag

SEQ ID NO: 31816 - DNA, 1200 bp, Artificial Sequence
  Description of Artificial Sequence: Synthetic coding sequence
atggccgtcacgatgttgcaggattggtgccgatggatgggagtaaatgctaggcgaggcctccttatccttgggattcctgaggattgcgacgacgccgagttccaagaatccttggaggctgccttacggcctatggggcactttacagtgctaggaaaggctttccgggaggaggataatgctactgcagcgcttgtcgaacttgatagggaagtgaactacgcgctcgtcccgcgagaaattcctggtactggagggccttggaacgtggtgttcgtaccaaggtgctcaggggaagagttcctaggcctaggccgagtgttccatttccccgaacaggaaggtcaaatggtggaatccgtcgctggagctcttggagtgggattgaggagggtttgctggctgaggagtataggccaagcagtgcagccctgggttgaggcagtgagatgccaatctttgggcgtcttttcaggcagagatcaacctgccccaggcgaagagtcatttgaggtctggcttgatcacaccactgaaatgctgcacgtctggcaaggggtgtccgaaagagagcggcgtcgccggttactcgagggactcaggggcacggccctgcagctcgttcatgccctgttagcagagaaccctgcacggactgcacaagactgcctcgctgcacttgcccaggtgtttggcgacaatgagtcccaggccactattcgagtcaaatgtctgaccgctcagcagcagtcaggcgagcgcctctccgcattcgttttgcgactggaagtcctgcttcagaaagcgatggaaaaggaagccttagctagagcctcagcagatagggtgcgattacgccagatgctgacccgggcacacctgaccgaacctctcgatgaggctctgcgcaaattgagaatggctggacgctcgccatcttttctagagatgctagggctggtaagggaatcagaagcatgggaggccagcctggcacggtctgtgcgcgcccagactcaggaaggggctggagctcgagcaggagctcaagctgttgccagggcttctactaaggtggaagcagtgcctgggggccctggacgagagcctgaggggttgctgcaagcaggcgggcaggaggctgaggagcttctgcaggaaggcttgaagccagtgctagaggagtgcgataattag

SEQ ID NO: 31817 - DNA, 1347 bp, Artificial Sequence
  Description of Artificial Sequence: Synthetic coding sequence
atggctctaactctgctggaggattggtgtaaaggcatggacatggacccaagaaaagcactgctgattgttggtatacccatggaatgcagcgaggtcgaaatccaggatactgttaaggccggactccagcctctctgtgcataccgggttttggggcgtatgtttagaagagaagacaatgccaaagccgtttttatagaactcgctgataccgtgaactatacgactttaccgtcccatatccctggaaagggggggagttgggaggtggtggtcaagcctcgaaatccagacgacgagtttctgtcgaggctgaactatttcctgaaagatgaaggtagatcaatgaccgacgttgccagggccttgggttgctgctcactgccagcagaaagcctcgacgccgaagtcatgccacaggtgcgatcacccccactggagcctcccaaagagagtatgtggtaccggaaattgaaggtgttttctggcacggcatccccgtcccccggcgaagaaacctttgaggattggcttgagcaagtcacagagatcatgccgatctggcaggtctccgaggtggaaaagcgccggagacttctcgaatcattaagggggccagccttgtcaatcatgcgggtcctccaggccaacaatgactcaattactgtggaacaatgcctggacgccctaaagcagatcttcggagataaagaggacttcagagcatcacagttccgcttcctgcagacctcgcccaaaattggagaaaaagtgtccacattcttgctgagactggaacctctcctccaaaaagccgtgcataaatccccactatctgtgcggagtacggacatgattcgcctcaagcatctcttagctcgggtggcaatgacgccagctttacgaggtaagctggagcttctggatcagcgtggctgccccccaaattttcttgagcttatgaagctcattcgcgacgaagaggaatgggagaacacagaagcagtgatgaaaaacaaagagaagccatcaggaaggggaagaggagcgagcggtcggcaggcgcgcgcggaggcgagcgtgagcgcgcctcaggcaacagtgcaagctcggagcttctcagattcttccccgcagaccatacagggaggcctgccacccttggtgaaaaggcgacgcttactgggctccgagtccactaggggggaggaccacgggcaggccacctatccgaaagctgagaaccaaacaccaggccgggagggcccccaagcagcaggagaagaacttggaaacgaggccggcgcgggagctatgtctcatcctaaaccctgggaaacttag

SEQ ID NO: 31818 - DNA, 1347 bp, Artificial Sequence
  Description of Artificial Sequence: Synthetic coding sequence
atggcactgacactgttggaggattggtgtaaggggatggatatggatcctagaaaagcattattgatcgtaggcatacctatggaatgctctgaagtggaaatacaagacacagtgaaagcaggcttgcagcccctgtgcgcttaccgagtgctgggccgcatgtttcggagagaagacaatgcgaaagctgtgtttatagagctggctgataccgttaattacaccaccctcccctcacacatccccggcaaaggcggtagctgggaggtggtggttaaaccaaggaacccagatgatgagttcttgagtaggctaaactactttctgaaggacgagggtcgatctatgacggacgtggcccgggctctcggctgttgttccctgcctgccgagtcgcttgacgctgaggtgatgccgcaggtgcgcagccctccactggagcctcctaaggagtcgatgtggtacagaaaacttaaagtcttctctgggacagcatcccccagccccggagaagaaaccttcgaagattggctcgaacaggtaactgagatcatgcctatttggcaggtcagcgaagttgaaaagaggcgtcgtctgctggagagcctgaggggccctgcccttagcatcatgcgcgtcctgcaggccaacaatgactctataaccgtggaacagtgcctggatgctcttaaacagatcttcggagataaagaagacttccgggcatcacagttcagattcctccagacctcgcccaagattggcgagaaagtatctaccttcctgttacgcctcgagcctctgctccagaaagccgtccataaaagcccactgtctgtccgtagtaccgatatgatccgattaaagcacctgctggccagagtggcaatgacaccagccctacgtggaaaactggagctgctagaccagcggggatgcccgccaaattttcttgaactcatgaaactcattagggacgaagaagagtgggaaaataccgaagcagtgatgaaaaataaggaaaaacctagtggccgtggtaggggggccagcggccgtcaggcaagagccgaggccagcgtgagcgccccacaagcgaccgtccaagctcgtagtttttcggactcgtcgccacaaaccattcagggaggcctgccacctctcgtgaagcggaggagattactaggaagcgaaagtacaagaggcgaagaccacggtcaagcaacatatccgaaggccgaaaaccagacccctggaagagaaggaccacaggcagcaggcgaagagctggggaacgaggcaggggccggcgccatgtcgcatcccaagccatgggagacttag

SEQ ID NO: 31819 - DNA, 1347 bp, Artificial Sequence
  Description of Artificial Sequence: Synthetic coding sequence
atggcacttactctcctggaggattggtgtaaaggaatggacatggaccctcgaaaagcactcttaatagtaggcatacccatggagtgtagcgaagtggaaatccaggatacagtaaaagctggactgcagcctctgtgcgcatatcgtgtgctgggccggatgttcagacgcgaggacaacgctaaagccgtgttcatagaactggctgataccgtcaactatacaacgctgcctagccacataccagggaaaggcggaagctgggaagttgtcgtgaagccaaggaacccagatgatgaattcctgtcaagactgaattatttcctgaaagacgagggccgcagtatgaccgatgtagcgcgggctctgggctgttgcagtctgccagcggagtctttggatgcagaggtaatgccccaagtgaggagtcccccgctggagcccccaaaggagtcaatgtggtatcggaagttaaaggtgtttagtggcaccgcctccccaagtcctggagaggaaacatttgaggactggctggaacaagtcactgagatcatgccaatctggcaggttagtgaggtggaaaagcggcgtcggttgctggaatcgctgcgtggtccagctctctccatcatgagggtcctgcaagcaaacaatgatagcataacagttgaacagtgtcttgatgcactgaagcagatcttcggggataaggaggacttccgcgcatctcagttccgcttcctccagacatctcccaaaatcggcgaaaaagtgtctaccttcttgcttcgattggagccccttctccaaaaggctgttcataagtctcctttaagcgtgagaagcaccgacatgattaggctgaaacacctgctcgcccgcgtggcgatgacacccgccctccgtggtaagctggagttgcttgatcaacggggatgccccccaaactttctggagctaatgaaacttatcagggacgaagaagagtgggaaaatacagaggcggtcatgaaaaacaaggaaaagccttcaggacgagggcgaggcgccagtggtcgccaggcaagggccgaggcatccgtgtccgcccctcaggcgaccgttcaggctaggagtttttcagatagttccccccaaactatccagggcggtttgcctccattagtgaagcgcagacgtctgctgggaagcgaatcaactagaggcgaagaccacggacaggcaacctaccctaaagctgagaatcaaaccccaggtagagagggaccccaagcagcaggggaggaactggggaacgaagctggagcgggggcgatgtcacatccaaagccctgggaaacctag

SEQ ID NO: 31820 - DNA, 1347 bp, Artificial Sequence
  Description of Artificial Sequence: Synthetic coding sequence
atggcattgaccctgttggaagattggtgtaagggcatggatatggacccacggaaggccctgctgattgttggtatacctatggagtgttcggaggtggagattcaagacaccgtgaaggccggcctccagcctctctgcgcttaccgtgtgcttggtcgtatgttcagacgggaagataatgccaaggcagtgtttatagagctggccgatacagttaactatacaactctgccttcccatatccccgggaaagggggctcatgggaggtggtggtgaaaccccgcaaccccgacgacgagttcttgagccggctcaattattttctaaaggatgaagggaggtctatgaccgacgtcgctcgcgcccttggatgctgctcactgcctgccgagtccctggacgctgaggtcatgccacaggttcgttcgccacctcttgaaccaccgaaagaaagtatgtggtacaggaaactgaaggttttctccggtaccgcctccccttctcctggggaagagacttttgaggactggttggaacaagtgaccgagatcatgcccatttggcaggtaagcgaggtggagaagaggagaagacttctggaatcgttgcgaggccccgctttgagcattatgcgtgtcctccaggcgaacaatgacagtatcaccgtggaacagtgtctggatgcgcttaagcagatatttggagacaaagaagacttcagagctagtcagtttcgtttcctgcagacctcaccaaagatcggtgagaaggttagcacattcctgctccgactggagccgctgctccagaaagccgtgcataagtcgccgctgagtgtcaggtctactgacatgatccgattgaagcacttgctggctagggtggcgatgacaccagctctgcgcggcaaactggaactgctggaccagcgcggttgccctcccaacttcttggagcttatgaagcttattcgcgacgaggaagagtgggagaacaccgaggccgttatgaagaacaaagagaaaccaagcggaagaggcaggggcgccagcgggagacaggcgcgagctgaggcctccgtcagtgctcctcaagccaccgttcaggctagaagtttttctgattcttcgccccaaacaatccaggggggattgcctcccctggtcaagcgccgtcggctgcttggttccgaatccactcgcggcgaagatcatggtcaagccacctacccgaaggcagagaaccagactcctgggcgggagggaccacaggccgccggtgaggaattaggtaatgaggccggggctggggcaatgtcgcacccgaaaccttgggagacctag

SEQ ID NO: 31821 - DNA, 1908 bp, Artificial Sequence
  Description of Artificial Sequence: Synthetic coding sequence
atggccatgtctctgctgcaggactggtgcagatcactcgatgtagatgcccaccgggctctgctggttactggtattcctgaaggactagaacaagccgacgtggaagcagtcttgcagccaacccttctccccctcggcacgtttagactgcgacacatgaaagcactgatgaatgagaaagcccaggcagcactcgtggaatttgttgaagatgtaaatcacgccgccattcctcgcgagataccaggaaaggatggcgtgtggcgcgttctctggaaggaccgagcccaggacacaagagtgctgcgccagatgcgtagactcctgctggatgacggccctacacaagcggctgaggcaggcacccctggggaggctcccacgccgcctgcgtcagagactcaagcccaagattccggggaggtgacaggccaggccgggtccctgctgggtgccgcacgcaaccctcgcagaggtagacgcggtcgccgtaatcgaactaggcggaaccgcctgacacagaaaggtaaaaaaaggagcagaggaggcaggccatcagccccagcaagatccgaggcggaagatagttctgacgaatctctcggcattgtgatcgaagaaatcgaccagggtgacctcagcggggaggaagaccagagcgccctgtacgccacactgcaggctgccgccagggagctagtaaggcagtgggccccctgtaattctgaaggcgaggaggacggccctcgggaatttctagctttggtgacggtgacggataaatctaaaaaggaggaagcagagaaggagcctgccggggccgagagtatcaggctgaatacaaaagaggacaaaaatggggttcctgatctggtggcgctcctggccgttagggatactcccgacgaggaacctgtagacagtgatacctccgagagtgacagtcaggaatccggagatcaggaaacggaagagctggataaccccgagttcgtcgctattgtagcttacaccgacccctcagacccatgggcaagagaggaaatgctgaaaatcgcatctgttatcgaaagcctgggctggagtgacgagaaagacaagagggatccacttaggcaggtgctctccgtgatgtctaaggatacaaatggaacaagggtcaaagtcgaggaagcgggcagggaggtggacgctgtcgtcttgcggaaagcaggagacgatggggacttgcgtgaatgtatatccaccctggctcaacctgacctgcctccacaggcgaagaaagctggaagaggcctcttcggaggttggagtgaacatcgtgaggatgaaggggggcttctcgagcttgtagctctactcgctgcacaggatatggcagaagtcatgaaggaggaaaaagagaatgcatgggaggggggcaagtataaatatccaaagggcaagctaggcgaagtcttagcgctgttggctgcacgcgagaacatgggctctaacgagggaagtgaagaggcctcagacgagcaatctgaagaggagagcgaggataccgaatctgaggcctctgaaccggaggaccgtgcctcaagaaaacccagagccaagcgagccagaactgcacccaggggactgactcccgctggagccccccctaccgcaagtggagcacgcaaaactagggccggaggacggggacgggggagaggcgtcaccccagagaaaaaggctggtagccgtggttccgcccaggacgatgctgctggaagcagaaagaaaaagggaagtgccggggcgggggctcacgctagggcgggtgaagccaagggtcaggcccctactggctctaaggccgcccggggtaaaaaagcacgccggggaagacgtctgccccctaaatgccggtag

SEQ ID NO: 31822 - DNA, 666 bp, Artificial Sequence
  Description of Artificial Sequence: Synthetic coding sequence
atgcagaaatctgaggggagtggtggaactcagctgaaaaatcgggccaccggaaattacgaccagagaacgtccagttcaactcagttgaaacacagaaacgcagtccaaggatccaagagcagcctgtcaacatcaagccccgagtctgccaggaaattgcatcctcgcccgtccgacaaactgaacccgaagacgatcaatcccttcggggagcaatctcgcgtgccctcagcattcgcagctatctattctaagggaggaatcccctgtcgcttagtgcacgggagcgtgaagcaccggttgcagtgggaatgtccccctgagagtctgagctttgaccctctgctcattaccctagctgagggactgcgggaaaccaagcacccttatacattcgtgagcaaagagggcttcagggaacttttgttggtgaaaggagcccccgagaaggccatccctctcctgcccagactcattcctgttcttaaagcagcccttgtacactccgatgacgaagtcttcgaacgaggcctcaacgccttggttcaactgagtgtggttgtgggcccctctctgaatgaccacctgaagcacctgctgacatctggttcgctcagcattattaagtccaagataccaacatactgcagtatctgttgctag

SEQ ID NO: 31823 - DNA, 666 bp, Artificial Sequence
  Description of Artificial Sequence: Synthetic coding sequence
atgcagaaatcagaaggatcaggagggactcaactcaagaatagagcaaccggtaattatgatcagaggacatcgagttcgacgcaactcaaacaccgcaacgcggtccagggctcaaaatcctcattatcgacgtcttcaccggaatcagcaaggaaattgcacccaaggccatccgataagttgaatcccaaaaccatcaaccccttcggagagcaatctcgagtacccagcgcttttgccgcaatctattccaaaggaggcattccttgtcgactggtccatggaagcgttaagcacagacttcaatgggaatgtccacccgaatcactgtcttttgacccactgttgatcacattggcagagggtctccgcgaaaccaagcacccatatacatttgtctccaaggagggctttagagagctcctactagtgaagggggcccctgagaaggctatacccttacttcccagattaatccccgtcttgaaagctgcgcttgtgcattccgacgatgaggttttcgagagaggccttaacgcccttgttcagctatcggtagtcgtcggcccaagcttgaatgatcatctgaagcacttgctgacatccgggagcctatctatcatcaaatctaaaatcccaacctactgttcaatatgctgctag

SEQ ID NO: 31824 - DNA, 747 bp, Artificial Sequence
  Description of Artificial Sequence: Synthetic coding sequence
atgcaaaagtcagagggctcaggaggcacacagttgaagaatcgtgcgaccgggaactacgatcaacgtacttcctcaagtactcagctaaagcatcgaaacgcagtgcagggctccaaatccagtctgtctactagcagccccgaaagtgctaggaaactgcatcctcgcccatccgacaagctaaaccccaaaacaatcaatccttttggcgaacagtcacgagtaccttctgcgtttgctgctatctattcaaaaggaggaattccctgcagactggtgcacggctccgtaaagcaccgactgcaatgggagtgcccaccagaatccctgagcttcgatcccttgctgatcactctggccgagggcttacgggaaaccaagcacccctatacgtttgtctccaaagagggtttcagagagctgttgctcgttaagggggcacccgaaaaggccattccactgctgccacgacttattccagtgctcaaggcagcgctagtgcactccgatgatgaggtgttcgagaggggattgaacgccctagtacagctcagcgtggtggttgggccttccttgaacgatcacttaaagcatctcctcacatcactctcaaagcgcctaatggacaaaaaatttaaagaacctatcacgtccgccttgcagaaacttgaacagcatggtgggagtggtagcctgtcaataatcaagtcgaagattcctacatattgctccatctgttgctag

SEQ ID NO: 31825 - DNA, 276 bp, Artificial Sequence
  Description of Artificial Sequence: Synthetic coding sequence
atgcagaaaagcgagggaagcggcgggactcaactcaagaatagggctactgggaactatgaccaacggacatctagctctacccagctgaagcacaggaatgcggttcagggctctaaaagtagcctttctacttcatcaccggagtccgccagaaaattacaccctcggccaagcgataagctgaatcccaaaaccatcaatccttttggggaacaatcaagagtgcctagcgcatttgccgcaatttacagcaagggtggaattccatgctag

SEQ ID NO: 31826 - DNA, 258 bp, Artificial Sequence
  Description of Artificial Sequence: Synthetic coding sequence
atgcagaagtccgaaggttccgggggcacccagctgaagaaccgggctacggggaattacgatcagcgcaccagttcaagcacccagttgaagcacaggaatgccgtccaagggtcaaaaagttctttgagcacctccagtcccgaaagcgctaggaagttgcaccctcgccccagcgacaaactcaaccccaagacgatcaatccattcggcgagcagtctagagtgccctccgcattcgccgccatttactcttag

SEQ ID NO: 31827 - DNA, 666 bp, Artificial Sequence
  Description of Artificial Sequence: Synthetic coding sequence
atgcagaaatctgaggggtctggaggtacccagctcaagaacagagctaccgggaactacgatcagaggacctcctcatctacacagttaaagcatcgaaacgcagtccaaggcagtaagtcctcgctttcaacatcttctccagaatctgcccgtaaactgcatccgcgacccagcgataagttaaatcccaaaaccatcaatcctttcggagagcagtccagggtaccctcagcattcgccgctatctattccaagggcggcatcccctgccggttagtccacggcagtgtgaaacaccggctccaatgggagtgccctccagagtccctcagcttcgaccctcttctgattacactcgcagagggcctgcgcgaaaccaaacacccttatactttcgtctcaaaggaagggtttagggaattgctgttagtgaaaggagctcccgagaaggcaataccgctcctgccccggctcatccctgttctgaaggccgccctggtccattccgatgacgaagtattcgagcgaggcttgaatgccctggtgcagctgagcgtggtcgtgggtccgagtctcaacgatcaccttaagcatctgctcacctccggctccctatctattattaaatccaagatacctacctattgctctatctgttgttag

SEQ ID NO: 31828 - DNA, 411 bp, Artificial Sequence
  Description of Artificial Sequence: Synthetic coding sequence
atgcagaaatctgagggcagtgggggaacgcaattaaagaacagagcaaccggcaattatgaccaacgaaccagctcctccacacagctgaaacaccggaacgcagtgcagggcagtaagagtagcctttcaacatcatcaccagaaagcgcacgtaaactgcacccccggccgagtgacaagctgaacccaaagactataaaccccttcggagagcagagccgtgtgccttcagcatttgccgccatctatagtaagggcggcatcccttgtagactcgtacatggcagtgtcaaacatcggcttcaatgggagtgtcctcccgagagcttgtcctttgaccctctgctgattacactcgccgaagggctgcgagaaaccaagcacccatatacctttgtgagcaagtag

SEQ ID NO: 31829 - DNA, 612 bp, Artificial Sequence
  Description of Artificial Sequence: Synthetic coding sequence
atgcagaaaagtgagggctcgggggggactcagctgaaaaacagagccacggggaactatgatcagcgaactagctcgagcacacagctcaagcataggaacgcagttcaggggtcaaagtcttcattgtcaacatcgagtcccgaaagtgctagaaaacttcaccctcggccctcagataagctgaatcctaagaccatcaatccctttggcgaacagtcacgtgtgccgtcagccttcgctgccatatattctaagggaggaataccttgtagactggtccacgggtcagtgaagcaccggctccagtgggaatgcccgccagagtcgctcagcttcgatcccctgctgatcacactggcagagggtctgcgggaaaccaagcacccctacacttttgtctccaaagaaggcttccgagagctcttactggtgaaaggcgcaccagagaaggccatccctctactgcctagactcatccccgtactgaaagccgctctcgtccactccgacgatgaagtgtttgagcgtgggctcaacgctctggtgcaactgtccgttgtggtcggtccctctcttaacgatcacctgaaacatcttctgacttcatag

SEQ ID NO: 31830 - DNA, 369 bp, Artificial Sequence
  Description of Artificial Sequence: Synthetic coding sequence
atgcaaaaatctgagggttccgggggcacacagctcaaaaatcgggccactggaaattatgatcaacggacttcctccagtacccagctgaagcatcgtaacgccgtgcagggctcgaaaagctcattatccacaagtagccccgaaagtgcccgtaagttgcatcccagaccctctgacaagcttaaccctaagacaattaacccattcggcgaacagtccagggtccctagtgcctttgccgccatctatagcaagggaggaatcccttgccgtctcgtccacggctctgtgaaacatagactgcagtgggagtgcccccctgagtccctatcttttgacccgctgctaatcaccctggctgagtag

SEQ ID NO: 31831 - DNA, 309 bp, Artificial Sequence
  Description of Artificial Sequence: Synthetic coding sequence
atgcagaagagcgaaggttcgggtggtacccagttgaagaatagggccaccggcaattatgaccagagaacgtcgagttctacccagctaaaacaccggaacgcagtgcaaggcagcaagtcaagtctctcgacatcgtcacctgagagtgcccggaagctgcaccctcgaccctccgacaagctgaatcctaagacaataaatccctttggtgagcagagccgcgtcccaagcgctttcgcagccatctattcgaagggtgggatcccttgtcgactggttcatgggtcggtgaaacataggctctag

SEQ ID NO: 31832 - DNA, 372 bp, Artificial Sequence
  Description of Artificial Sequence: Synthetic coding sequence
atgcagaagagtgaggggagcggcgggactcaactgaaaaatagggccaccggaaactacgaccaaaggacctccagcagtacacagttgaagcaccgcaatgctgtccagggctccaagtcctccctcagtacttcctcccctgaatctgcaagaaagctccacccgagaccatctgataaactgaaccctaaaaccatcaacccagtgcatagcgacgacgaggtgtttgaacgtggcctaaatgctctcgttcagttgtccgtcgttgtgggaccaagcttgaatgaccacctgaaacacttgcttacctccggatccctcagcataattaagagtaagatccccacgtattgcagtatctgttgctag

SEQ ID NO: 31833 - DNA, 372 bp, Artificial Sequence
  Description of Artificial Sequence: Synthetic coding sequence
atgcaaaagtccgaaggaagcggaggtacccagctaaaaaatcgggccacgggtaactacgatcagagaacgagcagcagcacacaactaaagcacagaaacgcagtacagggcagcaaatcctcactctccactagctcccccgaatcggcccggaagctacacccccgacccagcgacaaactgaatcccaagacgattaatccagtgcacagtgatgacgaagtgttcgagaggggacttaacgcccttgttcagctgtccgtcgtcgtgggaccgagcctcaatgaccatcttaagcatcttttgacaagcggatctctatccattatcaaaagtaaaatccccacctactgttctatatgctgttag

SEQ ID NO: 31834 - DNA, 762 bp, Artificial Sequence
  Description of Artificial Sequence: Synthetic coding sequence
atgaagcacattaatctctcctttgcggcttgtggttttttaggcatttaccacctgggagccgcatcagctctctgcagacacggaaaaaagctggttaaggacgtcaaagctttcgccggagcttccgctggcagtctagtggcctccgtgctgctaacagcccccgagaagattgaagagtgcaaccagtttacttataagttcgccgaggaaataagacggcagagctttggcgcagtaaccccagggtatgattttatggcaaggctacggtcaggcatggaatccatactgcctccgtcagcccacgagctggcgcagaatcgacttcatgtgtctataactaacgctaagactcgagaaaaccatctggtgagcaccttctcttcgagagaagatctcattaaagtgttactggcttcaagctttgttcctatttatgcaggactgaaactcgtggagtacaagggccaaaaatgggtcgatggagggttgacaaacgccctgcccatcctgcccgttggcaggaccgttacgatttcacccttttctggacgcctcgacatttccccacaggacaagggtcagctggacctttatgtgaatatcgcgaagcaggatattatgttgtcgctggccaatctggtgagactgaatcaagccctgtttcctcccagcaaacgcaaaatggagtctctgtatcaatgtggtttcgatgacacagtgaaattcttgctgaaggaaaattggtttgaatag

SEQ ID NO: 31835 - DNA, 573 bp, Artificial Sequence
  Description of Artificial Sequence: Synthetic coding sequence
atgaagcacatcaatctgtcattcgctgcctgcgggttcctaggcatctaccatctcggcgccgcaagcgctctatgccgacacggcaagaagctggtcaaggatgttaaagcattcgcaggggcgagcgcaggcagcctcgtagcaagcgtcctgttgacagccccagaaaagatcgaggagtgcaatcagtttacgtacaagttcgccgaagaaattcgtagacagtctttcggcgccgtgactcctggatatgatttcatggccagattgcgttccggtatggagtccattttgccaccaagtgcacatgagctggcccagaaccgattgcatgtgagcatcaccaatgcaaaaactagggagaaccacctcgtcagcacattttcctctcgggaggatctcattaaggtcttattagcctcctcattcgtgcctatctatgcgggactcaagctggttgagtataaagggcagaagtgggtcgacgggggcctcaccaatgctcttccaatcttgcccgtgggaagaaccgtcacaatatctccattctccggccgcttggatatctag

SEQ ID NO: 31836 - DNA, 762 bp, Artificial Sequence
  Description of Artificial Sequence: Synthetic coding sequence
atgaaacatattaacttgagtttcgctgcctgtggcttcctcgggatttaccacctgggcgctgcgagcgcgttgtgcaggcacggcaagaaattggtgaaggatgtgaaggcttttgctggagcttccgcgggttcactggtagcaagcgtccttctcactgcaccggagaagatcgaagaatgcaaccagtttacctacaagttcgctgaggagatacggcgacagtctttcggcgccgtgactcccggctatgacttcatggcaaggttgaggagcgggatggagagcatccttccccctagtgctcacgaacttgctcagaataggctgcacgtgtccatcacaaacgctaaaactcgtgaaaaccatctcgtttcaactttttcatcgagggaggacttgattaaagtgttgctggcttcctcttttgtaccgatctacgcaggtttaaaactggtggagtacaaaggccagaagtgggtcgacggcggcttgacgaatgctctccctattctgcccgtgggaaggacggtcacgatctcgcccttttccgggcgactcgatatcagccctcaggacaagggacaattagacctctatgtaaacatcgctaaacaagatattatgctgtcccttgcaaacctggtcaggcttaatcaagctctgttccctccctcgaaacggaagatggagagcctgtaccagtgcggatttgacgacaccgttaaattcctcctgaaagagaattggtttgaatag

SEQ ID NO: 31837 - DNA, 501 bp, Artificial Sequence
  Description of Artificial Sequence: Synthetic coding sequence
atggcgcgccttagaagcggaatggagtccattcttccgcccagcgcccacgagctggctcagaacaggctgcatgttagcatcacaaacgctaaaactcgagagaaccacctagtgagcaccttctcatcccgcgaggacctcattaaagtcttgctggctagcagtttcgttcccatctatgctggcctgaagctagtggagtacaagggccaaaaatgggttgacggaggtttgacaaacgccctgcccatcctgccggttgggcgtaccgtgacaatctcccctttttcaggccgccttgacatctccccacaagacaaagggcagctggacctttacgtgaatatcgcaaagcaggacatcatgctcagcctggcgaacttggtgcgcctgaaccaagcacttttccccccaagcaaacgaaaaatggaaagcctctaccaatgtgggtttgacgatactgtaaagtttttgctgaaagagaactggtttgagtag

SEQ ID NO: 31838 - DNA, 969 bp, Artificial Sequence
  Description of Artificial Sequence: Synthetic coding sequence
atggaagggatcagcaacttcaaaacaccatcgaagctttcagagaaaaagaagagtgtcttatgttcaaccccaaccatcaacatcccagcaagtccattcatgcagaaactgggctttggaacgggcgtgaatgtgtatctcatgaagaggtcaccccgaggattaagtcactctccctgggctgtgaagaagatcaacccaatatgcaacgatcattataggtcagtgtaccagaaaaggctgatggacgaagccaagattctcaaaagcctccatcatccaaatatcgtaggctatagagcgttcactgaggccaacgacggttctttatgtctggcaatggaatatggtggcgagaaatccctgaacgaccttattgaagaacgctacaaggccagtcaggacccattccccgccgccatcatcctcaaggtggcactgaatatggcaaggggcctgaaatatctgcatcaggaaaagaaattgctgcacggagatatcaaatccagcaatgtggtcattaaaggagatttcgagactattaaaatctgcgatgtgggcgtaagtcttccacttgatgagaacatgactgtgactgacccagaagcgtgttacatcggaaccgaaccttggaagccgaaggaggctgtggaagagaacggagtcatcacggataaagccgatatcttcgcatttggactgaccttatgggaaatgatgacattaagcattccacacatcaacttgagtaacgacgacgatgacgaagacaaaacatttgacgaatcagacttcgacgacgaggcctattacgccgcacttggcacacggccccccataaacatggaggagcttgacgaatcctatcagaaagtgattgagctgttttctgtgtgtactaacgaggatccaaaagaccggccctctgctgcacacatagttgaagctctcgaaaccgatgtatag

SEQ ID NO: 31839 - DNA, 1560 bp, Artificial Sequence
  Description of Artificial Sequence: Synthetic coding sequence
atgacgagcacattcaaccctcgggagtgtaaactctctaaacaggaaggacagaactacgggttctttctaagaattgagaaggacactgaaggccaccttgtgagagtcgtcgaaaagtgttcccctgcagagaaggctggtctgcaggacggtgacagggtgctgcggattaacggggtgttcgttgataaagaggagcatatgcaggtggtagatctggtcagaaagagtgggaactcagtgacgctcctggtgctggatggcgacagctacgaaaaagctgtcaaaactagggtggatttgaaggagctggggcaatcccagaaagagcagggattgtcagacaacatcctgtcccccgtcatgaacggcggcgtgcaaacatggacacagcccaggctgtgttacctggtaaaagaagggggttcctacggattctcactcaagaccgttcaaggaaagaaaggcgtttacatgacagacatcactcctcagggagttgccatgcgggccggtgtactggctgacgaccatctaatcgaggtcaacggtgaaaacgttgaggacgcttctcacgaggaggtggttgagaaggtcaaaaagtctggttcccgcgtgatgttcctgctggttgataaggaaactgataaacgccacgtggagcaaaagattcagtttaagcgcgaaaccgcttcgttgaagctgctgccgcatcagcctcgtatagtcgaaatgaaaaaaggatccaacgggtacgggttttaccttcgggctggatccgaacaaaaagggcagataatcaaagacatcgatagcggcagcccggcggaggaggccggtcttaagaataacgacctggttgtagccgtcaatggggagtcggtggaaacgctcgatcacgattccgtggtcgaaatgatacgcaaaggtggcgaccagaccagcctgctcgttgtggacaaagagaccgataacatgtatcggttggcccacttttctcctttcctgtactaccagagtcaggaactccccaatgggagcgtcaaagaagctccggctcctactcctaccagcctggaagtcagctctcccccagacactactgaggaagtggatcacaagccgaagctctgtcgactggcaaaaggcgagaacgggtacgggttccacctgaatgccatacgagggcttcctggcagcttcataaaagaggtacagaaggggggccctgccgatctcgcaggcctcgaagacgaggatgttatcatcgaggttaacggggtaaatgtgcttgatgaaccctatgagaaagtggttgacagaattcaaagttctgggaagaatgtaactctgctggtgtgcggcaagaaggcatacgactatttccaggcaaaaaagatcccgattgtgagctctctggctgaccccttggataccccgcctgattcaaaagaaggaatcgttgttgagtctaatcacgactcccacatggcgaaagaacgggctcactcaactgcatcacattcatcctccaactccgaggacaccgaaatgtag

SEQ ID NO: 31840 - DNA, 1560 bp, Artificial Sequence
  Description of Artificial Sequence: Synthetic coding sequence
atgacatccaccttcaaccctagagaatgtaagctttccaagcaagaaggacagaattacggcttttttctgcgcattgagaaggatactgaaggccacttggtacgggtagtggagaagtgtagtccagccgaaaaagctgggttacaggatggggatagagttctgaggataaacggtgtgttcgttgacaaagaagagcatatgcaggttgtggacctggtacggaagtccggtaatagtgtcacattgctggtactggatggcgatagttatgagaaagcagttaagacacgtgtggatctgaaggaactgggccagtctcagaaggagcagggcctctctgacaatatcctgtcccccgttatgaacgggggagtccaaacatggactcagccaaggctctgctacttggtgaaagagggcggcagttatggcttcagtctgaagacagtgcaggggaagaagggggtttacatgacggacatcacaccccagggtgtcgccatgcgcgcaggggtgttagcggatgaccacctgattgaggtgaacggggaaaatgtggaggacgccagtcacgaggaggtagttgagaaagtcaagaaaagtgggagcagagtgatgttcttgctcgtggataaagaaaccgataagaggcacgtggaacagaaaatccaattcaagagggaaactgcctccctgaagctgttgcctcatcagcccaggatagtggaaatgaaaaagggaagcaatggctatggcttttacctgcgcgccgggagtgagcagaagggccagataataaaggatatagattctgggtcaccagcagaggaggctggtctgaaaaacaatgaccttgtggtcgccgtcaacggtgaatccgttgagaccttagatcacgattcggtcgtcgagatgattcgcaaggggggggaccagacttccctcctggtcgtcgacaaggaaactgacaacatgtatcggctggcccacttttctccttttctttactatcagagtcaggaactccccaacggaagcgtgaaggaagcacccgctccgacacctaccagtctggaggtctcctccccaccagatactacagaggaagtagatcataagccaaagctgtgtcgtctggcgaaaggcgaaaatggctatggctttcacttaaatgctatcagaggccttcccggcagctttattaaggaagttcagaagggggggccagccgatctggccggccttgaagacgaagacgttatcatcgaagtcaatggtgttaatgtgctggacgagccctacgagaaagtcgttgatcggatccagtcttcaggcaaaaacgtgacccttctcgtctgcggcaaaaaagcatacgactatttccaagcaaaaaaaatcccaatcgtctcatcattggctgacccgttggacacacccccggatagcaaagaagggattgttgttgaatcaaatcatgacagtcatatggccaaagagagagctcattctaccgcgagccatagctctagcaatagcgaggatacggagatgtag

SEQ ID NO: 31841 - DNA, 609 bp, Artificial Sequence
  Description of Artificial Sequence: Synthetic coding sequence
atggccgaaggggaggaagaaggtggggacgtcttgataagcgtcgggcacgcgaatgtgttggggtatacactgcgggaatttctacagctcctgcaacatatcactatcggtactgttctgcagattaaggtttaccgagacttcatcaacattcctgaagagtggcaggagatctatgatttaattcctgaggcaaaatttccagtgacctcgacccctaagaagatcgagctggccaaagacgaatcatttacttcttcggatgacaatgagaatgttgatttggacaaaagattacagtattacagatacccctggtcaactgtgcaccatcccgcacgacgccctatctcgataagtcgagattggcatgggtataaaaagaagaatcatacgatctccgtggggaaagacatcaactgcgacgtcatgatccaccgcgacgataagaaagaggtgagagcaccctctccatattggatcatggtgaagcaggacaacgaatcttcaagcagctccacaagtagcacttccgacgctttctggctggaggactgcgcgcaagttgaagaaggaaaggcacagcttgtgtccaaggtaggctag

SEQ ID NO: 31842 - DNA, 795 bp, Artificial Sequence
  Description of Artificial Sequence: Synthetic coding sequence
atgcagaaagctagccacaagaacaagaaagagcgcggggtatctaacaaagtgaagacatcagtccataatctatccaagacacagcagaccaagctcacagtgggttcattaggcttgggtttaatcatcattcagcacggaccttatctgcagattacacacctgatcagaaagggggccgccgcaaacgatggtaaattgcagcctggcgacgtgctcatctccgtgggacatgccaacgtgctgggctatacgctccgcgagtttctgcagctgctgcaacacatcacaattggtaccgtgctgcagatcaaggtataccgggacttcattaacatacccgaagagtggcaagaaatctacgatctgatccctgaggccaagtttccagtcacatctactcccaagaagattgaactcgctaaagatgaatctttcactagttcagacgataacgagaacgtggaccttgacaagcgccttcaatactaccgctacccatggagcaccgtccatcatcctgcaagacgcccaatctcgatttcgcgggactggcatggctacaaaaaaaagaaccacactatttccgtcggaaaagacatcaattgtgacgtgatgattcaccgcgacgataagaaggaggtcagagcacccagtccctattggataatggtgaaacaggacaacgaatcctcctcatcctccacgtcctctaccagcgacgccttttggcttgaggattgcgcccaggtggaggagggcaaggcccagcttgtatctaaggtcggatag

SEQ ID NO: 31843 - DNA, 615 bp, Artificial Sequence
  Description of Artificial Sequence: Synthetic coding sequence
atgcaaaaagcgagtcataagaataaaaaaggtgacgtgctcatctcagtgggtcatgcaaatgtgctcggctataccctgcgcgaattccttcagctgcttcagcatatcacaattggcactgttctgcagatcaaggtatatcgagattttattaatataccggaggaatggcaggagatttacgatctgatccccgaggctaagttcccagtgacttcaacaccaaagaaaatcgagctagcaaaggacgaatcattcacctcaagtgacgacaacgaaaacgtcgacttagataagaggctacagtattataggtatccctggtcgaccgtccatcacccagcgcgccgccccatttctatctcacgggattggcatggatataagaaaaaaaaccataccatctccgtcggcaaggacatcaactgcgacgtcatgatccaccgcgatgacaaaaaggaagttcgggcacctagtccctactggatcatggtgaagcaggataacgagtcttcaagctcaagcacctcttccaccagtgacgcattttggctggaagactgcgcgcaagtggaagaggggaaggcccagttggtctccaaggtcggatag

SEQ ID NO: 31844 - DNA, 2103 bp, Artificial Sequence
  Description of Artificial Sequence: Synthetic coding sequence
atggacttcgtcagacttgcaaggctgtttgccagggccaggccaatggggctgtttatcttgcagcatttggatccatgtcgagctcgctgggccggcggacgtgaagggctaatgagaccaatgtgggcaccattctctagctcctctagtcagctcccactgggccaagagagacaagaaaataccggtagtctcggctctgacccaagccattccaacagcaccgccacccaggaggaagatgaggaggaggaggaatcctttggcacacttagtgataaatattcttcccgtcgtctattccgcaaaagtgcagcccaatttcacaatctgcgcttcggggaacgccgcgacgagcagatggaaccagaacctaaattgtggaggggcaggcgaaataccccttattggtatttcctccagtgcaagcaccttatcaaggagggcaagcttgtagaggcgctggacctattcgaacggcagatgctgaaggaggaacgcctacagcccatggaatctaactataccgtgctgattgggggatgtggtcgggttggctatctgaaaaaagctttcaacttgtataaccagatgaaaaagcgtgacctggaaccttctgacgcgacttacaccgcgttatttaatgtatgtgccgaatccccctggaaagacagtgccctgcaaagcgctttaaaactgcgacagcaactccaggcaaagaatttcgaactgaacctgaaaacttaccatgcgctcctaaagatggcagccaagtgcgcagacctcagaatgtgccttgacgtatttaaagaaatcatccacaaaggacacgtagtcaccgaggaaaccttttccttcctgctgatggggtgtattcaggacaagaagactggattcagatatgcgttacaggtgtggcgtctaatgctgtccctcgggctgcagccctctagggattcctacaatctgctgttggtcgccgccagggattgtgggctgggcgacccacaagttgcgtccgagctcctgctcaagccccgtgaggaggcaacagtactacagccacccgtatccaggcagcgcccaaggcgcaccgcacaagctaaggcagggaacctaatgtcagcaatgctgcatgttgaagccttggaacgacagctcttcctggaacccagccaggcattgggcccgcctgagcctcctgaggcaagggtccccggtaaggcacaacctgaggttgacactaaggctgaacctagccatacagccgccctgacagcagtggccctcaagccacccccggtcgaacttgaggtgaaccttctgacccccggagcggtccccccaaccgtggtaagttttggcacagtcacgacacccgcggataggctggctctcataggcggactggaggggtttctgtcaaagatggccgaacatagacagcagcctgacattagaactcttacactgcttgctgaagtagtggagagcggatcaccagccgagtccttacttctggccctcttagacgaacaccaggtggaggcggacctgacctttttcaacaccctcgtcaggaagaagtctaagctgggcgatcttgaaggagccaaggcactgctgcccgtgctcgccaaacgcggcctggtgccgaacctccagaccttttgcaatctcgctattggctgccacaggcctaaggatggcttgcagcttcttaccgacatgaaaaagtcgcaggtgaccccaaacacccatatatactcagcccttataaatgctgctattagaaagttgaactatacgtacttaataagtattctgaaggacatgaagcaaaatagggttccggtgaacgaggtagtgatccggcagcttgagtttgctgcgcagtaccccccaacttttgacagataccagggcaagaacacctatctggaaaaaattgacggttttagagcttactacaagcagtggctgaccgtgatgcctgctgaggagacacctcatccatggcaaaaatttcggaccaagccacaaggagaccaagacacagggaaggaagcagatgatggctgtgccttgggcggcagatag

SEQ ID NO: 31845 - DNA, 321 bp, Artificial Sequence
  Description of Artificial Sequence: Synthetic coding sequence
atggatttcgttcggttggcccggctcttcgctagggcccgccccatgggcctgtttatactacaacatctggacccctgtcgtgcacgttgggctgggggaagagagggactgatgaggcccatgtgggctccattctcctcaagtagcagccagctgccattaggacaggagagacaagaaaacacagggtccctcgggtccgacccaagccactccaactcaaccgccactcaagaagaggacgaagaggaagaggagtcttttggcaccctgtctgacaaatattcctctcggagactttttcggaagagtgcatag

SEQ ID NO: 31846 - DNA, 435 bp, Artificial Sequence
  Description of Artificial Sequence: Synthetic coding sequence
atggattttgtgcggctcgctagactcttcgccagggctaggcccatgggcctgttcatactgcagcatttggatccatgtcgagcacgctgggcaggaggcagagaaggtctaatgaggccaatgtgggcaccattctcatcctcatcctcacagttacccttgggccaagagagacaggagaatacgggaagtttgggttcagatccatcccatagcaattccactgccacacaggaagaagatgaggaggaagaggaatcgttcggcaccctgagcgataagtactccagtagacggctttttcgaaaaagtgccgcacagtttcacaacctgcgattcggggaacgaagagacgaacagatggaacccgaacccaagctgtggcgcggcaggcgtaatacaccatactggtatttcctccagtgcaagtag

SEQ ID NO: 31847 - DNA, 495 bp, Artificial Sequence
  Description of Artificial Sequence: Synthetic coding sequence
atggactttgtccgattagcacggcttttcgccagagctcgcccaatgggactgttcattctgcagcatctagacccctgccgtgcccgttgggcaggggggcgtgaagggctcatgcggcccatgtgggcacctttctcttccagtagcagccagcttcccctgggacaggagagacaggagaacaccggttccctgggctcagaccccagccatagtaactctacagccacacaggaagaagacgaggaggaagaggaatcctttggtaccctttctgataagtactctagccgtcggctgttccgtaaatccgccgcacagttccataacctgaggtttggggagaggcgggacgaacagatggagcccgagcctaaactctggagaggtcgtcgtaacaccccctactggtattttctgcaatgcaaacaccttattaaggagggcaaactggtagaggcactggatctttttgaaagacagatgctttag

SEQ ID NO: 31848 - DNA, 213 bp, Artificial Sequence
  Description of Artificial Sequence: Synthetic coding sequence
atggatttcgtaaggctggcaagattatttgccagagcacgcccaatgggactatttatactgcagcacctcgacccatgtcgcgcacggtgggctggagggagagagggcctaatgagaccgatgtgggcgcctttctccagttcgtctagccaactccctctgggccaggagcgtcaggaaaacacaggatcgttgggaagcgatccctag

SEQ ID NO: 31849 - DNA, 1449 bp, Artificial Sequence
  Description of Artificial Sequence: Synthetic coding sequence
cggaagcgcctggtgcggagaggggatagggctggactccccgtcggagtgcaccagctgcaggctaagaattttgaactaaatctgaaaacttaccatgccctgctgaagatggcagccaaatgcgcagacctccgtatgtgcttagatgtgttcaaggagataatccacaaaggacacgtggtgaccgaagagacattttcgttcttgttgatgggatgcattcaagacaaaaagactggctttcgctacgcgctgcaggtgtggagattgatgctctctctgggtctccagccctctagggattcatataatctcctgctggtggccgccagagactgtgggttaggggacccacaggtcgcatccgaactgctgctgaagcccagggaggaagcgaccgtactgcagcccccggtgtctaggcagagaccaagaagaacagctcaggctaaggcagggaaccttatgagtgccatgctccacgttgaagccctggaaaggcaattatttctggaacccagtcaggctctgggtcccccggagccgccagaagcaagagtgccaggaaaagcccagcctgaggttgacaccaaagcagagcccagtcacacagcggcactcactgcagtcgctctgaagccgcctccagttgagcttgaggttaatctgctgacacccggagccgtgcctcccacggttgtaagcttcggcactgttaccactcccgccgacagacttgcactgattggcggactggaaggatttctgagcaagatggccgagcataggcagcagccagatattcggacactcacactcttagcagaagtggttgaaagtggctctcccgcggagtcactcttgctggctctactggatgaacatcaggtggaagcagatctgactttctttaacacgctggtccgcaagaaaagcaagctcggggaccttgagggcgctaaagctctgttgcccgtgttagccaagagaggcctggtgcctaacctgcagactttttgcaatttagctattggctgccacaggccaaaggatggcctccagttattaaccgatatgaagaaaagccaagtgacaccaaacactcacatttattccgcgctgattaatgctgcgatccggaagctcaattacacctatctcatctctattctgaaggacatgaaacagaatagagttcctgtcaacgaggtcgtgatccgccaactcgagtttgccgctcagtatccacccactttcgatcgataccagggcaagaacacctatctcgaaaaaatcgatgggtttagggcctattataaacagtggttgactgttatgccagctgaagagacacctcatccctggcaaaaattccggacaaagccacagggggatcaagacactgggaaggaggcagatgacggatgcgccctgggcggtcgctag

SEQ ID NO: 31850 - DNA, 2250 bp, Artificial Sequence
  Description of Artificial Sequence: Synthetic coding sequence
atggcctcagtggtgccagtgaaagacaagaaactcctggaagtcaagctcggtgaactaccaagctggattttgatgagggatttttctccctctggaatattcggggcgtttcagaggggccccggaggcaccggtaagcccgagatggattttgttcggctggctaggctcttcgcacgcgctcgtcccatggggctgtttatcctccaacatctcgacccttgcagggcccgttgggcaggaggtagagaggggctgatgaggccaatgtgggccccatttagctctagttcgagtcagcttcccttggggcaagagagacaggaaaatacaggatctttgggctccgatcccagtcatagtaactccacagcaacacaagaagaggacgaggaggaggaagagtctttcggaaccctgagtgacaagtatagctctagaaggctattccgaaaatcggcagctcagtttcataatttgcgctttggagaaagacgagacgagcaaatggaacctgaacctaagttgtggcgggggaggagaaatacaccatattggtattttctgcaatgtaaacacctcatcaaagagggcaaactggtagaagctctcgacctattcgagcggcagatgttaaaagaagaacgccttcaacccatggaatccaactacacagtgctcattgggggctgcggtcgcgttggttatttaaagaaggccttcaacttgtataatcaaatgaaaaagagggacctggagccgagcgacgcaacctatacggcactgttcaacgtgtgtgcagaaagcccttggaaggactccgccctgcaatccgcactgaagttacggcagcagctgcaggctaagaatttcgagctgaacctgaagacttaccatgccctgctgaagatggccgctaagtgcgcagatctgaggatgtgcctagatgtgttcaaagaaatcattcataaagggcacgtggtgactgaagaaaccttctccttcctgttaatgggctgtatccaggacaagaaaaccggcttcagatacgccctacaggtgtggcggctgatgttgtccttaggtctgcaacccagtagagattcatacaacctgctgctggttgccgcccgcgactgcggcctgggggatccccaagtggcatccgaattactgctcaagccaagagaggaagcaacggtgttacagccccctgtttccagacagagacctcggcgcacagctcaggcaaaggcaggcaaccttatgagcgccatgctccacgtggaggccctggagagacagctgttcttagagccatcccaggcgctgggtcctccagagcctcccgaagcaagagtgcctgggaaagcgcagcctgaggtggacaccaaggcggagcctagccacaccgctgctctgaccgccgttgccctgaagcctcccccagtagagcttgaggtaaatttgttgaccccgggggctgtgcctccgaccgtcgtgtccttcgggactgtgacaactcctgccgatcggctggcgctcatcggcggattagagggctttttgtccaagatggccgagcaccgccagcagcccgacatccgcacactaacactacttgctgaagttgtggagtcaggctcgccagcggagtccttacttttagcccttctggatgaacatcaggtagaggcagacctgacctttttcaacaccctcgtgagaaagaagagcaagctcggtgacctggagggagcaaaagctttactccccgtgcttgcaaaaaggggactggtgccaaatctgcagactttctgtaatctggccatcggttgccaccgtcctaaagatggactgcaacttttgaccgacatgaagaagtctcaggttacaccaaatacccatatatatagcgcgctgatcaatgccgctattagaaagttgaactatacctatctgatcagcatcctgaaagatatgaagcagaaccgggtaccggtaaacgaggtggttattagacagcttgagtttgcagctcagtaccctcctacatttgatcgctatcaagggaagaatacctatcttgagaaaatcgatggcttccgggcatactataaacaatggctgacagtgatgcccgcagaggagacaccacatccttggcagaagttccggacaaaaccccaaggtgaccaggataccggcaaagaagctgacgacgggtgtgcacttggcggcagatag

SEQ ID NO: 31851 - DNA, 1311 bp, Artificial Sequence
  Description of Artificial Sequence: Synthetic coding sequence
atgagacccggtggcgagagacccgtcgaagggggtgcttgtaatggcaggtctgagcttgagctgttgaagttgaggtctgccgagtgcatcgatgaggccgcagagcgcctgggcgccctgagtagagccatctggtctcaacccgagctggcctacgaggaacaccacgcccatcgtgtgctcacccatttttttgagcgagagccccccgcggctagctgggctgtacagccccactaccagcttccgacagcgttcagagccgagtgggagcccccggaagctagggccccatcagcgacgccccggcccctgcatttgggcttcctgtgcgaatacgacgccctgcctgggatcggacacgcctgtggccataatcttattgcggaggtgggggccgcagcagccttgggcgttcgcggggcgctagaagggctgcccagacctccaccccctgtgaaagttgtcgtcctaggcacccctgccgaggaagacggcggcggaaaaattgacctcattgaagctggtgcgtttacaaacctggacgttgtttttatggctcacccaagccaggagaacgccgcctacttgccagacatggcagagcacgacgtgaccgtgaaatactatggaaaggcgagccacagtgccagctacccctgggagggactcaatgccctggacgctgcagttctcgcctacaataatctgtcggtctttcgccagcagatgaaacctacgtggcgggtgcatggcatcattaaaaacggcggcgtgaagcctaatattatcccttcttattccgaacttatctactatttccgcgcccctagtatgaaggagctccaagttcttactaaaaaagcagaggactgtttcagagctgccgccctggccagtggatgcaccgtcgagatcaagggcggcgcccacgactattacaatgttttgcccaacaagtccctgtggaaagcctacatggaaaacgggcgtaagctgggcatcgaattcatcagcgaagacactatgctgaacggtccaagtggttcgactgatttcggtaacgtctcttttgtcgtgcctgggatccatccttattttcacatcggcagcaatgctctcaaccacaccgagcagtataccgaagcagctgggtcccaggaagcccagttctacacccttcggacggctaaagctctggctatgactgctctcgacgttatattcaaaccggaactcctcgaggggatcagagaagatttcaaactgaaactgcaggaggagcagtttgtgaatgctgttgaatag

SEQ ID NO: 31852 - DNA, 840 bp, Artificial Sequence
  Description of Artificial Sequence: Synthetic coding sequence
atggccaggcctcagccctgtggtcccccacatgcccggtgtgggtccccatcgttacccgagcggcccctgcaggtcaaggtggtgggactcttctcctgccccaatttccagattgccaaatccgccgcagaagaacttaagaacgagacatgggaatatagcagcagcgtgatctcatttgtgaatggccagtttctgggagacgcgctcgatctgcaaaagtgggcccacgaagtatgggacatcgtggacattaagccttctgccctgtacgacgctctcacagaggatttcagcgcgaagttcctcagggacactaagcacgatttcgtgttcctggatatctgtatcgatagctctcccatcgggcgccttatatttgaactgtactgcgacgtgtgtcccaaaacatgcaaaaactttcaagtgttgtgcaccggcaaagcagggttctcccagcgtggcatccgcctccactataagaatagtatattccatcgaatcgtacaaaacggatggattcaaggcggcgacatcgtgtacggaaaaggcgacaacggcgagtccatctacggaccaacctttgaggacgagaatttctccgtcccacacaacaagcgaggggtcctagggatggcaaataaggggcggcattccaacgggagtcagttctacataacactacaagcaactccatacctggataggaagtttgtggcctttggtcaactgatagaagggactgaggtactaaaacagctagaattggttccaacccagaacgaacgccccatacatatgtgcagaatcactgactctggcgatccatacgcgtag

SEQ ID NO: 31853 - DNA, 936 bp, Artificial Sequence
  Description of Artificial Sequence: Synthetic coding sequence
atggcaaggccacagccatgtggcccgccccatgcgcggtgtggctctcccagcctgccagaaaggccgctacaagttaaagtggtggggctctttagctgccctaacttccaaatcgccaagtccgctgccgagaatctgaagaacaatcatcctagcaagttcgaagatcccatcctagttcctttacaggaatttgcgtggcaccaatatcttcaagagaagaaacgagagttgaaaaatgagacatgggaatacagttcatctgtcataagtttcgtcaatgggcagttcttaggggacgcgcttgatctgcaaaagtgggcccacgaggtgtgggacatcgtggacattaaaccctctgccctctacgatgccctgaccgaagacttttccgccaagttcctaagagatactaagcacgatttcgtatttctggatatttgcatcgattcatctccaatcggccggctcattttcgagctgtattgcgacgtttgcccgaaaacgtgcaaaaactttcaggtgctgtgtaccggcaaggctggtttctcacagcgcggaatccggcttcactacaaaaattcaatcttccatagaattgtgcagaatggctggattcagggaggggatatcgtctacggcaagggcgacaacggggaaagtatctacggcccaacttttgaggatgagaatttctccgtccctcacaataagcggggcgtgcttggaatggctaacaaaggtcgccactcaaacggatcccagttctacataaccctgcaggcaacgccatacttggataggaagttcgtagctttcggacaattgatcgagggaacagaggtactgaaacaattggaactcgtgcccacccagaacgaacgacctattcacatgtgtaggatcactgactcaggcgacccttacgcgtag

SEQ ID NO: 31854 - DNA, 1014 bp, Artificial Sequence
  Description of Artificial Sequence: Synthetic coding sequence
atggctagaccccaaccctgtggacctccccacgctaggtgtggctcaccctctctccctgagcgacctttgcaagttaaggtggtggggcttttttcctgccctaactttcaaattgccaaaagcgccgccgaaaatcttaagaacaaccacccctcaaaatttgaggaccctattctggtgcctctgcaagagtttgcctggcaccagtatctgcaagagaagaaaagggaactgaaaaatgaaacttgggagtacagtagttccgtcattagtttcgtgaatggacagtttctgggggacgctctggacctccagaaatgggcccacgaggtgtgggacatagttgacatcaagccatctgctctttacgacgcacttacagaggattttagcgcgaaattccttagagacactaagcacgactttgtttttctggatatttgtatcgattcttctccaatcgggcggctgatcttcgagctgtattgcgatgtatgtccgaaaacctgtaagaatttccaggtcttgtgtaccggcaaggccggtttcagtcagagaggaatcaggctccattacaagaactctatctttcaccgtattgtgcagaacggatggatccagggcggtgatatcgtgtatggtaagggagataatggtgagagcatttatgggccaacctttgaggaactctacggaagcttgaagaggtctgtgaagaggcagaaagagtcacggggcgttggaaagattgaaaagtacagggatgaaaatttcagcgttccacataataagcgcggagtgttaggcatggccaacaagggcaggcactcaaacggtagtcagttttacatcaccttacaggctaccccttacctggaccgtaagtttgtcgcttttggtcagctgatcgagggtaccgaggtgctgaagcaactggagctagtgcctacccagaacgagaggcccatccacatgtgtaggataaccgactccggcgacccctacgcctag

SEQ ID NO: 31855 - DNA, 495 bp, Artificial Sequence
  Description of Artificial Sequence: Synthetic coding sequence
atggtcaactcagtggtgttttttgagattactcgcgacgggaagcccctaggcaggatctccataaagctttttgcagacaagattcctaagacagccgaaaacttcagggccctgtcaacaggagagaagggcttccgatacaagggctcttgttttcaccggattattcccggctttatgtgtcagggcggagactttacccgccctaatggaaccggagataaatctatctatggagagaagttcgatgatgagaacctgattcggaagcacacaggttcgggaattctgtcaatggctaacgctggcccgaacaccaacgggtcccaattctttatttgtgccgcaaaaactgagtggctggatgggaaacacgttgcattcgggaaagtgaaggagcgggtcaacattgtggaagctacagagcactttgggtacagaaattccaagacgtccaaaaagatcacgatcgcggactgcggccagttttag

SEQ ID NO: 31856 - DNA, 495 bp, Artificial Sequence
  Description of Artificial Sequence: Synthetic coding sequence
atggtcaattccgtggtctttttcgaaatcactcgtgacggcaagcctctggggcggatcagtatcaagctgtttgcagataagatccccaagaccgcggagaatttccgggcgctttcgaccggagaaaagggattcagatataagggtagctgtttccacaggataatccccgggtttatgtgccaggggggtgactttactcggccgaacggtacaggggacaagtctatctatggggagaagttcgacgatgagaacctgattcggaagcacaccggctctggcatactatccatggctaatgccggaccaaatactaacgggagtcagtttttcatctgcgcagctaaaaccgagtggcttgacggcaagcatgtggcgtttgggaaagtcaaagagcgggtgaacattgtggaagccacagagcatttcgggtatagaaacagcaaaacatcaaaaaagatcacgatcgctgactgcggccagttctag

SEQ ID NO: 31857 - DNA, 423 bp, Artificial Sequence
  Description of Artificial Sequence: Synthetic coding sequence
atgcacaggggggtgggcccggcttttcgggtagttcgtaagatggctgcgtctggtgcggagccccaggtgctggttcaatacctcgttctgcgaaaagatctaagtcaggcacccttttcatggcctgccggagctctagtggcacaggcctgccatgcagccacagccgccctgcacacccaccgggaccatcctcacaccgcggcttatctgcaggagctggggaggatgaggaaggtcgtgctggaagcccccgatgaaacaacactgaaggagttggcagagactctccagcaaaagaacattgaccacatgctttggctagagcaacctgagaacattgctacatgcattgccttgaggccctatcccaaggaggaggtgggacagtatctaaaaaagtttcgtcttttcaagtag

SEQ ID NO: 31858 - DNA, 393 bp, Artificial Sequence
  Description of Artificial Sequence: Synthetic coding sequence
atggcagacgggaaggctggggacgaaaagcctgagaaatcgcagcgcgcgggtgccgcagggggacccgaggaggaagccgaaaaacccgtgaaaactaagacagtcagcagctctaacgggggagagtcaagttctcgttccgccgaaaaacggagcgctgaggaggaggcggctgaccttccaacaaagccaaccaaaatcagcaaattcgggttcgcgatcggatcccagactacgaaaaaggctagcgcaatctctataaaattaggcagctcaaagcctaaggagactgtgcctaccctcgcaccaaagacattgtcagtggcagctgcttttaacgaagatgaagacgggtacacaaacatttcatggacaaagctgttgcagtag

SEQ ID NO: 31859 - DNA, 222 bp, Artificial Sequence
  Description of Artificial Sequence: Synthetic coding sequence
atgggagtgaagttggaaatattcagaatgatcatctatctcacctttcctgtggccatgttttgggttagtaaccaggccgagtggttcgaagacgatgtcatccagagaaaacgggagctttggcctccggagaagctgcaagaaatagaagagtttaaggagcgactgcggaaaagaagagaagagaagctgttacgggacgctcaacagaacagttag

SEQ ID NO: 31860 - DNA, 2667 bp, Artificial Sequence
  Description of Artificial Sequence: Synthetic coding sequence
atggatcgcagtagcaagagacggcaagttaagcctctggccgcctccctgttggaggcactggattacgactctagcgatgactctgactttaaagtgggcgacgccagcgattctgaagggtcagggaatgggagtgaagatgcttccaaggacagtggcgagggttcttgcagtgacagcgaagagaacatcctcgaggaggagctgaacgaggacatcaaggtgaaggaagagcaactgaagaactccgcagaggaggaggtgctgtcatcagaaaaacagcttattaaaatggagaaaaaagaggaagaagagaatggagaaaggccccgaaagaagaaagagaaggagaaggagaaagaaaaagaaaaagagaaggagaaggagcgagaaaaggagaaggagaaagcgactgtgtctgagaacgtcgcagcttccgctgcagccactaccccggctacatcgcccccggccgtgaacacttcaccttcggtacccacaaccaccacggctactgaagagcaagtgagcgagcccaaaaaatggaacctcagacgcaaccggcctttgctcgatttcgtcagcatggaagaacttaacgatatggatgattacgacagtgaggacgataacgactggagacctacggtcgtaaagcgcaaggggcgcagtgctagccagaaagagggatctgatggcgacaacgaggacgatgaagatgagggctcgggcagcgatgaggacgagaacgacgaaggtaatgacgaagaccactcctcgcctgcttctgaagggggctgtaaaaagaagaagagtaaggtgctgtcccgcaattctgccgatgatgaagaactgacaaacgacagtctgaccctatcacagtcgaagagtaatgaggacagtctgatcttggaaaagtcccagaactggagtagccaaaaaatggaccatatccttatttgttgcgtgtgcctgggcgataatagtgaggatgctgacgaaatcatccagtgcgataactgcggcattaccgtgcatgagggatgctacggagttgatggcgagagtgactcaatcatgagctccgcttcggagaactcaactgaaccctggttctgtgatgcttgcaaatgtggtgttagtccttcatgcgaactgtgtcccaatcaggatggaatcttcaaagagactgatgccggccggtgggtgcacatcgtgtgcgctctttacgttcccggtgtggcctttggcgatattgacaagttgcggccagtgaccttgacagaaatgaattacagcaagtatggcgccaaagagtgctcgttctgcgaggatccccgtttcgcacgtactggcgtttgcatatcttgtgatgcaggcatgtgtagggcttactttcacgtgacctgtgcacaaaaggaaggtttactctccgaggcagctgctgaggaggacattgcagaccctttcttcgcttattgcaaacagcatgcagatcgcctggacaggaagtggaagagaaagaattacctcgccctgcagtcgtattgcaagatgtcgcttcaagagagagagaagcagctgtcgcccgaagcacaagcaagaataaatgcccgattgcaacagtaccgagctaaagctgaactggccagatctacaaggccccaggcctgggtaccacgcgaaaagctcccccgaccgttaactagcagcgcaagcgcgattagaaagctgatgcgcaaggcagaacttatgggtatcagcaccgatatcttccccgtcgataacagcgacacatcttcttcggtggacggcaggcgtaagcataaacagcccgccctaacagccgactttgtgaactattacttcgagcgcaatatgaggatgatacagatccaggagaatatggcagaacagaagaatatcaaggacaagttagaaaacgagcaggaaaaactccacgtagaatacaacaagctgtgcgaatccctggaagagttacagaacttgaatggtaagcttagaagtgaaggtcaagggatctgggccctactgggacggatcaccggacagaagttgaacatccctgcaatcttgagagcccctaaggaacggaagcccagtaagaaggaaggggggacacagaagacaagtacccttcctgctgtactttactcctgtggtatctgcaaaaagaaccatgatcagcatctcctgctgctatgcgacacatgcaaattgcattaccacctgggttgtcttgatcccccgctgacacggatgcccaggaagacgaaaaactcctattggcagtgctctgaatgcgatcaagcaggatcatcggatatggaagctgacatggccatggaaaccctgccagatgggacaaaacggtccagacgccaaatcaaagaacctgtgaagtttgttccacaggatgtgccacctgagccaaaaaaaatccctatccgcaatactaggactaggggccggaagcgaagtttcgtccctgaggaagagaagcatgaggagagagtccctcgggaacgtaggcagagacagtcagttctgcagaaaaagccaaaggctgaggatctccggacggagtgcgcaacgtgcaagggtacaggcgacaatgaaaatctggtgcggtacccctcctag

SEQ ID NO: 31861 - DNA, 1992 bp, Artificial Sequence
  Description of Artificial Sequence: Synthetic coding sequence
atgattgtacaaatgacagtcatattaaaattggaaatgccccaggacagcctcatcttagaaaagtctcagaattggtcaagtcagaagatggaccacatcttgatctgctgcgtctgccttggcgataattctgaggacgccgacgagattattcagtgtgataactgtgggattaccgtacacgaaggatgttatggtgtggacggggagagtgattccatcatgtccagtgcgtcagagaacagcacggagccatggttctgcgatgcatgcaagtgcggcgtgagccccagctgcgaactctgccctaatcaggacgggatcttcaaggaaacagacgccggcagatgggttcatattgtgtgcgccctgtatgtccctggcgtggccttcggagatatcgacaagctgaggccagtaacgttgaccgaaatgaactactctaagtacggcgccaaggaatgctcattctgcgaggacccacgctttgccagaaccggagtctgcataagctgtgacgccggcatgtgccgggcgtattttcacgtgacctgtgctcaaaaggagggattactcagtgaggctgccgcggaagaggacattgccgatccattcttcgcctactgtaagcagcacgccgaccgcttggaccgaaagtggaagcgcaagaattacttggctctccagtcatactgtaagatgagcctccaggagagagagaaacaactgtctcctgaagctcaggcgcgcattaatgcaaggctgcagcagtaccgagccaaggccgaactcgcaagatctaccagacctcaagcttgggtgcctagagagaaactgccaagacctcttaccagttcagccagcgccattaggaagctgatgaggaaggccgagttgatgggcatatccaccgatatctttccagttgataacagcgatacctcctccagcgtggatggtcgcaggaagcacaaacagccagccctgactgccgacttcgttaactattattttgagaggaacatgcggatgattcagattcaagagaatatggccgagcagaaaaacatcaaagataaactggagaacgaacaggagaaattgcatgtcgagtacaataaattgtgcgagtctctggaagaacttcagaacctgaacggcaagctccgttcggagggccaggggatttgggctttgcttggccgcatcactggccagaagcttaacattcctgcaatcctgcgcgcacctaaggagagaaagcctagcaagaaagaaggaggcactcagaagacttccacacttcctgcagtgttgtattcctgcggcatctgcaaaaagaatcacgatcagcacctcctcctgctgtgcgatacatgcaagctgcattaccacctcggctgtctcgatccccctcttactcgcatgcctcgcaagaccaagaactcatactggcaatgctccgaatgtgaccaggccggctcctctgatatggaagcagacatggctatggagacgcttcccgacggcactaagcggtcgaggcggcaaattaaggagccagtcaagtttgtccctcaggacgttccgcctgaacccaagaagatcccaatccggaatactaggacacggggacgcaagagaagctttgtccccgaagaagagaagcacgaagaaagggtgccccgcgaacggcggcagcgtcaatcagttctccagaaaaaaccgaaagctgaggatttgcgcaccgagtgcgccacttgtaagggtaccggggataacgaaaatctggtgcggtgtgacgagtgtaggctgtgctatcatttcggttgtctagatcccccccttaagaagtctccgaagcagacagggtacggatggatctgtcaggagtgtgacagttcgagctctaaggaagatgaaaacgaggccgagagaaagaacattagccaggaactgaatatggaacagaagaatcctaaaaagtag

SEQ ID NO: 31862 - DNA, 1077 bp, Artificial Sequence
  Description of Artificial Sequence: Synthetic coding sequence
atggccgagaggcaggaggaacagcgcgggagcccccccctccgtgcagaggggaaagctgatgccgaggtcaaactgattctctaccactggacacacagtttttcctcccagaaggtcagacttgtgatagctgagaaggcgttaaaatgtgaggaacatgacgtatctctccccttatccgagcacaatgaaccgtggttcatgcgtttgaattccacaggagaagtgccagttctgatccacggcgagaatatcatttgtgaggcaacccaaatcatagattacctagaacagacctttctcgacgagcggaccccccggttgatgccggacaaggaatcaatgtactaccccagggtgcagcattatagagaactgctggactctttgcctatggacgcatacacccacggatgtatccttcatcccgagctgaccgtggattctatgattcccgcctacgctactacacggattaggtcccagattgggaacaccgaatctgaactaaagaagctcgccgaggagaaccctgacctgcaggaagcgtatatcgccaagcaaaaacgcctaaagagtaagctgttggatcatgataacgtgaaatatctgaaaaagatacttgacgaactggagaaagtcttggaccaggtcgagactgaactgcagcgcaggaatgaagaaacacctgaggaaggccagcagccatggctgtgtggggaaagctttactttggcagatgtgagcctggccgtgactctgcataggctgaaattcctggggttcgctcggcggaattggggaaacgggaagagacccaacctggaaacctattacgaaagggtcctcaagcgcaaaacatttaataaggtgttaggacacgtcaataacatactcatctctgcagtgctcccaactgcttttcgcgtggctaagaagcgagcccctaaagtcctgggcactacattggtagtcgggttgctggcgggagtcgggtactttgccttcatgttgtttcgaaagcgactcggttcaatgattctcgcattcaggccgaggccaaattacttttag

SEQ ID NO: 31863 - DNA, 1722 bp, Artificial Sequence
  Description of Artificial Sequence: Synthetic coding sequence
atgtctaaaaaaccccctaaccggccaggtataacttttgagatcggtgctaggctcgaggctctggattacctgcagaagtggtacccaagccgtattgaaaagatagactatgaagaggggaagatgctggtgcatttcgagaggtggtcccacaggtatgacgagtggatatactgggactcgaacagacttcggccactcgagagacctgcactgcgcaaggaggggctaaaagatgaggaggattttttcgacttcaaagctggtgaggaggttcttgccaggtggacagattgccgatattatccggccaagattgaggcaattaataaagagggtacattcactgtccagttttacgacggggtcattcgctgtcttaaaaggatgcacattaaagccatgccagaggacgcaaaaggccaagtgaaaagccagcaccctctgtcatggtgttgtcccattgaccctgccggatcgtgcaatcagtcaatgggtagcgaggactggattgctctcgttaaagctgcagcagccgccgctgcgaaaaacaaaaccggcagcaagccgaggaccagcgccaacagcaacaaagacaaggacaaggatgagagaaagtggttcaaggtgccgtcaaagaaggaggagactagcacctgcattgcaactcccgatgtggagaagaaagaggatttgccaacctcttccgagactttcggtctgcatgtggaaaatgtgcctaagatggtctttccacagccagagagcaccctgagcaataaaagaaaaaacaaccagggcaactcctttcaagccaagcgtgcgagacttaacaaaatcactgggctgctggcttcaaaagctgtcggcgtggatggtgcagagaagaaagaggattataatgaaaccgcccccatgctcgaacaggccattagccccaagcctcagtcccagaaaaagaacgaggctgacatatccagtagcgccaatacccaaaagccagctttactcagcagtacccttagttccggtaaagctcgatccaaaaaatgcaaacacgagagtggcgactcttcaggttgtatcaagcccccaaagagtcccctgagtcctgagttgattcaagtggaggatttaacattggtgtcacagctgagctcttccgtgattaacaagacttctccgccacagcccgtgaatcctccgcggccgtttaaacattccgagcggcgacgccgcagccaacgactggccaccctccctatgccagatgattcagttgagaaggtgtcaagccctagccccgctacagacggtaaggtgttctccattagtagtcaaaatcaacaagagtcctctgtcccggaggtgcctgacgttgcccatctgccgctggagaagttaggcccttgccttccactagacctgtcccgagggagtgaagtgacagccccagtggcctcagacagttcataccgcaacgagtgtccccgagcggagaaggaggacacacagatgttgccaaatcctagctctaaagcaattgcagacggtcgtggcgctccagctgcagccggaatctccaaaacagagaaaaaggttaagctggaggacaaatcttctactgcattcggaattcggagttgggatttttcagctctattgatgaagattccctcatattccccgatttcactctctggactccccgagtcatag

SEQ ID NO: 31864 - DNA, 1332 bp, Artificial Sequence
  Description of Artificial Sequence: Synthetic coding sequence
atgcacatcaaagccatgccggaggacgctaagggtcaggttaaatctcaacaccctctatcatggtgttgcccaattgacccagcgggatcttgtaaccagtctatgggaagcgaggactggatcgcgttagtaaaagcagccgctgcagccgccgccaaaaataaaaccggatctaaacctcgtacctctgccaatagcaataaggataaagataaagacgagaggaaatggtttaaggtccctagtaagaaggaagaaactagcacatgtattgcaaccccggatgtcgagaagaaagaggatctgccgacgtcctctgaaacattcgggctccacgtggagaatgttccaaaaatggtcttcccgcagcccgaatccacattgagcaataaaaggaagaataaccaggggaattcatttcaggcaaagagagccaggctcaacaagatcaccggtctgctggcgagcaaggccgttggcgtggacggcgccgagaagaaggaagactataacgagaccgcccccatgttagaacaagcaattagcccaaaaccgcagagccaaaaaaagaacgaagccgacatctccagcagcgccaacactcaaaaacccgcattgctctcaagtaccctttcatccggtaaggcgagatccaagaaatgtaagcatgaatccggggacagctcaggctgcattaagccacctaaatcccctttgtcacccgagctcatccaggttgaggatctcaccctcgtgtcccagttgtccagtagtgttatcaacaagacttcaccaccacagcccgtgaacccaccccgcccattcaagcattctgagcggcgccgccggtcccagcgactggcaactttgccaatgccagatgactcagtggagaaagtgagcagcccctcacccgcaacggatgggaaagtgttctctatatcctctcagaaccagcaagagagctccgtgcccgaagtgcccgacgttgcccacctgccgctggagaaactgggcccctgtctgcctttggatctgagtcggggaagtgaagtgaccgcacccgtggcatccgactcttcttatcggaacgagtgtccccgcgccgagaaagaggatacccagatgctccccaatccctcatccaaagccatcgctgacggtcggggagctccagcagccgccgggatctccaagacggagaagaaggttaagctggaagacaaatcctcaaccgcattcggaatccgaagttgggatttctccgccctcctgatgaaaattccttcctactcacccatctctctctctggtctccccgagagctag

SEQ ID NO: 31865 - DNA, 858 bp, Artificial Sequence
  Description of Artificial Sequence: Synthetic coding sequence
atgagcaagaaacccccaaatcggccaggcattacgttcgaaataggggctagactcgaggccttggactatttgcagaaatggtaccccagcagaattgagaagattgattatgaagaggggaaaatgttggtacattttgagcgatggtctcacagatacgatgagtggatatactgggatagtaaccgcctgcgccctttagagcgaccagccctcagaaaggaaggcttaaaagatgaagaggactttttcgacttcaaggccggagaggaagtgctggctaggtggaccgattgcaggtactacccggctaagattgaagccatcaacaaagaggggactttcaccgtgcagttttatgacggtgttatccgttgcctgaaaaggatgcacatcaaagctatgccggaggacgccaagggacaggactggatcgccctagtaaaggctgctgccgctgccgctgcgaaaaacaagaccggctcaaagccccggacttccgcgaattctaacaaagataaagacaaggacgagcgcaaatggtttaaggtccctagcaagaaggaggagactagtacctgcatcgctactccggatgttgaaaaaaaggaagatcttccaacttcttccgaaacgttcggcctgcatgtcgagaatgttcccaagatggtttttccacagccagaaagtacactctctaataaaaggaaaaacaatcaaggaaatagtttccaggctaaacgtgctagattaaataaaatcaccggattactcgccagcaaagccgtgggtgtggacggcgcagaaaaaaaggaggactacaacgagacggcacctatgttggagcaagtctag

SEQ ID NO: 31866 - DNA, 3054 bp, Artificial Sequence
  Description of Artificial Sequence: Synthetic coding sequence
atgtcaaagaagccaccaaaccgccctggcattacttttgagatcggggcccggcttgaggccctcgactacctgcaaaagtggtacccaagccgtattgaaaagattgactacgaggagggtaaaatgcttgtgcacttcgagcggtggagtcacagatacgacgagtggatctattgggacagcaatcgccttaggccgctggagagacccgcattgaggaaggaaggactgaaggatgaagaggatttctttgactttaaagccggcgaagaagtgttggcaagatggacagactgtcgatattatccagctaaaattgaagccatcaacaaagagggcacctttacagttcagttttatgacggggtgatccggtgccttaaacgtatgcacatcaaagctatgcctgaggatgccaaaggccaggtgaaatcacagcaccccctgagctggtgctgccccatagatccagccgggtcatgtaaccaatctatgggcagcgaagattggattgccctagtcaaggcagcagctgccgcagccgccaagaacaagactggatcgaagccacgtacaagtgcaaattcaaacaaggataaagacaaggacgagcgaaagtggtttaaagttccgagtaagaaggaggaaacctctacctgcattgccactccagacgtcgagaaaaaagaggacctccctacttcctcagaaactttcggattgcacgtggagaatgtgccaaagatggtattcccacagccagagagcactctgagcaacaagaggaagaacaatcagggaaactctttccaggctaaaagagccaggctgaataaaataactggactcctggctagcaaagctgtgggcgtcgatggagctgaaaagaaagaagattataatgaaaccgctcctatgctagagcaggcaattagcccaaagccccagtcacagaagaagaacgaggccgacatcagcagctcagccaatactcagaaacccgccctgctctccagcaccctgtctagcggaaaggcccgctcaaaaaaatgtaaacatgagagtggtgactcctccggatgcattaagcctccgaagagtcccctcagtcccgaactgattcaggtggaggacctcacactggtgtcccagctgtcctcatcagtgattaataaaacatccccgccccagcccgtaaaccctccacgcccctttaagcattccgagcgacggcgtagaagccaaaggctcgctaccctgccaatgccagatgacagtgttgagaaagttagcagtccctcacctgcaaccgacgggaaagtcttctccatcagcagccaaaatcaacaagaaagctcggtaccagaagtccctgacgtcgcccatctacccctagaaaagttaggcccgtgcctgcctctggacttgagtcgaggcagtgaggtgaccgcaccagttgcgtctgactcatcatatagaaacgagtgcccgagggctgaaaaagaggatactcagatgctccccaacccctcatctaaagccatcgcagatggacgcggggccccggccgctgcagggatcagcaagactgagaagaaggttaaattagaagataagagttctacagcattcggaaagcgtaaagagaaagacaaggagaggagagagaagagggataaggaccattatcgaccaaagcaaaagaagaagaagaagaaaaagaaaaaatccaagcaacatgattattctgattatgaagatagcagtttggaatttctggagaggtgttcgagcccactgacaagaagcagcggcagcagcctcgcttcccgctccatgtttaccgagaaaacaacaacttatcagtacccgagagctatcttatcagtggacctgtcgggggaaaatctcagcgatgttgattttctggatgattcctctaccgaatccttgctgctgtctggagacgaatataaccaggacttcgattcaactaacttcgaagagtcccaggatgaggacgacgcgctcaacgaaatcgtgagatgcatctgtgaaatggacgaggagaatggattcatgattcagtgcgaagaatgcctgtgctggcaacactccgtgtgtatgggactcttagaagaatcaatccccgaacaatacatctgttacatctgccgagaccccccaggccagagatggtctgccaaataccgctatgacaaggagtggctcaacaatgggcggatgtgtggcctgtccttcttcaaagagaattattcccaccttaatgccaaaaaaattgtatctacacatcacctgctggccgatgtgtatggcgtaaccgaagttcttcatggcctgcagctgaagatcggcatcctgaaaaataaacaccatcctgatctgcatctctgggcctgcagcgggaaacggaaggatcaagatcaaatcattgctggagtcgagaagaaaattgcacaagacacagtcaacagagaggaaaaaaagtacgtccagaaccataaagagcctcctcgactgcctctgaaaatggaaggtacctacattacatcagagcacagctatcagaaaccgcagtcttttgggcaggactgtaagtctctggcagacccaggatctagcgacgacgacgacgtgtcctccctggaggaagaacaggaatttcacatgaggagcaaaaactcgctgcagtactcagctaaggagcacggcatgcccgaaaaaaatcctgccgagggaaacaccgtgttcgtgtataacgataagaaggggacagaggatccaggcgattcccatcttcagtggcagttgaatcttctgacccatatcgagaacgtgcaaaacgaggtcacgtcccggatggatctgatcgagaaagaggttgatgtactcgaaagctggctcgacttcacaggtgagttggagccgccggatcctcttgctagactccctcaacttaagaggcacattaagcagctgctgattgacatgggtaaggtacagcagatcgccaccctctgctcagtgtag

SEQ ID NO: 31867 - DNA, 1596 bp, Artificial Sequence
  Description of Artificial Sequence: Synthetic coding sequence
atggaacttcagtctagacctgaggcactcgccgtggaattggccagacatcaaaacggcgatctaaaaaagcaactgcacgaaagacagccgcggatcgcagcactttctgataaacaagctctcggcacaattacagccgtccctgtgactggaccccaagtcagctccctgcagaggctggctgggcagggggcggcagttctgccacaggttcgtcccaagacactgatacccgattccttgcccgtggccccggggcgggacaggccccctaagcagccgcctacattccagaaagcaaccgttgtaagcgtgaaaaacccctcccccgctctccccactgcgaataacaccgtctcccacgtaccagctcctggttcacagccccaggcattagcagaaccagcagctttagcctctccattgtcgtcagccggtgtagcctacgccatcatctccactagtccatccaacgccgccgcgatggctccttcaactgctgtgagcgtggtgtctgatagcatcaaggtacaacctctgctgatttccgcggacaacaaacccccaccacggctgttgtcttctccccatccagccacacaccattgccctctacatccgagtagcctccctttgacgccgccgagcccatcactgtccccctcacccctccacggaatttttcaggtcatcataatccagccgcaggtgcagactcagcccgagagcactgctgagtcccggccgccaaccgaagaacccagtcaaggtgcccaggccaccaaaaaaaagaaggaagataggccacctactcaggaaaatcctgaaaagatagcttttatggtggcgctcggtctggtaacaacagagcacttggaagaaatccagagcaagcggcaagagcggaaaaggcggagtactgccaatcctgcatacagcgggctgctggaaaccgaaagaaagagactcgcgtctaattacctcaacaacccactgtttctgacagccagggcaaatgaggacccctgctggaaaaacgagatcactcatgacgagcattgcgctgcttgcaaacggggggccaacttgcagccatgcggaacatgcccaggtgcgtaccacctgtcctgtctcgagccacccctcaaaactgcgcctaagggcgtgtgggtctgccctcggtgccagcagaaggcccttaagaaggacgagggcgtaccctggacagggatgttagccatagtccactcatacgtgactcacaaaaccgtgaaagaggaggaaaagcagaagttgctccagaggggaagtgaactccaaaatgagcaccagcaactggaggaaagagatcggcggcttgctagtgctgtgcagaaatgcttagagctgaaaactagtttgttggctcgccagcggggcacccagagctccctggacaggctgcgagccctgctccggttgatccagggtgagcagttactacaagtgaccatgaccaccacttccccagcgcccttgctggccggcccgtggacgaagccttcagtagccgcaactcatccaactgtgcaacacccccaaggccacaactag

SEQ ID NO: 31868 - DNA, 1470 bp, Artificial Sequence
  Description of Artificial Sequence: Synthetic coding sequence
atggaactgcagtctcgcccagaagcgctggcagttgagttagccagacatcagaatggggatctgaaaaagcaactgcacgaaaggcagccgcgcattgccgccctgtccgacaagcaggccctggggactataaccgctgtgcctgtaaccggcccccaggtgagttccctgcaacgccttgctggacagggtgccgcagtcttgccacaggtgagacccaagaccctcatccctgattctctccccgttgcgcccgggagagatcgcccccccaaacagccccctaccttccaaaaagccactgtcgtcagcgtgaaaaacccatctcccgctctccctactgctaataacaccgtctcacatgtccccgcacctggaagccagcctcaggcacttgctgaaccagccgctctcgcctcgccgctctcaagtgcaggggttgcctatgccatcatttcaacatctccctccaatgccgcagccatggcaccgagtaccgccgtctccgtagtttctgattccataaaggttcagcctctgctaatcagtgccgacaacaaggtgatcatcatccagccccaggtgcagacccaaccagaaagcacagctgagtctcggccaccaactgaggagcccagtcagggcgcacaagccacaaaaaagaagaaagaagatcgccccccaacccaggagaaccccgagaagattgccttcatggtggcactcggccttgtgactaccgagcatctggaggagatccagtcgaaaaggcaagagagaaagcgccgcagtacagcaaacccagcatacagcggcctgctggagaccgaaagaaaacggttggcgagtaactacctcaacaaccctctcttccttaccgctagggcgaatgaggacccatgttggaagaatgagatcacccatgacgagcattgtgcggcttgtaaaaggggcgctaatttacagccttgtggcacctgcccgggggcctatcacctctcttgcctggaaccgccactgaaaacggcacccaagggggtgtgggtctgcccccgctgccaacagaaggcgctgaaaaaagatgaaggggtaccctggactgggatgctcgcaatcgtgcattcttatgtgacccacaagactgttaaggaggaggaaaagcagaagttgttgcagcgcggctccgaactgcaaaacgagcaccaacagctggaggaaagagatagacgactggctagcgcggtgcagaagtgcctcgagctcaagacaagcctcctagctaggcagcggggaacgcagagttcactggatagactgagagcgcttcttaggcttattcagggagagcaactgttgcaagttactatgaccaccacaagtccagctcccctgctcgccggcccttggaccaagccttctgtggccgcaacacacccgactgtacagcatcctcagggccacaattag

SEQ ID NO: 31869 - DNA, 1434 bp, Artificial Sequence
  Description of Artificial Sequence: Synthetic coding sequence
atgaggaggcaaccacagaatggcgatctgaaaaagcagctacatgaacgtcagcccaggatcgctgcactgagtgacaaacaggctctcggcactataactgcagtgcccgtgaccggtccccaagtctcgtcactccaaaggttggctggccaaggtgctgccgtcctgccccaggttcgtcccaagacgctgatccccgatagcctaccagtcgcccctggacgcgatcgcccgcccaagcagcctcccacttttcagaaggcgactgtagtgtctgtaaagaatccgtcaccggccctccctaccgcaaataacacggtgagtcacgtgcccgccccgggtagtcagcctcaagccctcgcggagccagcggcgttggcctctccactttcatctgcaggcgttgcctatgccatcatttctacaagcccttctaatgccgccgctatggcaccttcaacagcagtgagcgtcgtgtcggacagcattaaggtccaacctttgttgatctctgcagacaacaaagtgatcatcatccaaccacaggtccagacccaaccggaatccacagcagagagccggccacccaccgaggagccttcacagggtgcccaggccacgaagaagaaaaaagaggatagaccacccactcaggaaaacccagaaaagatcgctttcatggtggcactgggacttgttacgaccgagcacttagaggagatccagagtaaacgccaggaacgcaaacgccgctctacagccaaccctgcttactccggcctgctggagactgagcgtaaaaggctcgcctccaactatctaaacaacccactcttccttaccgcacgggccaatgaagacccctgttggaagaatgagattacccacgatgaacattgcgccgcttgcaaaagaggcgcaaacttacaaccgtgcgggacctgtccaggggcctaccacctgtcgtgcctggaaccacccttgaagacagctcccaagggagtttgggtatgcccacggtgtcagcaaaaagctttgaaaaaggatgaaggagtcccatggaccggtatgctggcgatcgtacacagctatgtgacacacaagacagtgaaggaagaggagaaacaaaaattgctgcagcgagggagtgagctgcagaacgagcaccagcagcttgaggagcgcgatcgtcgcctcgcctcagccgtgcagaagtgcctggaactgaagacaagtctgttagcccggcagcgggggacacagtctagcttggatagacttcgagcactgcttcggctgattcagggagaacagctgctgcaggtgactatgactactacgagtcctgcaccgctgctggccggaccgtggacaaagccgtctgtcgccgccacccaccctacggtgcagcacccccagggtcacaactag

SEQ ID NO: 31870 - DNA, 873 bp, Artificial Sequence
  Description of Artificial Sequence: Synthetic coding sequence
atgagaagacagccccagaacggggatctgaagaagcagctgcatgagcgccagcctaggatcgccgcactatccgataaacaggcactgggcaccatcactgctgtacctgtgactgggccccaagtatcttccctgcaaagactggccgggcagggcgccgcagtgcttccccaggtgcgaccgaaaactctgattccagattctctgcccgtggcgccgggcagagaccgcccccccaaacagccacccacctttcagaaggcgacagtggtgagtgtgaaaaacccctctccggcgcttcccaccgcaaacaatacagtgagccacgttccagcccccggcagccaacctcaggcactcgccgaacccgcggccctagcttcacccctcagttctgctggcgtcgcgtatgccatcatcagtactagcccatctaacgccgcggcgatggcaccctcaaccgctgtctctgtcgtgtccgattcaataaaggtacagcccttgctaatctcagcagataacaaagttattattatccagccacaagtacagacacagccggagagtactgcagagagccgccccccgacagaggagccctcccaaggagctcaagccaccaagaagaaaaaagaagaccgtcctcctacccaggagaatcctgaaaagattgccttcatggtggctctggggctcgtaacaacagagcatctagaggagatccagtcaaaacggcaggagcggaagcgcaggtctacggctaaccccgcttattcgggtctgcttgagacagagcgaaaaaggctagcaagcaactatctgaacaaccctctatttctgacggcaagggaacgcgatcatcctcggtag

SEQ ID NO: 31871 - DNA, 1743 bp, Artificial Sequence
  Description of Artificial Sequence: Synthetic coding sequence
atggactatcctaagatggactattttctcgatgtggagtccgctcatcggcttctggacgtcgagtccgcgcagcggtttttttattcacagggtgcccaggctcgcagggcaacgctgctgctgccaccaacactaatggctgcctcgagcgaagatgacatcgatcggcggcccatcaggagagtgagatctaagagcgacaccccctacctcgcggaggccagaatcagttttaatctgggtgccgcggaagaggttgaacgcctcgcggctatgagaagtgactccctcgttcctggaacccacaccccacccataagacggcggtctaaatttgccaatctcggacgaatcttcaaaccttggaaatggcgtaaaaagaagtctgagaaattcaagcacacctccgccgctctcgagcgcaagatttcgatgagacaaagtagagaggagctaatcaagcgaggcgtcctcaaggagatctacgacaaggacggagaactgtccatctcgaatgaggaggactcactggaaaacggccagtcattgtctagctcccagctgtcattgcccgccctgtcagagatggagccagtaccaatgccacgcgacccctgttcctacgaggtgctgcagccatcagatattatggacggcccagatcctggcgccccagtcaaactgccgtgcctcccggtgaaactgagcccacccctgccacctaagaaggtgatgatttgcatgccagtgggcggcccagacttatctctggtcagctatacagcccaaaagagcggtcaacagggcgtggctcaacaccaccataccgtgctccccagccagattcagcatcagctccaatatggtagccatgggcagcacttacctagtacgaccggttctctgcccatgcatccaagcgggtgtcggatgattgacgagctcaacaaaactctggctatgaccatgcagcggctggagtcctccgagcaacgcgtaccctgctctacctcctaccacagtagcgggctccattcaggggatggcgtgactaaggccggcccaatgggcctccctgaaatccgtcaggtccccaccgttgtcattgagtgcgacgacaataaagagaatgtcccacacgaaagcgactacgaggactcttcctgcctgtatactcgggaagaggaggaggaagaagaggacgaggacgatgactcgagtttatacacaagtagcttagctatgaaggtgtgtcggaaggacagtcttgcaatcaagctgagcaatcgtccatccaaacgagaattggaggagaaaaacattcttccacggcagactgatgaagagcgcttggagctccgtcagcagattggtacaaagctcacacggcgactgtcacagcgccctactgccgaggaactggagcagcgcaacattctgaagcctcgtaacgaacaggaggaacaagaagagaaaagggaaattaaacgacgcctgacacgtaaactgagccagaggccaacggtggaagagctgagagaacggaaaattctgattcgcttctcagattacgttgaggtagctgatgcccaggattatgacagacgagcagacaagccttggacaagacttactgcggcagacaaggctgcaatcaggaaagaattgaatgagttcaagtctaccgaaatggaagtgcacgaactgagcagacacctgaccagtttcagattcccttag

SEQ ID NO: 31872 - DNA, 423 bp, Artificial Sequence
  Description of Artificial Sequence: Synthetic coding sequence
atgtacttgcaggggccccggaagctcatgacgcaaggcggctatgatatggttcagaaactcttcctggacttttttcggcgtagactctcgcaaaggcctacagctgaggagctcgaacagcgaaatattctgaaacccaggaacgagcaagaagagcaggaggagaagcgagagatcaaaagaaggctgaccaggaaactctcccagcgtcccaccgtggaagagttgcgggaacggaagatcctgattagattctccgattacgtggaagtcgctgatgcccaagattacgaccggagggcagacaaaccctggacccggttgaccgctgccgacaaggtgagccggggtgaatgctggagagttgggggaagaactgtgtgttgggtgtctttgggatcaccccttggctctgtttag

SEQ ID NO: 31873 - DNA, 435 bp, Artificial Sequence
  Description of Artificial Sequence: Synthetic coding sequence
atgtacctccagggcccgagaaaactcatgacacaaggaggctatgatatggtgcagaagctgtttctggacttcttcaggcgtcggctttctcagaggcccaccgcagaggagctagagcagaggaatattttaaagcctagaaatgagcaagaggaacaggaggaaaaaagagagataaagaggagactaacgcgaaagctgtcacagaggccaaccgttgaggagcttcgggagcgcaagattctgatccgtttctcagattacgtggaggtggcagacgctcaggattatgaccggagagccgataagccttggacccgcctgacggccgcagataaagcagctatccgcaaggagttgaatgaattcaaaagcacggagatggaagtccacgaactgagcaggcacctgactagattccatcgcccctag

SEQ ID NO: 31874 - DNA, 600 bp, Artificial Sequence
  Description of Artificial Sequence: Synthetic coding sequence
atgaggcagtcgagagaggagttgattaagaggggagtcctgaaggaaatttatgacaaagacggagaactgtccatctcgaacgaagaggactctctcgagaatggtcaatcgctttctagtagtcagctaagcctcccagcacttagcgagatggaaccagtgcctatgccacgagacccttgcagctacgaagtactccagccttccgatattatggatggtcctgtgagcgaggagtccccatccgccagcgagtcaggcgttctgctgtctcaggatccttccgcgaaaccggtattgctgctaccaccaaagaaaccagccgcattccccggggatcatgaggagaccccagtgaagcagctgccactgctgaagcaacctcccgccctcccaccgaagcccactactagaattgccaaccaccttaccgattggcatcaggctcaccaggttggtcagcgccaccccctaccgccctggcagtgggcctttagttctcctggatcaagcaaaagaatccagagcagaccaggagccgtggcttacgcatgcaacccttctacactgggaggacgtggacgctggattacctag

SEQ ID NO: 31875 - DNA, 510 bp, Artificial Sequence
  Description of Artificial Sequence: Synthetic coding sequence
atggattaccctaaaatggattattttctggatgttgaatccgcccacagactcctggatgtagaatccgcacagcggtttttttactcacagggagctcaggctcgccgggctaccttattactgccccctacccttatggccgcctcgtccgaggacgatattgatcgcagacccattcgacgtgtgcggagcaagagtgacaccccataccttgctgaagctaggattagcttcaatcttggtgccggtgtgtctctgtttggcgatatggacgaggcaaggatgggaccagccgtccccacgctcggccggcctctaggcctggaattgtgcagcctcgagaatcacggtctattgaagacggcccccacatacaccacgtctgctcacatttgctctggccccagcacagggggtcagttctctactcagggcatgtcacctgtgcagggagcaaagaggcgaagagtggtctggctcccacttgaaggggaagaatttggctag

SEQ ID NO: 31876 - DNA, 1455 bp, Artificial Sequence
  Description of Artificial Sequence: Synthetic coding sequence
atggattacccgaagatggattactttcttgatgtcgagtctgcccacaggctgctagatgtagaaagcgctcagcggttcttctatagccaaggagcacaggccaggagggctaccctgctgctccctccaaccctaatggcggccagttctgaagatgacatcgatcggaggcccatcaggcgtgtccggtcaaaatcagacacaccgtacctggcagaggcaaggatatcattcaacctcggtgccgctgaggaggtagagagactggccgcaatgagatctgacagcctcgttccagggacccacacgccacccatccggaggcggtcaaaattcgctaacctgggacgcatattcaaaccgtggaagtggcggaagaagaagtcagagaagtttaagcacacctctgcggcgttggaaagaaaaattagcatgcgccagtcacgggaagagctgattaaacgcggcgtgctaaaagagatttacgataaggatggcgagctgtccataagcaatgaggaggacagcttagagaatggacaatctctgagcagcagtcaactgagcttgccggcattgagcgagatggaaccagtgcccatgccgcgggatccgtgctcgtacgaggttttacagccgagcgacatcatggatgggccggatcctggagctcccgtcaagctgccttgcctgcccgtgaagctgagccctcctctgcctcctaaaaaggtgatgatctgcatgccagttgggggtccagacttatctctggtgtcttacacggcccagaagtcagggcagcagggtgtcgcccaacaccaccacaccgtgctccctagtcagattcagcaccagctacagtatggctctcatggccagcatttaccctcaacgaccggcagcctgcctatgcacccgtctggatgtcgtatgatagatgagctgaacaagaccctggccatgacgatgcagaggctggagtctagcgaacagagagtaccatgctcgacgagctatcacagttctggactgcatagcggtgatggtgttaccaaagccggacctatgggcctgccagaaatccgccaggttccgaccgtggtcatcgagtgcgacgacaataaagaaaatgtgccacatgaaagcgactatgaggacagctcttgtctgtatactagggaggaggaagaggaagaggaggacgaagacgacgacagcagtctctacaccagctccctcgctatgaaagtctgcagaaaagattcattggcgatcaagctaagcaacaggccctccaaaagggagctggaagagaaaaacatcctgcctcggcagaccgatgaggaacgcctggagttacggcagcagattggtacgaagctaacacggcgcctctcccagcgccctactgcagaggagctcgaacagcgaaacattctcaaacggaagtag

SEQ ID NO: 31877 - DNA, 798 bp, Artificial Sequence
  Description of Artificial Sequence: Synthetic coding sequence
tgatcccctttcactcctttctcccctctcctgagtttcttcttgtccccgtttttctttctgtttcccagcttgagccactccctgcctacaccctctctccctctgcctagccccttccccagcccctccccagtgcgggaaccgttgcctctgccttccagccctttccgtttgtctcccagcccttctgtgagcttcagcctgagcgcccgacgagctactctgttgctcccgcctaccctgatggccgctagttctgaagacgatattgacagaaggcccatccgcagggtccgctctaagagcgacactccataccttgccgaagccagaatctctttcaaccttggggccgccgaagaagtggaacgcttggccgcaatgcggtctgatagtctggtacccggtacccatacgcccccgatcagaaggcggagcaagtttgcaaacctaggaaggatttttaaaccttggaagtggcggaagaagaagtccgaaaagttcaagcacacaagtgcagctttggagcgaaaaatttccatgcgccagtcacgggaggagctcattaaacgcggagtgctcaaggagatctatgacaaggatggcgagctgtccatctccaacgaggaggattcgctggaaaacggccaaagcctgtctagctcacagctaagtctacctgccctctctgaaatggagcccgtgcccatgcctagagacccttgttcatatgaagtacttcagccttccgacattatggacgggcccgtatccgaagaatccccctccgcttag

SEQ ID NO: 31878 - DNA, 1248 bp, Artificial Sequence
  Description of Artificial Sequence: Synthetic coding sequence
taaggggagctttccatttccaacgaggaggactcactagaaaatggccaaagcctgagctcaagccaactgtcattacccgccctgtctgagatggaaccagtgccaatgccccgcgatccgtgctcgtacgaggttctgcagcccagtgacatcatggacggaccagacccaggcgcacccgtcaagctgccctgccttcctgtcaaactgagcccgccgctgccgccaaagaaggtgatgatttgtatgcccgtgggggggccagacttgtcccttgtctcatacaccgcccaaaagagcggtcaacagggagtggcgcagcatcaccacacggtcttgccttcccaaattcaacaccagttgcagtatggctctcatgggcagcacctgccgtcaacaaccgggagtttgcctatgcacccttcaggatgcagaatgattgacgagctcaacaagactttagccatgacaatgcagcgtctggaatcatccgagcagcgggtaccatgctctaccagctaccactcttccgggctccacagtggggacggggtcaccaaggcgggacccatgggcctccctgaaataaggcaggtgcccactgtcgttatcgagtgtgacgacaataaggaaaacgtgccccacgaatctgattatgaggatagttcatgcctgtatacacgggaggaagaggaggaagaggaggatgaggatgacgactcttcgctgtacacctcctccctggcaatgaaagtttgtaggaaggatagccttgccatcaaactgtcgaatagaccaagtaagcgagagttggaagagaagaatatcctgcctagacagacagatgaggaacggctcgagctcaggcagcaaatcggcaccaagctcactcggcgcctcagccagaggccgacagcagaagagttggagcagcggaacatcctgaaaccgcgcaatgagcaagaagaacaggaggaaaaaagggaaattaagcgccggctgacccggaagctctcacagcggcctactgtcgaggaacttagagaacgaaagattctgatccgattctccgactacgtggaggtcgcagatgcacaggactacgaccgccgtgctgataagccatggactaggttgaccgccgcagacaaagctgccattcgcaaagagctcaatgagtttaaatcgacagagatggaggtgcatgagttgtcacgccaccttaccaggtttcatcgcccctag

SEQ ID NO: 31879 - DNA, 1644 bp, Artificial Sequence
  Description of Artificial Sequence: Synthetic coding sequence
atggactacccaaaaatggactactttcttgacgtcgaatccgcccacagactgcttgacgtggagagtgcacagcggttcttctactcccagggtgctcaggctagacgagcaaccctgctattacctcctactctcatggctgcatccagcgaagacgacatagatcgacggcccatcaggcgcgtccgcagcaagagtgataccccgtatctagccgaagcccggatttcattcaacctcggggccgctgaggaagtggaacgcctcgcagccatgcggtcagattctctggtacccggaacccataccccacccatacgaaggagaagcaagtttgctaacctcgggcgcatcttcaagccctggaaatggcgtaagaaaaaatccgagaaattcaagcacacgtccgcggccctggaacgaaaaattagcatgcggcagtcccgtgaggagctgattaaacgcggagtgctgaaagaaatatacgacaaagacggcgagctgtctatctctaacgaggaggatagcctcgaaaacggccaaagtctttctagtagtcagctctcactccctgccctgagcgaaatggagccagtacccatgcctagggatccttgctcctacgaggtactgcagccgtcagacatcatggacgggcctgtgagcgaagaatctccaagtgcatcagagtctggagttctactgagtcaggaccctagtgctaagccggtgttgcttctgcctccaaagaaacctgctgcattcccaggagatcacgaggagacccctgtgaagcaactacccctgctgaagcagccgcccgccctgccacctaagcccacaacccggattgccaatcacctgaccgatcccggtgcgcctgtgaagctcccctgtctacctgtaaagctgtcgcctccacttccccctaaaaaagtgatgatatgtatgccggttggcgggcccgacctcagtttggtgtcatacacagcccagaagagcggacaacaaggcgtggctcaacaccatcacacagtgcttccaagccagatccaacatcagctgcagtacggcagccacggccagcaccttcccagcaccaccggatctcttcctatgcacccctcaggttgcagaatgatcgatgagctcaataaaacgctggctatgacaatgcaacgccttgaaagttccgaacaaagggttccttgcagcacctcttaccacagcagcggccttcatagcggcgatggtgtgacaaaggcaggccctatgggtctgcctgagatccggcaggtgcctactgtggttattgaatgtgatgataacaaagaaaatgtcccgcacgaaagcgactacgaagacagctcctgcctgtataccagggaagaagaggaggaagaggaggacgaagacgatgactcctctctatataccagctccctggcaatgaaggtctgtcgaaaggacagtcttgcaattaaactgtcaaatagaccctctaaaagggagctggaggaaaagaacatcctgccgcggcagaccgacgaggagaggctagagcttcgccagcagataggcactaagttaaccaggaacaaattccggagggacttcggacgccaactggagggaaagtag

SEQ ID NO: 31880 - DNA, 693 bp, Artificial Sequence
  Description of Artificial Sequence: Synthetic coding sequence
aatctgggtagaatttttaagccctggaaatggagaaagaagaaatctgagaaattcaagcatacctccgctgcacttgaaaggaagatcagtatgaggcagtctagagaagaactgattaagcggggggtccttaaggaaatatatgataaggatggagaactcagtatttctaatgaagaggacagcctcgagaatggacaaagtctgtcaagcagccagctgagtttacccgctctgtcggaaatggaaccggtgccaatgcccagggacccgtgctcatatgaagtgttgcagcctagcgacatcatggatggtccggtatccgaagagtctcccagcgcttcagaatcgggcgtcctcctgtctcaggaccctagcgccaagccggtgttactcttgcccccaaaaaaacctgctgcattccctggagatcatgaggagactccagtgaagcagctcccattacttaagcagccccccgccctccctccaaagcccactactcgtattgccaatcacctcactgactggcaccaggcccaccaggtcggccaaagacatcccctgcccccatggcaatgggctttcagttctcccggctctagcaaacggatccaatctcgccctggcgccgttgcgtatgcttgcaaccccagcaccctggggggaagagggcgatggatcacttag

SEQ ID NO: 31881 - DNA, 1308 bp, Artificial Sequence
  Description of Artificial Sequence: Synthetic coding sequence
atgcggcagtccagagaggaactgatcaaacggggagtgctcaaagagatatacgataaagatggcgaactctccatatccaacgaagaggacagtctcgagaatggacagtctctaagcagctcacagttgtccttgcccgctctgtctgaaatggagcctgtccccatgccaagagatccctgctcctacgaagtcctacagccgagtgacattatggacgggccagaccccggagcaccagttaaactcccctgtctccccgttaaactgtcaccacctctacctccgaagaaagtgatgatttgcatgcctgtcgggggacctgatctctctctcgtgagttatactgcccagaagtccggccagcaaggagtggctcagcaccaccacaccgttctaccgagccaaatacagcaccagctccagtacggctctcatggccagcatctccctagtacaaccggctcactgccaatgcacccctcaggctgccggatgatcgacgagttgaacaagactctggcaatgactatgcaaagactagaatcctctgaacaacgcgtgccatgctctaccagttaccatagctccgggctgcacagcggcgatggcgttaccaaagccgggccaatggggctgccagaaatacgccaggtgcccaccgttgtgatcgagtgcgacgataataaggagaatgtcccacatgagagtgattacgaggacagttcctgtttgtacacacgagaagaagaggaagaggaggaggacgaggatgacgactcttctttgtacacttccagccttgctatgaaggtctgcaggaaagactctctcgctattaaacttagcaaccgtccttccaaacgagagttggaggagaaaaatatccttcccagacaaacggatgaagaacgcctggaactccggcagcagatcgggaccaagctgactcgcagactgagccagcgccccacggccgaggagctcgagcagagaaatattctcaaaccacgcaacgagcaggaggagcaggaggaaaaaagagaaataaagcgacggctcaccaggaaacttagtcagcggcctaccgtggaggagttacgggagaggaagatcctgattcgattttctgattacgtagaagtggccgacgcccaggactacgacaggagagccgataaaccatggactcggctgaccgcagccgataaggcagcaataagaaaggagctcaacgaattcaagtctactgagatggaggtccacgagttgtcacgccacctgaccagctttaggtttccatag

SEQ ID NO: 31882 - DNA, 1665 bp, Artificial Sequence
  Description of Artificial Sequence: Synthetic coding sequence
atggataatgccgttgacggtctagataaagctagcattgccaacagtgacggacctaccgctgggtctcaaacccctcctttcaagcggaaggggaagttgtccacaataggcaagatctttaaaccgtggaagtggcgcaaaaagaaaacatccgataaattcagggagacaagtgctgtcctggaacgtaagatatcaacacggcagtcgcgggaggaactcatcagacgaggcgttctgaaggaattacctgaccaggacggcgatgtaactgtcaattttgagaactcgaacggccacatgattcctattggcgaagagtctacccgtgaagaaaatgttgtaaagagtgaggaaggcaacgggagcgtgtcggaaaaaactcccccactggaggagcaggctgaggacaaaaaggctggtagctcacattcaaaaaaaactacgggatccaaagcttccgcctctccctccacaagcagcacatcctcccggcccaaggcctcaaaggaaaccgtttcgagcaaggcaggtactgtcggaaccaccaaaggcaagagaaagacagacaagcagcccataacctcccatctgagctcagacactaccaccagtgggacttccgacctcaagggcgagccagcagagacccgcgttgagtcttttaaactagagcagacagtgccaggagcggaagagcagaatacaggtaagttcaaaagcatggtgccccccccgcccgtggcacccgccccctctccactcgctccgcctctacctctggaggatcaatgtattacagcatccgatacacctgtcgttctggtaagtgtgggcgctgacctgccagtgagcgcactcgatcccagccagttgctgtgggcagaagaacccacaaaccggacaactctgtacagtggtacaggcctgtccgtgaacagggagaacgcaaagtgtttcacaacaaaggaagagctgggaaagacagtgccccagcttctgacaccagggctgatgggggagagcagtgaaagcttttctgcctcagaggatgagggacatcgtgagtaccaggccaacgattctgacagtgatggccccattctctatacagatgacgaggatgaagatgaggatgaagacggttcgggagagagcgccctggcttccaagattaggaggagagacaccctggccatcaaactgggcaacagaccctcaaagaaggaactggaagataaaaacattttacagagaacctctgaggaggagcggcaagagattaggcagcagatcgggactaaactggtgcgccggttgtcgcagaggcctacaacagaggaacttgagcagcggaacattctgaagcaaaagaatgaggaggaggaacaggaggcaaagatggaattgaagcgaaggttgtcccggaagctgagcctgagaccaactgtggccgagctccaggcaagaaggattttaaggtttaacgagtacgtggaggtgactgactcgccagactacgataggcgggcagacaagccctgggccagactgaccccagcagataaggctgcgatacggaaggaactaaatgagtttaagagtactgagatggaagtccacgaggaatcacgtcagttcactaggttccaccgtccgtag

SEQ ID NO: 31883 - DNA, 1698 bp, Artificial Sequence
  Description of Artificial Sequence: Synthetic coding sequence
atgggccagacttcggtatcaacactgtcccctcagcccggaagcgttgacgggctggacaaagcgtctatcgcgaatagtgatggtcccacagccggctcacagacccctccatttaaacggaaaggcaaactgtccactatcggcaaaatcttcaagccctggaaatggcgcaagaaaaaaacttcggacaagttccgggaaacaagcgccgttctggaacgaaagatttcaaccagacagagcagagaagaattgatccgcaggggtgtgctcaaagagttaccagaccaagacggggatgtgactgtgaatttcgagaacagcaacggacacatgattcctattggtgaggagagcacacgggaagagaacgtcgtgaagtctgaggaagggaacggctctgtgtctgaaaagactcctcccctcgaagaacaggctgaggacaaaaaggcagggagttctcacagcaaaaaaaccactggaagtaaagcaagtgcttctccttcaacctcaagcacatcgtcaaggcccaaggctagtaaggagacagtctcatcaaaggccgggacggtgggaacaaccaagggaaagagaaaaacagataaacagcccatcacctcccacctgagcagcgacacaactacttctggaacctccgacctgaaaggcgagcctgctgaaactcgcgttgaaagcttcaaattagaacagactgtgcctggcgccgaggagcaaaacaccggaaaattcaagtctatggtgccgccccctcccgtggcccccgccccgtccccactcgccccgccactgcctctcgaggatcagtgtattactgcttccgatacccctgtggtgctcgtgagtgtgggcgccgatctgcccgtttccgccctggatccctcgcagttgttatgggctgaagagcccaccaacaggaccactctgtactccggcactggcttatctgtgaatagggagaacgccaaatgctttactaccaaggaagagcttggtaaaaccgtgcctcaactgctgacgccgggattaatgggcgagtctagtgagtcattcagtgcaagcgaagacgaaggccatcgagaatatcaggccaacgattcggatagtgatggccctattttgtataccgatgacgaggatgaagatgaggacgaagatggaagcggggagtcagccctggcaagcaaaatcaggcggagagatacactggccattaaactcggcaacagaccttccaaaaaagaactggaagataagaatatcctccagagaacttcggaggaggaacgccaggaaatccgccagcagattgggaccaagttggtgcgccggctgtcccaaagacccactactgaagagctagaacaacgcaacattcttaagcagaaaaatgaagaagaagaacaggaggccaagatggagctgaagaggcgcctttcgcgtaaactgtctttgaggcctactgtggccgagctccaggcaaggcgcatattacgcttcaacgagtatgtggaagtcaccgattcccctgattacgatcggagggctgataaaccatgggcccgcctgacgcctgcagacaaagcagccatccgaaaggaactcaatgaatttaagtcaacggagatggaggttcacgaggagagccgccagtttacgcggttccatcgcccgtag

SEQ ID NO: 31884 - DNA, 537 bp, Artificial Sequence
  Description of Artificial Sequence: Synthetic coding sequence
atgggtcagacatccgttagcacactgtctcctcagcccggtagcgttgacggcttggacaaggcgtcaatcgcaaacagtgacggtcccaccgccggttctcaaacgcccccatttaagcgcaaaggtaagcttagcaccatcgggaagatattcaagccatggaagtggcgaaaaaaaaaaacatctgataagttcagagagacttctgccgtgctggagagaaagatttccactcggcaatctcgagaagagttgatccggagaggtgtgttgaaagagctccccgaccaggctggcagcagtcatagcaagaagactacagggagtaaagcatcggccagtcccagcacatcctcgacatcctcaagacccaaggccagcaaggagactgtctccagtaaagctggtaccgtcgggactacgaagggtaagaggaagacagacaagcagcccatcacatctcatctttcctctgatacgactacaagcggtaccagcgatttaaaaggagagcccgccgagacacgggtgtag

SEQ ID NO: 31885 - DNA, 1905 bp, Artificial Sequence
  Description of Artificial Sequence: Synthetic coding sequence
atggacaatgccgtcgatggcttagacaaggccagcatagcaaactccgacggacctacggccggatcccagacccccccctttaagagaaagggaaagctcagtacaattggaaaaatcttcaaaccatggaaatggaggaagaagaagacttcagacaaattccgagagacgagcgcagtgctagaacgcaaaatcagtacgcgtcagagcagagaagagctaatccgcaggggagttctgaaggagttacccgaccaggatggtgacgttactgttaatttcgaaaattcaaatggccacatgattccaatcggtgaagagtcgacccgcgaagaaaatgtggtgaagtctgaggaaggaaacggctctgttagcgaaaaaacgccacctctggaggagcaagcagaagataaaaaggaaaacacagagaatcactctgagacccccgctgcacctgccctgcccccttccgccccacctaaacctcggcctaaacctaaaccaaagaaatccccggtcccacccaagggagctaccgctggggcatctcataaaggggacgaagtaccacccataaagaagaacactaaagccccaggaaaacaggcccctgtgccacccccaaaaccagcttcccggaacactactcgtgaagccgcaggaagttcccactctaaaaagacaacggggtcaaaagcctccgccagcccttctaccagcagcacctcctcgcggcctaaggcctcaaaggagactgtatcatctaaagcgggcaccgtgggcacaactaagggaaagcgaaagactgataaacagcctattacttcccatctctcaagcgacactacgacatctggcacctccgatcttaagggagaacccgccgaaactcgggtggaatcattcaagttggagcagactgtacctggagccgaagagcagaataccggcaaattcaagtcaatggtgcctccccctccggtagcaccagccccctcacctctcgcacctcctctcccactggaggatcagtgcatcacagcatcagacactcctgtggttctggtctcagtcggcgccgatctgccggtgagtgccctcgacccatcccaattgctttgggccgaggagccgaccaaccgcacaacactctatagtggcaccggcttgtcagtaaacagggagaacgcaaagtgttttactacaaaggaagaacttggcaagaccgtgccacagctgctgacacccgggttaatgggcgagtcaagcgagtcattctccgcctctgaagatgagggccatcgggaatatcaagcgaatgattcagattcggatgggccaatcctgtatacggatgatgaagatgaagacgaggacgaagacgggagcggagagtcagccctggcgagcaagatcaggcgtcgcgatacgctagccattaaactgggtaacaggccctctaaaaaagaattagaagataaaaacatactacagcgtaccagcgaggaggagagacaggaaatcagacagcagattggtacaaaacttgtgcgccgcctgagtcaacgcccaactacagaggaactcgagcagcggaacatactaaagcaaaaaaacgaagaggaggagcaggaggccaagatggaactgaagcgtaggctgagtcggaaactgagtctaagacccacagtagcggaactgcaggcccgcagaattttgcgattcaatgagtacgtagaggtgaccgattctcccgattacgacaggcgagccgataaaccatgggcccggttgaccccggcagacaaggccgctatccgaaaagagctgaacgaattcaagagcaccgagatggaagttcacgaagaatcaaggcaatttacccgtttccacagaccctag

SEQ ID NO: 31886 - DNA, 1938 bp, Artificial Sequence
  Description of Artificial Sequence: Synthetic coding sequence
atgggacagacatctgtgagtacattatcgccacagccgggaagtgtggacggtcttgataaggcatctatagccaactccgatggcccaacagctgggtcccagacacccccgttcaagagaaagggtaagctgagtaccattggcaaaatctttaaaccctggaagtggaggaaaaaaaaaacatcggataagtttcgagagacgagcgctgttcttgagaggaagataagcactcgccaaagccgcgaggagctgattcgtagaggcgtcctcaaagaacttcccgaccaggacggcgatgttaccgtgaactttgaaaacagtaacggacacatgatccccattggtgaagagagcactagggaggaaaacgtggtcaagagcgaggagggaaatggcagcgtatccgagaagaccccccccctggaggaacaggccgaggacaagaaagagaatactgaaaatcattccgagacgccagcagcaccagctctgcctcctagcgcccctccaaaacccaggcctaaacctaagcccaaaaagtcccccgtaccaccaaagggggccaccgccggtgcgtcccataagggcgacgaggtcccccccatcaagaaaaacaccaaggctcctgggaagcaggctccggttccccccccgaaacctgcttctcggaacactacacgggaagcagccgggagttctcatagtaaaaagactaccgggagtaaagcctccgcaagccctagtacatcctctacatcatctagaccgaaggcgagcaaggagaccgtgtcctccaaggcgggcactgtgggcacgacgaagggcaagcggaagaccgacaagcagcctattacaagtcatctcagctccgataccaccaccagtggtacatccgacctgaaaggcgagcccgcagagacgagggttgagagctttaagttggaacagactgtgcccggagcagaagaacagaataccggtaaattcaagtctatggttccaccgccgcccgttgctccggctccctccccgttagcacctcccttacccctggaagaccaatgtatcacagccagtgacacacctgtcgtgctggtgtccgtgggggccgacctccctgtgagcgcattagatccctcacagttactctgggccgaagagccaacaaatcgcaccacactgtacagcggcaccggcctgtctgttaatcgcgaaaacgcaaagtgctttaccacaaaggaggagctggggaagacggtgccccagttactgacccctgggctgatgggggagtccagcgaatcattcagtgcgtcagaggatgagggacatagagaatatcaggcgaacgactccgactctgacggaccaattctctataccgacgatgaggacgaggatgaagatgaagacgggtcgggcgagagcgctctggcctctaaaattagaagaagagacactcttgccatcaaacttggtaatcggccgtcaaaaaaagagctggaagacaagaacattcttcagcgaacttctgaagaagagagacaggagatacggcagcagattggaacgaagctggtacgacgtctctctcagagacctacaaccgaggagctggagcagcgcaatattctcaagcagaaaaacgaggaggaggagcaggaggccaaaatggagttgaagcgacgcctgtctcggaagctgtctctccgcccaacagttgcagagctccaggcccgacgcatcctccggtttaacgagtatgtggaagtaacagatagccctgactacgataggagagcagacaagccctgggcccgcctcacccccgcggacaaggcagcaatccggaaagaactgaacgagtttaagagtactgaaatggaagtccatgaggaatcacgccaattcacacggttccacagaccctag

SEQ ID NO: 31887 - DNA, 2139 bp, Artificial Sequence
  Description of Artificial Sequence: Synthetic coding sequence
atgggccaagctgacgtcagccgacccgtaaacccagacgcggtggaagaagcagaccagcccacgaccgagccaggaatggtgttggattctgtggaagccggcgacaccactccacccaccaaaaggaaatccaagttcagcggattcggcaaaattttcaagccatggaaatggcgcaagaagaaatcttccgataaatttaaggagacatctgaggttttagaacggaagatatccatgaggaagcccagggaggaactcgtgaagagaggcgttctcttggaggatccagagcagggcggcgaagatccaggtaagccatcagatgcaatgttgaaaaacggccatacgaccccgattggtaacgcccgctcaagtagtccagtgcaggttgaagaagaaccggtgcggttagcctctcttaggaaggctatcccagaggaagacttaaagaaacgcctgggatcaacaggttcacagcctaactcagaagccgagagtgtccccgaaaacgtaccaaagccccctttactgccaccaaagcgcccactaagtagctctcacgaggcctccgaggggcaggccaaggatgctacttctagtggtggtaccgcccgattcattatttctacgtcaattaccactgccccagctgcaactactgccgctacctctctggccaaaaccgtgaacctgtccgtcactcctagcccagctccccgaaccctacctgctgcccccgcaagtactaataccaccgcgacgccctcattaacccatatggtccctgccaaacagccccccattcctccacccaagcccgctcatcgcaatagcaatccagtcatcgcagaattgtcacaagccatcaacagcgggacactcctgtccaaaccttcacccccacttcctcccaagagaggaatcccatctacctctgtgcctacacttgagtcagctgcagctattaccacaaagacaccaagtgatgagagggagaaatctacctgttccatggggagtgaactccttccgatgattagtccacgctcccccagccccccactgcctacccatattcctcccgaaccacctaggactccgccctttcccgcaaaaacatttcaggtggtaccagagattgagtttcctccgtccctagaccttcaccaggaaataccgcaacaggaagaccagaagaaagaggttcctaaacgcatcctggatcagaattttggcgagccgcacataccaagtcggctgcccccacttcctctacacatcagaatccagcaagccctgactagcccactaccaatgaccccaatattggaggggtctcaccgggcccactctttactttttgaaaattcagactcattctccgaggatagctcgacactgggacgaacaagatctttgccaatcacaatcgagatgctgaaagtgcccgatgacgaggaggaagaggaacagacctgtccttcaacttttagtgaagagatgactcccacaagcgttattccgaaactgcctcagtgcctgcgcgaagaagaggagaaggaatccgactctgactctgaagggccgatccagtaccgggacgaagaagatgaggacgagagctatcagtcagccctggctaacaaggtcaaaaggaaggacacgctggcaatgaaattgaaccaccgcccatctgaacctgaattgaacctgaacagttggccatgcaagtctaaggaagagtggaatgaaattaggcatcagattggcaataccctcattcgcaggcttagccaacggcctacacccgaggaactggagcagagaaacatcctgcagccaaagaacgaagccgataggcaggcagagaaaagagaaataaaaaggcgactcacacgaaagctctctcagcgcccaaccgtcgccgaactgctagcccggaagattctgcgttttaatgagtatgtggaggtcactgacgcccaggattacgacaggcgggccgataaaccgtggacaaaactcactccagccgacaaggccgcaattcgcaaggagctgaacgagtttaaatcgagcgaaatggaggtccatgaagagtccaaacactttacccgttaccatcgaccatag

SEQ ID NO: 31888 - DNA, 1938 bp, Artificial Sequence
  Description of Artificial Sequence: Synthetic coding sequence
gaacgccctgctgaggaggcagatcagcccaccaccgagccgggcatggtgcttgactccgtggaggccggggacactacaccacctactaaacgtaagagcaaattttccggctttggcaagattttcaaaccctggaaatggaggaaaaagaaatcttctgataaattcaaggaaacatcagaagtcctcgaacggaagatatctatgcggaaaccgcgggaggagctggtcaagcggggagtcctgctggaggatccagaacaggggggagaagacccaggaaagccatcagacgctatgctcaagaacggacataccactcccatcggcaacgctagatctagcagtccagtgcaggttgaggaagagcccgttcgactggcatcacttcgtaaggccatcccagaggaggacctgaagaagcggcttgggagcaccggatcacagccgaactccgaggccgagagcgtccccgagaacgtacctaaacctcccctgttacccccgaagcgaccactcagttcaagtcatgaggcaagcgaaggccaggctaaggacgccacttcttctggggggactgcacgatttattatttccacctccatcacgactgcgcctgctgcgactacagctgctacatctcttgctaaaaccgtcaacctctccgtgacgccctcacccgccccccggacactccccgcggctcctgcatctacaaacacaactgccacgccttctctaacacacatggttccggccaagcagcctcctatcccaccaccaaaacctgcccaccgaaattccaaccctgttattgccgagctgagccaagccattaatagcgggacattgctctctaagccttctcctcccttaccccccaaaagaggcatacctagtacgagcgtgcctaccctcgaatcagctgccgccattaccaccaagacgcctagcgatgagagggaaaagagtacgtgctccatggggtcggaactcctcccaatgatttctcctcgcagtcctagccccccgttgcctactcatataccccccgaacctccccggacaccgccctttcccgcgaagacatttcaagtagttcctgaaatcgagtttcctccctccctcgacctacatcaagagattccccagcaggaggatcagaaaaaggaagtgccgaagcgaatactagaccagaatttcggggagccacacattccctctcggttaccacctcttcccttgcacatcaggatccagcaggccctgacctctccactcccaatgacaccaatcctggagggaagccatagggcgcactcacttctgttcgaaaactctgatagcttcagcgaagactcttctacccttggccgcacccgctcactccccattactatcgagatgctgaaggtgcccgacgacgaggaggaggaggagcagacctgcccaagcactttctcggaagaaatgacccccacttctgtgatccccaaactgccccaatgtctccgcgaggaagaggaaaaggagtcggactctgactccgaagggcctattcagtatagggatgaggaagatgaggacgagtcctaccagtctgcattggctaataaagtgaagcgcaaggatacgttggctatgaaactcaatcacaggcctagtgagcccgagctgaacttaaatagctggccttgtaaaagcaaggaagagtggaatgagatcagacatcagattgggaacacattgatccgccgcctaagtcagcgccccacaccagaggaattagagcagcgaaacatcctgcagcagtatagggttaagttcgggctgaaatccctcttaactgagaaggtgtgggcgagtttaggcctgttcgtgagcatgttttccctgactaatccatcccctgtgctgagcgcattactggggtag

SEQ ID NO: 31889 - DNA, 2109 bp, Artificial Sequence
  Description of Artificial Sequence: Synthetic coding sequence
atggaggacccttttgaagaggccgaccagcccacaaccgagccgggaatggtgcttgatagcgtggaggccggcgatacaaccccaccaactaaacgtaaaagtaaattctcgggatttggcaagattttcaagccctggaaatggcgcaaaaaaaaaagctccgataagttcaaagagacctcagaggtcctggagcggaaaatatcgatgaggaagccccgggaggaattagtgaagaggggggtcctgctggaggatcctgagcaagggggagaagacccaggaaagccttcagacgctatgctgaaaaatggtcataccactcctatcggtaacgctcgtagctcttcacccgtacaggttgaagaggagccagtcagattggcttccctgcggaaagccattcccgaagaagacctaaagaagagactgggatctacaggttcccagcccaacagtgaggccgaatctgtccctgagaacgtcccaaagcctccactgctgccccctaagcgtccattaagttcttctcatgaggcatctgagggccaggctaaggacgccacttcttccggtggcaccgcccgcttcattatctccacatcaatcacaacagcacccgccgcaaccacggccgcaacaagtctagcaaagacagttaatctttctgtcacaccctcccccgcacctcggacattgcccgccgctcctgcatcgactaatacaaccgccactccctccctgacacatatggtgcccgcaaaacagcctcccataccccctccaaagcctgctcacaggaactccaaccctgtcattgccgaactaagtcaggcaatcaactcgggcactctgctaagcaaacctagtcctcccctgcctccaaaacgggggatcccttctactagtgtccccaccttagaaagcgcagccgctatcaccacaaagacgcccagtgatgagcgtgaaaagtctacttgttccatgggtagcgagctgctacctatgattagccccaggtccccatcacctcctttgcccacccacatcccgcccgagcctcccagaacccctccattccctgctaaaactttccaggttgtgccagaaatagaatttcctccttctctcgatttacaccaggagataccacagcaggaggatcaaaagaaggaggttccgaaacgaatcctggaccagaatttcggagagcctcatattccttctaggttgcctccattaccactgcatatcagaatccaacaggccctgacctctccgttgcccatgacacccattctggaaggtagccaccgagctcactctttactgttcgagaactccgatagctttagtgaagacagcagtacgctcggtcgtacccggtccctccctattacgattgaaatgttgaaagttcccgacgacgaagaggaggaggaacagacctgcccatctaccttttcagaggaaatgacccctacctccgtgatcccaaaactgcctcagtgtctccgcgaggaagaggagaaggagagtgacagcgattccgagggccctatacaatacagagacgaggaagatgaggatgaatcttatcagagcgctctagccaacaaggtgaagcgcaaagacaccctagctatgaagctcaaccatcggccttctgaaccagaactgaatctgaattcttggccatgcaagagtaaggaggagtggaatgagattcgccatcagatcggtaacaccctcattcgccggctgtcccagcgccccacaccggaagaattggaacagcgcaatatcctgcagccaaagaatgaggctgatagacaggcggagaagcgcgagattaaacggcgactgaccaggaagctttcccagcggcccacggtcgccgagctgttggctagaaagattcttcgtttcaatgaatatgtagaggtgacagacgcccaggattacgataggcgggccgataagccttggaccaaactcacgcccgccgataaagctgccattcggaaagaacttaatgaattcaaatcgtcagagatggaagtgcacgaggaatccaaacactttactagataccatcgcccctag

SEQ ID NO: 31890 - DNA, 804 bp, Artificial Sequence
  Description of Artificial Sequence: Synthetic coding sequence
atgtcaggatgtttccctgttagtggactgcgctgcctgagtagggatggcaggatggcagcgcaaggcgctcctcggtttctattgaccttcgacttcgacgagaccatcgtggatgagaatagcgacgactccatcgtccgagctgcacctgggcagaggctccctgagtcattacgtgctacatacagagagggcttctacaatgagtacatgcagcgagtgttcaaatacctgggtgagcagggagtgcggccaagggatttatcagcaatatacgaggccataccattgtccccaggaatgtccgatctgctgcagttcgtcgcgaaacagggcgcctgttttgaggtgatcctgatcagcgacgctaatacttttggagtggagtccagcctccgtgctgctggtcatcattccctgttcagaagaatcctgtctaacccaagcggcccagatgcccgcggacttctagctctgcgaccattccacacccactcgtgcgctcgttgccctgcgaacatgtgtaaacataaagtcctgtcagattatctgcgagagagagcccatgacggcgtccatttcgagaggcttttctatgtgggcgacggagccaacgatttttgccccatgggcttattagcaggtggagatgtcgcattccctaggcgcgggtatcctatgcatcggctcatacaggaggcacagaaagctgagccgtcatcttttagagcctccgttgtgccctgggaaactgcggccgacgtccgattgcacttacagcaagttctgaagagctgttag

SEQ ID NO: 31891 - DNA, 879 bp, Artificial Sequence
  Description of Artificial Sequence: Synthetic coding sequence
atgtgccaacggctgtggccatggccagctaaccagcctctgcccggtggattgcttccaagacccctctcactggccccctctagctccagctcgtgctgttcccccccctgcagtcaagacgggcggatggccgcgcagggagcccctcgtttcttactgacttttgacttcgatgagacaattgtcgacgagaactcagacgatagtatcgtgagagcagctcctggacaacgccttccagagtcactccgagccacataccgggagggcttttataatgagtacatgcagcgcgtcttcaagtatttgggagaacagggcgtgcgtccgagagatctcagcgccatctacgaagccatccctctgagtcctggaatgagcgacctgctgcaattcgtggcaaaacagggagcctgcttcgaggttattctaataagcgacgccaacacttttggtgtcgagagctcccttcgcgccgcaggccatcattcattgttcagaagaattctgtctaaccccagcggccccgatgctcgggggctgttggcacttaggccctttcatactcacagctgtgccaggtgtcctgctaatatgtgtaaacataaagtgttatccgattatctgcgggaacgcgcccacgacggggttcatttcgagcgactgttttatgtcggggatggagcaaacgacttctgccccatgggcttgttagccggtggcgacgtcgcatttcccaggcgcggctacccgatgcaccgcctgatccaggaggcacaaaaggcagagccatccagttttcgggccagtgtcgttccatgggaaacagcggcagacgtgcgactgcatttgcagcaggtgctcaagagctgttag

SEQ ID NO: 31892 - DNA, 615 bp, Artificial Sequence
  Description of Artificial Sequence: Synthetic coding sequence
atgtctggctgtttccctgtgtcaggactcaggtgtctttcccgggacggtcgaatggctgcacaaggcgcacctcgcttcctgctaaccttcgacttcgacgagaccattgtggacgagaatagtgatgacagcatcgtgcgcgccgcacccggacagaggttgcccgagtccctgcgcgctacctacagagaagggttctacaacgagtacatgcagcgggtgtttaaatacctcggtgagcagggtgttcgcccccgggatctgtcggccatatatgaggcaatccccctgagtcctggaatgagtgacctcctccaatttgtggctaagcagggggcctgcttcgaagtgattctgatcagcgacgccaatacctttggagtggaaagcagtctgcgtgcagcagggcatcacagcctctttcgtaggattttgtctaatccctctggccccgacgcccgaggcctgctggctttgcggccctttcatacccacagctgtgcccgatgtccagccaatatgtgcaagcacaaagtgctgtcggactacctgcgggagcgggcacatgatggtgttcacttcgagagactcttttatgtgggagatggatag

SEQ ID NO: 31893 - DNA, 336 bp, Artificial Sequence
  Description of Artificial Sequence: Synthetic coding sequence
atgtgccagcggctgtggccttggccagcaaatcagcctctgcctggggggctgctcccaagaccactctcattagccccatcttcgtccagctcttgttgtagccccccctgcagccaggatggccggatggctgcgcagggtgcccccagatttctgctcactttcgatttcgacgagaccatcgtggacgagaactccgatgatagtattgtgagggccgcaccaggacagcggctgcctgagagcctccgggccacttacagagaaggcttctataatgaatatatgcagcgggtcttcaaataccttggtgaacagggggttaggccctag

SEQ ID NO: 31894 - DNA, 879 bp, Artificial Sequence
  Description of Artificial Sequence: Synthetic coding sequence
atgtgccagcgactgtggccttggccagccaaccagccccttccgggcgggctgcttcccaggcctctgagtttggctccctctagctcctcgagctgctgctccccgccatgttcccaggatgggcgaatggccgcccagggcgcacccagattcctgctgacattcgacttcgatgaaacgatcgtcgacgaaaattcggacgatagcatcgtccgagctgccccaggccagagacttccggagagtctgcgcgctacctaccgcgaaggtttttacaacgagtacatgcaacgggtgttcaagtacttaggggaacaaggtgttaggccccgggatctctccgctatctacgaagcgatcccactatctcctggaatgagcgacctgttgcagtttgttgcaaaacagggggcatgctttgaggtcatacttatttccgatgcgaacacgtttggggtggaatcctccctacgggccgccgggcaccactccctatttaggagaattctcagtaacccgtctggaccggatgcaaggggactgctggctcttcggcctttccatacacatagttgcgcccggtgtccggccaatatgtgtaaacacaaagtcctgagcgattacctcagggaacgggcacacgatggagtccacttcgagcgattgttttacgtgggggatggtgccaatgacttttgcccaatgggcctcctcgccggcggcgatgtggccttccctaggcggggatatccaatgcaccgtctgatccaagaggcccaaaaggctgagccgtcatcctttcgagccagtgtggtgccctgggagacagctgccgatgttaggcttcatctccagcaggtcttgaaatcgtgctag

SEQ ID NO: 31895 - DNA, 726 bp, Artificial Sequence
  Description of Artificial Sequence: Synthetic coding sequence
atgaagattctgctcgtcttcgacttcgacaatacaatcatcgacgataatagcgatacctggattgtccagtgcgcaccaaataagaagcttcccatcgagttgcgggacagttaccgaaaaggcttttggaccgagtttatggggagggtgtttaaatacctgggagataaaggagtaagagaacatgagatgaaaagagcagtgactagcttgccttttactcctggtatggtagaactgtttaacttcatacggaaaaacaaggacaagtttgactgtataattatttccgattctaatagtgtgttcatcgattgggtgttggaggcagcaagtttccacgacatcttcgataaggtattcaccaatcctgccgcgtttaattctaacggacatctcacggtggaaaactatcatactcatagttgcaatcgctgccctaaaaatttgtgcaaaaaggtcgtcctgatcgagtttgtggataagcagcttcagcagggtgtcaactacactcagatcgtttatatcggagatggcggaaacgatgtttgtccggttacattcctgaaaaacgacgatgtcgccatgccgcggaagggctatacactccaaaaaactttatccagaatgagtcagaacttggagccgatggaatattccgtggtagtgtggagtagcggcgtagacatcatttctcacctccagttcctgattaaggattag

SEQ ID NO: 31896 - DNA, 411 bp, Artificial Sequence
  Description of Artificial Sequence: Synthetic coding sequence
atgaagattctgttagtcttcgactttgacaacaccatcatcgacgataatagcgacacttggatcgtccagtgcgcccccaataagaagctgcctatagaactaagagactcgtatcgcaagggcttctggacggagttcatgggacgtgtgtttaaatatcttggggacaagggggttcgagaacacgaaatgaaacgggccgttactagtctgcccttcaccccaggaatggtcgagctatttaatttcatcagaaaaaacaaggataagttcgactgcatcatcatttcagactccaactctgtgttcatcgactgggttttagaggctgccagctttcatgatatattcgataaggtgttcacgaacccagctgcgtttaactccaatggtcacctcactgtttag

SEQ ID NO: 31897 - DNA, 171 bp, Artificial Sequence
  Description of Artificial Sequence: Synthetic coding sequence
atgaaaatattactggtcttcgacttcgataatacaattatcgatgacaattccgatacatggatcgtgcaatgtgccccaaataagaagcttcccatcgagctgcgagatagctacaggaagggattctggaccgaattcatgggacgagtgttcaagtacctcgggtag

SEQ ID NO: 31898 - DNA, 150 bp, Artificial Sequence
  Description of Artificial Sequence: Synthetic coding sequence
atgaagatcctgctggtgttcgacttcgacaacaccattattgacgacaactccgatacatggatagtgcagtgcgccccaaacaaaaagctgcctattgagctacgggatagttaccgaaagggtttttggacagaattcatggggtag

SEQ ID NO: 31899 - DNA, 936 bp, Artificial Sequence
  Description of Artificial Sequence: Synthetic coding sequence
atggtacaggctataaagtgggtcgacgaagtggttccagctgcgccctacgtcacgactctggaaaccttggataagtacaactgcgacttctgcgttcacgggaacgacatcaccctcactgtggatggccgggatacctacgaagaagttaaacaggcaggccggtacagggagtgcaaaagaacgcagggtgtgtctacaacagatcttgtgggcagaatgctgctcgtgaccaaagcccatcatagctctcaagagatgagcagcgagtacagggagtacgcggactcttttgggaaatgccccggaggccgtaacccttggacaggcgtctcacagtttctgcaaacctcccagaaaataattcagttcgcctccggtaaagaaccccagcccggcgaaactgttatctacgttgcgggcgccttcgacctctttcatattggacatgtcgacttcctggaaaaagtccataggctggccgaacggccctatatcatagccggcttgcatttcgatcaggaagtaaatcactacaagggcaagaactatcctatcatgaacctccacgagagaaccctatccgtgcttgcctgtcgctacgtctccgaagttgtgatcggcgcaccctacgcggtgacagccgaactgctgagtcatttcaaggtggacctggtctgccacggaaaaaccgagattatacccgatcgggatggaagcgacccctaccaagaacctaagagacgcgggattttccggcaaatcgactccgggagcaacctcacaacagatcttattgtacagagaattatcacaaatagattagagtacgaggctcgaaaccaaaaaaaagaagcgaaggagctggccttcctcgaagccgcccgccagcaggctgcacagcccctgggggagagagacggggatttctag

SEQ ID NO: 31900 - DNA, 1224 bp, Artificial Sequence
  Description of Artificial Sequence: Synthetic coding sequence
atgattaggaacggccgtggggcagccggaggcgctgaacaaccaggtccagggggacggagggctgtgagggtttggtgtgacgggtgctacgacatggtacactacggtcacagtaaccagttacgtcaagcccgtgccatgggcgattatctaattgttggggtgcacaccgatgaggagattgccaagcacaaaggtccgcccgtcttcacacaggaggagcgttacaagatggttcaggccatcaaatgggttgacgaggtggtccctgcagccccctatgtgacaacgctggaaaccctagataaatacaactgcgacttctgcgtccacggcaatgacattacactgactgtggacggcagggacacctatgaggaggtgaaacaagctggccggtatagagaatgcaaacggactcagggagtgtccacgactgacctggtgggccgcatgctgctggtgacaaaagcacaccactcatcccaggaaatgagttcagaataccgggagtacgcagatagttttggtaagcctccccaccccatcccagctggtgatatcttatcttccgaggggtgttcacaatgtcccggcgggcggaacccatggaccggggtatctcaatttcttcaaacctcgcagaagatcatccaattcgcttcaggcaaagagccccagcccggtgaaacagtgatctacgttgccggagcctttgacttgtttcacatcggccacgtggattttctggaaaaagtccacagactggccgaacggccctacataatcgccggtctccatttcgatcaggaagtgaatcactataaagggaagaactaccccattatgaacctgcacgagaggacactgtccgttttggcttgtcggtatgtgtccgaggttgttataggggcgccatatgccgtgaccgcggagttattatcccattttaaggtagatctcgtgtgccacggtaagacagaaatcatccctgaccgggatggttccgacccgtaccaggagcctaagaggcgcggaattttcaggcaaatcgactcggggtctaacctcactacagatttgattgtgcagcgcatcataacaaatcgcctcgagtacgaggcgcggaaccagaaaaaagaggctaaagaactggcattcctggaagctgcacgccagcaggcggcacagcccctcggagagcgggacggggatttttag

SEQ ID NO: 31901 - DNA, 1170 bp, Artificial Sequence
  Description of Artificial Sequence: Synthetic coding sequence
atgatcaggaatggcaggggtgctgccggaggagcagagcagccaggaccaggggggcgacgcgccgtgagggtctggtgtgatggttgctacgatatggtgcattacggacatagcaaccagctgcggcaggcacgtgccatgggcgattacttgattgtgggggtacacacagatgaggaaatagcaaaacataagggcccacccgtgttcacgcaggaagaacgctacaaaatggtccaggcgattaagtgggtcgatgaggtggtcccggcagctccttacgtaactacccttgagactttagacaaatacaattgcgacttctgcgtgcacggaaacgacatcacactgacagttgatgggcgggatacttatgaggaggtcaagcaggcgggccggtacagggaatgtaaacgtacccagggggtgtccaccactgatctcgtgggacgcatgttgttagtgaccaaagctcaccatagctctcaggagatgtcctcagaatacagagagtacgccgacagcttcgggaagtgcccaggaggccggaacccctggacaggagtttctcagtttctccagacaagtcagaagattattcagtttgcttctggtaaagaaccgcaacccggggagactgtgatctacgtggccggagcctttgatctatttcatatcggtcacgtggattttctggagaaagttcacaggctggctgaacggccctatataatcgcgggcctccacttcgaccaggaggttaatcattacaagggaaaaaattacccgattatgaatctgcatgagaggacgctgagtgtattggcctgcaggtacgtgagtgaggttgtgattggtgcaccctacgcggtgacggccgaactcctgtcccatttcaaggtcgacctggtctgccatggtaaaaccgaaataattcccgacagggatgggtctgatccctaccaggaaccaaagcgcagaggcatatttaggcagatagatagcgggtctaacctgacaaccgacctcattgttcagagaataattacaaataggctcgagtatgaagcgcgtaaccagaagaaggaggcaaaggaactggcttttctagaggccgcccgtcaacaggcagcccagccgttgggcgaacgggacggcgacttttag

SEQ ID NO: 31902 - DNA, 1515 bp, Artificial Sequence
  Description of Artificial Sequence: Synthetic coding sequence
atgtcggagaagcagatgaaggaggctttcgtaagcaaccttaacggcaccaccgtgctggagatcacacagggcttatgcttcccagcattttgcatcttatgtagaggcttcttgatcatattcagccaatatctgtgcagctttagtcccacctggaagactcggtttctcacggattttgtggtcctaatcgtccccatggtggccacactcaccatatgggctagctttattctgcttgaactcttaggcgtaatcattttcggcgctggcctgctgtatcagatctaccggcgtagaacatgttacgcacgcttacccttcctgaagattttggagaagtttctgaacatcagtctcgaatctgagtataaccccgccatttcctgttttcgcgtgatcacttcagcatttactgccatagccatcctggcagtggattttccattatttccacggcgatttgccaagactgagctgtacggcaccggagccatggacttcggcgtagggggttttgtgtttggttcagcaatggtttgtctggaggtgagacggagaaagtatatggaaggatccaagctgcattatttcactaattccctgtatagcgtgtggcccctcgtatttttaggcattggccgcctggccattataaagagcattggataccaagagcaccttaccgagtacggcgtccattggaatttttttttcactattatcgtagttaaactgattaccccgctgctgctgatcatctttcccctcaataagtcctggataatcgccctgggaattacagtgctgtaccagttggccctggattttacatctctgaaaaggctgatcctgtacgggaccgacgggtctggtactcgcgtcgggctcctgaacgctaaccgcgaggggataatttccaccctgggatatgtcgctatccacatggcaggtgtccaaacaggactgtatatgcacaagaatcgaagccacataaaggatctgataaaagtagcctgctttctgctgttggctgcaatctccctgtttatttcactttatgtcgtgcaggtgaacgtcgaagcagtatctaggcggatggcaaatctggctttctgcatttggatcgtagcaagctcacttatccttctcagtagtctgctgctgggggacatcatcctgagctttgcaaagtttctgatcaagggagcattggtgccttgctcttggaaactgattcagtctcccgtaactaacaagaagcatagcgaaagtctggtgcctgaggcagagaggatggaaccctcactgtgcttgattaccgcactcaacaggaagcagctgattttcttcctcctgtctaatatcacgactgggttgatcaatctgatggttgacaccctgcactcctccaccctctgggccctgttcgtggtcaatctctatatgttttccaactgcctcatcgtctatgtattatacctccaggacaaaacagtgcaattttggtag

SEQ ID NO: 31903 - DNA, 807 bp, Artificial Sequence
  Description of Artificial Sequence: Synthetic coding sequence
atgcttcttaaggagtataggatatgtatgcccctgactgtcgacgaatacaagatcggccagctgtacatgatctccaaacattctcacgagcagtctgaccgcggggagggggtggaggtcgtacagaatgagcctttcgaggatccacaccacggtaatggccagttcactgagaagcgggtctatctgaacagcaaattgccatcttgggcccgtgcagtggtgccgaaaatcttttatgtcacggaaaaagcctggaactactatccctataccatcactgagtacacctgtagcttcctgccaaaattttccattcatatagagaccaagtacgaagacaacaaaggtagcaacgacaccatcttcgacaacgaagcaaaggacgtagagcgcgaagtttgctttattgatatcgcctgcgacgaaatccccgaaagatactacaaggagtccgaggaccccaagcacttcaaaagtgaaaagactggccgcggtcagctgcgagagggttggagggattcacaccagcccatcatgtgttcctacaagctcgtgacagtgaaattcgaggtctggggactgcaaacccgagtggaacagttcgtgcataaagtggtgcgagatatccttctgatcgggcatcgccaggctttcgcgtgggtagacgaatggtacgatatgaccatggacgatgtccgcgaatacgaaaaaaatatgcacgaacagacaaatattaaagtgtgtaaccaacatagtagcccagtggatgacatcgagagtcatgcccagacttccacttag

SEQ ID NO: 31904 - DNA, 807 bp, Artificial Sequence
  Description of Artificial Sequence: Synthetic coding sequence
atgctgctgaaagaatatcggatctgcatgcccctcaccgtcgacgagtacaaaattggccagttgtacatgattagcaaacattcgcacgagcaatctgatcggggagaaggcgtagaggtcgtgcagaatgagcccttcgaagacccccaccacggtaacggacagttcactgaaaaacgagtgtaccttaactccaagctccctagttgggcccgcgctgttgtacctaaaattttttacgtgactgagaaagcttggaattattacccttacacaatcacagaatataagtgctcctttcttccaaaattttctatccacatcgaaacaaagtacgaggacaacaagggaagcaacgacacaatttttgacaacgaggctaaagacgttgagcgggaagtgtgctttattgatatcgcttgtgacgaaattcccgagcgatactataaagagtccgaggatccaaagcacttcaaatccgagaagaccggaaggggccagctccgagaagggtggcgtgactcccaccagcccatcatgtgttcttataaactagtcacggtgaagttcgaagtctggggattgcagacacgggtggagcagtttgtccacaaggtcgtgcgggatatcctcctgataggacatcggcaggcgtttgcttgggtagacgagtggtatgatatgacaatggatgatgtccgggagtacgagaagaacatgcacgagcagacaaacatcaaggtgtgcaaccagcactcatcccctgtggacgacattgaaagtcatgcccagaccagcacctag

SEQ ID NO: 31905 - DNA, 999 bp, Artificial Sequence
  Description of Artificial Sequence: Synthetic coding sequence
atgcttttaaaagagtataggatctgcatgccacttaccgtagatgagtacaagatcgggcagctttacatgataagtaagcatagccatgagcagtctgaccgcggagaaggcgtcgaagttgtccagaatgagccctttgaagacccccaccacggcaacggccagttcacggagaagcgggtttatctgaattccaagcttccctcctgggctcgagccgttgttcccaaaatcttttacgtgaccgagaaagcctggaactattatccctataccattaccgagtacaagtgctcgttcctgcctaaatttagcatccacatcgaaactaaatatgaggataataagggctccaacgacactattttcgacaacgaagccaaagacgtggagagagaagtgtgcttcatagatattgcatgtgacgaaattcccgaaaggtattataaggagtcagaggaccctaaacattttaaatcggaaaaaactgggagagggcagctccgcgagggttggagggatagccaccaaccaataatgtgctcctataagctggtcactgtcaagttcgaggtgtgggggctgcaaacaagggtggaacagtttgtccacaaggtcgtgagagatattctactgattggccatcgccaggcctttgcctgggtggatgagtggtatgacatgaccatggatgaggttcgagaattcgaaagagcaacacaagaggcaaccaacaaaaagatcggtatatttccgcctgccattagcatcagctccatcccactcctcccttcctccgtgcggagcgctccatccagtgcccccagcacaccactttctacagacgcaccggagttcctaagcgtccctaaggatcgcccacgaaagaagagtgcacccgagactctgaccctacctgacccagaaaaaaaggctactctgaacctgcccgggatgcactccagcgataagccttgccggcccaagagcgaatag

SEQ ID NO: 31906 - DNA, 801 bp, Artificial Sequence
  Description of Artificial Sequence: Synthetic coding sequence
atgcacaacatcctgaagaaatatcatcaatatatcgttgagtgccacgggatcacgcttctgccacaattcctcggcatgtaccgtttaaacgtagacggggtggagatttacgtaattgttactagaaacgttttttcacacaggctttcagtgtacaggaagtacgacctgaaaatggcgaatctgaaggcgaccttcacattccccaagcctacaggcagtactgtggccagggaggcttccgataaggaaaaggctaaggagctgcccacattgaaggataatgactttatcaacgagggacagaagatttatattgacgacaataacaagaaggtgtttctggagaaacttaagaaggatgtggagttcttggcgcagctgaagcttatggactactccctgcttgtcggcatacacgacgtggaacgtgcagaacaggaagaagtggaatgtgaggaaaacgacggtgaggaggaaggagagtcagacggtacccatcctgtgggtacaccgcctgattctccgggtaacacccttaattcatctccccccctagcccctggggagttcgatcctaacatagacgtgtacggtataaagtgccacgaaaactctccccggaaagaggtctacttcatggctatcattgatatacttactcattacgatgctaagaagaaagctgcacacgccgccaaaaccgttaagcacggggctggagctgaaattagtacagtgaatccagagcaatattcaaaaagattcctagatttcattgggcacatccttacctag

SEQ ID NO: 31907 - DNA, 669 bp, Artificial Sequence
  Description of Artificial Sequence: Synthetic coding sequence
atgtggggcgtgaatcatagtattaacgaactatcccacgtgcaaatccctgttatgctgatgcccgatgactttaaggcctatagcaaaattaaggtagacaaccacctattcaacaaggagaacatgccctctcattttaagtttaaggaatactgcccaatggtatttagaaatctgcgggaacggtttggaatcgacgaccaggacttccagaacagcctcaccagatctgccccactccccaacgattctcaagcccgatccggcgctcggttccacactagttatgacaagcgatatatcataaaaacgatcacgagcgaagacgtagccgaaatgcataacattctgaaaaagtaccaccaatatattgtagaatgtcatggaataacactgctgcctcagtttttggggatgtataggttgaatgtggatggtgtggaaatctatgtgatcgtaacccggaacgtgttctcacaccgtctatccgtgtaccggaagtacgatttgaaaggtagcactgtggctcgcgaagcctcagataaagagaagtcccccacccccgctattgtagttttgcccgttccccatagcgccgccaccagtgaaaagcactgcatcgacccaatgcgtgtgctgctgcacttcagctcctccaattgttag

SEQ ID NO: 31908 - DNA, 1221 bp, Artificial Sequence
  Description of Artificial Sequence: Synthetic coding sequence
atggccacacccggaaatctggggagttcagtgctggcctccaaaaccaaaacaaagaagaaacacttcgtagcccagaaggtgaagctatttagggcttctgacccgctgctgagcgtcctgatgtggggggtgaatcactctatcaacgagctgtcacacgtccagatccctgtcatgttaatgcccgacgattttaaggcgtactctaagatcaaggtcgataatcacttattcaataaggagaacatgccttcccactttaaattcaaagagtattgcccaatggtctttcgcaatctccgggagaggttcggaatcgatgaccaggacttccaaaattcccttacacgttctgcccctctccctaatgatagccaggcccgttcaggagctcggttccatacatcgtacgataagagatacatcattaagactataacttcagaggatgtagccgaaatgcataatattctgaaaaaatatcaccaatacattgtcgaatgtcacggaatcaccctgctgccccagtttttgggaatgtaccgactcaacgttgacggcgtggaaatttatgttatcgtaacaaggaatgtgttttctcatcggctgtcagtgtatcggaaatatgacctgaagggatcaaccgttgcaagagaagctagcgacaaagagaaggctaaggagttgccaacactgaaagataatgactttattaacgagggacaaaagatttacattgacgacaacaacaagaaggtgtttctggagaaactgaaaaaagatgtggaatttctcgctcagttaaagctcatggactactccctcttagtggggatacacgacgtcgaacgcgcagagcaggaggaagtcgagtgcgaagaaaatgatggggaggaggaaggggaatcagacggaacacaccccgtgggcactccaccggactcaccaggtaataccctgaactctagcccaccgctggcacctggcgaattcgatcctaatatcgatgtgtacggtatcaaatgtcacgagaattctccccgcaaagaagtctacttcatggcaattattgacattcttacacactacgatgctaaaaagaaggccgcccacgccgcaaaaacagtgaagcacggagccggggcagaaataagcaccgttaaccctgagcagtacagcaaacgcttccttgatttcatcggtcatattctaacatag

SEQ ID NO: 31909 - DNA, 648 bp, Artificial Sequence
  Description of Artificial Sequence: Synthetic coding sequence
attaatgagctgagccatgtgcaaattcctgtgatgctgatgccagatgactttaaggcgtatagtaagatcaaggtggataatcatctttttaacaaggaaaatatgccaagccactttaaatttaaggaatactgccccatggtctttcggaatttgcgagaacggtttgggattgatgaccaagattttcagaactcattgacacgaagtgctccactcccaaatgactcccaagcccgctctggagctagattccatacatcctatgacaaacgttacataattaaaaccataacaagtgaggatgtggcagagatgcacaacatcctgaaaaagtaccaccaatatattgtggagtgccacgggatcactctgctaccccagttcctggggatgtatcgcctgaatgtggacggtgttgaaatttatgtcatcgtgacacgtaatgtcttttcacatcgcctcagcgtgtatcgaaagtacgatctcaagggaagcactgttgcacgagaagcttctgataaggaaaaatcccctactccggcgatcgtcgtgctgccggtgccccattctgctgccaccagcgaaaagcattgcatcgaccccatgcgggtgctgcttcatttctctagctccaattgctag

SEQ ID NO: 31910 - DNA, 228 bp, Artificial Sequence
  Description of Artificial Sequence: Synthetic coding sequence
atcaatgagctgtctcacgtgcaaattcctgtcatgctgatgcctgatgacttcaaagcttatagtaaaataaaagtcgacaatcacctctttaacaaagagaatatgccaagccactttaagttcaaggagtactgcccaatggtgttcagaaatctgagagaacgcttcggaatcgacgatcaggattttcaggtgtcttgcgtctgtaacatttgcttccaatag

SEQ ID NO: 31911 - DNA, 1044 bp, Artificial Sequence
  Description of Artificial Sequence: Synthetic coding sequence
atgcttatgccagacgacttcaaagcgtatagcaagatcaaggtggacaatcacctttttaataaggagaatatgccaagccatttcaagtttaaggaatattgcccgatggttttcagaaacctgagagaaaggttcggcatcgacgaccaagactttcagaactctctgacccggtctgctccgctccctaatgacagccaggccagaagcggggccaggtttcacacatcttacgataagcgctatattatcaaaactatcacaagcgaggatgtagccgagatgcacaacatcctcaagaagtatcatcaatacatcgttgagtgtcacgggatcaccctacttccccaattcttgggtatgtaccgtcttaacgtagacggcgtcgagatctatgtcatcgtcacaaggaatgtgttttcccacaggctgtcggtgtaccgtaagtatgacctaaagggatcaacagtcgctagggaggcgtctgataaggagaaagctaaagagctgcctaccttaaaggacaacgactttatcaatgaggggcagaaaatatacatagacgacaataacaagaaagtgtttttagagaaacttaagaaggatgtggagttcctcgctcagctcaagcttatggattattccctgctggtaggaattcacgacgtcgagcgggcggaacaggaagaggtggaatgcgaggagaatgacggagaagaagagggagagagcgatggaacccatcccgtcgggacacccccggattccccaggcaatactcttaattcctcaccacctctggcacctggcgagttcgaccctaatattgatgtctatgggattaaatgtcacgagaactctcccagaaaagaagtatattttatggccattatagacatcctgactcactatgacgcaaagaagaaggccgcccacgcagctaagacagtgaagcacggagctggagctgagatttccacagtaaaccccgagcagtattcaaaaaggttcctggatttcatcggtcacattcttacttag

SEQ ID NO: 31912 - DNA, 972 bp, Artificial Sequence
  Description of Artificial Sequence: Synthetic coding sequence
atgggaggacaagttagcgctagtaatagcttttcacgactacattgccggaacgccaatgaagactggatgagcgcactgtgtcctcgactatgggatgtgcccctgcatcacctgagtatccctggatcacacgacacgatgacttactgtctcaataagaagtccccaatcagccacgaggaatctcgtcttctccaactattgaacaaggccctcccttgtataacacgacccgtcgtgttaaaatggagcgtaacccaggccctagatgtgactgaacaactcgatgccggcgtaagatatctcgacctccgaattgcacacatgctggaggggagtgaaaaaaatcttcacttcgtgcatatggtgtacaccaccgccctggttgaggacacactaaccgagatatccgagtggctggagaggcaccccagggaagtcgtgatcttggcgtgtcgcaatttcgagggcctttccgaggatttacacgaatacctggtggcgtgtattaagaacatcttcggagacatgctgtgtcctcgcggcgaggttcccactcttaggcaactgtggtccagagggcagcaggttattgtgtcttatgaagacgagtccagcctgcggagacaccacgaactttggcctggtgtgccttactggtggggaaacagagtaaagactgaagctctcattcggtacctcgagacgatgaaaagctgcgggcgacctggcggattgtttgtggcaggcataaatctgactgaaaatctgcagtacgtgctggcacacccaagcgaaagcttggaaaaaatgaccctccccaacttgccgcgcctgagcgcctgggtgcgcgagcaatgtcccgggccaggatcccggtgtactaacatcatcgcgggcgacttcatcggggcagacgggtttgtgagcgatgtcatcgcacttaaccaaaaactgctgtggtgttag

SEQ ID NO: 31913 - DNA, 972 bp, Artificial Sequence
  Description of Artificial Sequence: Synthetic coding sequence
atgggcgggcaggtgtctgcaagcaactcgttttcaagactgcactgtcggaatgctaacgaggattggatgtcagcgttgtgcccaaggctgtgggatgtcccacttcaccacctgtccatacctggcagtcacgataccatgacgtattgcttgaataagaagagccccatcagtcatgaggaaagtcgccttctccagttacttaataaggccctgccttgtattacaaggcccgtcgtcctcaaatggtcagtcacacaagccctggacgtaacggagcagctcgatgccggcgtgagatatctagatctccggattgcgcatatgctggagggctccgaaaagaatctacatttcgtgcatatggtgtatacgactgccctggtcgaggatacactcaccgagatatccgagtggcttgagcgtcatcctcgcgaggttgtgattctcgcctgtcgcaattttgagggactgtccgaagacttgcacgagtatctggtggcttgtattaagaatatatttggcgatatgttgtgtccgcgtggtgaggtccctaccctgcggcagttatggtctcgcgggcaacaggtcatcgtctcgtatgaggacgagagttcacttcggcgtcaccacgaactttggccaggggtgccctactggtgggggaatagggttaagactgaagccttgatccggtacttggaaacaatgaagagctgtggaaggccgggcggcctgtttgttgccggcattaacctaactgaaaatttacagtatgtattagctcatcccagcgagagtttggagaagatgacactgccaaatctcccccggcttagcgcttgggtgagggaacagtgccccggaccgggaagcaggtgcactaatatcatagcaggcgactttatcggagcagacggctttgtgagtgatgtcattgcactaaaccagaagttgctctggtgctag

SEQ ID NO: 31914 - DNA, 972 bp, Artificial Sequence
  Description of Artificial Sequence: Synthetic coding sequence
atgggaggacaggtgtcagcgtctaacagctttagcaggcttcactgtcgaaatgcaaacgaagattggatgagtgctctctgtccaagactctgggacgttccgttgcaccatctgagtatacctggttcacacgatactatgacctactgcctgaacaaaaagtcaccaatctcacacgaggagagcaggctccttcaactcttaaacaaggccctcccctgcatcacacggcctgttgttctgaagtggagcgtaacccaggctctcgatgtaactgagcagctggatgcaggcgtgaggtacctggaccttcgcattgcacacatgttggaaggcagcgaaaagaatctacactttgtacacatggtgtacacgaccgcacttgtggaggataccctcacggagataagcgagtggctggaaagacaccctcgggaggtcgtgatcctggcttgccgaaactttgaaggactgtcagaggatctacatgagtacctggtcgcttgcatcaaaaatatattcggggacatgctatgccctcgcggtgaagtccccactctccgccagctgtggagccgaggccagcaagtgattgtttcctacgaggatgagtcctcactgcgtcggcatcacgagctgtggccaggtgtgccctactggtggggcaatagggtgaagaccgaagccctgattagatatctagaaactatgaagagttgtggacggcctggcggacttttcgtcgctggcataaatcttacagaaaatctgcagtatgtgcttgctcatccctcagagtccctcgaaaaaatgacccttccgaatctgccaaggctgtctgcctgggtccgtgagcagtgccctgggccaggttcacgctgcaccaatattattgccggggacttcattggagccgatgggttcgtgagtgacgtcatcgccctcaaccagaaactgttgtggtgctag

SEQ ID NO: 31915 - DNA, 537 bp, Artificial Sequence
  Description of Artificial Sequence: Synthetic coding sequence
atggggggccaggtttcagccagcaacagctttagccgactgcactgccgcaatgccaatgaggattggatgtccgccttatgtcccaggctgtgggatgtgcccctgcaccatctatccatcccaggtagccacgacacaatgacatattgtctcaataagaaaagccctatttcccacgaggagtcccgtttgctgcagctgctgaataaagcccttccttgtattaccagacctgtggtcctgaagtggagcgtcactcaggccctggatgtaacagagcagctggatgccggtgtgcgatacctggatttgagaatcgcgcatatgctggaaggttccgagaagaaccttcatttcgtccacatggtgtatactaccgcactggttgaagacaccctgactgagatctctgagtggcttgagcggcatccaagagaagttgtgatcctggcctgtcgaaatttcgaggggctctcagaggacctccatgagtatcttgtggcctgtatcaaaaacatcttcggagatatgtag

SEQ ID NO: 31916 - DNA, 183 bp, Artificial Sequence
  Description of Artificial Sequence: Synthetic coding sequence
atgggaggacaagtctccgcctccaacagctttagcaggttgcattgcaggaacgcaaatgaggactggatgtctgctctgtgtccccggctctgggatgtccccttgcaccatctgagtatccccggctcgcatgacacaatgacttactgtttgaacaagaaatcccccatatcccactag

SEQ ID NO: 31917 - DNA, 525 bp, Artificial Sequence
  Description of Artificial Sequence: Synthetic coding sequence
atgggagggcaagtcagcgcctccaactccttctcccggctgcactgtcggaatgcaaatgaggactggatgtctgcactgtgccccaggttgtgggatgtcccgctgcatcacttgagcatcccagggagccacgacacaatgacctattgccttaataagaagtctcccatctcccacgaggaatctagactcctgcagctcttgaataaagcactgccctgcatcacacgaccagtggtgcttaaatggtctgtgactcaggccttggatgtgactgaacagctggatgctggggttaggtatctcgacttgcggattgctcacatgctcgagggctccgaaaagaatctacacttcgtgcacatggtgtacacaacggccctcgtggaagacactctgaccgagatcagcgaatggctggagcgccatccgagggaggtggtgattcttgcttgcaggaactttgaaggacttagcgaggatctgcacgaatatttagtggcctgcataaagaacatatag

SEQ ID NO: 31918 - DNA, 225 bp, Artificial Sequence
  Description of Artificial Sequence: Synthetic coding sequence
atgggaggtcaggtgagcgccagcaattcctttagtcgcctgcactgccgaaacgccaatgaagattggatgtccgccttgtgtccccgcctgtgggacgtgcctctgcaccaccttagtattcccgggagccacgatacaatgacttattgtctgaacaaaaaaagcccaattagtcatgaagagagcaggctgctgcagttgctaaataaggcgcttccctag

SEQ ID NO: 31919 - DNA, 267 bp, Artificial Sequence
  Description of Artificial Sequence: Synthetic coding sequence
atgggaggacaggtatccgcctctaatagcttttcacggctgcattgtagaaacgccaatgaggactggatgtctgctctgtgccccagactgtgggacgtgccgttacatcacctctctatccccggatcccatgataccatgacatattgtctgaataagaagtcaccaatttcccatgaagagagccggctcttacagttgctaaataaggctctgccatgcattacacgccctgtcgtgttaaaatggtcggtcacccagtag

SEQ ID NO: 31920 - DNA, 525 bp, Artificial Sequence
  Description of Artificial Sequence: Synthetic coding sequence
atggggggccaagtgtctgcctctaatagttttagccgcctccattgccgaaacgcaaatgaggactggatgtccgccctgtgtccaaggctttgggacgtccccctccaccatctttctattcccgggagccatgataccatgacatactgcctgaacaaaaagtctccaatctcccatgaggaaagtcgattgctccaacttctgaataaagccctgccctgcattacacgtcccgtggtcctgaaatggtctgtgacacaggccctggatgttacagagcagctcgatgccggagtccggtacctggacttaaggattgctcatatgttggagggaagtgaaaagaacctccacttcgtgcatatggtctacaccactgctctggttgaggatacccttaccgagatctcggagtggctcgagaggcaccccagggaggtagttattctggcatgtaggaactttgaaggactctcagaggacttgcacgagtatttggtggcctgtattaaaaacatctag

SEQ ID NO: 31921 - DNA, 375 bp, Artificial Sequence
  Description of Artificial Sequence: Synthetic coding sequence
atggggggccaggtctcagcttccaattcattctctcgattacactgcaggaatgcgaacgaggactggatgagcgctctgtgcccaagattatgggacgtgcctctccaccatctaagcatacctgggtcacacgacacaatgacatactgccttaacaagaagtcacctatctctcacgaagagagccgtctgttacagctgctgaacaaggcattaccctgtatcactagaccagttgtgttgaaatggtctgtaacacaggcattggacgtcaccgaacaacttgacgcaggcgtccggtacctggacctacgtattgcccatatgctcgaagggtcagaaaagaatctacacttcgtgcatatggtgtag

SEQ ID NO: 31922 - DNA, 915 bp, Artificial Sequence
  Description of Artificial Sequence: Synthetic coding sequence
atgctggcagttcgcaaggcaaggcggaagttaaggatggggactatctgttcacctaatcccagtggtacaaaaacaagctccgaggtgtgtaatgccgactggatggcaagcctgccacctcatctccacaacctgccactttctaacctcgctattccaggttctcacgattcattctcctactgggtggacgagaaatccccagttggccccgaccagacacaagctatcaagagattggcccgcatatcactcgtgaaaaaattaatgaagaagtggtccgttacccagaatctgacatttagagagcagttagaagcgggtatccggtacttcgatctccgtgtaagttcaaagcccggtgatgcagaccaggagatttacttcatccacggcctgtttgggattaaagtttgggacggtctgatggagattgatagtttcctcactcagcacccacaggagatcattttcctcgactttaatcacttctacgcaatggatgaaactcatcacaaatgtctggtgcttaggatccaggaggcctttggtaacaagttgtgcccggcctgttctgtggaatccctcacgcttcgaaccttatgggagaaaaattgccaggtgttgatcttttaccattgccctttctataagcagtatcccttcctctggcctgggaaaaaaatccctgcaccttgggctaataccaccagtgtgcgcaagctcatcttgtttttagagaccacgctgtcagaacgagcctcaagaggctcatttcacgtctctcaggctattttaactcctcgtgttaaaacgatcgctcggggtctggtgggaggattgaagaatacccttgtacatcgactcgccctgatcccggtttaccctttgcgcttctctcgtcgtagttag

SEQ ID NO: 31923 - DNA, 918 bp, Artificial Sequence
  Description of Artificial Sequence: Synthetic coding sequence
atgctggcagtgcgtaaagcaaggaggaagctgcgcatgggaaccatctgcagccctaatccgtcaggaaccaagacgtcgtccgaagtgtgtaacgccgactggatggcttctcttcccccacatttacataatctgcctttgagcaacctggctatccccggaagtcatgactccttctcttactgggtggacgaaaaatcccccgtcgggccggaccagactcaagctattaaaaggctggccaggatttccctggtgaagaaactcatgaagaaatggagcgtcacgcagaacctcacattccgcgagcagctggaggctggaattcgttattttgatttgcgcgtatcctccaagcctggcgacgcagatcaagagatttatttcattcatggcctttttggcatcaaagtgtgggacggcctgatggaaatcgactcttttctgactcaacatccgcaggagatcatcttcctcgacttcaatcatttttacgccatggatgagacacaccacaaatgtcttgtgctgcgaatccaggaggcgtttggtaataaattatgccccgcatgttcagttgagagcctgacccttcgtacgttgtgggaaaaaaattgccaagtcttgattttttaccattgccccttctataagcaatatccattcctctggccgggcaagaagataccggctccctgggctaatacaacctccgtaagaaaactgattctctttcttgagaccactctgagcgaaagggccagcaggggtagctttcacgtgtctcaggccatcctgaccccaagggtgaagaccatcgcacgcggattagtaggcggactcaagaacaccctcgtccacagcaatcgctggaacagccatggcccatctctactcagccaagaacgttcttag

SEQ ID NO: 31924 - DNA, 966 bp, Artificial Sequence
  Description of Artificial Sequence: Synthetic coding sequence
atggcaagcagtcaggggaagaacgaactgaaactcgcagattggatggccacactacccgaatcaatgcactctattcccttgacaaatctggccattccgggatctcacgattccttctctttctatatcgatgaggccagcccagttgggcccgaacagccagagactgtccagaatttcgtcagcgtctttggtacggtggccaagaaacttatgaggaaatggctggccacacagaccatgaatttcacgggtcagctcggcgctggaatcaggtactttgacttaagaatctctacaaaaccccgcgatcccgataacgagctgtattttgcccatggcctcttctccgccaaggtaaacgagggcctggaggaaattaatgccttcctcaccgatcaccataaagaggtggtcttcttggacttcaaccatttctatggcatgcagaaatatcatcatgagaaattagtccaaatgctgaaagatatctacgggaacaagatgtgtcctgccatcttcgcccaggaagttagtctgaagtatctgtgggagaaggattatcaagtactggtcttctatcattccccagttgcgcttgaagtgcccttcctgtggcccggacagatgatgcccgccccctgggccaatacaacagatccagagaagctgatacagttcttgcaggccagcatcaccgaacgccgcaaaaaggggagcttttttatctcacaggtcgtcctgacacctaaggcttccaccgtcgtgaaaggggtcgctagcggtctgcgagagacaattaccgagcgggccctccccgctatgatgcagtgggtcagaacccaaaaacctggagaatccggcataaacatcgtgaccgctgattttgttgaactgggcgattttatctccactgtgatcaaactgaattatgtattcgacgagggagaggctaatacatag

SEQ ID NO: 31925 - DNA, 966 bp, Artificial Sequence
  Description of Artificial Sequence: Synthetic coding sequence
atggcctcctcacagggcaaaaatgagctgaagttagcggattggatggctacactcccggagagcatgcactcaatcccgttgacaaatttggccatcccagggagccatgactcatttagtttttatatcgatgaagcctcacctgtgggccccgagcagcccgagacagtccagaattttgtgtccgtatttgggactgtggcaaaaaagctaatgcggaagtggctggctacccagactatgaactttactggccagcttggagctgggatccgatacttcgacttacgaatttcgacaaagcctcgcgaccccgacaacgaactttacttcgcacacgggttattttccgccaaggtgaacgaagggctggaggagatcaacgcattcctgacagaccaccataaggaagtagtatttttggatttcaaccatttttacggaatgcagaaataccaccacgaaaaactggtgcagatgctgaaggatatttatggtaacaagatgtgtcctgcaatattcgcacaagaggtttctttgaagtatctgtgggaaaaggactatcaggtcctggtcttttatcattcacccgtcgccttggaggttcccttcctgtggcctggtcaaatgatgcctgcaccctgggctaacactaccgaccctgagaaacttattcagtttcttcaggccagcatcacagagcgacgcaaaaaaggatccttctttataagtcaggtggtgctgacccctaaagctagcactgtggttaaaggtgtggcttctggcttgcgggagaccattaccgagcgtgctcttccagctatgatgcagtgggttagaacacagaagcccggtgagagcggtatcaatatagtgacggctgatttcgttgagctaggcgattttatcagcacggtcattaagctgaactacgtttttgacgaaggggaggcaaatacatag

SEQ ID NO: 31926 - DNA, 351 bp, Artificial Sequence
  Description of Artificial Sequence: Synthetic coding sequence
atgggccctaaagaccacatggtcacttctagcttctgttgtcaatctgacggctgtaacagtgccttcttgtccgtccccttgaccaacctgaccgaaaacgggcttatgtgccctgcgtgcacggcttccttccgggataaatgtatgggacctatgacccactgcacggggaaggaaaaccattgtgtgagtctttcgggacatgtgcaagccggcatattcaaacctcgcttcgcaatgcgtggctgcgcaaccgagagcatgtgctttacaaaacccggggcggaggttccgaccggcactaatgtgcttttccttcaccatatagagtgtacacacagcccctag

SEQ ID NO: 31927 - DNA, 615 bp, Artificial Sequence
  Description of Artificial Sequence: Synthetic coding sequence
atgcggctgagtcgccggcctgagacttttctgttggctttcgtgctcctctgcacccttctgggcctcggctgcccgcttcactgcgagatctgcactgcagcgggaagtcgatgccacggccagatgaaaacttgttcctccgacaaagacacctgcgttctgttggtgggcaaggccacaagtaaagggaaggagctggtgcatacttacaagggatgtatccggagtcaggactgctacagtggggttatttccaccaccatgggccctaaggaccacatggtaacttcatcattctgctgccagagcgacgggtgtaactccgcattcctttcggtgcccttaacgaacctcactgagaatggtctgatgtgtcccgcttgtacagctagctttagggataagtgcatgggaccaatgacccactgcaccggtaaagaaaaccactgcgtgagcctttcaggccacgtccaagctggcatttttaagcccaggtttgccatgagggggtgtgctactgagtctatgtgttttaccaaaccaggcgccgaagtgccgaccggtacaaacgtgctgttcctccatcacatagaatgtacccatagtccctag

SEQ ID NO: 31928 - DNA, 2520 bp, Artificial Sequence
  Description of Artificial Sequence: Synthetic coding sequence
atgagagccaagtgcatcacagaacctgtcggaattgagctggccccgtgtctccaggccccttccgtgccggagaccgatttgaagggagttgtgcaggcaagagggggaggggcctccgttttggaaaagccaagagagggattcaagcgcgcagagcaggtgccggtgtctcaaactgactgttttgtcagcctttggttgccaaccgcttcacaaaagaagctgcgcaccagaactatttcaaattgccctaatcctgaatggaacgaatccttcaactttcagatccagagccgggtaaaaaatgtgcttgaactgtccgtttgtgacgaggataccgttactccagatgaccacttgctaaccgtgttatatgatttgactaaactgtgctttaggaagaagacacacgttaaattccctctgaacccccagggcatggaagagctggaagtagagttcttactcgaagagtccccctcacctccagagacactggtgaccaatggggtgttagtgtcgcgacaggtctcttgcctggaggtacatgcccaatcacgccggcgacgcaagcgggagaagatgaaagacctacttgtaatggtcaacgagtctttcgaaaatacgcaaagagtcagaccgtgcctggagccttgttgtcccacaagtgcttgttttcaaaccgccgcctgctttcactaccctaagtactttcaatcccaggtacacgtggaggtgcccaagtcccactggtcctgcggtctgtgctgcagatctagaaagaagggcccaattagccagcccctggattgtttgtcagatgggcaggtgatgactttgcctgtcggagagagctatgagctgcacatgaagtccacgccttgccctgaaacactagacgtacgattgggcttctccctgtgccccgcagaacttgaattcctgcagaaacggaaagtggtggtggccaaagccctgaagcaggtactgcagctggaggaggatttacaggaggatgaagtgcccctgatcgctattatggctactggaggaggtacacgctctatgacctcaatgtacggacaccttttagggctccagaaactcaatttgttagactgtgcgtcttacataacagggttgtcgggtgcgacatggaccatggccactctgtatcgagacccagattggagttccaagaatcttgagcccgcaatattcgaggccaggaggcacgtggtcaaagataaacttccctcactgttccccgaccaacttcggaagttccaggaggagcttcgccagcggtcacaggaagggtaccgcgtgacttttaccgacttctggggactcctcatcgagacctgtctcggtgacgagaggaatgagtgtaagctcagcgatcagagagctgctttgtcttgcggacagaacccccttccaatctatctcaccattaatgtgaaggacgatgtgtctaatcaagacttccgcgaatggtttgagttcagcccttacgaggtgggattacagaaatacggagcctttatcccctcagaactgtttggctctgaattctttatgggtagacttgtgaaacgaatccccgaaagccgaatctgttacatgttaggactctggtcctcgatcttttctctgaacctcctcgatgcctggaacctgtcacacacatcagaagaatttttccacagatggacgcgcgagaaagtccaggatatcgaagatgagcccatcctacctgagatcccaaaatgtgatgcaaacattttggagacaaccgttgtgatccccggatcgtggcttagcaactcttttagagaaattctgacccatcggagttttgtgtctgaattccataatttcttgtccgggctgcaactgcatactaattatctgcagaacggacagttctctaggtggaaggacaccgtcctggacggttttcccaatcagctgacagaaagcgctaatcacctgtgcctcctggatactgcttttttcgtcaatagcagctacccgccactgctgagacccgaaagaaaagctgacctgataattcatctcaattattgtgcaggttctcagaccaaacctctgaagcagacctgcgaatactgcacagttcagaacatcccttttccaaaatacgagctgcccgacgagaacgagaacttgaaagagtgctacttaatggaaaacccccaggaacctgacgcacctattgtgacctttttccccttgatcaacgacacattcagaaaatataaggccccaggagtggagaggagccccgaggagctggaacaggggcaagtagacatttatgggcctaagacaccctacgcgacaaaggagctgacctatactgaggccactttcgataagctggtgaaactttccgagtacaatatccttaataacaaagatactctcctgcaggccttgagattagccgtcgagaagaagaagcggctgaaggggcagtgccctagttag

SEQ ID NO: 31929 - DNA, 2388 bp, Artificial Sequence
  Description of Artificial Sequence: Synthetic coding sequence
atgacaagtggcgccacaaggtatcggcttagctgctcactccgcggtcacgaactggatgtcagaggcttggtgtgttgtgcctacccaccaggtgccttcgtaagcgtgtctcgtgaccgaacaacacgcttatgggcgcctgatagtcccaaccggtccttcaccgagatgcactgcatgtcaggccactcaaacttcgtcagttgcgtctgcatcatcccgtcctctgacatctatcctcatggcctcattgccacaggcggcaatgatcacaacatatgcatattttccctagactcacctatgccactgtacatccttaagggtcacaagaacaccgtctgttcattgagctctggaaaatttggaacccttttaagcggaagctgggataccactgcaaaggtgtggttaaatgataaatgcatgatgactcttcaagggcacacagccgcagtatgggctgtcaaaattctgcctgaacagggccttatgctcaccggctctgctgacaagacagtaaaactctggaaagctggcagatgtgaacggactttctctgggcacgaagactgtgtccggggactcgcaatcttatctgagacagagttcttgtcatgcgccaacgacgcaagtatccggcgctggcaaataactggggagtgcttggaggtctactacgggcacaccaattatatatacagtatcagtgtgtttcccaattgccgggatttcgtgactacagcagaggataggtcactcaggatctggaagcatggggaatgcgcccagacgataagattacccgcccagtctatctggtgctgttgtgttttagataacggggacattgttgttggggcaagtgacggaatcatccgagtattcactgaatccgaagaccgcaccgcctccgccgaagagatcaaggctttcgaaaaggaattgagccacgccaccattgactccaaaactggggacctgggagatattaacgctgaacagctgcccggccgagagcatttgaatgagccagggacccgggaaggccagacacggctgattagagacggagagaaggtggaggcttaccagtggagtgtcagcgaagggagatggataaagatcggggatgtcgtaggatctagcggggctaaccagcagacatctgggaaggtgctctacgagggcaaggaattcgactatgtcttttctatcgatgtgaacgagggcgggccatcctataagctcccctacaatacttccgacgatccctggctgacggcatacaatttcctgcagaagaatgatctgaaccctatgtttctggaccaggtggctaaattcatcatcgacaataccaagggccagatgctcggattgggcaacccaagtttttcagaccctttcactgggggcggcagatatgtccctggatcatctggaagctccaacactttgcctactgccgacccatttactggtgctggcagatacgtaccagggagtgcaagcatgggaaccactatggcgggagtggacccttttacaggaaatagtgcgtaccgctcagctgccagcaagactatgaacatctattttcccaagaaggaggcagtgacattcgaccaggcgaatccgacacagattctgggaaaactgaaggagctgaacggcacagctccagaggagaaaaaactgaccgaagacgacctcatactgctcgagaagatcctgtcactgatatgtaattctagctccgaaaaacctaccgtccaacagctgcagatactgtggaaagcaattaattgtccagaggacattgtgttcccggctctcgatatcctgcgattatctatcaaacacccttcggtgaacgaaaacttttgcaatgaaaaggaaggtgctcagttttcttcgcacctgattaacctgctgaacccgaaagggaagcccgccaatcagttactcgcgctgagaaccttttgcaactgcttcgtgggccaggccggccagaaacttatgatgtcacagagggagtctctcatgtcacatgctattgaactgaaaagcggatctaacaaaaatatacacatcgcgttagcgacacttgcgctgaattactctgtatgttttcataaggaccacaatattgaaggaaaggcccagtgcctgagcctgatttcaaccattcttgaggtggttcaggatctggaagccacattcagactgttagtggcattgggcacacttatctcagatgactccaacgcggtgcagctggctaaatctttgggagtagactcacaaattaaaaagtactcatccgtcagtgagccggctaaagtgtcagaatgctgtaggttcatactgaatttactgtag

SEQ ID NO: 31930 - DNA, 2367 bp, Artificial Sequence
  Description of Artificial Sequence: Synthetic coding sequence
atgctgtgtggtaggtggagacgttgcaggcggccgccagaggagcccccagtggccgcccaggtagcagctcaggtggcagcgcccgtggctctaccaagtccgcctacgccctccgacggcggtacaaaaagacccgggctgcgagcccttaaaaaaatggggctgacggaagatgaagacgtaagggctatgctccgaggatcccgtctgcggaaaatcaggagcagaacttggcataaggagagactctaccgcttgcaggaagatggcctttctgtgtggtttcagaggagaatacccagagcccctagtcagcatatcttcttcgtgcagcatatcgaagcggtgcgggagggtcatcagagcgagggtcttaggcggtttggaggcgcgttcgcgcctgccagatgtcttactatcgcatttaagggccgccggaagaacctggaccttgcagcgcctactgccgaagaagcccagcggtgggttcgcgggctcactaaactgcgggcacgcctggatgcaatgtcccagcgggaaaggctagatccctggattcactcctacttgcatcgagcagattccaatcaggatagcaagatgtcctttaaagaaattaaatccctcctgaggatggtaaatgtggacatgaatgatatgtacgcgtatcttctgtttaaagagtgcgaccactctaataacgataggctggagggcgccgagatagaggagttcctccgcaggctgctgaaaagaccagagctcgaggagatcttccaccagtactcaggagaggatcgcgtgcttagcgcccctgaactcctggagttccttgaagatcagggagaagaaggggcaacactggcccgcgctcagcagctgatccagacctacgagctaaacgaaactgccaaacagcacgaactgatgaccctggacggctttatgatgtatctgctctccccagagggggctgcgttagacaatacccacacctgcgtgttccaggatatgaatcagcctcttgctcattatttcatcagctcttctcacaatacgtatctgactgatagccagataggcggcccctcaagcactgaggcctacgaccgcgccttcgctcaggggtgcaggtgtgtggagctggactgctgggagggccccggcggtgaaccagtgatttaccacggccacacactgacaagcaaaatcctgtttcgtgacgtggtacaggccgtgagagaccacgccttcactctttctccttaccccgtcatcctgtcactggagaatcactgtgggcttgaacaacaggctgctatggcgcggcatttgtgtaccattctgggcgatatgttggtgacacaagcccttgatagcccaaatcctgaggagctcccatcccccgaacagttaaaaggcagagtgctggtaaaggggaaaaagcttcctgcagccagaagcgaggacgggagggccctgagcgatagagaggaggaggaagaggacgatgaagaggaagaagaagaagtcgaggcggctgcccagcggcgattagccaagcagatttctcccgagctgagcgccctcgctgtgtattgtcatgccaccagattgaggctccaccccgccccgaatgcaccacaaccgtgtcaggtgtcctccctaagcgaacgaaaagccaagaaattaatacgggaagccgggaactctttcgtgagacacaatgcacgtcaactgaccagggtatatccacttggcctacgcatgaattccgcgaactactctccacaagagatgtggaacagcggttgtcaactggtcgcactcaactttcaaactcccggctacgaaatggatcttaacgccggacgttttctcgttaatggccaatgtgggtacgtgctcaaacctgcctgtctgagacagccggattcaaccttcgaccctgagtacccgggaccacctcgcacgaccctctcaatacaggtcttaaccgcccagcagttgcctaagctaaacgccgagaagccgcactcaatcgtggaccctctagtccgaatcgaaattcatggggtcccagccgactgtgcacgccaggaaactgactatgtgcttaacaacggatttaaccctaggtggggacaaacccttcaattccagctcagggcccccgagctggcgctggttcggttcgtagtcgaagactatgacgctacatcaccaaacgatttcgtaggtcagttcacgctgcctctgtcaagcttaaaacagggctatcggcacattcaccttctctccaaagacggcgccagcctaagccccgccactctgttcatacagattcgaatccaacgtagctag

SEQ ID NO: 31931 - DNA, 144 bp, Artificial Sequence
  Description of Artificial Sequence: Synthetic coding sequence
atgtcccaacagaaatgtatcgttattttcgccttagtctgctgttttgctatattggtcgcactgatattctctgcagtggatatcatgggggaggacgaagacggtctgtccgaaaagaactgccagaacaaatgtaggtag

SEQ ID NO: 31932 - DNA, 816 bp, Artificial Sequence
  Description of Artificial Sequence: Synthetic coding sequence
atggcttctaaggatgcacagaaccagaggagagggcttcccggattcctgccgggggcccccgaccctgatcagagcttacctgcctccagtaacccaggtaaccaggcatggcagctgtcgttacctctcccatcatcattcctccctaccgtgtcattgccgcctggtctggagtacctctctcagttggacttgataattattcaccagcaggtcgagctgttgggcatgattctcggaacggaaacctctaataagtatgaaataaagaatagtttgggccaaaggatctatttcgcagtcgaggaaagcatctgctttaatcgcacattctgttctaccttgaggagctgtaccttgcgaattaccgacaactccggtagggaggttatcaccgtgaacagaccactgcgatgtaatagttgttggtgcccatgttaccttcaggagctcgagatccaggcacctccaggcaccatcgtgggatacgtgacgcagaagtgggaccccttccttccaaagtttaccattcagaatgccaacaaggaggacatcctgaagattgtgggcccgtgcgtcacctgtggctgtttcggtgatgtcgacttcgaagtaaaaactatcaatgagaaactaacaataggtaaaatctctaaatactggtccggcttcgtcaatgacgtctttacgaacgcagataactttgggatacacgtccctgctgacctagatgttaccgtgaaggctgccatgattggcgcctgcttcctgtttgactttatgttcttcgagcacagccttgccggactgtag

SEQ ID NO: 31933 - DNA, 816 bp, Artificial Sequence
  Description of Artificial Sequence: Synthetic coding sequence
atggctagcaaagacgcacaaaaccagcgacggggattgcccgggtttctgcccggcgccccagaccccgatcaatccctgcccgcttcgagcaatcccgggaaccaggcttggcagctgtcactacctctgccctcgtccttcctccctactgtgagtctgcccccaggtctggagtacctctcccagctagacttgattatcattcaccagcaggtagaattgctaggtatgattttgggaacggagacatcaaataagtatgagattaagaactcccttgggcagagaatatactttgcggtggaagaatcgatttgcttcaatcgcaccttttgctctaccctgcgctcctgtacgctgaggatcactgacaactcgggtagggaagttatcactgttaaccgccctctcagatgcaatagctgctggtgtccttgctacttgcaagagttggagattcaggcacctccaggcactatcgttggatacgtaacccaaaagtgggacccctttctgccaaaatttacgattcagaacgctaataaggaggacatcctgaagatcgtcgggccttgcgttacctgtggttgcttcggggacgtggactttgaggtgaaaacaattaatgagaagctaacaataggtaagatcagcaagtattggtctgggttcgtcaacgacgtatttaccaatgccgataattttgggatccacgtgccagcggacctcgacgtcacggtgaaagctgcgatgatcggcgcctgcttcctcttcgacttcatgttttttgaacacagtcttgccggtttgtag

SEQ ID NO: 31934 - DNA, 3033 bp, Artificial Sequence
  Description of Artificial Sequence: Synthetic coding sequence
atggcagctagagtgcttatcattggctccgggggcagagagcacacgctggcctggaagctggcacagagccaccacgttaaacaggtactggtcgcaccaggaaacgccggaacagcctgcagcgaaaagatcagtaatacagctatctccatcagtgaccatactgcccttgcccaattttgcaaagaaaagaaaattgagttcgtggttgtcgggcccgaggcaccccttgccgctggtattgtagggaacctccgctctgccggcgtgcaatgtttcgggcccacagcggaggctgctcagctggaaagttctaaacgcttcgcaaaggagtttatggacagacatggaatccctacagctcagtggaaggcatttaccaaaccagaggaggcatgcagctttattctgtcggccgatttccctgcgctggtggtcaaggccagtggcctggctgccggaaagggcgttattgtcgccaagtctaaagaagaggcttgtaaggcagtccaggagataatgcaggagaaggctttcggcgccgcaggcgaaaccattgtgattgaggagctcctcgacggggaagaggtctcatgcttatgcttcacagacgggaagaccgtagccccaatgccgccggctcaggatcataagaggctgctggaaggtgatggcggacccaacacaggcggcatgggcgcctattgccctgctcctcaagtttctaacgatctgctgcttaaaataaaggacaccgttcttcagagaacagttgatggcatgcaacaggagggcacaccatatacaggaatcctttatgccggtattatgctgaccaaaaatggcccaaaggtgctggagttcaactgccgatttggcgaccccgagtgtcaggtgattctcccgctgctcaagagcgacctgtatgaggtgattcagtctacactggatgggctgctgtgtacctctctgcccgtgtggctggagaaccatacagcgctaactgtcgtcatggctagcaaagggtaccctggtgactatacgaagggcgtggagataacgggctttcctgaagcccaggcccttgggctagaggtctttcacgcgggcaccgcactaaagaatggcaaagtggtcacccacgggggacgcgtattggccgtgacagccattcgcgagaaccttatcagtgccctggaggaggcaaaaaagggcctcgcagcgatcaagttcgagggcgcaatctaccggaaagatgtaggatttagggcaatcgcctttctgcagcaacctcggagtctgacctataaagaatctggagtcgacattgcagcggggaacatgctagtcaagaagatacaacccttggctaaagctacttcacggtctggatgtaaagtggatttgggtgggtttgccggtctctttgacctgaaggcagctggctttaaggacccactactggcctcaggaacagacggcgtcggcacaaaactgaaaatcgcccaactgtgtaacaaacatgacacaatcgggcaggacctggttgctatgtgcgtcaatgacattctggctcaaggggccgaaccgcttttttttcttgactatttttcatgtggtaagctggacctttccgtgaccgaggctgttgtggccggcatcgctaaagcctgtggtaaagccggctgtgccctgctgggaggggaaactgcggagatgcccgacatgtaccctccaggagagtatgatttggccggattcgctgtgggcgccatggagcgcgaccagaagcttccccatctggaacggatcacagaaggagatgtggttgtagggatcgcaagcagtggccttcacagcaacggttttagcctggtccgcaaaattgtggccaaatctagcctgcagtatagtagcccagccccagacgggtgcggagaccagacactgggtgaccttcttctgactccaaccagaatctatagccattcactgttgcccgttcttcggtccggacatgtgaaagcattcgcgcatattacaggaggcggcctgctcgagaatatcccgagggtgctacccgagaaactgggtgtggacctggacgctcagacatggaggatcccccgcgtgttcagctggctgcagcaagaaggccacttgagtgaggaggaaatggcccgaacctttaactgcggggtgggcgctgtgctggtggtatcaaaagagcagactgaacaaatcttacgagacattcaacagcacaaggaggaagcttgggtaattgggagcgttgtggccagagctgaaggttcgcccagggtcaaggtcaaaaacttgatcgagtccatgcagatcaatggctctgtgctgaagaacgggtcccttaccaatcatttctccttcgagaaaaaaaaggccagagtggctgtcctaatctcaggcacaggttctaacttacaggccttaatcgactcaactagagagccaaatagttcagcccagattgatatcgtcatatcgaacaaagcagctgttgcaggcctggataaggcagagcgggcaggcatcccaacgcgggtcataaatcacaaactctacaaaaatagggtcgaatttgacagcgccatcgatttggttctcgaggaattctccatagacattgtctgcctcgcaggatttatgcgcattcttagcggcccttttgtgcaaaagtggaatggtaagatgcttaatatccacccatccctgctgccaagtttcaaaggcagcaacgcccatgaacaggcccttgaaaccggggtcacagttaccggctgcaccgtgcactttgtagcagaggacgtggacgctggtcagatcatactgcaggaagccgtcccggtgaagcgaggcgataccgtcgccacccttagtgaacgagtgaagcttgcagaacataaaatctttcctgctgccttacagctcgtggcttctgggacagtgcaattgggtgagaatggaaagatttgttgggtgaaagaagagtag

SEQ ID NO: 31935 - DNA, 3033 bp, Artificial Sequence
  Description of Artificial Sequence: Synthetic coding sequence
atggcggcccgcgtgttgattatcggtagtggtgggcgcgaacacacactggcatggaaactggcacagtctcatcatgttaagcaagtcctggttgcccccggcaatgccgggactgcttgctcagagaagatatccaacacagcgattagcatctccgaccataccgccctggcacaattctgtaaagagaaaaaaatcgagtttgtagtcgtgggacccgaagctcccctggccgccggcatagtggggaatttgcgctccgccggcgtacagtgttttggacctactgcagaggcagcccagcttgagagttctaaacggtttgcgaaagaatttatggaccgacacggaatccccactgctcagtggaaagcatttaccaaacctgaagaggcatgtagcttcatcctgtcggccgacttccctgccctcgtggtgaaagccagcggactggctgcaggcaagggggtgatcgttgcaaagtctaaagaggaagcgtgtaaggcagttcaggaaatcatgcaggagaaggcatttggggccgccggggaaactatcgtgatcgaagagctgctcgacggcgaagaagtctcttgcctgtgctttaccgatgggaagactgtcgcacctatgccacccgcccaggaccacaaacgcctccttgaaggtgatgggggcccaaacaccggtgggatgggagcttactgtcctgcccctcaggtttcaaatgatctgctcctgaagataaaggataccgttctgcagagaacagttgatggaatgcagcaggagggaactccttataccggaattctttacgccggcatcatgctgacaaaaaacgggcctaaagtgctcgaatttaattgccgttttggggaccccgagtgtcaagtgatcctcccacttctaaagtcagacttatatgaagtgatacaatctacactcgacggcctgttatgtacctcactgcccgtgtggctggagaaccataccgcactgaccgtggtcatggcatccaaaggttatccaggagattatacgaaaggcgtggagatcacaggctttcctgaagctcaggccctcggtctcgaggtatttcatgctggtacggctttgaaaaacgggaaggtggtgacccatggaggacgggtactcgcagtgaccgccatacgcgaaaacctcatctcagccctcgaagaggccaagaaaggcctggctgctattaaatttgagggtgccatctatagaaaggatgtgggcttcagggcaatagccttcctacagcagccaagatctctcacctataaggaatccggcgtggatatcgctgccggaaacatgcttgtaaagaagatacaaccattagctaaggccacctcccggtccgggtgtaaagttgacctgggaggattcgcagggctgtttgacctgaaagccgccgggttcaaagatcctctgcttgccagtgggacagacggcgtcggaaccaagctcaaaatcgctcagctctgcaacaagcatgatacgatcggacaggatctggtcgcaatgtgcgttaatgacattctggcacagggcgccgagccgcttttctttctcgactatttcagttgcgggaaactggatctgtccgtcaccgaagccgtcgtggcaggaatagctaaagcttgcggcaaggccgggtgcgccctgctgggtggtgagactgcagaaatgccagatatgtaccctcctggagaatacgatctcgctggattcgcagtcggggccatggaaagagaccagaaactacctcacttagagcggatcaccgagggcgatgttgtggtgggaatcgcttctagcggcctgcactctaacggcttctctctggtgcgtaaaatcgtggcgaagagctccctgcagtactccagtccagcgcctgacggctgcggcgaccagaccctgggcgacctactgcttacccccaccaggatttatagccatagcttgttgcccgtcctgcgctcagggcacgttaaagccttcgcacacattacaggagggggccttctcgaaaatattcccagagtgctgcctgaaaaactgggcgtggatctcgatgcgcaaacttggaggataccaagggtgttctcctggctccagcaagaaggtcacctcagtgaggaagaaatggctaggactttcaattgtggcgtgggagctgtcttagtggtgtcaaaagagcagactgaacagattctgagagatatacaacagcataaggaagaagcatgggttattgggagtgtggtcgctagggctgagggaagcccccgtgtcaaagtcaaaaacctgattgagagcatgcaaatcaacggatcggtgctgaagaacgggtctttgacaaatcatttctcatttgaaaaaaagaaggcacgggttgccgtgcttatttctggtaccggctcaaacctgcaggcactgatcgactccacaagggagcccaattcttctgcacagattgacatagttatttcaaacaaggccgcggttgccgggttggacaaggcagaacgggccgggattcctactagggtcatcaaccataagctgtacaaaaatagagtggagtttgactccgccattgacctcgtccttgaggagttcagtatagatatcgtgtgcctcgcgggttttatgagaatcctgtccggcccattcgtccagaagtggaacggtaagatgttgaacatacaccctagcctgctccccagtttcaaagggtcgaacgctcacgaacaggccctggaaacaggagtaaccgtgaccggttgcaccgttcacttcgtcgccgaggacgtcgatgccggtcaaatcatcctacaagaggccgtgcctgtgaaaagaggcgacactgtcgccacattgtccgagagagtaaagttggcggaacacaaaattttccctgcagctttacagctggtggcctccggcacggtgcagctgggagagaacggtaagatatgctgggttaaagaagaatag

SEQ ID NO: 31936 - DNA, 3033 bp, Artificial Sequence
  Description of Artificial Sequence: Synthetic coding sequence
atggccgctagggtgctgataattggcagtggcggaagggagcacactctggcttggaaattggcacagagccaccacgtaaaacaggtcttggtggccccaggcaatgccgggacagcttgttccgaaaagatttccaatacagcaatcagtataagcgatcataccgccctggctcagttctgtaaggagaaaaagattgagttcgttgtggtggggcctgaggcaccccttgccgcaggcatcgtcggcaatttacgcagcgctggggtccagtgcttcggccccaccgccgaggcggctcagctggaatctagcaaacgctttgctaaggaattcatggaccgccatgggatcccaacagcccagtggaaagcgttcaccaagccagaggaagcctgcagtttcattctttccgcggacttccctgcgctggtggtaaaagccagcggacttgccgccggcaagggcgtaatcgtcgctaaatccaaggaggaggcttgtaaggctgtgcaggagatcatgcaggaaaaggcctttggcgccgccggggaaacaatcgtgattgaagaactgctggacggagaagaggtgtcttgcctctgttttactgacggaaaaaccgtagcacctatgcccccggcacaggatcacaaacggctactagagggtgatggaggccccaatacaggggggatgggggcctattgcccagccccccaggtttccaatgatctgctgctgaagataaaagataccgttctgcaaaggaccgtcgatggaatgcagcaggaagggacaccctacactgggatactgtacgcaggtatcatgcttactaaaaacgggccgaaagtccttgaattcaattgcaggttcggagaccccgaatgtcaggtgattttacccttattgaagagcgacctgtacgaggtcatccagtctactctcgacgggctgctgtgtacatcgctgccggtttggctggaaaatcatacagccctgaccgtcgtgatggcaagcaagggttacccaggcgactatacaaagggtgttgaaattactggctttccagaggcacaggcactgggtttagaggtgttccacgctgggactgcactcaagaatggcaaagtggtcacacatggaggccgggttctggcggttactgctatacgggaaaatctgattagcgccctggaggaagctaaaaagggcttggccgcaattaagtttgagggcgctatttacagaaaggatgtgggcttcagagccatcgccttcttgcagcagccgcgctcattgacctacaaagaaagcggggtggacatcgccgcgggcaatatgctggtgaaaaagattcagcctttagcaaaagcgactagcagaagtgggtgcaaggttgatctggggggctttgcaggcctgttcgacctcaaggccgccggattcaaggatcccctcctcgcctcggggacagatggcgtgggtactaagttaaagattgcccagctgtgcaacaaacacgacaccataggtcaggatctggtggctatgtgcgttaatgacattttggcgcagggcgctgagccactgttttttctggattatttctcatgtgggaaattggatctgagtgttaccgaagccgtggtggctggaatcgcaaaggcttgcggtaaagctggatgcgcactgctcggcggggagacggcggagatgccagatatgtatcctccaggagaatatgacttggctgggttcgccgtgggggcaatggagcgcgaccaaaagctgccccacctggagaggattaccgagggcgatgtggtagtcggaatcgcctcctccggtctccacagcaatggcttcagcctagtgcgcaaaattgtggccaaaagctcacttcagtatagtagcccagccccagacggctgtggagaccagactctgggcgatctcttgctcactcccacccggatctactcgcactcactcctcccagtcctgcggagcggtcacgtgaaggcttttgcacacattacgggaggagggctgctggagaacattccgagggtgctccctgagaaattgggagtcgatctggatgcacagacttggaggatccccagggtctttagttggctacagcaggaaggacacttgagcgaggaggagatggcccggacgtttaactgcggggtcggcgccgttctcgttgtgagcaaggagcaaacagaacagattctacgggacattcagcagcataaggaggaggcctgggtgatcggaagtgtcgtggctagagcagagggcagccctagagttaaagtcaagaatttgatcgaatccatgcagattaacgggtctgtccttaaaaacggatccttgacaaaccatttcagctttgagaaaaagaaagctagggtggcagtgctgatctccgggactggaagcaatttgcaggccctgatcgatagtactcgagaaccaaattcttctgctcagatcgacatcgtgatttcaaacaaggccgctgtggcaggccttgataaggccgagagagcagggattcctacgcgggtgattaaccataaactgtataaaaacagagtggaatttgattccgctatcgatttggtcttagaagaattcagcattgatatcgtgtgccttgccggattcatgcgtattttgagcggccccttcgtgcaaaagtggaacggcaaaatgctgaacatccatccatcgctattgccaagcttcaaggggtccaatgcccacgaacaagcactagaaactggggtgaccgttactggctgtacggtgcatttcgtggctgaggacgtggacgccgggcagattattctgcaagaggctgtccctgtcaaacggggggatactgtggctacactttcagaacgcgtcaaactggccgagcataaaattttcccggccgccctgcagttagtggcctctgggacggtgcaactgggagaaaatggaaagatctgctgggtaaaagaggagtag

SEQ ID NO: 31937 - DNA, 993 bp, Artificial Sequence
  Description of Artificial Sequence: Synthetic coding sequence
atggagctgttgtctacgccgcattccatcgagattaataacattacatgcgacagctttagaatctcttgggccatggaggacagtgacctcgaacgggtgacgcactacttcatagatttgaataaaaaggagaataaaaatagcaacaagttcaaacatcgagacgtgcccacgaagttggtcgctaaggccgtgcccctacctatgaccgtgcgtggccactggtttttgagcccacgcaccgaatactctgtggccgttcagacggctgtgaaacaaagtgacggtgagtatctggttagcgggtggtccgagacagtggagttctgcacaggagactatgctaaggagcatcttgcccaactgcaggagaaagcagagcaaatcgccggcaggatgcttcgcttctccgtgttctatcgcaaccatcataaagagtacttccaacatgctcgaacacactgcggaaacatgctgcagccttacctgaaggacaactcgggtagccacgggagcccaacaagtgggatgctgcatggtgtcttttttagctgtaacaccgagttcaataccggtcagccgccccaggattcaccatatgggaggtggcgtttccaaatccctgctcaacgtctgtttaatcccagcacaaacctgtacttcgccgatttttactgcatgtacacggcataccactacgccatcctagttctggcgcccaaaggaagcctcggcgacagattttgccgagatagactgccccttctcgatattgcttgtaacaagttccttacttgctctgtggaggatggggagctcgtgttccgtcatgcccaggatttgatcctggaaattatttatactgaacccgtggacctgagcttaggtaccttgggggagataagcgggcaccaactgatgtcgctgtccaccgctgatgctaagaaagacccttcctgcaaaacgtgcaacattagtgtgggcagatag

SEQ ID NO: 31938 - DNA, 714 bp, Artificial Sequence
  Description of Artificial Sequence: Synthetic coding sequence
atggaactcctgtctacgccccactccatagaaattaataacataacgtgcgatagttttcgaatttcctgggctatggaggattctgaccttgaacgggtgacccattatttcattgacctgaataaaaaggagaacaagaattctaatcaccacaaagaatattttcagcacgcccgcactcattgtggcaatatgcttcagccctaccttaaagataactccgggtctcacggatcaccaacaagtgggatgctccatggcgtgtttttctcttgcaacactgagttcaacacaggccagcctccccaggatagtccatatggcagatggcgcttccagatacccgcgcaaaggctgtttaatccctccacaaacctctattttgctgatttttactgtatgtataccgcctaccactacgcaatactggttcttgcaccaaaaggatccctcggtgatcgcttctgtcgggatcgacttcctctgttagatattgcgtgtaataaattccttacctgcagcgtcgaggatggggaattagtcttccggcatgcacaagacctgatcctggaaatcatctacactgagcccgtcgatctgagtctgggcacccttggggagatctccggccatcagctgatgagcttatcaacagcggacgcaaagaaggatccttcttgcaagacctgcaatatttctgtcggccggtag

SEQ ID NO: 31939 - DNA, 993 bp, Artificial Sequence
  Description of Artificial Sequence: Synthetic coding sequence
atggaattactttctacgccacacagtattgagattaataacatcacctgcgattctttcaggatatcatgggcgatggaggatagtgacctggagcgcgttacccactacttcatcgatctgaacaagaaagaaaacaaaaatagcaacaagtttaaacaccgcgacgtccccactaagttggtagccaaggctgtcccgcttccgatgacagtgagaggacattggtttttatctcctcgcaccgagtattctgtggccgtgcagactgctgtgaaacagagcgatggcgaatacctagtatctggatggagcgagaccgtagagttctgcaccggggactatgctaaggagcatttggcccagcttcaggaaaaagcggagcagatcgctggtaggatgcttaggttctccgtgttctaccgcaaccaccacaaggaatacttccaacatgctaggacccactgtgggaacatgctccaaccctacctaaaggacaactctggatctcatgggagccccacatctggcatgttgcatggtgtattcttctcctgcaataccgagttcaacacaggccagcccccacaggattcgccttacggcaggtggagattccagattcccgcccagaggctcttcaacccaagtactaacctctacttcgccgatttctattgtatgtataccgcttatcactacgccatactggtgttggcccccaagggatctttgggggatcgcttctgccgtgatcgactgccattgctggacattgcctgtaataagttcttgacctgtagcgtggaggatggagagctggtcttccgccacgcacaagatttgattctagaaatcatctatacagaacctgtcgatctgagcctggggacactgggcgaaatcagtggccaccagctgatgagcctgtccaccgccgacgcaaagaaggatcccagctgtaagacctgtaacatctcagtaggacgttag

SEQ ID NO: 31940 - DNA, 894 bp, Artificial Sequence
  Description of Artificial Sequence: Synthetic coding sequence
atggcgtgcctcagtccctcgcagttacagaagttccagcaggacggctttctcgtgctggaagggttcctgagcgccgaggaatgtgttgctatgcagcagagaataggcgagatcgtcgcagagatggatgtgccactccactgtcgtactgaattctccacgcaagaagaagagcagctccgtgcccagggttcaacggattacttcctgtccagtggtgataagatccgatttttttttgaaaaaggagtcttcgatgagaaaggcaactttctcgtcccgcccgagaagtccatcaacaaaatcggccatgctctccacgcacacgatcccgttttcaaaagcatcacccattccttcaaggtgcaaactttggcccggagcctaggcttgcagatgcccgttgtggtccagagcatgtacatctttaagtctccactcattcgcaccccccctagctgtactcggagcccatgggcaggatgttgggcctgcggcagtcaatggcgcatgccaagatggcggactgccgtgtctggaagcagtctggcacctaccccagtggtgtgccaggagggctggtccggccctttgctggcccagcgactggtccccgccagcctggggcagagtcagcccgggattaccgcatccctgtgtcctccgcaatgtcgagaaggaccctggagctctagtatggagaaatggtacaccagggccagccgaacatcactgacggccagggcccggccaacactgtctacttcttggagacctttggcgcctcctggtgccaggcgaactgggagtagccagcaactgaactgtcctttcccaaattgcactccaaaaggcagtcggcgagccggggctttggctccgccagggtag

SEQ ID NO: 31941 - DNA, 813 bp, Artificial Sequence
  Description of Artificial Sequence: Synthetic coding sequence
atggcatgtctctccccatcccaacttcagaaatttcagcaagacggctttctggtcctcgagggcttcttgagtgcggaagagtgcgtggctatgcagcagcggattggagaaatagtggccgagatggatgtgccactccattgcaggacagagttcagtacgcaagaggaggaacaactgcgcgcgcagggaagtactgattacttcctttcatcaggagataaaatccggtttttcttcgaaaaaggggttttcgacgagaagggcaatttcttggtaccgccagagaaatccattaataaaattggccacgcattacacgcccacgatccagtcttcaagtctattacccacagttttaaggtgcagcagcctcactttgggggcgaggtgtctcctcatcaggacgccagcttcctgtacaccgaaccccttggacgcgtcctgggcgtgtggatagccgtagaagatgccacactcgaaaatgggtgcctctggtttattccagggtcccacaccagtggcgtctcccgccgcatggtgcgcgctcctgtgggatcagcacccggtacttcttttctgggttccgaacccgctagggataattctttgtttgtaccaactcccgtgcagcgcggtgctcttgtcctgattcacggcgaagtagtgcataagagcaagcagaatctgtcggaccggtcccggcaagcctatacatttcatctcatggaagctagtggcacaacttggagtcccgagaactggctccagccaacggctgaactgccattccctcagctctatacctag

SEQ ID NO: 31942 - DNA, 876 bp, Artificial Sequence
  Description of Artificial Sequence: Synthetic coding sequence
atggcatgtttgtctccgagtcagctccagaaattccagcaagacggattccttgtgctcgaaggctttctgtctgcggaggagtgcgttgccatgcagcaacgtatcggtgaaatagttgccgagatggatgtgccccttcattgtaggaccgaattttccactcaagaggaggaacagctccgcgcgcagggcagcacagattacttcctgtccagtggagacaaaatccgctttttctttgagaagggggtttttgacgaaaagggaaactttcttgtgcctcccgagaaaagtattaacaagatcgggcatgccctacatgcccatgatcctgtgtttaaaagcatcacacactccttcaaggttcaaactctcgccagatctctggggctccaaatgcctgtggtggtgcaatccatgtacatctttaagcagccacatttcggtggggaagtgagcccccaccaagatgcaagttttttgtataccgaaccgctggggcgcgtgctgggggtgtggattgcggttgaggatgctacgctggaaaacggctgtttatggttcatccccggcagccacacttccggagttagccgacgaatggtgcgagcaccagtgggcagtgctcctggtaccagttttctcggatcagaacccgctcgtgataattccctgtttgtgccaacaccagttcaacgaggtgcacttgttcttattcatggtgaagtggttcacaagagcaagcagaacctcagcgatagatctcggcaagcctacacttttcatctgatggaggctagcggaacgacttggagccccgagaattggctccagcctactgctgagctgcctttcccacagctatatacttag

SEQ ID NO: 31943 - DNA, 201 bp, Artificial Sequence
  Description of Artificial Sequence: Synthetic coding sequence
atggcttgcctgagtccaagccagctccagaaattccaacaagacggttttctcgtgctggaggggttcttgtcagccgaagagtgtgtggccatgcagcagcgaataggcgagatcgtcgccgaaatggatgtgccactgcattgcaggacagaattctcgacccaggaagaagagcagcttcgcgctcagggtagctag

SEQ ID NO: 31944 - DNA, 813 bp, Artificial Sequence
  Description of Artificial Sequence: Synthetic coding sequence
atggcttgtctgtcaccaagtcagctccaaaagtttcagcaggatggatttctggtcttggaagggttcctgtctgcggaagagtgtgtggcgatgcaacagcgaatcggggaaatagttgcggaaatggacgtgcctcttcactgccggaccgagttctccacacaggaggaggagcagctgagagcccagggatcgactgattatttcctctctagcggcgacaagattcgtttcttttttgaaaagggagtctttgatgagaagggcaacttcctggtgcccccagaaaaatccatcaataaaatcggccatgccctgcacgctcacgatccagttttcaagtccatcacacacagcttcaaggtgcagcagccccatttcggcggtgaagtgtctccccatcaggacgcaagtttcttgtacaccgaacctctggggcgcgttctcggcgtgtggattgcagtcgaggacgccaccctggagaacgggtgcctgtggtttattcccgggagccacacaagtggggtgagccggcggatggtacgtgcccccgtagggagtgctcccggcacaagttttcttggctccgaacccgcccgcgacaactcgctgttcgttcccaccccggtccagagaggggctctggtactgattcatggggaggtcgtgcataagtcaaaacaaaacctgagtgatcgctctcgccaagcctacactttccacctgatggaagcttcaggaaccacatggagtccggaaaactggctgcagcccacggccgagctcccttttccccagctttatacctag

SEQ ID NO: 31945 - DNA, 534 bp, Artificial Sequence
  Description of Artificial Sequence: Synthetic coding sequence
atggcctgcttgtccccatcgcagctgcaaaagtttcaacaagatggattcctggtgctggaaggcttcctgtcagctgaagagtgtgtggctatgcagcagcgtatcggggaaatcgtggctgagatggatgtccctttgcattgtaggacagagttctccacacaggaggaggagcagctcagagctcaaggcagcactgattattttctatcaagtggtgacaagattagattttttttcgagaagggagtattcgatgaaaaaggcaactttctcgtgccgcccgagaaatccatcaataagattggccacgcactacacgctcatgatccggtgtttaaatccataacacattcatttaaggtccagactctagccaggtccctgggattgcagatgcccgtggtggtgcaaagcatgtacatcttcaagcagccacattttggtggggaagtttctcctcaccaggacgcaagcttcctgtacactgagccactgggaagggtcctgggtgtgtggatcgctgtttag

SEQ ID NO: 31946 - DNA, 195 bp, Artificial Sequence
  Description of Artificial Sequence: Synthetic coding sequence
atggcctgcttaagcccctcgcagctccaaaagtttcagcaggacggcttcttggtgctggaaggttttctttctgctgaggagtgtgtagccatgcagcagcgcatcggtgaaatcgtggcggaaatggacgtgcccttacactgcaggacagaattttccacacaggaggaggagcaactacgggcccagtag

SEQ ID NO: 31947 - DNA, 1779 bp, Artificial Sequence
  Description of Artificial Sequence: Synthetic coding sequence
atggcaagcacctcacgcgacgttatcgcagggcgtggcatccattccaaggtgaaatcagccaagctactagaggtcctgaatgctatggaggaagaggagagtaataacaacagagaagagatctttatcgctcccccggataacgcagctggcgaatttactgacgaagacagcggagacgaggacagccagcggggtgcccatcttcccggatccgtactgcacgcctctgttctgtgtgaagacagcggaacgggagaggacaacgacgatttggaactccagcccgcgaagaagcgacaaaaagcagttgtgaagccccagcgtatctggacaaaaagagatatacgcccggactttgggtcttggacagcatcagatccccacatcgaggacctcaagtcacaagagctgagcccggtgggcctgttcgagttgttcttcgacgaaggaacaattaacttcattgtcaatgagacaaatcggtatgcctggcagaaaaatgtaaatctctctctcactgcacaggaattgaagtgcgtgttggggattctgattttatcgggctacattagttaccccaggcggaggatgttctgggagacatcacctgactcccaccaccacctcgttgctgatgccataagacgggacaggtttgaactgattttttcctatttacattttgccgacaacaacgagctcgacgcctcagatcgcttcgccaaagtcagacctttgattatcagaatgaactgtaactttcaaaaacacgcccctcttgaagagttttacagttttggagaatcaatgtgcgagtatttcgggcaccgggggagcaagcaactccacagagggaaaccagttcggctggggtataaaatctggtgtggtaccaccagtcgcgggtacctggtctggttcgagcccagtcagggaacccttttcaccaaacctgaccggtctctggatctgggcgggagcatggtcatcaagttcgtggatgcattacaggagcgtggattcttaccctatcatatcttcttcgacaaggtctttacttctgtgaaactgatgagcatcctgagaaaaaaaggggtcaaggccacagggactgtaagggagtataggaccgagcggtgtcctctaaaagacccaaaggaactaaaaaagatgaaacggggatcttttgattacaaggtggatgaatctgaggaaatcatcgtgtgtagatggcatgactcaagtgtggtgaacatctgttccaacgccgttggaatcgagccggtgcggctcacgtctaggcatagcggggcagcgaagacacggactcaagtgcaccagccgtctctggtgaagctctaccaggagaaggttgggggggtaggcaggatggatcaaaatatagcgaaatataaggtgaaaattagaggtatgaaatggtacagctctttcataggctacgtcatcgacgctgccctgaacaacgcctggcaactgcaccgcatctgctgtcaagacgcccaggttgacctattagcgttcaggcggtacatcgcgtgcgtgtaccttgaatctaacgcggacacaacgtctcagggacgacgttcccgtaggctcgagacagaatctcgatttgacatgataggacactggatcatccatcaggacaaaagaactcgctgtgcgctgtgtcattcacagacaaatacccgctgtgagaagtgtcagaagggtgtccacgcaaagtgcttcagggagtatcacattcgctag

SEQ ID NO: 31948 - DNA, 1026 bp, Artificial Sequence
  Description of Artificial Sequence: Synthetic coding sequence
atgaattgcaacttccagaaacacgcccccctcgaagagttctattccttcggagagtcaatgtgcgaatatttcggtcacagagggagtaaacagcttcatcgcggaaagcccgttagactaggatacaagatctggtgtggcacgacatctaggggttatctcgtgtggtttgagccttcccaaggtactctctttacaaagccagaccggagcctcgacttggggggtagtatggttattaagtttgtcgacgctctgcaggaacgcggattcttgccgtatcacatcttcttcgacaaagtctttacctctgtcaagttgatgtccatattacgaaaaaagggcgtgaaagccactggaaccgtcagggagtaccgaaccgaaaggtgcccgctgaaggaccccaaggagctgaagaagatgaaacgaggctcattcgactataaagtggatgagtccgaagagattatcgtctgcagatggcacgacagctccgtagtcaacatatgttctaatgctgtaggtatagagccggtacggctaacatcccggcactccggtgccgcaaagaccaggacacaagtgcaccaaccgtccctggttaagctgtaccaagaaaaagttggcggggtgggccgaatggatcagaatatagccaaatataaagtgaagatcagaggaatgaagtggtattcttcgttcattggttacgtgatcgacgctgctctgaacaatgcctggcagttgcaccggatttgctgtcaggacgctcaggtggacttgctggctttcagaagatatattgcatgcgtgtacttagaatcaaatgctgacactactagccagggcaggcggtccaggcgccttgaaaccgagtctcggttcgatatgattggtcattggattatccaccaagataaacgcaccaggtgtgcactatgtcattctcagactaatacacggtgtgagaaatgtcagaagggcgtccacgcaaaatgtttccgggagtatcacattcggtag

SEQ ID NO: 31949 - DNA, 1770 bp, Artificial Sequence
  Description of Artificial Sequence: Synthetic coding sequence
atgggccgtgacgtgattgctggtcgcggcatacacagcaaagtgaagtccgctaaactgttggaggttcttaacgctatggaggaagaggaatccaacaacaaccgggaggaaatcttcatcgccccgcccgacaatgcagccggcgaattcacagatgaggacagtggagacgaggacagccagcgaggcgctcacctcccagggtccgtcttgcacgctagtgtgctctgtgaagactccggaaccggggaggacaatgatgacctcgagctgcagcctgcgaaaaagcggcagaaagcagtggttaaaccacagaggatctggacaaagcgcgacatccgacccgatttcggttcttggactgccagtgatccacacattgaggatctgaagtcccaggagctatcccctgtaggacttttcgagctgttcttcgatgagggcaccattaactttatagtgaacgaaacaaataggtacgcctggcagaagaatgtcaatctgagtctgacagcccaggaattgaaatgcgtcctgggaatcttaatcctctccggatatatcagctacccaagacgccggatgttctgggagacctccccagactcccaccaccacctggttgcggacgcgatacgaagggatcgattcgaattaattttctcatatctccacttcgctgataataacgagttggacgcttccgatagattcgccaaagttcgcccgctaataataaggatgaattgcaatttccagaagcacgctccactcgaagagttctacagcttcggagaatcaatgtgtgaatattttggtcacaggggtagcaagcagcttcacagaggaaagccggtacggctcgggtacaaaatctggtgtgggacgacctcccggggatacctcgtctggtttgaaccttcccagggaacacttttcacaaaacccgaccgatccttggatctggggggaagcatggtcataaagtttgtcgacgcactgcaagaaaggggctttctgccctaccatattttcttcgataaagtgttcacctctgtaaagctgatgagtatcctcaggaaaaaaggggtgaaggccaccggcaccgttcgggagtacagaactgagcgttgccctttaaaagatcccaaggagctgaaaaagatgaagcgtggtagtttcgattacaaggtagacgagtcggaggagatcatcgtgtgtaggtggcatgacagttcagtcgtgaacatatgttctaatgcggtcggcatcgaaccagttcggctcacatcgaggcattccggagccgcaaaaaccagaactcaggtgcaccagcccagcctcgtgaaattgtatcaggagaaggttggcggagtcgggcggatggatcagaacatcgcaaagtacaaggtgaaaatccgaggcatgaagtggtactccagctttatcggttatgtgattgatgccgctctgaataacgcttggcagctccacagaatttgctgccaggacgcgcaggtcgatctgctcgctttcagacgatatatcgcttgtgtctacctggagtccaatgctgataccacatcccagggacggagaagcaggcgcctcgagacagagtctagattcgacatgatcggacactggatcattcatcaagataaacggacacgttgcgccctttgccattcccagacgaatactcgttgtgagaagtgtcagaaaggggtccatgcaaaatgtttccgagaataccacatcagatag

SEQ ID NO: 31950 - DNA, 1782 bp, Artificial Sequence
  Description of Artificial Sequence: Synthetic coding sequence
atgcccaggaccctttccctccacgagatcacagacttgctggaaactgacgacagtattgaagcttccgcaatcgtgatccagccccctgagaacgccacagctcctgtaagtgatgaggagagtggtgacgaagaaggcggcactattaataatcttcccggcagcctgttgcacacagccgcctatctgatccaagacggtagtgatgccgaaagcgactcggacgatccctcctacgcccccaaggatgacagccccgacgaagttccctccactttcactgtccagcagcctcctccctcacggcgacgcaaaatgacaaagatcctttgcaaatggaaaaaagcagacctgactgtgcagcctgtcgccggcagagtgaccgctccaccgaacgatttcttcaccgtcatgagaacgcctaccgagattctggaactctttctagatgacgaggtaatcgaacttatcgtcaagtacagcaatctctatgcatgctcgaagggggtccacctgggtctgacttcgtctgagttcaaatgtttcctgggaatcatttttctttctgggtacgtgagtgtaccccggcgccgcatgttctgggaacagcgcacagatgtgcacaacgtgcttgtttcggccgctatgagaagagatcggtttgagaccattttcagtaacctgcacgttgccgataatgcaaacctcgatccagttgacaagttttctaaactgcggccactgatttctaagttgaacgaaagatgtatgaaatttgtgccaaatgagacctacttttcttttgatgaatttatggtaccgtatttcggaaggcacggatgcaagcaatttatccggggcaaacccatccgtttcggttacaagttttggtgcggagccacatgcctgggatacatctgttggtttcagccttaccagggcaagaaccccaacaccaagcacgaagaatatggcgttggggcgtcattggtgttacagttctctgaggccctgaccgaagcgcatcccggtcagtaccactttgtgtttaataacttcttcaccagcattgccctcctggataagcttagctcgatgggtcaccaggctaccggaacggtgcgcaaagaccatatagacagggtgcccctggagagtgatgtcgccctcaaaaagaaggagcgggggacctttgactatcggatcgacggcaagggcaacattgtgtgcaggtggaatgataattccgtcgtgacggtggcctcctctggagctggtatccaccctctatgtcttgtgtctagatatagtcagaagcttaagaagaaaattcaagtgcagcagcccaatatgatcaaagtgtacaaccagttcatgggaggcgtggacagagccgacgaaaacatcgataagtatagagcctccatccggggaaaaaaatggtatagcagcccattgctgttttgctttgagttggttttacagaacgcctggcagcttcacaagacctatgatgaaaaaccagtggacttccttgagttccgcagaagagtggtttgccactatctcgaaactcacgggcatcccccagagcctggccaaaagggccgaccacagaaacgaaatatcgattcccgctatgacggcatcaaccacgtgatagtgaaacaggggaagcagacccgctgcgcagaatgccataaaaataccacatttcgttgcgagaagtgtgacgttgcactgcatgtcaagtgctccgtcgaatatcacaccgaatag

SEQ ID NO: 31951 - DNA, 1782 bp, Artificial Sequence
  Description of Artificial Sequence: Synthetic coding sequence
atgcctcgaactctaagtctgcacgagatcaccgacttgttggagaccgatgattccatcgaggcatctgcaattgtgattcagcccccggagaacgcaaccgcccccgtgagtgatgaggagtccggggacgaagagggcgggacaataaacaatttgcccgggtcactccttcatacagccgcatatcttatccaagatgggtcagatgctgagtccgactcagatgatccctcatatgcccctaaagacgactctcccgacgaagtgcccagcacatttacggtccaacaacctcctccaagtcgtagaagaaagatgacaaagatcctatgcaagtggaaaaaggctgatctcaccgtgcagccagtcgctggccgcgtgacagcccctcctaatgacttctttaccgtgatgcggacgccgacggaaatactggagctgtttctggacgacgaggtcattgaacttattgtgaagtatagcaatctgtacgcatgctcgaagggcgtccacctgggcctgacatcgagcgagtttaaatgcttcctgggcattatctttttgtcaggttacgtgtcggttccccgtcgacgcatgttttgggagcagcggaccgatgtacacaatgtccttgtcagtgccgctatgagaagagacaggttcgagactatattctcgaacttgcatgttgctgacaacgcaaatctggatcccgttgacaagttcagcaagctgcgccctctgatttcaaaattgaatgaaaggtgcatgaagtttgtaccaaacgagacatacttctccttcgacgaattcatggtcccatatttcgggcgacatggctgtaagcagtttatcagaggaaagccgattcggtttgggtataagttttggtgtggggctacttgcctgggatatatctgctggtttcagccatatcaggggaagaatcccaataccaaacatgaggagtatggtgtgggagcctcactggtgctccagttcagcgaagccctgactgaagcgcatccaggacagtaccactttgtgtttaacaacttttttacatcgatagccctgctggataaactatcctccatgggccatcaggccacgggcactgtgaggaaggaccacatcgatcgcgtccccctagagtcagatgtggcacttaagaagaaagaacgtggcacttttgactacaggatcgatggcaaaggaaatattgtgtgtcgatggaatgacaactccgtggtgacagtggcgtctagcggagcaggaattcaccccctgtgcctcgttagtagatattcccaaaagctcaagaagaagattcaggtacaacagccaaacatgatcaaggtctataatcagttcatgggaggcgtggaccgggccgatgaaaacattgataagtaccgagcatctatcagggggaagaagtggtacagttcgccacttttgttctgctttgagctcgtgcttcagaatgcctggcagcttcataagacctatgatgagaaaccagtggatttcctcgagttcagacgcagggttgtgtgccattaccttgagactcatggccatccgccagaaccaggccagaaaggtaggccccagaaaaggaatattgactcaagatacgatgggatcaaccacgttatcgtcaaacagggaaaacagaccagatgtgctgagtgtcataaaaatacaacttttagatgcgaaaagtgtgacgtggctctgcacgtgaagtgttcagtggagtaccataccgaatag

SEQ ID NO: 31952 - DNA, 1758 bp, Artificial Sequence
  Description of Artificial Sequence: Synthetic coding sequence
atgagcaaccccaggaaacgcagcattccgatgagggattcaaataccgggctcgagcagttactggcggaagactcctttgatgaatcagacttttccgagatcgacgactcagataattttagcgactccgcgcttgaggctgacaagatcaggcctctgagccacctcgagtcggatggcaagagttcaactagctccgattccggaagatcgatgaaatggtctgctcgcgccatgattccgcggcagcgctacgacttcaccggtacacctgggcgaaaggtggacgtaagcgacataacagatccgctgcaatattttgagctgttttttacagaggaactggtgagcaagataaccagagaaacaaacgcacaggccgccttactggcctctaagccgcccggtcccaaaggcttttctcggatggataaatggaaagataccgataacgatgaactcaaagtgttttttgccgttatgctccttcagggtatagtccagaagccagagctggagatgttctggagcacaagacccctgctggatacaccatatttgcggcagatcatgaccggtgagaggtttctgctgctgtttcgatgtttgcactttgtgaataatagctccatttctgccggccagagtaaagcgcagattagccttcagaaaatcaaaccggtgttcgacttcctcgtaaataagttcagcacagtgtacacgccaaatcgcaacattgccgtagatgagtctctgatgctcttcaagggcccactcgccatgaagcagtacctcccaacgaaacgcgtgcgatttggcttgaaactttacgtactgtgcgagtcccaatctggatacgtctggaatgccctggttcacacaggccccggcatgaacttgaaggattccgctgatgggttgaagtcatcgagaatcgtcctgaccttggtgaacgacctgttaggacagggttactgtgtgttcctagataatttcaatatcagcccgatgctgttcagggaactgcaccagaatcgaaccgacgctgtggggaccgccaggttaaatcggaaacaaattccaaatgatcttaagaaacggatagccaaaggcaccactgtggctcgtttctgtggcgagctgatggcacttaagtggtgcgacggaaaagaagtgaccatgctctccacatttcacaacgatacagttattgaagtgaataatcgcaacgggaagaaaaccaaaagacctagggtgatagttgactacaacgaaaacatgggggctgtcgactcagcggatcagatgctcacaagttacccctccgaacgtaagcgtcataaggtttggtataagaagtttttccaccatctcttacatattacagtcctgaacagctatattctgttcaaaaaggataatccagaacacaccatgtctcacatcaatttcaggctggccctgatagaacggatgctagaaaagcaccataagcccggccagcaacatcttaggggtcgcccctgctccgacgacgtgacccctctgagactctcgggcaggcatttcccaaagagtattcccgcaacttccggtaagcaaaaccccactggccgatgtaaaatatgttgtagtcaatatgataaggacggtaagaaaattcggaaagaaacgaggtacttttgtgctgagtgcgacgtgccactctgcgtggtgccatgtttcgaaatctatcacacaaagaaaaactattag

SEQ ID NO: 31953 - DNA, 948 bp, Artificial Sequence
  Description of Artificial Sequence: Synthetic coding sequence
atggaaacaagctctaaaggactactgactcaggttacccagttttggaatcttctcgacgacctcgctcagtccgaccccgagggatacgaaaaatttattcagcagcagctgaaagaaggtaagcagctttgcgcggctcccgaacctcagttatgtctgcagacacgaatcctgaagcctaaagagaagatcttatttataaacttgtgtcagtggactcggatccccgcaccacaaagcacaacccacccagtaccgctaaccgtgggtaagcctgaagataccaccgagatttcagacgcttatacagtcatagatgttgcttacaaccccgacgtcctgcacgctgccgagaaagaccaagttaaaaagaaccaactaattcagatggctatgaagtgtatagaggagaaattccagttcacactttctcattcctaccacatcacaaaattccgaatcaaaggcagtatacagagaatgaaacagaacctgatgggtatccaaacagactctatcgacttgagggagaaaatgcgccgagagctcaccctcggtcagattcggagcagtacaatgagtaaccccgaccactttccacagctattattgccaaaggaccaggtgagcgggaaggcggtctgtctgatagaagagatcagcagcaccgaaatccaggtcgagatgaaaatgcccgcctacgaattaaaaatagtccacgaccatagcgaaaagccactgaaaatcgagcttaaggtggagctgccagggattaacagcgtgtccttgtgtgacctcagtgtgtccgaggacgacctgctcatagaggtttcagaaaagtatagattacacctgaatctgcctaaactcatcgacacagaaatgacaactgctaagttcatcaaggagaagagcaccctgatcattaccatgccactcgtctag

SEQ ID NO: 31954 - DNA, 867 bp, Artificial Sequence
  Description of Artificial Sequence: Synthetic coding sequence
atggaaacaagctccaaagggctgctgactcaggtgacgcagttctggaaccttctggacgacctggctcagtccgatcctgagggttacgaaaaattcatccagcaacagctcaaagagggcaaacaactctgcgctgcccctgaaccgcaactctgcctccagacaaggatcctgaaacccaaggaaaagatcctgttcatcaacttgtgccagtggacaaggattcctgcaccacagagtacgactcacccggtgccgctgactgtcggaaagccagaagacactactgagattagtgacgcttacacagtgatcgatgtcgcatataatccagatgtgttgcatgctgccgagaaagatcaggtgaagaagaaccaattgatccagatggcgatgaagtgcattgaggagaagtttcagttcacccttagccactcctatcacataaccaagttccgtattaaggggagcatccagcgaatgaagcagaaccttatgggcattcaaacggacagtatcgatctgagggagaagatgcgacgggaactgacactgggccagatccggtcgtcaactatgtctaaccccgatcatttccctcagcttctgctgccaaaagaccaggtcagcggcaaagccgtatgccttatagaggagatttccagcacagaaattcaggtggagatgaaaatgccggcttatgaattgaaaattgtacatgaccacagcgaaaagccactaaagattgaactgaaggtcgaactgccggggatcaactccgtctctctatgtgatctgagcgtatccgagggcaccacagagccccaagccctggctaaagatgaactcagcctgaagttttag

SEQ ID NO: 31955 - DNA, 867 bp, Artificial Sequence
  Description of Artificial Sequence: Synthetic coding sequence
atggaaacctctagtaaaggcttgcttacccaggtgacccaattttggaatctgctcgatgatctagcacagtccgaccctgagggctacgaaaagttcattcaacagcagcttaaggagggtaaacagctttgtgccgctcctgagccgcagctctgtctgcagacgagaattcttaagcctaaagagaagattctctttatcaatctatgtcagtggacaaggattccggcccctcagtcgactacgcaccccgttccccttactgtcggaaagccagaagacactacagagattagcgacgcatataccgtgatagatgtcgcctacaacccagatgtcttacacgcggccgagaaggatcaggtgaaaaagaaccagctgatccagatggcaatgaaatgcatcgaagagaagtttcaattcaccctttctcatagctatcacatcaccaagttcaggattaagggcagcattcaaagaatgaaacagaacctgatgggcatccagaccgatagtatcgacctgcgggagaagatgcgtcgcgaactcacattaggccaaattcggtcgagcactatgtctaaccccgatcattttccccagctcctgctgccgaaggaccaagtgagtggaaaggcagtttgtctgattgaagagatctcttcaacagagattcaggtggagatgaaaatgcctgcctatgaactcaagatagtgcacgatcactccgagaaacccttaaaaatcgagttaaaggtggagctgcctggcataaacagcgttagcctctgcgacctgagtgtttcagagggtaccaccgaacctcaggccctggcaaaagatgagttgtccctcaagttttag

SEQ ID NO: 31956 - DNA, 948 bp, Artificial Sequence
  Description of Artificial Sequence: Synthetic coding sequence
atggaaacgtcctccaagggactgttgacccaggtcacccagttctggaacctactcgatgatctagcacaaagcgatccagaaggatacgagaagtttatccaacagcagctcaaagaaggaaaacagctgtgcgctgcaccagaaccccagttatgcctccagacccgtatattaaagccaaaagagaagatactgtttatcaacctgtgccaatggacacgtattccagcccctcagagtactacacaccccgtcccgttgacagtaggcaagcctgaagacactaccgagatcagtgacgcatacactgtgatcgacgtggcttacaaccctgacgtgttacatgccgcagagaaggatcaggtcaagaagaaccagctcattcaaatggcgatgaaatgtatcgaagagaagttccagtttacccttagccactcttaccatatcaccaagttccgaatcaaaggttcaatccagcggatgaaacagaatctgatggggatacagaccgacagtattgacttaagagagaaaatgcgcagggaattgaccctgggacagatccggagcagtaccatgagtaaccccgatcattttcctcagctcctactgccaaaagaccaggtgagcggaaaggccgtatgcctgatagaggagatctcttctacggagatccaggttgaaatgaagatgcccgcctacgaactcaagattgtgcacgatcactcagagaagcctttgaagattgaacttaaagtggaacttcctggaataaattcagtcagcctgtgtgacctgtccgtttcggaggacgatctcctgatcgaggtcagcgaaaaatatcgcctgcacctgaatttgcctaagctcatagacactgaaatgactaccgccaagtttataaaggaaaaaagtacgctgataattacaatgccattagtctag

SEQ ID NO: 31957 - DNA, 636 bp, Artificial Sequence
  Description of Artificial Sequence: Synthetic coding sequence
atgtcccacgggcacagccatggagggggtggctgtaggtgtgctgcggagcgagaagagccccccgagcagcggggtttggcctatggactttacctgcgcatcgaccttgaaagactacagtgtttaaacgagtcgagggagggcagtggaaggggagtcttcaagccctgggaggaaagaacagacagaagtaaatttgtggaaagtgacgcagacgaagaactcctgtttaacattccttttaccgggaatgtcaaactgaaaggaatcatcattatgggcgaagacgatgatagccatccctccgaaatgaggctatataagaacatcccacagatgagtttcgatgacactgaaagggaacccgatcaaacattcagtctgaacagagatctgactggggagcttgaatatgctacaaaaatttctcgttttagcaacgtatatcatctctccatacacatttctaaaaactttggtgctgatactaccaaggttttctacatcggcctgcggggtgagtggacagaactcaggcggcacgaggtgacaatttgcaactacgaagcgagtgcgaatcccgcagaccacagggtccaccaggtaacaccgcaaactcatttcatttcctag

SEQ ID NO: 31958 - DNA, 297 bp, Artificial Sequence
  Description of Artificial Sequence: Synthetic coding sequence
atgtcatttgacgataccgagcgtgagccagaccagactttttctctcaacagggacctaaccggggagctggaatatgccactaaaattagccggttctcaaatgtttatcacctcagcatccacattagcaagaatttcggagccgatacgacgaaagtattctatattggtttacggggagagtggacggaactacggagacatgaggtaaccatctgcaactacgaggccagcgctaaccccgccgatcatagagtgcaccaggtgacaccccagactcacttcatctcatag

SEQ ID NO: 31959 - DNA, 213 bp, Artificial Sequence
  Description of Artificial Sequence: Synthetic coding sequence
atgggggaagacgacgactcacacccgagcgagatgcgtctgtacaagaacatcccgcaaatgtctttcgacgacactgaaagagaaccagatcagacctttagccttaatcgagacctaaccggtgaactggaatacgccactaaaattagtcgcttctccaatgtctaccatctctccattcatatctctaagaacttcggagcagactag

SEQ ID NO: 31960 - DNA, 903 bp, Artificial Sequence
  Description of Artificial Sequence: Synthetic coding sequence
atggagccaccaatggaacctagcggaggggaacaggagcccggggcagtaagattcctggacttaccgtgggaggacgtccttttacctcatgtcctgaatcgcgtccccttgcgccaactgctccggctgcagcgggttagcagagcctttcgatctctggtccagctccatctggctgggctacggagattcgacgccgctcaggtaggccctcagatcccgcgagcagcgttggcacggcttcttagagacgcggagggtctccaggagctcgctcttgccccctgtcacgagtggttgtccgatgaggacttggttccagtcctagcacggaacccacagctgcggtccgtcgcgctcggcggttgtgggcagttgagcaggagggccctcggagctctggccgaggggtgtccccgactgcaacgcttgtctctggctcactgtgactgggtcgacgggctggcactccgcggcttggcagaccggtgccctgcactggaagagttagatctgacagcttgtcgccagttaaaggacgaagctatcgtctacctggcccagagacggggagctgggctgagaagcttaagcctcgccgtcaacgcaaacgtcggagacgctgccgtacaggaactggctcgcaactgtcccgaactgcaccatttggacctcaccggatgtctcagggtggggtctgatggcgtacgcaccctggccgaatattgccctgttttaagaagtttacgcgtccgacactgtcaccatgtagctgaatccagcctctcacgcctacggaagcggggtgttgatatcgatgtagaaccacctctacaccaggccctagtgttgttacaggacatggcaggcttcgccccgtttgttaatctccaagtgtag

SEQ ID NO: 31961 - DNA, 3093 bp, Artificial Sequence
  Description of Artificial Sequence: Synthetic coding sequence
atgagaaacgtcgcgcttagaagggctgcaggaccagtatgtgcagaggcagcggagaggaggacctgtacgccccagtccgtggccatggaacaatacaagctaggagacaagatacacgggtttacggtgaatcaggtcaccagcgttcccgaactgtttctaaccgccgtgaaactcacacatgacgacaccggagctcgctatcttcatctggccagagaagatactaacaatttgttctctgttcaatttcggaccacaccaatggactccactggagtgccccatattctggagcacactgttttatgtggtagccagaaatatccctgccgggatcctttctttaagatgctcaaccgcagcttatctaccttcatgaacgccttcactgcctctgattataccctctatccgttttccacacagaatccaaaggattttcaaaatttgcttagtgtatacctggatgcaactttctttccttgcctgagagaacttgacttttggcaggagggatggagactcgagcatgagaacccctcagatccacagacgccactcgttttcaaaggagttgtgtttaatgagatgaaaggcgcttttaccgataatgagcgcattttcagccagcacctacagaatagattgctgcccgaccatacctattccgtcgtctccggcggcgatcccttatgcatacctgagttaacctgggaacagcttaaacaatttcatgcaacacattatcacccgtccaatgccaggttctttacttacggcaacttccctctggaacagcacctcaagcagatccatgaggaggcactgtctaaattccagaagatcgaaccgtcaaccgtggtgcccgcacagacaccatgggataaaccacgggaattccaaatcacctgcggtcccgactcgttcgctactgacccaagcaagcagactactatatccgtctcttttctgttgccggatattactgacactttcgaggccttcactctatccctcttatcctccctgctgacaagtggaccaaacagtcctttctataaagcgctgattgagtcgggcctcgggacagacttttctccagacgtagggtataatggttatacgcgtgaagcttacttctccgtggggctccagggcattgctgagaaagacatcgagaccgttcggtcgttaatagataggactatcgacgaggtcgtggagaaaggatttgaggatgatcgtattgaggctctcttgcataaaatcgaaatccaaatgaagcaccagtctacctcctttggccttatgctgacgagctacatcgcatcttgctggaatcacgacggagacccagtggaactcctgaagttgggcaaccagctagccaagtttcggcaatgtctccaggaaaaccccaagttcctccaggaaaaggtgaaacagtacttcaagaacaaccagcataaactgactctatccatgaggcctgatgataaataccatgagaagcaggctcaggtagaagctaccaaactcaaacagaaagtggaagcgctgagcccaggcgatagacagcagatatacgaaaaggggttagaactcagaagccagcaaagtaagccccaggacgccagttgtcttcctgcattgaaggtcagcgatatcgagccgacaatcccagtgacggaactggacgtcgtcctgacagccggggatatcccagtccagtattgtgcccagcccactaatggcatggtctattttcgagcattctcatcattgaacaccctccccgaagagctgaggccttacgttcccctgttttgcagcgtcctgacaaaactgggatgtggtctgttggactatagagagcaggcccagcagattgaactcaagacaggcggaatgagtgcttctccccacgtgttgccagacgacagccatatggacacgtacgagcagggcgtgctcttctccagtttatgtctggatcggaatcttcccgacatgatgcagctatggtcggaaatcttcaataatccctgttttgaggaagaggaacacttcaaggtactcgttaaaatgaccgctcaagaactcgccaatggcatacctgacagcggtcacctctacgcctccatccgcgcggggcggacactaactcctgccggcgacctccaggagaccttcagtgggatggatcaggtgcgactgatgaaaaggattgccgagatgactgatatcaaacctattctgagaaagctgcctcgcatcaagaaacatcttctcaatggtgataatatgcgctgcagcgtgaatgccactcctcagcagatgcctcagacagagaaagccgtcgaggattttctacgctctatcggccgttctaaaaaggaaaggaggccagtgcgcccacacacggtggagaaacctgtcccaagttcgtctggcggcgacgcccatgtaccgcacggatcccaggtgattaggaagctcgtgatggagcctaccttcaagccatggcaaatgaaaacccacttcctgatgccatttcctgttaactatgtcggtgagtgcattcgcactgtcccctacactgaccctgatcacgcttctctcaagatcttggcaaggctgatgactgccaagtttctgcacacagagatccgcgagaagggcggcgcttatggcggtggggccaaacttagccacaacggcatattcacgctgtatagctacagggatcctaacaccattgagaccctgcaaagcttcggcaaagccgtggactgggccaaatcagggaagttcacccagcaagatattgacgaggctaagcttagtgtattctccaccgtagatgcacctgtagcccccagcgacaagggaatggatcacttcctttacggattgtcagatgaaatgaagcaagcacatagggaacagttgttcgccgtgagtcatgacaaattgctggccgtgtccgacaggtacctgggtaccggaaaatcaacgcacgggctggccatcctgggtccagaaaacccaaagatagccaaggatccaagctggataatccagtag

SEQ ID NO: 31962 - DNA, 3117 bp, Artificial Sequence
  Description of Artificial Sequence: Synthetic coding sequence
atgtggaggtgcggtggacggcaagggttatgcgtgctgagaagactgtcgggagggcacgcgcatcatcgagcgtggcggtggaattccaacagggcttgcgaacgcgccctacagtataaactaggagacaagatccacggcttcacggtgaaccaagttacttcagtcccggagttattccttacagcagtcaaactgacccacgacgacaccggcgcacggtacctgcacttagcaagggaggacaccaataacttattctcagttcagttcaggaccaccccaatggatagcaccggggtgcctcacattctcgaacacaccgtactctgcggcagtcagaaatacccgtgccgggaccccttttttaagatgctcaatcgttcactttcaacattcatgaacgcctttacggcctccgactacactttgtacccgttctctacccagaaccccaaggattttcaaaatctgctgtcggtgtatttggatgcaaccttcttcccttgtctccgtgaactcgatttctggcaagaggggtggagactggagcacgaaaatccctcagatccccaaactcctttagttttcaaaggcgtagtgttcaacgagatgaagggggcttttaccgacaatgagagaatcttcagccagcatctgcagaaccgccttctccccgaccacacatacagcgtcgtgagtggcggggacccactgtgcattccagagctgacctgggagcaactaaagcagttccacgcaacccactatcatccttctaatgcaagatttttcacatatggaaactttcctctggaacagcaccttaagcagatacatgaggaggctctgtctaagtttcagaagatcgagcccagcacggtagtacctgcgcagaccccttgggataaaccaagagagttccagataacctgtggtcccgatagcttcgctactgatccttccaaacaaacaacgattagcgtaagttttttgttgcccgatataacggacacttttgaagctttcacccttagtttactgagcagtcttctgactagcggacccaattccccgttttacaaagccctgatcgaaagcggtttgggcactgatttctcaccagacgtgggctataacgggtatacccgagaggcctacttctccgtcggccttcaggggattgcagagaaagacatcgaaaccgtgcggagcctgattgacagaacaattgacgaagtcgtagaaaagggttttgaggacgatcggatcgaagccttactacacaaaattgagatccaaatgaagcaccagtcaactagcttcggactcatgctgacaagttatatcgcttcttgttggaaccacgatggggatcccgtagagttgttgaagctgggaaaccaactcgccaagtttcgacagtgcctgcaagaaaaccccaaatttcttcaggagaaggtgaaacagtatttcaagaataaccaacacaaattaaccctcagtatgagacctgacgacaagtaccacgagaaacaggcacaggtagaagctaccaaacttaagcagaaagtggaggctctgtctccaggtgataggcaacaaatctatgagaaaggcctggagcttcgttctcagcagtctaagccccaggatgctagctgtctaccagctctgaaagtcagcgatattgagcctacaatcccagtgactgagctcgatgttgtactgactgccggcgatattccagtgcaatactgtgcacaacctacaaacggcatggtgtatttcagggccttctctagtcttaatacgctcccagaggagcttagaccctacgttccactcttttgtagtgtactgactaagttagggtgcggcctactggattatcgtgaacaggcccagcaaatcgagctaaaaacaggcggcatgtctgcctccccacatgtgctgccagacgacagccacatggatacatatgaacaagtgggcgtactgttttcgagcttatgtttggacagaaatctcccagacatgatgcagctgtggagtgagatcttcaacaacccctgctttgaagaggaggaacatttcaaagtgctggtcaaaatgactgcgcaggagctggcaaacggaattcctgactccggccatctttatgccagcatcagggccggtagaacattaactcccgccggcgatctccaggagacattcagtggaatggatcaggtgcgtctgatgaagcgcatagctgaaatgacagatatcaagcccatcctcaggaagctgccgcggatcaagaagcacctgcttaatggtgacaatatgagatgttcagtcaacgccaccccccaacagatgccgcagactgagaaggccgtggaagactttctcaggagtataggacgatctaaaaaagaacgtcggccagtccgaccgcataccgtggaaaaaccggtgccttcatctagcggtggcgacgcacatgtgccccatggctctcaggtgatccggaagcttgtgatggagcccaccttcaagccttggcagatgaagactcacttcctcatgccctttccagtgaattatgtcggtgagtgtatccggacggtaccctatactgatcccgatcacgcttctctaaaaatcttggcacggttgatgacagccaaattcctgcatactgaaatcagagaaaagggtggcgcttacgggggcggggcaaaactcagtcacaacggtattttcaccctgtatagctacagggaccctaatacgatcgagactctgcaatcattcggtaaagccgtcgactgggctaaaagcggaaagtttacacaacaggacatcgacgaggcaaaacttagcgtgttttccactgtggatgccccggtagcccccagtgacaaggggatggaccacttcctctatggtttgagcgacgaaatgaagcaggcacatagagagcagttgtttgcagttagccatgacaagctcctggcggtgtccgaccgctatctcggaacaggtaagagtactcacggactggccattctcggacctgagaatcctaaaatcgccaaagacccatcttggatcattcagtag

SEQ ID NO: 31963 - DNA, 1788 bp, Artificial Sequence
  Description of Artificial Sequence: Synthetic coding sequence
atgtggaaatctagtttccagtatattgccagctgctggaatcatgacggagatcccgtagaactcttgaaacttgggaatcaattggccaagttcagacaatgtctccaggagaaccccaagttcttacaagaaaaggtgaagcagtatttcaagaacaatcagcataagctgactctcagcatgaggcccgatgataagtaccacgaaaaacaggctcaggtggaagctacgaagctgaaacagaaagtagaggccctctcacccggtgaccggcagcaaatctatgaaaagggtctagaactcaggtcacaacagtccaagccccaagacgcgagctgtcttcccgccctgaaggtgtccgacatcgagccaaccatcccagtgaccgagcttgacgtcgtactaaccgccggggacatccctgtgcaatactgtgcacagcccaccaatggcatggtgtactttcgggccttctcctctctcaatactctgcctgaagagctgaggccttacgtccctctgttttgttcagtcctcactaagttgggatgtggactgctggattatcgagagcaggctcagcagattgagctcaagaccggcggcatgagcgccagtccccacgtacttcctgatgattcccatatggatacctatgagcaaggcgtgctgttttcaagcctgtgcctcgataggaatctgcctgatatgatgcagctctggtccgaaatattcaacaacccctgttttgaagaagaggagcactttaaagtcttagtcaagatgactgcccaagagttagctaacgggattccagattccgggcacctatatgcttctatacgggccggtagaaccttaacacccgcgggcgacctccaagaaactttctctggcatggaccaggtgaggctcatgaagagaatcgctgagatgacagatattaagcccatactgcgtaagttgccaagaatcaagaagcatctcctgaacggagacaatatgcgttgttcggttaatgcaacaccacagcagatgccgcaaacagaaaaggccgtagaggacttcttgcggagtatcggccgttccaaaaaagaacgtagacctgtcaggccccacaccgtggaaaagccagtgccttcctcctcaggaggcgacgcgcacgtgccacacggctcccaggtgatccgaaagctcgtgatggagccaacatttaaaccctggcagatgaagacccacttcctcatgccattcccagtcaattacgttggtgaatgtattcgcacagtgccctatacggaccctgaccacgccagtttgaaaattctggcccgactgatgacggctaagttcttgcatactgagattcgagagaagggtggagcttacggcggcggcgcaaaactgtcccacaacggtattttcacactgtactcgtatcgggatcctaataccatcgaaacactgcagtcctttgggaaggcagtggactgggcaaagtcagggaaatttacacagcaggacatcgatgaagccaagttgtccgtttttagtaccgtcgacgccccagtggctcctagcgacaaggggatggaccattttctgtacggactgagcgacgagatgaaacaggcccacagggaacagctcttcgccgtgtcccatgacaagctgctagcggtctctgatcgttacctcggcaccggcaagagcacacacgggcttgccatcctgggcccagaaaatcccaagatcgccaaagacccatcctggatcatccagtag

SEQ ID NO: 31964 - DNA, 261 bp, Artificial Sequence
  Description of Artificial Sequence: Synthetic coding sequence
gtcaacgcaaccccacagcagatgccacagactgagaaggccgtggaggattttctgcgaagcatcggaagatccaaaaaggaacgacggcccgtgagacctcatacagtggagaaaccagttccgtcttccagtggcggtgatgcccatgtcccgcatggctcccaggtcattcgtaaactagtcatgtatacgctccggcatcacgttaaaattggcggcttgcatgttagttttaccgtgcgtaactgtgtcgagtag

SEQ ID NO: 31965 - DNA, 702 bp, Artificial Sequence
  Description of Artificial Sequence: Synthetic coding sequence
tgactgatagagtctggcctgggaacggacttctcgcccgatgtgggttataacgggtacacgagagaagcttatttcagtgtgggactgcaaggtatagctgaaaaagatattgaaaccgtaagatctcttatcgaccgtaccatcgacgaagtcgtggagaaaggattcgaggacgaccggattgaggcattgctgcacaaaatcgagatccagatgaaacaccagtccacaagcttcggcctcatgctcacttcatatatcgcctcgtgctggaaccacgacggcgatccagttgaactcctcaaattgggcaatcagctcgccaagttcagacagtgcctccaggaaaatccgaagtttcttcaggagaaggtcaaacagtacttcaagaacaaccagcacaagctcacactctcaatgcggcccgatgacaagtatcacgagaaacaagcgcaggtggaagccacaaaactcaagcagaaagtagaagctctatctcctggcgaccgccaacagatctacgaaaagggactggaattacgcagccagcagtccaagccccaggacgcatcctgtctacctgctctgaaagtttctgacatcgaacctaccattcctgttacagaacttgatgttgtcctaactggccattgcgagaggtacgcattcccaggctctcgggtgccatggggcaattag

SEQ ID NO: 31966 - DNA, 2820 bp, Artificial Sequence
  Description of Artificial Sequence: Synthetic coding sequence
atgaggaatgtcgctctgcgtagggccgctgggcctgtctgtgccgaggccgcagaaaggagggtgactagtgtgcccgaactttttctcacggccgtcaaacttacgcacgacgatacaggggcccggtacttgcacctcgcccgggaggatactaacaatctgttcagtgtccagtttagaacgacacccatggattctactggagtgccacacatactggagcacaccgtgctttgtggatcacagaagtatccatgtagggatcctttcttcaaaatgctaaaccgctcgctgtcaaccttcatgaacgcgttcaccgcctcagactatactttataccccttttcaacacagaatccaaaggacttccagaatctgctcagcgtctacctcgatgctacattctttccttgccttagggaactggacttttggcaggaaggatggcggcttgagcacgagaaccctagtgacccacaaactcccctagtcttcaagggcgtggttttcaatgagatgaaaggtgccttcacggacaatgaacgtattttcagccagcatctccagaacaggctgctccccgaccacacttattctgtcgtgagtggaggtgaccccctgtgtatccccgagctgacctgggaacagttgaagcagtttcatgcaacccattatcatccctcgaacgcgagattcttcacctacgggaattttccgctagagcaacacctcaaacagatacatgaggaagccctgagtaaatttcagaaaatagagcctagcaccgtcgtcccggcccagactccttgggacaagccacgagagttccagattacatgcgggccagacagcttcgccaccgacccgagtaaacaaacgacaatcagcgtttctttcctccttccagacataaccgacacgtttgaagctttcacactgagcctgctttcctctttattgacatcaggcccgaatagccctttttataaagctcttatcgaaagtggtctggggaccgatttttcccccgatgtgggatataatggatacacccgcgaggcttacttctccgtggggctgcaaggaattgccgagaaagatattgagacagttaggtccctcatagataggaccattgacgaagtggtggagaaaggctttgaggacgacaggatcgaagccctgctgcataagattgagattcagatgaagcaccaaagcaccagctttggactgatgttgacatcctatatcgcctcatgctggaaccatgatggcgaccccgttgaacttctcaagctgggcaatcagctggcgaagtttaggcagtgcctccaggagaaccccaagtttttgcaagaaaaagtgaaacagtattttaaaaataatcagcataaactcacgctgtccatgagacccgatgacaaataccatgagaagcaggctcaagtggaggccaccaaattaaagcagaaagttgaagccctgtccccaggcgatcgccagcagatctatgagaagggcctcgagctccgatctcagcagtcgaagccacaggacgcttcctgtctgcccgcgttaaaagtgtccgatatcgagccgacgattcctgtgaccgaactagacgttgttctaactgctggggacattccggtgcagtattgcgcccagccgacaaatggtatggtgtactttcgagccttcagttcactgaatactttacccgaggagctacgtccgtatgtgcctctcttctgtagcgtcctgacgaacccctgcttcgaggaggaggagcactttaaggttctcgtcaagatgacggctcaggaactggctaatggtatcccggatagtggccatctgtatgcgtctatcagggcaggaaggacgctgactccggccggcgatctacaggagacattctctggtatggaccaagtgaggcttatgaaaagaatcgcagagatgacagacattaaacccattctccggaagctgcctcggatcaagaaacacctgctgaatggcgacaacatgaggtgctccgtgaacgcaacaccccaacagatgcctcagacagagaaggcagtggaagacttcctgcggagtataggtcgatctaagaaggagcgaagaccagtccgacctcacactgtggaaaagcccgttccaagcagttcaggtggtgatgctcatgtgcctcacggctcccaggtcattaggaaacttgtaatggaacctaccttcaagccttggcaaatgaagacccatttcctgatgcccttccctgtgaattatgtcggcgagtgtattcggacggtcccctatacagatccagatcatgcaagcttgaaaatccttgcccgcctgatgacagctaagttcttgcacactgagatcagagaaaaaggaggggcctacggtggcggggcaaagcttagtcacaatggaatatttaccctctattcatatagggacccaaacactatcgagacactgcaatcattcggtaaagcggtggattgggcgaaatctggcaagttcactcagcaggatattgatgaggctaagttgagcgtgttcagtactgttgacgcacctgtggccccttcggataaagggatggaccattttctctacggtttatctgatgaaatgaagcaagcgcaccgggaacagttgtttgccgtctcacacgataagctgctagccgtctccgaccgctacctgggaaccgggaaatcaacgcatggactggctatcctgggcccagaaaaccccaagatagccaaggacccgagctggattattcaatag

SEQ ID NO: 31967 - DNA, 780 bp, Artificial Sequence
  Description of Artificial Sequence: Synthetic coding sequence
tgattttcatccctctgcttggacagaaatcttcccgacatgatgcaactctggtccgagatcttcaataacccttgttttgaagaggaggaacacttcaaggtgctggtgaagatgactgcccaagaactggcaaatgggataccagactccggacacctgtatgcctctatcagagcaggtagaacactgactcctgccggagacctgcaggagaccttttcgggtatggatcaggtccgcctgatgaaacgaatcgccgagatgacggatattaagccgatccttcgcaagcttccgcggatcaagaagcatctgttaaacggagacaatatgagatgttccgtaaatgccacaccgcagcagatgccccaaaccgagaaggctgttgaggattttctgcggtcaattggccgctccaaaaaagagcgtcggcctgttcgccctcacactgttgaaaaaccagtgccttcgtcttcaggaggcgacgcacatgttccccacggctcacaggtgattagaaagctagttatggaacccaccttcaaaccgtggcagatgaagacacattttcttatgccctttcccgtaaactacgtgggtgaatgtatcaggaccgtgccatacaccgatcccgaccacgctcggaagagacccgtgtgcggttctggcgatctcggtctcataagccccagggcttcgagtagaagcctctgcttgtgctgccgacctagtcatcactgcctccctcggctactctccgaggttgatgtcttttag

SEQ ID NO: 31968 - DNA, 555 bp, Artificial Sequence
  Description of Artificial Sequence: Synthetic coding sequence
aagcccgtgccgagttctagcggcggggatgcacacgtgcctcacggttctcaagttataagaaaacttgtcatggagccaacatttaagccttggcagatgaaaacccatttccttatgccctttcccgtgaactacgtgggagaatgtatcagaacagttccctacacggatcccgaccacgcttccctcaaaatccttgcacggcttatgacagcaaagttcctgcatacagagatccgggagaagggaggtgcgtacggtggcggggctaagctgtcacacaatgggatttttactctttattcttaccgcgatcccaacacaattgagactttgcagtcctttgggaaagcagtggactgggctaaaagcggtaagtttacccaacaagacatagatgaggcaaagctctccgtgttctcaaccgtggatgccccagttgcaccctctgacaagggaattctgagcattacagtgagaatctcaacccacagtctcacagatgatgtcgccgtctttcaggtgccaggaatgcacgggcaagaacattag

SEQ ID NO: 31969 - DNA, 534 bp, Artificial Sequence
  Description of Artificial Sequence: Synthetic coding sequence
atgaattggtttgggtcaaactttttccgctgccccgaggacttatcccttctgaacatatatagccctctgttaagccatatgtcgtccgaagacgaacattttatctccaacctgcgtggccacgtccccgcttctgctgtggtgaagcagcccgtgcgcggtgccagtggcagaacaactataactgccattgttcagacaggaggtggctggagtacgggtctcttttccgtgtgtcgagatcggcgcatctgcttctgtggcttgttttgccccatgtgtttagaatgcgatatagcgagacactacggagagtgcctgtgctggcccctcctgcccgggtcaacgttcgccctgcggattggtaccagagagagacacaagatacagggtactttatgcgaggattggttggcagtccactgctgctgggcgttcagtatttgccaggtggctagggaactgaaaatgagaacatctcaggtgtacgagatttgcgccgtgcccatgacgaaggacactttggtatag

SEQ ID NO: 31970 - DNA, 348 bp, Artificial Sequence
  Description of Artificial Sequence: Synthetic coding sequence
atgcaagcccaagcccccgttgtggtcgttacccagcctggcgtggggccaggacccgctcctcaaaactccaattggcaaacagggatgtgtgactgtttttcagattgcggggtgtgcctgtgcggaaccttctgtttcccatgcctaggatgccaagtagctgccgatatgaatgagtgctgtttatgcgggacttcagtcgctatgagaaccttgtatagaacgagatatgggattccaggatcaatttgcgacgattatatggctacactgtgctgtccacattgcactctgtgccagattaagagagacatcaatcggaggagggcaatgcgcaccttttag

SEQ ID NO: 31971 - DNA, 348 bp, Artificial Sequence
  Description of Artificial Sequence: Synthetic coding sequence
atgcaggcgcaggccccggtggtcgtggtgacccaacccggtgtcggccccggtccagctccccagaacagcaattggcagactggaatgtgcgactgttttagcgattgtggtgtatgcctgtgcggcactttctgttttccctgcttgggctgtcaagttgcagccgatatgaacgagtgttgtctgtgcggtacatccgttgcaatgagaacactataccgcacacggtacggaatcccaggatccatttgcgacgattacatggccacactgtgctgtcctcactgcaccctctgccaaatcaaaagggacattaacagaagacgcgcaatgagaactttttag

SEQ ID NO: 31972 - DNA, 348 bp, Artificial Sequence
  Description of Artificial Sequence: Synthetic coding sequence
atgcaagctcaagcgccagtcgttgtggtgactcaaccgggggtcggacccgggccagcccctcagaactctaattggcagactggcatgtgtgactgtttctccgactgcggcgtgtgcctttgtggcacgttttgcttcccatgtttgggttgccaggtggcagcagatatgaacgagtgctgcctctgtggtacaagtgtggcaatgcggacactttacagaacccggtatgggatacctggttctatctgtgacgattatatggccactctttgctgtcctcattgtaccctgtgccaaatcaagcgcgatatcaaccgaagacgtgccatgcgcactttttag

SEQ ID NO: 31973 - DNA, 348 bp, Artificial Sequence
  Description of Artificial Sequence: Synthetic coding sequence
atgcaggctcaggcaccagttgtcgtagttacacagcctggcgtgggccctgggcccgctcctcagaactctaactggcagacaggaatgtgcgattgtttttcagattgtggtgtgtgtctatgcggaacgttttgtttcccgtgcctcgggtgccaggtcgcggctgacatgaatgaatgctgcctctgcggcacctctgttgccatgaggactttgtatcgcaccaggtacggcatccctggcagtatttgtgatgactatatggctaccctgtgttgtccccactgcaccctatgccagattaaacgggatattaaccggaggagagcgatgagaactttttag

SEQ ID NO: 31974 - DNA, 1893 bp, Artificial Sequence
  Description of Artificial Sequence: Synthetic coding sequence
atggatgaaatggctacgacacagatctccaaggacgagttggacgagcttaaggaagcctttgccaaggtcgacctgaattctaatggcttcatctgtgattacgagctgcacgagctgtttaaggaagcaaatatgccactccctggatataaagtgcgggaaatcatacagaagctcatgctggacggagatcgcaataaagacggcaagattagctttgacgaattcgtctatattttccaggaagttaaatctagcgatatagccaagacattccgcaaggcaattaatagaaaggagggaatttgcgcattagggggaacatccgaactgtcctccgagggcacacaacattcttattccgaagaggagaagtatgccttcgtcaattggataaacaaggctctggaaaacgaccccgactgtcgtcacgtgattcccatgaaccctaatacagacgacctgtttaaggccgtaggagacggaatagtgctttgcaagatgatcaatctgtccgtgccggatacaatcgatgaaagagccattaataaaaagaagcttacaccatttatcatccaggagaatcttaacctggcattgaatagcgcctccgccattggttgtcacgtggtaaacatcggggctgaggacttacgcgccggcaagcctcacctcgtgcttgggctgctctggcagatcataaagatcggcctattcgccgacattgagttgtcaaggaacgaggcgttagcagctttgttaagagatggcgaaacacttgaggaattgatgaagcttagccctgaagagctcctccttaggtgggcaaattttcacctggagaatagtggatggcagaaaatcaataacttttccgctgacatcaaggacagcaaggcttacttccatctactgaaccagattgctcctaagggtcagaaggaaggcgagccacggattgatattaatatgtcagggttcaacgagacagacgacttgaagcgagcagagagtatgctgcaacaagcagacaagctgggctgtaggcaatttgtaacgccagcggacgtggtttctggaaatcctaaactgaatcttgcattcgtagctaatctgttcaataagtacccagctctcaccaaaccagaaaatcaagatattgattggaccctactcgaaggggagactagagaagagcggacctttagaaactggatgaatagcctgggagtcaacccacatgtgaaccatctatacgctgatctgcaagatgccctggtcattctacaactgtatgagcgcattaaagtgcccgtcgattggtctaaggtcaacaagcctccatacccgaaacttggcgctaacatgaaaaagctagaaaattgtaactacgcggtggaacttggaaagcatcctgctaagttttccctggtaggcattgggggacaagacctcaatgatgggaaccagactctgaccctcgctcttgtatggcagttgatgaggaggtacactctgaacgttcttgaagatctgggtgacggacagaaagcgaatgatgatatcatcgtgaattgggtgaacagaactctgagcgaagctgggaaatcaaccagtatacagtcctttaaggacaaaaccattagctcctccctcgccgtggtggaccttatcgatgctatccagccaggatgcataaattacgacctcgttaagtcaggtaacctgactgaggatgacaaacataacaatgctaagtacgccgtttcaatggccaggagaatcggcgcgagagtctacgccctgcctgaagatctggttgaggtaaagcctaagatggtaatgacagtgttcgcgtgcctgatggggcgagggatgaagcgggtgtag

SEQ ID NO: 31975 - DNA, 3849 bp, Artificial Sequence
  Description of Artificial Sequence: Synthetic coding sequence
atggcagccgacctgaatctggagtggattagcctgccccgcagctggacatacggcattacgagaggtggcagggtgttcttcataaacgaagaggccaaaagcacaacatggctgcatccagtcaccggggaagccgtggtcacgggacaccgaagacagagtacagatctccccaccgggtgggaagaggcatacacctttgaaggggctcggtattatatcaatcacaacgagcgtaaggtgacctgtaaacacccagtcacaggacagccgagtcaggacaattgcatctttgtggttaacgagcagaccgttgcgacaatgacttcagaagagaaaaaagagcgcccaatttccatgattaacgaagcatctaactacaatgtgacctccgattacgcggttcacccaatgtctcccgttgggaggacgagccgtgctagcaagaaagttcataattttggaaagcgctctaatagcatcaagcgcaaccccaatgcaccagtggtccggcggggctggctctacaagcaggactccacaggaatgaagctctggaaaaagcggtggttcgttctgagcgatctttgtctgttctattatcgggatgagaaggaagaaggtattctgggatccatcctgcttcccagtttccagatagcactgcttacttcagaagaccacatcaaccgcaaatacgcatttaaagctgcccacccgaatatgaggacctattatttttgtactgatacaggcaaggaaatggagctctggatgaaggccatgctggacgcagctctggtgcagacagaaccggtgaaacgcatcaccttcaactttagggtggacaagatcaccagcgagaatgctcccactaaagagacgaacaacatccctaatcaccgggtgctgatcaaaccggagatccaaaataaccagaaaaataaggagatgtccaaaatcgaggagaagaaagcccttgaggcagagaagtacggattccagaaggacggccaagacaggcctctcactaaaattaacagcgtgaagctgaacagtctgccttctgagtacgagtctggttccgcatgccctgcccagactgtgcactatagaccaatcaaccttagcagcagcgaaaacaagatcgtgaatgtgagcttggccgacctgcgtggcggaaacagacctaataccggcccactctacacagaggctgatcgtgtgatccaacggacaaacagtatgcaacagctggaacaatggatcaaaatccagaagggacggggccacgaagaggaaacaaggggggtgatctcctatcaaacattgcctcgcaacatgccatctcaccgcgctcaaatcatggcacggtatcccgaggggtacagaacattgcctcgcaacagcaaaacaagacctgagtctatctgttccgtgacacccagtacacacgataaaacactggggcctggcgccgaagaaaaacggcgcagcatgcgggatgacacgatgtggcagctgtatgagtggcagcaacgtcagttctataacaagcaatctaccttgccccgccacagtacgctcagtagcccgaaaaccatggtgaatataagcgatcaaacaatgcactcgatccccaccagccccagccacggatcaattgccgcataccaagggtacagcccccagcgcacctacaggtccgaggtgagcagtcctattcagaggggcgacgtcacaatagacagacgtcatcgcgctcatcaccctaaacacgtctacgtacctgacaggagaagtgtcccagccggtcttacactccagagcgtgtcacctcagagcctgcagggaaaaacccctgaggaactgaccctcctgctgattaagctgcggcgtcagcaagcagaactttcaagtatcagggagcataccctggcacaattaatgcagcttaaacttgaagcccacagccctaagaatgaaattctttcacatcatttgcagaggaatacaatttatctcgatcaccagatgaaggagaacgagccaataatcaccatggtgcacaccatgatagaaaatagcgctcttcgtcctcaactttatcagcagttcttgagacagaagagtaagataagcctctactgcctgagccaggatgaagggaggggaactctgtacaaatatcggccagaggaagtcgacatcgatgccaaattgtcacgtttgtgcgagcaggataaagtggtgcacgcgcttgaggaaaagctgcagcaactgcacaaagagaagtacacactggagcaggctcttcttagtgcgtcccaggagattgaaatgcacgccgataacccagccgcgattcagaccgtggtgctccagcgagatgatctgcagaacggcctgctcagtacttgtcgcgaactctcccgggccaccgctgaacttgagagagcatggagggaatacgacaagctggagtacgacgtgactgtcactcgcaaccagatgcaagagcagctagaccaccttggagaggtgcagactgaatccgctggcatccagagggcgcagatccagaaagaactgtggaggatacaggacgtgatggaggggctcagcaagcacaagcaacaacgcgggacaacagaaatcggcatgattgggtcaaagccattttctactgtcaaatataagaacgaagaggaggaggttgtccctcccagacctcctctgccccgatcatacgactttaccgagcaaccaccaataatcccacctctgccatctgacagcagtagtttgctttgctatagtaggggcccggtacacttgccagaagagaaaaagatgtatcaggtccagggttacccaaggaacggttctcactgcggacccgattaccgactctacaagagtgaaccggaactgacaacagtagcagaggtggacgagtctaatggggaggagaaatccgaacccgtttcagagatcgagaccagcgttgttaaagggtcacactttccggtgggagtggtccctcccagggccaagagtcctacacctgaatcatccaccatcgcttcctatgttacacttcgcaagaccaagaaaatgatggatcttcggacagagagaccgcgttcggcggtggagcagctttgcctggctgagtctaccaggccacggatgacagtcgaagagcagatggagcgtatccgtcgccaccagcaggcgtgcctgcgggagaagaaaaagggtctgaacgtgatcggcgcgtccgaccaaagtcctctgcagtccccttcgaatctgcgggataacccttttcggaccacccagacacgccgccgcgatgataaagagctagacaccgcaatacgtgaaaacgacgtcaagcccgaccacgagacgccggctacagagatagttcaattgaaggagacagaaccgcagaacgttgatttctctaaggaattaaaaaagacggagaatatcagctatgaaatgttgttcgagcccgagccaaacggggttaattctgtggagatgatggataaggagcggaacaaggacaaaatgccagaggatgtgacattctccccacaggatgagacacagactgccaaccacaagccggaggagcatcctgaggagaacaccaaaaactcagttgacgaacaagaggaaaccgtgattagctacgaatcgaccccagaggtcagtcgtgggaatcagactatggctgtgaaatctttgtccccctcccccgagagtagtgcctcccctgtaccatctacacaaccacagctgaccgaaggctctcattttatgtgcgtgtag

SEQ ID NO: 31976 - DNA, 231 bp, Artificial Sequence
  Description of Artificial Sequence: Synthetic coding sequence
atggccgccgacttaaaccttgagtggatttcattgccacgcagctggacatacggaataacaagaggcggacgcgtattcttcataaatgaggaagccaagagtactacctggctccacccagtcacaggggaagctgtggtgactggccaccggaggcagagcaccgatctaccaacaggatgggaggaggcgtacacattcgagggcgctaggtactatatcaattag

SEQ ID NO: 31977 - DNA, 2382 bp, Artificial Sequence
  Description of Artificial Sequence: Synthetic coding sequence
atgcctttaccaggtgggttgtggtggcttctatgttgccgtcggggttttacattattgcaccgggactatggtgacggggagctcagtggagacggagacgaggatgaagacgaagagacattcgaattaaggaccccctctcccgcgggaggcggcagaggccccctagaagtgaccttaacacagcccgtccgatctgggccggtgagtaatcgcctgcagtcttgggaagaaacatggagcctgatccccgaaaaaggcctgccagaggacgatcctgatatcgtggtgaaaggatggctgtaccgtgaacctcgcggaggcggcgcccgtccctggctacccccacgccgcgcatggttcgtgcttacccgggattctctggatcagtttagctcgagtggcaaaggagctcgacgcctggggtccctcgttctcacgtccctgtgctcagtaaccggacctgagcgacgccgtaaggagacaggactgtggtcagtcacagtgtcagggaggaaacactctgtcaggctttgctcaccacggcaagcagaagccgaacggtggggcgtggccctcagggaggttatagcgtccaaagctccgctcgagacaccgacacagttgctactccgggacattcaggaatcatgcggcgatcccgaggcagtggcgctgatctacttgaggaaccccatcttgaggcacacaagtggggcgctgtacgctccattactccctctgccttatggggttagtgctccaggcccgggatacgccccacttcgtgaagaagctgtaagactattcctggctcttcaggcattagagggcgccagacgacccggcccactaatgcagggtgttctccagacttgccgggatctgcccgctctccgggatgaactgttccttcaattggcaaagcagacaagtgggccggcaggtccaccagggctgcctgctacacaagacccagccgctctccgttactggcagcttctgacatgcatgtcgtgtaccttccggccgggaggggccgttaggggccatctgcttggacacctcgagagaactgagcaagcattgccagactccgaactggccgaatacgctcgttttattcgtaaggcgcttggaaggacacgcggaagagaactggtccctagcctagccgagatctccgctctttcacagaggcaggaattgttatgcactgtgcactgtcctggggcaggggcttgcgctgtggccattgacagccacacaactgccggggaggtggcgagagagctggtgggccgtcttggtctagcacggtccaggaacgccttcgcactgtatgaacagcgtggggcccaggagcgcgcccttgctgggggaacactcgtggcagatgtgctcactcgctttgagaacctagccgccgaggaggcgggacttgaagatagccccgattccggatggagactgtgtctccgcttacatggcccccttcaccccgaaggtttgtcacctgacggacacgagttacctttcctcttcgagcaggcacacgcgttgctactccgcggtagaccgcctcctcctgacgatacgctgcgcgccctggctgctctgagactgcaatccctccagagagatttttctcctagggtccccctgccgaggcttgataggcttctccccccccctgcccccccccgggaagatcctccaaggccaaccccaagaccgccgccaagtgccgctctgctcgctggagctctctggagtccaggactggccaaaagaagagccgagagagccagacgcgggggagctgggcgcaccgctggcagcatcgctagggaggggggaggtggcgccggaactgcggctgccgtgctggggggatggaagcggttgaggggaatgggccgagccgaggctatggcggcgtatctggcacttgccgcccagtgcccaggattcggagccgctcgctacgatgtgctggagctctctactgagccgggacggggcgcaccacagaaactctgcttggggctcggagccaaagcaatgtcgctttcaagacccggagaaaccgaacctattcactctgtaagttatgggcacgtggcggcctgtcaactgatgggcccccacacactggctctgcgggttggtgagagccagctgctcctgcagagtccacaggtcgaagaaatcatgcagctcgtgaacgcctacttagctaacccttcacctgaaaggccatgcagcagttccagcccaccttgtcaggacttgcccgacacctccccccccagtcagcgacctggcctggatgaaccccaaggacaaagtggctgtctcgggcagctccaagactag

SEQ ID NO: 31978 - DNA, 450 bp, Artificial Sequence
  Description of Artificial Sequence: Synthetic coding sequence
atgcgttataacgagaaggagctgcaagccctttctcgacaaccagcagagatggctgccgagctgggaatgagaggaccaaaaaaaggatccgttctcaagagaagacttgtgaaactggttgttaattttttgttttatttcaggaccgacgaggccgagcccgttggggccctgctcttggagagatgtagagtggttcgtgaggagcctggaactttttctatctcgttcattgaggaccccgagagaaagtaccacttcgaatgcagcagcgaggagcagtgtcaggaatggatggaggcactcagaagagcatcatatgagtttatgcgacggagtctgattttttaccggaacgaaattcggaaggtgaccggcaaggaccccctcgaacagtttggaatcagtgaggaggcccgcttccaactgagcggcctccaggcttag

SEQ ID NO: 31979 - DNA, 3351 bp, Artificial Sequence
  Description of Artificial Sequence: Synthetic coding sequence
atggccgcagatttgaacttggagtggatcagtctgccacggtcctggacttacgggatcactaggggcgggcgggtatttttcattaatgaagaagctaaatctaccacttggctgcatccagtgaccggggaggccgtggtgaccgggcataggcgacagtccacggacctgcccactggctgggaggaagcgtatacctttgaaggagcccgatattacattaatcataacgagagaaaagtaacgtgtaagcaccccgtcaccgggcagccgtcccaggacaattgcatcttcgtagttaatgagcagaccgttgcgacaatgacatccgaagaaaagaaggaacgtccaatctcgatgattaacgaggccagtaactataacgtgacaagcgactatgccgtgcaccccatgtctccagttggacggacctctcgtgcatcaaagaaggtacacaatttcggaaaacgctctaatagtattaagaggaacccaaatgcgcccgtggtgcgcagaggttggttgtataagcaagattccaccggcatgaagctctggaaaaaacgctggttcgtgctcagtgatctgtgcctgttctactacagagatgaaaaggaagagggcattctgggctcaatacttctgcctagcttccagatcgccctgctgactagcgaggaccatatcaatcgcaaatacgcatttaaggcagcccatccaaacatgcgcacatactacttttgcacagacacaggaaaagaaatggaattgtggatgaaggccatgctcgatgccgccttagtccaaaccgagcctgttaagcgggttgacaaaatcaccagtgagaatgcccccacaaaagaaacaaataacatcccgaaccaccgcgtcctaatcaagccagagatccagaataatcaaaaaaacaaagaaatgagtaagatcgaggaaaagaaagccctggaagccgagaagtacgggttccaaaaggacggccaggaccggcccctgacaaagatcaatagcgtgaagttaaattccttgccctctgagtacgagtctggcagcgcttgccccgcccagacagttcactatcggccaatcaacttatcttcatctgaaaataagatcgtgaacgtgtctttagctgatttgaggggtgggaaccggccaaacaccggacccctttacactgaagccgatcgtgtgattcagaggaccaacagcatgcagcagctggaacagtggattaagatccagaaagggcgcggacatgaggaagagacgcgtggggtgatttcctaccagacgctcccacgcaatatgcccagtcaccgtgcacagattatggccaggtaccccgagggataccgtaccttgccccggaatagtaagactaggcccgaatccatttgttccgtcactccatcaacacacgacaaaacccttggacctggagctgaggagaagcgaaggagcatgagagatgataccatgtggcagctttatgaatggcagcagcggcaattctataacaaacagagtaccttgcctagacatagcacgctgagttctccaaaaaccatggttaacatcagcgatcaaaccatgcactcaataccgacatccccctcacatggtagcatcgccgcataccagggctattcccctcaacgcacctatcggtccgaggtgagttcacccatccaacgtggagacgtgacaattgaccgccgacatcgggctcaccaccctaagcatgtgtacgtgcccgacaggcgatctgtgcctgcgggcttgacacttcaaagcgtgtccccccaatctctccagggaaagaccctctcacaggatgagggccggggcactttatataaatatagacctgaggaggttgacatcgatgcaaagctgtcacggctctgcgaacaggacaaggtggtgcatgcactcgaggagaaacttcagcagttacacaaggagaagtataccctggaacaggcgttgttaagtgccagccaagagatcgagatgcatgcggataatccggcagccatccagaccgtggtgctccagcgagatgatcttcagaacggactgctaagtacttgcagggagttgagcagagcaaccgctgagcttgagcgcgcgtggcgggagtatgacaagctcgaatacgacgtcaccgtcacacggaatcagatgcaggaacaattggatcacctgggcgaggtgcagactgaatctgccggcattcaaagggcacagattcaaaaagagttgtggaggatccaagacgtcatggaaggcctgtccaaacacaagcagcagaggggaacaactgaaatagggatgatcgggagcaagccgttcagcacagtcaagtacaaaaacgaaggcccagactacagattgtacaaaagcgaacccgagctcaccaccgtggccgaagttgatgagtctaatggcgaggagaagagcgagcctgtgtccgaaattgaaacctcagtggtcaaggggtcacacttccctgtaggggtggtacctccccgggccaaatctcccactcccgaatcaagcaccatcgccagctacgtgactctgagaaagactaaaaaaatgatggacctaaggacagagagacctagaagcgctgtcgagcagttatgcctcgcagaatccacccgacccaggatgacagtggaggaacaaatggagcgtattcggcgtcaccagcaggcttgtctccgagaaaagaagaaaggcctaaatgtcattggagccagtgatcagtcgcccctacagagtccctccaatctgcgcgacaacccgtttagaaccacccagacccgccgaagggacgacaaggagctggacactgccatcagggaaaacgatgtcaagccggatcatgaaactcctgccaccgagatcgtgcagcttaaggagaccgagccgcagaacgttgattttagcaaagagttgaagaagaccgaaaatataagctacgaaatgctattcgagccagagcccaacggcgtcaatagcgtggagatgatggacaaagaacggaacaaggacaagatgccagaggatgtgaccttttctccccaggatgagacccagactgcaaatcacaagcccgaagaacacccagaggaaaacacgaaaaatagcgttgacgaacaggaggaaaccgtgatctcttatgagtccactccagaggtatcacggggcaatcagacaatggctgtgaaatcactgtcgccttccccagagagctctgcttcgccagtgccatcgacccagccgcagctcaccgaagggagtcattttatgtgtgtgtag

SEQ ID NO: 31980 - DNA, 1953 bp, Artificial Sequence
  Description of Artificial Sequence: Synthetic coding sequence
atggctgccgaccttaatcttgaatggatctccctgcccaggagttggacatatggaatcactaggggaggccgggtttttttcatcaatgaggaggcgaagagcacaacctggctccaccccgtgaccggggaagctgtggtgacaggtcaccgaagacaatctacagacctcccaactggttgggaagaagcttacacgttcgaaggcgcaaggtattacatcaaccacaatgagagaaaagtgacatgtaagcatcctgtgacaggacagccatcacaggacaactgtattttcgttgtgaatgagcaaacagtggccactatgacatcagaggagaagaaggagagaccaatatcaatgattaacgaggcttctaattataatgttacctctgactatgccgttcaccccatgagccccgtgggaagaacaagtagggcctccaagaaagtccataatttcggtaagagaagcaactcaattaagagaaatcctaacgcgcctgtcgtgagacggggatggctgtacaagcaggacagtaccgggatgaagttgtggaagaagaggtggttcgtgctaagcgacttgtgcctgttctattaccgggacgagaaggaagagggaatcctcggctcaatactgcttccgtcttttcagatagctctcttgactagtgaggaccatattaatcgcaaatatgcttttaaagctgcacaccccaatatgaggacatactacttttgtacagacaccgggaaagagatggaactgtggatgaaggctatgctcgacgcagcacttgtccagacagagccagtgaaacgggtggacaagattacctcggagaatgcacctaccaaagagactaataatattccaaatcatcgggtgctgatcaagcccgaaattcagaacaaccagaagaataaggagatgtccaaaattgaggaaaagaaggctttagaggcagagaagtatggtttccagaaggatggtcaggatcggccgctaacaaaaattaattctgtcaaactcaatagcttaccctccgagtacgagagcggcagtgcctgccctgcgcaaacggtacattatcggcctattaacctgagcagcagcgagaacaaaatagttaacgtcagtttagccgatctgcgcggaggcaacagaccgaatactggaccgctttataccgaagcagacagagtgatacagcgcaccaattcaatgcaacaactggagcagtggatcaaaatccagaagggccgcggccatgaggaggaaaccaggggtgtgattagttatcagacattacctaggaacatgccttcccaccgggcacagattatggcccggtaccctgaaggctataggacactaccccgcaatagcaagactagacccgaatctatctgtagtgtgacgccctccacccatgacaagacgctagggcctggagcggaagagaagcgaaggtcgatgcgggatgacacaatgtggcagttatatgagtggcagcagcgacagttctataataagcagagcaccctaccccggcatagcaccctttcatcccccaagactatggttaatatctccgatcaaactatgcactccattcccacctctccttcacacggctcgatagccgcatatcagggctactcacctcagagaacatacaggtcagaagtaagctccccaatccagcgaggagatgtgaccattgatcggaggcaccgggctcatcacccgaaacacgtctacgtcccagataggagaagcgtacctgcaggactgacactccagtcagtttcacctcagagtttacaggggaagacatggggccgcgagaaggtggccacagccacaggcgcagcagaggctgtggccagcgatacccacctgccaagaacgggcagtagttcacccagcttactgtgcgtgtag

SEQ ID NO: 31981 - DNA, 3540 bp, Artificial Sequence
  Description of Artificial Sequence: Synthetic coding sequence
atggctgcggacttaaacctggaatggatctcactgccccgcagctggacatacgggatcacccggggggggcgagttttcttcattaatgaggaagccaagtcaaccacctggttgcaccccgtaacaggggaagccgtggtgacagggcataggaggcaatccactgaccttccaacagggtgggaagaggcttatacatttgagggcgcaaggtactacattaaccacaatgagcgaaaggtgacttgtaagcaccctgtcaccgggcagcctagccaggataattgtatctttgtggtcaacgaacagaccgtggcaaccatgaccagcgaggagaagaaagaaagacccatctcaatgatcaatgaagcctcaaattataacgtgacctcggactacgctgtacacccgatgtccccagtggggagaacttctagagctagcaagaaggtgcacaatttcgggaaacggtccaattccatcaaacgtaacccaaatgctccagtggttcgtcgaggttggctttacaagcaggattctaccgggatgaaattgtggaagaaaagatggtttgtgctaagcgacctgtgtctattctattaccgggatgaaaaggaggagggcatcttagggtctattctgctgccctcctttcagattgcgctgttgacctccgaagaccacatcaatagaaagtatgcttttaaagcagcacaccccaacatgcgtacctactacttctgcaccgacaccggcaaggagatggaactgtggatgaaagctatgctagacgcagctctagtgcaaaccgaaccagtaaaaagagtcgataagataacatcggagaacgccccgacgaaggagaccaataacattcctaatcaccgcgttctgatcaaacctgagatccaaaacaatcagaagaataaggaaatgtctaagatagaggagaagaaagcactcgaggccgaaaaatacggatttcagaaagacggccaggaccgccccttgacaaaaatcaattctgtcaagctcaactcccttccaagtgaatatgaatccggcagcgcttgtcctgcccagaccgttcactatcggcccatcaatttgagtagctctgaaaataaaattgtgaacgtcagccttgccgacctgaggggcggaaaccggccgaatactggtcccctctatacggaggctgaccgcgtaatccagcgaacaaattccatgcagcagctggagcagtggataaagatccagaaagggaggggtcacgaagaggagacacggggtgtgatttcctatcagaccttaccacgaaacatgccgtcccatagggcacagattatggcccggtatccagagggctatcggacactaccacgtaatagcaaaacaaggcccgagagcatatgctcggtgactccatcaactcatgacaaaaccttggggcccggggcagaggagaagaggcggtctatgagggacgatactatgtggcaactgtatgaatggcaacagcgccagttctacaataagcagtcgactctgccaagacacagcacactaagctctcccaaaactatggttaatatcagcgaccagaccatgcattccatcccgacctctccctcgcacggctctattgcagcgtatcaaggttacagcccccagaggacctatcgctcagaggtttcaagcccaatccaacggggggatgttaccatagaccgccgacaccgtgcccatcaccccaagcacgtctacgtgccagaccggaggtccgttcctgcgggcttaacgcttcaaagcgttagcccgcagtctctacagggcaagacactgtcacaggacgagggtagaggtaccctgtataaatacaggcctgaagaagttgacattgacgccaaactgtcacggctatgtgagcaggataaggtggtgcatgccttagaagaaaaactccagcagttacacaaggaaaagtataccctggaacaggccttactcagtgccagtcaggagattgagatgcatgctgacaacccggccgctatccagacggtggtgctgcaacgggacgacctgcagaatggactgctctccacatgccgggaactgagccgcgctacggcagagctggaacgtgcttggagagaatatgataagttggaatatgacgttaccgttactcgcaaccagatgcaagaacagctggatcaccttggggaggtgcaaaccgagtcagccgggatccagcgcgcccaaatccagaaggagctgtggcggatccaagacgtgatggaaggattgtcaaaacacaagcagcagcggggtaccacagaaatcggcatgattgggtccaagcccttttctaccgtcaagtacaaaaacgaagaggaggaggttgtgcctccacgaccaccgctccctcgctcatatgatttcacagagcagccgccaatcattccacctctcccctcagattcaagctcattgctgtgttatagccgcggtccagtgcatcttccagaagagaaaaagatgtatcaggtgcagggctacccacgcaacggttcccactgcggacctgattaccgactgtacaagagcgagcccgagctcactactgtggccgaggtggacgagagtaatggcgaggagaaaagcgaacccgttagtgagatcgagaccagtgtggtaaagggatcccattttccggtgggtgtggtgccaccccgggctaagtcccccacccctgagtcatctaccattgccagctatgttaccctaaggaagacgaagaaaatgatggatttgagaaccgaacggccccgttccgccgttgaacaactgtgccttgccgagagtactcggccccggatgacggtggaggagcagatggaaaggatcagacggcatcagcaggcttgtctgcgggagaagaagaaaggattaaacgtgatcggggcctccgatcagagccctctccagtcaccttccaatctccgagacaatccattcagaacaacccaaactcggcgacgcgacgataaggagctggatactgcaatcagggaaaacgacgtgaagcccgaccatgaaacccccgccacagagatcgttcaattaaaagaaactgagccccagaatgtcgacttttcaaaagaattaaagaagaccgagaacatcagttatgaaatgcttttcgagcccgaacctaatggggtgaatagcgtcgaaatgatggacaaagagcgaaataaggacaaaatgccagaggatgtcacctttagcccccaggacgaaacccagacagctaaccataagccagaagaacacccagaggaaaatacaaagaacagcgtggacgagcaagaagagactgtgatctcttacgagtcaactccggaggtgtctagaggaaatcagactatggcagttaagtcactgtccccctcacccgagtcctccgcatcccctgtcccaagcacacagccccaactaacagagggcagccatttcatgtgcgtgtag

SEQ ID NO: 31982 - DNA, 3525 bp, Artificial Sequence
  Description of Artificial Sequence: Synthetic coding sequence
atggcagcggatttgaacctcgagtggatcagtctgcccaggtcctggacttacgggatcacaagggggggcagggtgttcttcataaatgaggaggccaagtcaacgacctggctgcacccagtgacaggcgaggccgtggttactggccacaggcggcagagcacggatctgcccaccgggtgggaagaggcctatacatttgagggcgctaggtactatataaatcacaacgagagaaaggttacttgcaaacatcctgtgactggccagccatcccaggacaactgtatctttgtcgtcaacgaacagaccgtagccacgatgaccagcgaagagaaaaaggaacgacctattagtatgatcaacgaagctagcaattacaacgtgacatcagattatgcggtgcacccaatgtcccccgtgggcaggacctcaagagccagtaaaaaggttcataactttgggaagagatccaacagcataaagagaaacccaaatgccccagtggtaaggcgtgggtggctatataaacaggatagtacaggtatgaaactgtggaagaaacgatggttcgtcttgtccgacctctgccttttttactatagagacgagaaggaggagggcattcttggttcaattttacttccatcgttccagatcgcactgctgacttcagaagatcacataaacagaaaatatgcatttaaagctgcccaccctaacatgcggacatattatttctgcaccgacaccgggaaggaaatggagctgtggatgaaagctatgcttgatgcagcgctggtgcaaactgagccagtcaagagagtggacaaaatcacaagcgagaatgctcccaccaaagagaccaataatatacctaaccaccgtgtgcttatcaaacctgaaatacaaaataatcagaagaacaaggagatgagtaagattgaagaaaagaaggccctggaagcagagaagtacgggttccagaaagacggccaggatcgccctttaaccaagatcaatagcgttaagctgaactcgctgcccagtgagtatgaaagcggttccgcatgccccgctcagaccgtgcactaccgtccaattaacctttcaagttcagaaaataaaatcgtaaatgtgtcccttgctgatctgcgcggtggaaatagaccgaatactggccctctctatacggaggcagatagagtcatccaaaggactaatagcatgcagcagctggaacagtggattaagatccagaagggccgcgggcacgaagaggagactcgcggagtgattagctatcaaacactgccccggaacatgccttcacaccgcgcccagattatggctcggtaccctgagggttaccggacccttccaaggaacagtaagacacgcccagaatccatatgcagtgtgacacccagcacgcacgataagaccttgggtcccggcgccgaggaaaagcggaggtctatgagagatgatacaatgtggcagttgtatgagtggcagcagcgacaattttacaataaacagtcaaccctccctcggcactcaacgcttagctccccgaagacaatggttaatatctctgatcagacaatgcactctattcctacgtccccctctcatggctctattgccgcttaccaaggctattcaccacagcgcacctatagaagtgaagtatcaagccctattcagaggggggatgttacgatcgataggaggcatcgggcccatcatccgaaacacgtgtacgtacccgacagaagatccgtgcccgccggactgaccctgcagtctgtgagccctcagagtcttcaaggcaagacgcctgaagagctgacccttctgcttatcaagctccggaggcagcaggcagagctgtcatctattcgagagcacaccctggctcagctgatgcaattaaagcttgaggctcacagcccaaagaatgagatcctctctcaccaccttcaaagaaacacgatctacctggatcaccagctgagtcaggacgagggacgaggtaccttatataaatacaggccagaagaagttgacatagatgcaaaactttcccggttatgcgaacaggacaaggtcgttcacgcccttgaggagaagctgcagcaactgcataaggaaaaatacaccttggagcaagcacttctgtctgcctcacaggagatcgagatgcacgctgacaatcccgcagcaatccagacagtggttctgcagagggatgatctccagaatggattactctcaacgtgtcgggaactttctagagccaccgctgagctggaaagggcctggcgagaatatgataagctggaatatgacgtcactgtgactcggaaccagatgcaggagcaactcgaccacctcggagaagtccaaacggaatcagcaggcatccagcgggcccaaatccagaaggaactgtggcgtatccaagatgtcatggaaggtctcagtaagcacaaacaacaacggggcacaactgagatcggaatgataggttccaagcccttcagcacggtaaagtacaagaacgaaggaccagattacagactctataaaagcgagccggaactaaccacggtggccgaagttgatgagtctaacggtgaagaaaagagcgagcccgtatctgaaatcgagacaagcgtggtgaagggaagccactttcctgtgggggtcgtgcccccccgcgccaagtcgcccacacctgagtcaagtaccatcgcttcttatgtaacgctaaggaagactaagaagatgatggacctaaggaccgaacgcccaaggtccgctgtggagcaactttgtctagccgagtccacaagacctcggatgactgttgaagagcaaatggagcgcatacgtcggcatcaacaggcgtgcctacgtgagaagaaaaaaggcctgaacgttatcggcgcatctgatcaatcgcccttgcagtcaccaagtaatttgagagataaccccttccgcacaactcagacccgccgtcgcgatgataaggaattagacactgccatcagggagaacgacgtcaagcccgatcatgagactccagcgactgaaatagtgcaactgaaggaaacagaacctcagaacgtcgacttttccaaggaattaaaaaaaactgagaacatttcctatgagatgctgtttgagccagagcccaatggagttaacagtgtggagatgatggataaagagaggaataaagataagatgccggaggacgtgacattctccccccaggatgaaacacaaactgccaaccataagcccgaggaacaccccgaagaaaataccaaaaattcagtggacgagcaagaagagactgtgatatcgtatgaaagtacccctgaagtttcccgaggtaaccagaccatggcggtgaaaagtctgagcccatccccagaatcatcagcatctccggtgccatccactcagccacaactgaccgaaggctcccacttcatgtgtgtatag

SEQ ID NO: 31983 - DNA, 3183 bp, Artificial Sequence
  Description of Artificial Sequence: Synthetic coding sequence
atggcagccgatttgaacctagaatggatctctcttcctaggtcctggacgtatggaataactagaggcggccgggtgttcttcattaatgaggaagcgaaatcaacaacttggttgcacccagtcacaggagaagccgtagttaccgggcatcgcagacagagcaccgacctgcctacggggtgggaggaggcctacacctttgaaggggcgcgctattacatcaatcacaatgagcgcaaggtgacatgcaagcacccagtaactggacagccctctcaggataactgtatctttgtcgtaaatgagcaaaccgtggctaccatgacaagcgaagaaaaaaaggaaagaccaatatctatgatcaacgaagcgagcaattataatgtcacctccgactacgctgtgcaccctatgagtcctgtgggtagaacatctcgcgcctccaaaaaggtgcacaacttcgggaagcggtcaaatagcatcaagcggaatccaaatgcacctgtggtgagacggggttggctgtacaaacaagactctacaggaatgaagttatggaaaaagcggtggtttgtgctgagtgacctgtgtcttttctactatcgggatgagaaggaggaaggaattctgggaagtattctcctgccaagcttccagatcgctctcctaacatcggaggaccacatcaataggaaatacgccttcaaggctgctcacccaaacatgcggacgtactacttctgcacagacactgggaaggaaatggagttatggatgaaggccatgcttgacgccgccctggtgcagaccgaacccgtgaaaagagtggataagatcaccagcgagaacgcacctactaaagaaactaataacatcccgaatcatagagtgctcatcaagcccgagatccaaaacaatcagaagaataaggagatgagcaagattgaggagaagaaagctctggaggccgagaagtacggtttccagaaagacggtcaggaccggccattgaccaagattaatagcgtcaagttgaactctctcccatcagagtatgaatcgggctcagcttgtccagcacagaccgtgcactatcgccccatcaacctgagcagctctgagaacaaaattgtcaatgtatctctggccgaccttagaggcggcaaccgtcctaatactgggcctctgtatactgaagccgacagagtgatccaaaggacaaacagcatgcagcagttagagcagtggatcaaaatccagaaggggaggggccatgaggaagaaacaaggggagtcatatcctaccagacacttcctaggaatatgccctcacaccgggcccagataatggcacgctatccagaggggtatcgtactctgccacgcaacagtaaaacgcgccctgagagtatttgcagcgtcaccccttcgacgcacgacaagacattaggcccaggggcagaggagaaaagaaggtcaatgcgggacgatactatgtggcaactctacgaatggcagcaacggcagttctacaacaagcagagcacgcttccaagacattctaccctctcaagtcctaaaacgatggtcaatatatccgatcaaaccatgcattccattcccacttcaccatcacacggaagcatagcagcataccaggggtacagcccccagcggacataccggagtgaagtgtccagcccgattcagagaggggacgtgaccatcgaccggcgccatagggctcatcacccgaaacatgtctacgtacctgaccgaaggtcagttcccgccggactcacactgcagtctgtgagcccccagtcactgcagggaaagactctttcccaggatgaaggccgggggacattgtacaaatacaggcccgaggaagtagatatcgacgcaaaattgtccaggctgtgtgaacaggacaaagtcgtacacgccctggaagagaagctacagcaactgcacaaggagaagtatacactggaacaggccctgctgtccgcctcccaggagatcgagatgcacgcagacaatccagccgctatccagacggtcgtgctgcagcgcgatgatttgcaaaatgggctcttgagtacatgcagggagctttcacgagctaccgccgagttagagcgtgcctggcgggaatacgataagctggagtacgacgtgaccgttaccaggaatcagatgcaggagcaactggaccaccttggcgaggtgcagaccgagtcagccggaattcagagggcccagatccagaaggaactctggcgtattcaagacgtgatggaaggcctgtctaaacacaagcagcagagaggcacgactgaaatcggttctcattttccggtgggagtggtccccccaagagccaaaagtcccactcccgagtcctccaccatcgcgagctacgtcacacttcgaaaaactaaaaagatgatggatctccggactgagcggcccagatctgctgtggagcaactctgcctcgctgagagtactcgaccaaggatgacagtcgaggaacagatggagcgcatcagaaggcaccagcaagcatgtctacgcgagaagaaaaaaggattaaatgtcatcggcgcatctgaccagtctcctctgcagtcccctagtaatctacgcgataaccccttccgtaccacacagacacgccggcgagacgacaaagagctggataccgcaatcagggagaatgacgtgaaacctgaccacgagacgcctgctaccgaaatcgttcagctgaaggaaaccgagccccagaatgtagattttagcaaagagctgaagaagacagaaaatatctcctatgaaatgctgtttgaacccgaacccaatggcgtaaactccgttgagatgatggataaggagcggaataaggataaaatgccagaggacgtaaccttctccccgcaagacgaaacccagaccgctaatcataagcccgaggaacatcccgaagaaaatacaaaaaattctgtcgatgaacaggaagagaccgtcatctcctacgagtctacacctgaagtaagccgcggaaaccaaacaatggcggtgaagtctctctcaccgtccccagaaagttcagccagtcccgtgccttctactcagccccagttaacagaaggtagccacttcatgtgtgtgtag

SEQ ID NO: 31984 - DNA, 963 bp, Artificial Sequence
  Description of Artificial Sequence: Synthetic coding sequence
atggctgcggatttgaacttggaatggatcagtttgccccgttcttggacatacgggatcacccgcgggggtcgcgtgttcttcattaatgaagaagcgaagtccactacatggctgcaccccgtcacaggtgaggccgttgtcaccgggcacagacgccagagcactgacctgccaaccgggtgggaagaagcctataccttcgagggcgctcgctactacattaaccacaacgagcgaaaagtgacttgtaagcatccggtgactggtcaaccgtcccaggataattgcatctttgtagttaacgaacagactgtggcaaccatgacgtccgaggaaaagaaagagagaccaatatccatgatcaatgaggccagcaactataacgtcacaagcgattatgcagtccatccaatgagccctgtcggaagaacttcacgagcttctaagaaagtgcacaacttcggcaaacgctcaaactcaataaagcggaatcctaacgctcctgtggtgcgtcgggggtggctctacaaacaggatagcaccggcatgaaactctggaagaagcgttggttcgtgctctccgacttatgtctcttttattatagagatgagaaggaggaaggcattttgggaagcatcctcctgccctctttccagattgcgctgctcacctccgaggaccacattaaccggaaatacgcatttaaggcagctcatcccaatatgagaacatactatttctgcaccgacaccggcaaggagatggaactctggatgaaggcaatgcttgatgctgcactggtgcagaccgaaccagtgaagcgcgtggacaagataacatcagagaacgctcctactaaagagaccaacaatatcccaaatcatagagtgctgattaaacccgaaattcaaaataatcagaagaataaagagaaaaaaaagaaaaaaaagaaaaagtag

SEQ ID NO: 31985 - DNA, 3318 bp, Artificial Sequence
  Description of Artificial Sequence: Synthetic coding sequence
atgacttctgaggaaaagaaagagcgtcctatctcgatgattaatgaggcatccaactataatgtgaccagcgactacgccgtccaccccatgtctccagtgggcagaacatctagagcttcaaaaaaggtccacaacttcggaaagcggagtaactcgataaagaggaatccaaacgcacccgtggtccgcaggggttggctgtataaacaagattctacaggtatgaagctgtggaagaagcggtggtttgtgctcagcgacttgtgcctgttttactatagagacgagaaagaggagggaattctgggctccattttgctaccttcttttcagattgcccttcttacaagtgaggaccacatcaaccggaaatacgcatttaaggccgcgcaccccaatatgaggacctactacttctgcacggataccgggaaagaaatggaactgtggatgaaggccatgctggatgcggcactggttcagactgaaccggtcaaaagagttgataaaattacttccgagaatgcacctaccaaggaaacaaataacattccaaaccatagggtcctaatcaaaccagaaatccagaataatcagaagaacaaagaaatgagcaagattgaagagaaaaaagctctcgaggcagagaaatacgggtttcagaaggacgggcaggatagaccattgactaagattaacagcgtcaagttgaacagcttgccatccgagtacgaaagtggctccgcgtgtcccgcccaaaccgtgcattatcgaccaattaatctcagctcctcagaaaacaaaatagttaacgttagcctagccgacctcagagggggtaatcgccccaataccgggccgctgtacactgaagccgatcgcgtaatccagagaacgaacagcatgcaacagctggagcagtggatcaagatccagaaggggagggggcacgaggaggagactcgcggcgttattagctatcagaccctacctagaaacatgccatcccatagagctcaaatcatggccagataccccgagggctatcgtacgctgccccgtaacagtaagaccagaccagagagcatctgtagcgtcacgccctctactcatgataaaacacttggccccggcgccgaggaaaagcggagaagcatgagagacgacacgatgtggcaactctatgaatggcaacagcgacaattctacaacaaacagagcaccttgcccagacactcaacccttagttcaccaaaaactatggttaacatcagtgaccagacaatgcactcaatacccacaagtccatctcatggatctattgctgcgtaccaaggctattcccctcagagaacatatagatcggaggtatcgtccccgattcagcgcggagatgtcacgatcgaccgtcgacaccgggcccaccaccctaagcatgtttacgtacctgataggaggtctgtacccgccgggctcacccttcaaagcgtgtctccacagtccctacaaggcaagacgatgaaagagaacgagcctataattaccatggttcacaccatgatcgaaaattccgctttgcggcctcagctgtaccagcagttcctaaggcaaaaaagcaagatcagcctgtactgcttgtcacaagatgaaggacgagggaccttgtataaataccgccctgaagaggtggatatcgacgctaaactcagcagactgtgtgaacaggacaaggtggtccacgccctggaggagaaattacagcagctgcataaggaaaagtacactctggagcaggctcttctttcagcatcacaggaaattgaaatgcacgctgacaatccggctgccatccagacagtcgtactccaacgcgatgatctacagaacggcctgctctctacctgtcgtgaactgtcaagagctaccgccgagctagaacgcgcgtggagggaatacgataaactggagtacgatgtaacagtcacaaggaatcaaatgcaggaacagctggatcacctgggagaggtccagacagagtcagctggcatccagcgggctcagatccagaaagaactgtggaggatccaagacgtaatggagggtctctcaaagcacaaacagcagaggggtatgattggcagtaaaccatttagcactgtaaaatataagaacgaggaagaagaagtagtacccccaaggccccccctgccccgctcctacgacttcacggagcaaccaccaataataccgccacttccatctgattcaagctcgttactctgttattcaaggggcccagtgcatctccctgaagaaaagaaaatgtaccaggtgcaggggtacccaagaaatggcagccactgcggccctgactacagattatacaagtcggagcctgagttgaccacagtggccgaagttgatgaatccaatggcgaggaaaaatctgaacccgtgagcgaaattgaaacatcggtggttaagggatctcatttccctgtaggcgtggtcccaccacgcgccaagagcccaacacccgagagctctaccatcgctagttacgtaactcttagaaagactaagaagatgatggatctaagaaccgagcgaccaagaagtgctgtcgaacagctctgcctcgccgagtcaacccggcctagaatgacagtggaagagcagatggaaaggatcaggaggcatcagcaagcttgtctccgcgagaagaaaaaggggctaaacgttatcggggctagtgaccaaagtccactgcagagtccttccaatttgagggataacccttttcgaacgacacagactcgtaggagagacgacaaagagttggacaccgcgattagagagaacgacgtcaagcccgatcacgaaacacctgcaactgagatcgtgcagctaaaggaaacagagcctcaaaacgtggatttctcaaaggaactgaaaaagaccgaaaatatttcttatgaaatgcttttcgaaccggagccaaatggagttaacagtgtcgagatgatggataaagaaaggaacaaggacaaaatgcctgaggatgttactttctctcctcaggatgaaacccagacggcaaaccacaaacctgaagaacaccctgaggaaaacacaaagaattcggtggatgagcaggaagagacagtcattagctacgaaagtactcccgaggtcagccggggtaatcagaccatggccgttaaatcccttagcccatctcctgagagtagcgcttcaccagtgccttctactcagccccagcttactgagggaagccattttatgtgcgtttag

SEQ ID NO: 31986 - DNA, 3525 bp, Artificial Sequence
  Description of Artificial Sequence: Synthetic coding sequence
atggccgctgacctgaatttggaatggatctctctgccccggtcctggacctatggtattactcgtggcggccgggtattttttatcaacgaggaggccaagagcaccacatggctacacccagtcactggggaggcagtggtcacaggccaccggcgacagagcacagacctgcccacaggctgggaggaagcctacacattcgaaggtgctcgttactacatcaaccacaatgagcgaaaagtcacatgcaaacaccctgtgaccgggcaaccctcccaggataactgcatattcgtggtgaatgagcagaccgttgccacaatgacatcggaggagaaaaaggagagacccatcagcatgatcaatgaggcttctaactataatgtgaccagcgattatgcagtgcatcccatgtcccccgtcggtaggacttccagggccagcaagaaggtgcacaatttcggtaaacgatccaactcaattaagcgaaatccgaatgcacctgtggtgaggcgtggctggctgtacaaacaggactctaccggcatgaaactttggaagaaacgatggtttgtactgagtgatctttgtctattctattacagggatgaaaaagaggaagggatcctgggaagcatcctgctcccatcttttcagattgctctccttaccagcgaagaccatattaacagaaaatatgcctttaaggcagcgcatccgaacatgcgaacttattacttctgtacagacacgggcaaagaaatggagctgtggatgaaagccatgctggacgccgccttagttcagacagagcccgttaagagagtggacaagattacctccgagaacgcccctaccaaggagaccaataacatccccaatcaccgcgtgctcatcaaacccgagattcagaacaaccaaaagaacaaagagatgtctaaaattgaggagaagaaagctctggaggctgagaagtatggtttccagaaagatgggcaggacaggcccctgacgaaaattaatagcgtgaagctaaactccctgccgtcggagtatgaatctggcagcgcctgcccagcccagacagtgcattataggccaatcaacttgtcctctagcgagaacaaaattgtaaatgtgtctctcgccgatttgcgggggggcaatcgccctaacaccggccccctctacactgaagcagaccgcgtaatccagagaacgaattccatgcagcagctcgagcaatggattaagatccagaagggacgtggccacgaggaagaaacaaggggggtcatctcctaccagacgctgccgagaaatatgcctagccaccgcgcacagatcatggcgcgctaccccgagggctaccgcacgctgcctcggaattcgaagacgagacctgagtctatctgcagcgtgaccccttccacacatgacaagactctaggtcccggagcagaagagaagaggagatccatgcgtgacgacacaatgtggcagctgtatgaatggcagcagagacaattctacaataagcagtcgacgcttccaagacactcaacactgagctcacccaaaaccatggtgaatatttcagatcagaccatgcactcaattcctacttcaccatctcatggatccatcgccgcctaccagggatatagcccacagcgcacctacagatctgaggtgagctcccctattcagagaggtgatgtgaccatagatcgcagacacagagctcaccatcccaaacatgtatatgtgcccgaccggaggagcgtgcctgcaggactcactctccaatctgtaagccctcagagtcttcagggcaagactccggaagagctcactctgctgctcataaagctgcgacggcagcaggccgaactgtcctctattcgcgagcataccctggcccagcttatgcagctgaaattagaggctcacagtccaaaaaacgagatcctgagtcatcatctccaacggaacacaatttacctggatcaccaattgtcccaggatgagggccgcgggaccctatacaagtataggcccgaggaagtggatatagatgccaagctctcccgcttgtgcgagcaagataaagtggtgcacgcattggaagagaaattacagcagctgcacaaggagaagtatacactggagcaggcgctgttgagtgctagtcaggagatcgagatgcacgctgacaacccagccgctattcagactgtcgtattgcagcgggatgatctgcagaatggcctgctttcgacttgcagagagcttagcagggcgacagctgagcttgaaagagcatggagggagtatgacaaactagagtacgatgtgaccgtcaccagaaaccagatgcaagagcaactggatcatctgggcgaggtacagacggaatccgccggcattcaacgcgcacagattcagaaggaactctggcgtatccaggacgttatggaggggctgagtaagcacaagcaacaaagaggcactactgagataggtatgataggcagcaagccttttagtactgttaagtacaagaatgagggtcctgactaccgattatacaagagcgagcccgagctgacaacagtcgccgaggtcgacgaatccaacggcgaggagaaatcagaacctgtcagcgagattgaaacaagcgtagtgaaaggctcacattttcctgtgggagtggtaccgccacgagcaaagagtcccacccctgaatcctctactatagcctcttacgtcactctccgcaaaactaagaagatgatggacctcagaacagagaggccaagatccgctgtggaacagttgtgtttagcagagagcaccaggcccaggatgactgtggaggagcaaatggaaaggatccggagacaccagcaggcctgtctgcgcgagaagaagaagggattaaacgtgatcggtgcatctgaccagtctcccctgcagagccccagcaatctgcgggacaatcctttcagaaccacgcagacgaggaggcgcgatgacaaagagctggatacagcgattagggaaaatgacgttaagcccgaccacgagacccctgccaccgagatcgttcagctgaaggagaccgagcctcagaatgtggattttagtaaggaactcaagaagactgagaacatttcttacgagatgctgtttgagccggaacctaatggcgtaaatagcgtggaaatgatggataaggagagaaacaaggataaaatgcccgaagacgtaaccttttctcctcaggacgaaacacaaacagccaaccacaagccagaggaacaccccgaggaaaataccaaaaattctgtcgacgagcaggaggaaacagtgatctcatacgagtcaacccctgaagtgtcccgtgggaaccaaacgatggctgtgaagtctctgtcacccagtcccgagagctctgcctcacctgtaccatccacacagcctcaactgacagagggctcccatttcatgtgcgtttag

SEQ ID NO: 31987 - DNA, 1194 bp, Artificial Sequence
  Description of Artificial Sequence: Synthetic coding sequence
tatacactcgaacaagccctcctgagcgcaagtcaggagattgaaatgcatgccgacaatccagccgctattcagaccgtcgtgctccagcgcgatgacctccagaatgggcttctgagtacgtgtcgcgaactgagtagggccactgccgagttggagcgagcctggcgtgaatatgacaagctggaatacgacgtcactgtgacacgtaaccagatgcaggaacagctcgaccacctgggggaggttcagaccgaaagcgccgggatacagagagctcagatccagaaggagctgtggcgcattcaggatgtgatggagggactgtctaagcacaagcagcaaaggggtactactgaaattggcagtcacttccccgtaggcgtggtgccaccaagggcaaagtctcccactcccgaatcctccacgatagctagctacgtgactctgcgaaaaacaaagaagatgatggacctccggacagaacgccctaggagcgcagtggaacaactctgtctagcggaatcaacacgtcccaggatgaccgtggaggaacaaatggagcgcatcagacgacaccagcaagcctgccttcgcgagaaaaaaaaaggactcaacgtgattggagcttctgaccagtctcctcttcagtccccctctaatctgcgggacaacccattccgcactacgcagacgcgaaggagggatgacaaagaactggatacagccataagagagaatgatgtcaaacccgaccatgaaacacctgctaccgaaatcgtgcagcttaaagagacagaacctcagaacgtggacttcagtaaagaactcaagaagacagagaatatcagttacgagatgctgtttgaaccagagcccaatggcgtcaacagcgtggaaatgatggataaggagaggaacaaggacaagatgccagaagacgtcacattttcaccacaggatgagacacaaacagcaaaccataagccggaagaacacccagaagaaaataccaagaattcggtcgacgagcaggaggagaccgtcattagttatgagtccacaccagaagttagccgggggaatcaaactatggccgttaaatctctttccccatcgccagagagtagcgcatcgccagttccgagtacccagccacagctcactgaagggtctcatttcatgtgcgtgtag

SEQ ID NO: 31988 - DNA, 2625 bp, Artificial Sequence
  Description of Artificial Sequence: Synthetic coding sequence
atgagaacctattatttctgtactgacaccgggaaggaaatggagctctggatgaaggctatgctagacgctgcccttgtccagaccgaaccagttaagagggtggacaagataacgagcgagaacgccccaactaaagagacgaataatattccgaaccatcgggtcctcattaaacctgagattcagaacaatcagaaaaataaggaaatgtccaagatcgaagaaaagaaagctctggaggccgagaaatatggtttccagaaggacggccaggatcggccacttacaaaaatcaattctgtgaagctgaacagtctaccgagcgagtacgagtcaggaagcgcatgtcctgcgcaaactgtgcattacaggcccatcaatctgtcttcttccgaaaataaaattgttaacgtttctctggcagacctcagagggggtaataggcctaacacaggacccctgtatacagaggccgaccgagtcatccagcggacaaattccatgcagcagctagaacagtggatcaagatacagaaaggacgtggccacgaggaagagacacgcggagtgataagctatcaaactctgccaaggaacatgcccagccaccgagctcagatcatggctaggtatcccgaaggctacaggaccctgcccagaaacagtaaaacacgcccagagagcatttgttcggtcaccccttcaactcacgataaaaccctgggccccggggcagaggaaaaacgccgctcaatgagagacgataccatgtggcagttgtacgaatggcagcaacggcagttttacaacaagcaatctaccctgccccggcatagcacactgtccagcccaaagactatggtgaacatatcggatcagactatgcatagcattcctacctcaccaagccacgggagtattgccgcctaccagggatattcccctcagaggacataccgaagcgaagtcagctccccaatccagcggggggacgtgacaattgaccgccgccatagagcccaccacccaaaacatgtatacgtgcctgaccggcgcagcgtgcccgccggactgacactccagtccgtgtctcctcagtccctgcaaggaaaaaccctgagtcaagacgagggcagaggtacactgtacaaataccggccagaggaagtggatatcgacgccaagctatcgcggctgtgtgaacaagacaaggttgtgcacgccctggaggagaaactgcagcaactgcacaaggaaaagtataccctcgagcaggcactgctcagcgcttctcaggaaatagagatgcatgcagataaccccgccgccatccagactgtcgtgctgcagcgcgatgatctgcagaacggtctcctctcaacttgccgcgagttgtcacgtgcaaccgccgagttagagcgcgcctggagggagtacgataaacttgaatatgacgtaaccgtaacacgcaatcagatgcaggagcaacttgatcatttgggcgaggtccagacagaatctgccgggatacaacgagcccagatacagaaggagctctggcggatccaggatgtcatggagggccttagtaagcacaagcagcagcggggaaccacggagattggaatgattggttccaagccattttctacagtgaaatataagaatgaggggccagattacagactgtacaagtcggaaccagaattaactactgtggctgaagtggacgagtcaaatggggaggagaagagcgagcccgtctctgagatcgagacctcagttgtgaaagggtctcacttccccgtcggcgtggtcccccctcgcgcaaagtcacccacccccgagagttccacaatcgccagctatgtcacactgagaaaaacaaaaaagatgatggacctgcgcacagagagaccacgtagtgcggtagaacagttatgtctggcggagagcacgcgaccgcgcatgaccgtagaggaacagatggagcgaattcggagacaccagcaggcttgcttgagggagaaaaagaagggtctcaatgttattggagcatctgaccagtccccattgcagtcaccatccaacttgagggacaacccgttccgaaccacccaaactaggcgcagagacgataaggagttagataccgccattagggagaacgatgtcaagccagaccacgagacaccagccacagagatagttcagttgaaggagacagagccacaaaacgtggactttagcaaagagctgaagaagactgagaatatcagctatgaaatgctttttgagccagagcccaacggtgtcaactccgttgaaatgatggataaggagcggaacaaggataagatgcccgaggacgttaccttttctccccaggatgaaacccagaccgcgaatcacaagccggaagagcaccccgaggaaaacactaaaaactctgtagatgagcaggaggagaccgtgatctcctatgagtctacgccagaggtgtcccggggcaatcaaaccatggcagtcaaatccctctctccttctccagaaagtagcgcatccccagtgcccagcactcagccgcagctcacagaggggagccacttcatgtgtgtgtag

SEQ ID NO: 31989 - DNA, 3555 bp, Artificial Sequence
  Description of Artificial Sequence: Synthetic coding sequence
atggctgcagacctgaacttggagtggatctctctcccgagaagctggacctatgggatcacacgaggcgggcgggtgttttttatcaatgaggaagcaaagagcacaacgtggttgcaccctgttaccggggaggccgtcgtcaccgggcacaggcggcagagtaccgacctgccaacaggatgggaagaagcctacacctttgaaggtgcaaggtattacattaatcataacgagcgtaaggtaacttgcaaacatcctgtgactggccaaccctcccaggataactgcatcttcgtggttaacgagcaaaccgtggctacaatgacttctgaagagaagaaagagcgccccataagtatgataaacgaagcctctaactataatgtgaccagcgactacgcagtccacccaatgtctccagtcgggcggacgagcagagcatcaaagaaagtgcacaactttggtaaaaggtccaactccatcaaaaggaatcctaatgcaccagtcgttaggagaggctggctgtacaagcaagactccaccggcatgaagctctggaaaaagcgatggttcgtgctcagtgatctttgcctgttctactaccgtgatgaaaaggaggagggcatcctgggctctatcttgctgcccagcttccagatcgcccttctgacgagtgaggatcacattaaccgcaaatacgcatttaaggcagcacatcccaatatgcggacctattacttctgcaccgacaccggtaaagaaatggaactgtggatgaaagcgatgctcgacgcggccctggtccaaacagaacctgtgaagagaatattcttctccgactttcgggtcgataaaatcaccagcgagaatgcccctacaaaagagaccaacaacatccccaatcatcgtgtgctgatcaagcccgaaatccagaacaatcagaagaataaggagatgtctaaaattgaagagaagaaggctttggaggctgaaaagtacggattccagaaggatggacaggaccggcctctgacaaaaataaatagcgtgaagctgaacagtctgcccagtgaatatgaatctggctctgcttgccccgcacaaacagtgcactaccggccgatcaatctgtctagctcagagaataagatagtgaacgtgtcactggccgatctgcgcggtggtaatcgtccaaacaccgggcccctgtacactgaggccgaccgggtgattcagcggactaattccatgcagcaactggaacaatggatcaaaatacagaagggccggggacatgaggaagagacccggggcgttattagttatcaaacattgccccgcaacatgccaagccaccgggcccaaattatggctaggtaccccgagggctacagaaccctacctcggaactccaaaactcgccccgagagcatctgtagcgtcaccccatcaacccatgacaaaacactcgggcctggcgctgaagaaaaacggaggagtatgcgtgacgatactatgtggcagctatatgagtggcaacaacggcagttctacaataagcagagcaccctgccacggcactctacactctctagccccaagacgatggttaacatcagtgaccagaccatgcattccatcccaaccagcccgagtcacggatcaattgccgcctaccagggttactctccccagcggacttacaggagcgaggtttccagccccatccaacgcggtgatgtgacaatcgacagaagacatcgagctcatcaccccaagcacgtctatgtcccggatcgcaggtccgtgcccgctggacttacacttcagtcggtcagtccgcagtcgctgcaggggaagacccccgaagagcttacattactgctaatcaagttgaggcggcagcaagccgaattgtcgagcatccgcgagcacaccctcgcgcaactcatgcaactgaagctggaggcacactccccgaagaacgaaatcctgtcacatcacctgcagaggaacacaatttacctcgaccatcagatgaaagagaacgagcctattatcaccatggtgcacacaatgattgagaacagcgccctccggccccagttgtatcagcagttcttgcggcaaaaatccaagatctcgctgtactgcctgagccaggacgagggtcgcgggaccctttacaagtatcgaccggaggaagtggacattgacgcaaagcttagtagattgtgcgaacaagataaggttgtgcacgcactggaagaaaagctgcaacagttgcacaaggaaaagtacactctcgagcaagctctcctatcagcctcacaggagatcgaaatgcacgctgacaatcccgccgctatccagactgtcgtgctccaacgagacgatcttcaaaatggcctacttagcacctgcagagaactatctagggccactgctgaactggaacgggcctggcgagaatatgataagctggaatacgacgttacagtcacccggaaccaaatgcaggaacagctggaccacctcggcgaagtccagactgagagcgccggaatccagagagcacagatacagaaggagctctggaggatccaggatgtgatggagggactgtccaagcacaaacagcagaggggaatgatcggatccaagcctttcagcactgtgaaatacaagaacgaggaagaagaggtcgtcccaccgaggccccctctccccaggtcttatgacttcactgagcaaccgcccataattcctcctcttccgagtgattcctctagtctgctgtgttacagtagagggcctgtgcatctgcctgaagagaagaagatgtatcaagtccaagggtatccgcgcaatgggtcgcattgcgggccagattataggctgtataagagtgaacccgagctgacaactgttgcagaggtcgatgagtctaacggtgaggaaaagtcagaacccgtttccgaaatcgaaaccagcgttgtgaagggctcacattttcccgtcggggttgtgccacccagggcaaaaagtcctacacctgagtccagtactattgcatcctatgttacactgaggaagactaagaagatgatggatcttcggaccgaacggccccgatccgccgtggaacagctgtgcctcgccgagagcacgcgtccccgaatgaccgtggaggaacagatggaacggatcaggaggcaccagcaggcatgcctccgcgagaaaaaaaaggggttgaacgtaattggtgcctccgatcagtccccgctgcaatcaccttctaatttgcgggacaatcccttcagaaccacccagacccgtcgccgcgacgacaaagagctggatactgcaatcagagaaaatgacgtcaaaccagatcacgaaactcctgcaaccgagatagtgcaactaaaagaaacagagcctcagaacgtcgatttcagtaaagagctcaagaagactgagaacatttcctatgagatgctctttgagccggaaccaaacggcgtgaattcggtagagatgatggattag

SEQ ID NO: 31990 - DNA, 3297 bp, Artificial Sequence
  Description of Artificial Sequence: Synthetic coding sequence
atgacatccgaagagaaaaaggagcggcctatcagcatgatcaatgaggcctcaaattataatgtaaccagcgactatgccgtccatcctatgagccccgtagggagaactagccgggccagcaagaaggtccataacttcgggaaacgctctaacagcattaagcgtaatcctaatgcacccgtggttagaagaggatggttgtacaaacaggactcaacaggaatgaagctgtggaagaagaggtggttcgttctgtccgatctttgtctgttttactatagggacgaaaaagaggagggtattctaggctcaatcctgctgccctcttttcagattgccttgctgacttccgaggaccacatcaatagaaaatacgctttcaaagcggctcatccaaacatgcggacttactatttttgtactgataccggcaaggaaatggaactatggatgaaagcgatgctggacgcggcattggtgcagacggaaccggtgaagagggttgacaaaataacctcggagaacgctccaactaaggagaccaataatatccctaatcaccgggtgctcataaaaccagaaatacagaataatcagaaaaacaaggagatgtcaaaaatagaagagaagaaggccctcgaagccgagaagtatggcttccagaaggatggacaggatagaccactcacaaagatcaatagcgtgaagttgaactccctcccgtccgaatatgaatccggatctgcttgcccagcacagaccgtccactataggccgatcaacctgagctcatctgagaataaaatcgtcaatgtgagcctggcggacctgaggggggggaaccggccaaacacaggccccttgtatacagaagcggatcgggtaatccagaggactaattccatgcagcaactcgagcagtggataaagatccagaaaggccgaggacacgaggaggagacccgtggagtaatttcatatcagactcttccaaggaacatgcctagccaccgggcccagatcatggcccggtaccccgaaggttacaggacattgccaaggaatagcaaaactagacctgagtccatctgctcagttaccccttcaacgcacgacaagacattgggccccggggctgaggaaaagcggcggtcgatgcgcgacgataccatgtggcagctgtacgaatggcagcagagacagttctataataagcagagcacactgccccgccactcgacgctgagttcacctaagaccatggttaatatctcagatcagaccatgcactctatcccaacatcgccttcccacggatcaattgctgcttaccaagggtattctccccagcgcacttatagatcagaggtgagtagtccaatacaaaggggtgacgtaaccattgaccgaagacatcgtgcacatcacccgaaacacgtgtatgtcccagatcgtaggtccgtgccagccggcctgacactccagtccgtctcccctcaatcacttcaaggtaaaacgatgaaagagaatgaacccataatcaccatggtccatactatgatcgagaactcagcccttagaccacaattgtatcagcagctgagccaagacgagggacgcggcactctttacaaataccgaccagaagaggtagatattgacgccaaactctctagactgtgtgagcaggataaagtagttcacgctttagaagagaagctgcagcaacttcataaggagaagtacaccctcgaacaggctctgctctctgcaagccaagagatcgagatgcacgctgacaaccctgctgctattcagacagtggtgttacaaagggatgacctccagaacggcctgctttctacctgcagggagctttcacgggcgaccgcggagctcgagagagcttggagggagtatgataagctcgagtatgacgttacagttacccgcaatcagatgcaggaacagttggaccacttgggggaggttcaaacagaatccgctggcatccagcgggcacaaattcagaaggaactgtggcggatccaggacgtgatggagggactctccaagcacaaacaacaacgggggaccacagaaatcggtatgatcggctcaaaacccttcagcacagtgaaatataaaaatgaggaggaagaggtggtcccacccaggccaccactgccccgatcttacgacttcaccgagcagcctcctatcataccacctcttccctctgattcaagttctctgctctgctactctcgtggaccagttcacctccctgaagagaagaaaatgtaccaggtgcagggctacccccggaacggctcgcactgtggtcctgattataggctgtacaaatccgaacctgaactgaccactgtagctgaagtagacgaatccaacggcgaggagaaatcagaaccggtatccgagattgaaaccagcgtcgtgaaaggctcccatttccctgtgggcgtcgtccctcctcgcgctaagtcacccacccccgaatcctccaccatcgcctcatatgtgacactgcgcaaaaccaagaaaatgatggacttaaggacagaaaggcctcgctcagccgtggaacagctctgcctggcagagtccacacgccccaggatgactgttgaggagcagatggagcgaatcagaaggcaccagcaggcctgtctgagagagaaaaagaaaggcttaaacgtgatcggggcctccgaccagtctcctctccagtcacccagcaatctgcgggacaacccatttcgcaccacccagacaagacggcgtgatgataaggaactggacacggccatccgggagaatgatgtcaaacccgaccatgagacaccggccacagagattgtgcagctgaaagagaccgaaccccaaaacgtagatttttccaaagagctgaagaaaacggaaaacatcagctatgagatgctgttcgagcctgaaccaaacggcgtgaactcagttgagatgatggacaaggagaggaataaggacaagatgcctgaagacgtaacgttctctccgcaggacgaaacccaaacagccaaccataaacccgaggaacatccagaagaaaataccaaaaacagcgtagatgaacaagaggagacggttattagctacgaatctactccagaagtgtcccgaggaaatcagaccatggctgtgaaaagcctgtcccctagccctgagtccagcgcctcgccagtcccaagtacgcaacctcaacttacggaaggctctcactttatgtgcgtttag

SEQ ID NO: 31991 - DNA, 3147 bp, Artificial Sequence
  Description of Artificial Sequence: Synthetic coding sequence
atgtcgaataagactggtggcaaacggccggctaccaccaactcagatattcccaaccacaatatggtaagtgaagtgcctcccgagaggccgtctgtgcgggcaacacgtaccgctagaaaggcggtggcctttggcaagaggtctcattctatgaagcgcaatccgaatgcacctgtaacaaaggcgggctggctttttaaacaggctagttctggggtgaagcagtggaacaaacgctggttcgtcctggtggaccggtgcttattctactataaagatgaaaaggaggaatccatcctggggagtatcccactgctctcatttagggtcgcggctgtgcagccctccgacaacattagccggaagcatactttcaaggccgaacacgccggggttagaacctatttcttctccgccgagtctcccgaagagcaagaagcctggatacaggctatgggagaggccgccagggttcagattccacctgctcagaaatccgtgccccaggcagtcaggcatagtcatgagaaaccggactcagagaatgtcccgccttccaaacaccatcagcaaccacctcataattcactgcctaaacccgagccagaggcgaagactcgaggagagggagacgggaggggctgtgaaaaggccgaacggaggcccgaacgccccgaggtgaagaaggaaccacctgtaaaagctaatggactgccagcgggcccagagcccgctagcgagcctgggagtccatacccagaagggcctagagtcccagggggcggcgaacagccagcacagcctaacggctggcaatatcactcaccgagtaggccaggctctactgctttccccagccaagacggcgagactggcggtcatcgccggagcttcccgcctaggacgaatccagataaaattgctcagcggaaatcgtctatgaaccaactgcaacaatgggtcaacctgcggcgaggggtgcccccaccagaggacctgaggagtccctcgagattttaccctgtgtcccgcagagtacccgaatattatggtccatactcttcgcagtaccctgatgattaccaatattaccccccaggtgtaaggcccgaaagtatctgcagtatgcctgcttatgacagaatttccccgccctgggcgctggaggataagaggcatgcttttcgaaacggaggaggccccgcttaccagttacgagagtggaaggaaccagcaagctacggcaggcaggacgctaccgtgtggattccctctccctcacgtcagcccgtgtactacgacgaattagacgctgcttcctccagtctccgccggctttcgttgcagcctaggtcacattcggtgcctaggtcacccagccaaggttcatatagcagagccaggatctattcgcctgtacggtcgccttcagcgaggttcgagcgccttccgccaagatccgaggatatttatgccgaccccgcagcttacgtcatgcggagaagcatttcctcccccaaagttccgccgtatccagaggtttttagggattccctgcacacgtataagttgaatgaacaggacactgacaaactgttgggcaagctgtgcgaacagaataaggtggttagagagcaggacagactagtgcagcaactacgggccgaaaaggagtcacttgagagcgcattaatgggcacacaccaggagctggaaatgtttggatcgcagcccgcttacccagaaaagctccggcataagaaggactccctccagaaccaactgatcaatattcgcgttgaactgtctcaggcaactaccgcgcttactaattccaccatagagtacgagcatcttgagtccgaagtgtccgcactgcatgacgacttgtgggagcagttgaatctagacacgcagaatgaagtactgaataggcagatccagaaagaaatctggcgaattcaggatgtcatggagggcctaaggaagaacaacccctcccgggggaccgacaccgctaagcaccgaggcgggttgggcccctccgcaacatacagctccaactccccggctagccccttaagcagcgccagcctgaccagccctctgtccccattcagcctggtatccggctcccaggggagccccactaagcccgggagcaacgagcctaaagcaaactacgaacaatcaaaaaaggacccgcaccaaactctgcctctcgacacgcctagggacattagcctagttcccacccgacaggaggtggaggctgagaaacaggcggctctgaataaggttggagtcgtgcctccacgcaccaagtctcccaccgacgacgaagtaacgcccagcgctgtggtgcggaggaatgctagcggactcacaaatggtttatcttctcaggagcgccccaagagcgccgttttccccggagagggtaaggtgaagatgagcgttgaggagcaaattgatagaatgcgcagacatcagagcggatccatgagggaaaaacgcagatctctgcagctacccgcctcgcctgcccctgaccccagtcctaggcctgcatacaaagttgtgcgaaggcataggagtatccatgaagtagacataagcaatctggaggctgccctgagggccgaggaacctggagggcacgcatatgaaaccccgagagaggagattgccaggctccgcaaaatggagctcgagccgcagcattacgacgtggacatcaataaggaactgtctacccccgacaaggttctgatccccgaaagatacatcgatcttgaaccggacactcctcttagtcctgaagagctgaaggagaagcagaagaaggtggaaaggatcaagacattgatcgctaaatcaagcatgcaaaacgtggttcctataggggaaggggactctgtagacgtgcctcaggattcagagtcacagctgcaggagcaagagaagaggatagaaatctcctgcgcgctggctacagaagctagcagacgagggcgaatgctttctgtgcaatgcgcaacccctagccctcctaccagtcctgcctcacccgctcctccagcaaacccacttagttctgagtcaccaagaggcgcagacagcagctacacaatgcgcgtctag

SEQ ID NO: 31992 - DNA, 321 bp, Artificial Sequence
  Description of Artificial Sequence: Synthetic coding sequence
agagctcggatctattcccctgtacggtctccctcagctaggttcgagagactgcctcccaggtccgaggacatttatgccgaccccgctgcctatgtgatgcgtagatccattagcagtccgaagtatgattatctaggagatcggcggccagtgcccgccgggctctttccttacaattaccctccctcacctaccgtacacgacaagatggttccaccctacccagaggtgttcagggatagcctgcatacatacaaactcaatgagcaggacacagataaacttttgggcaagttatgtgagcagaacaaggtgtag

SEQ ID NO: 31993 - DNA, 3207 bp, Artificial Sequence
  Description of Artificial Sequence: Synthetic coding sequence
atgagcaataagaccggcggcaaaaggcctgccacaaccaacagcgacatcccaaatcacaacatggtaagtgaggtgccacctgagagacctagcgtgagggccacccgtaccgcacgcaaggcggtggcatttggcaaaagaagccattccatgaagagaaatcctaacgctccagttactaaggctgggtggctgttcaagcaggcttcatcaggagtgaagcagtggaataagaggtggttcgtcttggtggaccgatgtctgttctattataaggacgagaaagaagagtccattttgggaagcattccccttttatccttccgtgtggccgctgtgcagcccagcgacaacatatctcgcaaacatacctttaaagtcaccgtatgctgggttgacgaagcagaggcatcaagcactcggtgcctgagtccacaggccgaacacgccggcgtccgcacatacttcttctcagctgaatcaccggaagagcaggaggcatggattcaagcaatgggtgaggccgctagagtccaaattccaccagctcagaagagtgtcccccaggcagtgcggcattcccacgagaaacccgacagtgagaatgtccctcctagtaaacatcatcagcagcccccgcacaattcactaccaaaacctgagcctgaagctaagacccggggtgaaggggatggtcgcggatgtgaaaaggcagagagaaggcccgaacgccccgaggtcaagaaggaaccccccgtaaaggccaatggactcccagccggtcccgaaccagcctcagagccggggagtccttacccagagggccccagagtgcccggcggaggcgagcaacccgcgcagccaaacggttggcagtaccacagcccgtctcgcccagggtccactgccttcccctctcaagacggcgagacagggggtcacagaaggagtttccctccgaggacaaaccccgacaagatcgcccagcgtaaatcttccatgaaccaactgcagcagtgggtgaacctccggcgtggcgtgccgccacccgaagacctccgatctccgtcccggttttatcccgtatcccgtcgggtccccgagtactacggtccatactctagtcagtaccccgacgactaccagtactacccccccggggtccgacctgagagtatctgttccatgcctgcttatgacaggatttccccaccctgggccctggaggataaacgccacgctttccggaacgggggtgggcctgcctatcaactgcgcgagtggaaagagcctgcttcttacggccgacaggacgcgacagtttggatcccttcaccctccagacagccagtctattatgacgaactggacgccgcttctagcagcttgcggaggcttagcctgcagcctaggagccatagcgtgccacgcagcccgtcccagggttcctatagtagggcaaggatctactctcccgtgcggtcaccatccgcgagatttgaaaggctgccgcccagatccgaggatatctacgccgaccctgccgcctacgtgatgcgacggagcatctccagcccaaaagttcccccctatccagaggtcttcagggactctttacacacttataagctgaacgaacaggacaccgataagctgttgggcaagctatgcgaacagaacaaggtggttagggagcaagaccgcctcgtgcagcagctacgcgctgaaaaggagagtctcgagtcagcgctgatgggtacccaccaggaactggagatgttcggatctcagccagcctacccagagaagctccgccacaaaaaagactctctgcagaaccagcttatcaatattcgagtggagttatctcaggcaacaacggcacttactaactcaaccattgagtacgagcacctggaatctgaggtgagcgccctgcacgatgatttgtgggaacagctgaacctcgacactcagaatgaggtgctgaatagacaaatccagaaggagatctggcgcatccaagacgtgatggagggtctacggaagaataatcctagtcggggcaccgatacagccaagcaccgcggcgggctgggcccatctgccacgtactcttctaattctccagcctcacccctcagctctgcatcacttaccagccctctttcccccttctccctggtatctgggtcgcaggggagcccaaccaagcccggctccaatgagcccaaagccaattatgagcagagcaagaaggacccacaccagacactccccctggacacacccagggatatctctctggtgccaaccagacaggaagttgaagctgagaagcaggccgccctgaacaaagtcggcgtggttcctccccgcaccaaatcaccgaccgatgacgaagtgactccctccgcggtggtgaggcgcaatgcgtcaggcttaacaaacggactttcaagtcaggagagacctaaatctgctgtcttccctggagagggtaaggtcaagatgagtgttgaggagcaaatcgaccgaatgagaagacaccaaagcggaagtatgcgcgaaaagagaagatctctacagttaccggcctcaccagcccccgatcctagtccccggccagcctacaaggttgtgaggagacaccgatctatccacgaggtggacatttcgaacctggaggctgctctgcgagccgaggaaccaggtggccatgcttacgagacaccgcgggaagaaatcgcccggctccgtaaaatggaactggaaccccaacactacgacgtagatatcaataaggaattgagcacccccgacaaagttctgatcccagagcggtacatagatcttgaaccagatacgccgctttcacccgaagaactcaaagaaaaacagaagaaagtggaaagaatcaaaacactgatcgcaaagagcagcatgcagaacgtcgtgcccattggggaaggggatagtgtggatgtgccacaggactctgagtcccagctccaggagcaggaaaagagaattgagatttcatgcgcgcttgctaccgaggcctcgcgacgtggccgcatgctatctgtgcagtgcgccaccccgtctccgccgacatcgcctgcttcccctgcgcctcctgccaacccgttgtcaagcgagtcacctcgcggagctgacagcagttataccatgcgggtttag

SEQ ID NO: 31994 - DNA, 315 bp, Artificial Sequence
  Description of Artificial Sequence: Synthetic coding sequence
agggcccgaatctactccccagtacgctccccttcagcacggtttgaacgcctgcccccaaggtctgaagatatttacgccgaccctgcggcatacgtcatgaggaggtccatttcgagccccaagatgtccgagagtgaaacactaattagcatggtgaaccgaatggtggagaacagctcccccagatcacaactgttcatgcaggttcctccctatcctgaagtctttagggacagcctccatacctataagctgaacgagcaggatacagacaaacttcttggtaagctgtgcgagcagaataaggtttag

SEQ ID NO: 31995 - DNA, 456 bp, Artificial Sequence
  Description of Artificial Sequence: Synthetic coding sequence
cgcgcccgcatctactctccagtgaggagtccttctgctagattcgagcggctgccgccgagatctgaggatatatacgccgaccccgctgcatacgtcatgagaaggagcattagcagcccaaagtacgactatctgggagataggcggccagttcctgcagggcttttcccgtacaactacccaccaagtcccaccgtgcacgataagatggatgaactgctggacctgcagcttcagcgtaatctggagtacctagaccagcagatgtccgagtcagaaaccctgattagcatggttaaccgtatggttgagaatagtagccctagatcgcaactgtttatgcaggtaccaccttaccctgaggtgtttcgtgacagcctgcacacttataagctgaatgaacaggacacagataaactccttggaaagctgtgcgaacagaataaggtgtag

SEQ ID NO: 31996 - DNA, 375 bp, Artificial Sequence
  Description of Artificial Sequence: Synthetic coding sequence
cgcgctcggatatacagccctgtacgtagtccttctgcccgcttcgaacggctcccgccacggagcgaggacatatacgcagatcccgccgcttacgtgatgaggagaagcatcagctccccaaagtacgactatttaggagacaggcgacccgtccccgccggcctcttcccatacaactaccccccttcgcctactgtgcatgataagatggatgaactactggacctacagctgcagaggaacctggagtacctggaccagcaggtgcctccctatcccgaggtcttccgggattctttacacacctataaactaaacgaacaggacaccgacaagcttctgggcaagctttgcgaacaaaacaaggtatag

SEQ ID NO: 31997 - DNA, 252 bp, Artificial Sequence
  Description of Artificial Sequence: Synthetic coding sequence
cgcgcaagaatctactcccctgttagatctccttcagctcggttcgagagactgcctccacggtccgaagacatttatgccgaccccgccgcctatgtaatgaggagaagcatctcttctcccaagtatgattacctgggtgacaggcgacccgttcctgccggcctgttcccctacaattaccctcctagtccaactgtgcacgataaaatgaagctgttgggaaagctctgtgagcaaaataaagtgtag

SEQ ID NO: 31998 - DNA, 402 bp, Artificial Sequence
  Description of Artificial Sequence: Synthetic coding sequence
agggctaggatttattcaccagtgcgctccccatccgcccggtttgaacgcctgccgccccggagtgaagacatttacgccgatccggctgcctacgtgatgcggcgaagtatcagtagcccaaaatatgattacctgggtgatagaagacccgtcccagcaggtttgtttccttacaactatccccccagtccaacagttcacgataaaatgatgtcagagagcgaaactctaatttcgatggtcaatcgtatggtggaaaacagcagtcctaggtcccagctattcatgcaggtgcccccatatcctgaggtgtttcgtgattccctacatacatacaagctcaacgagcaggacacagacaagctcctaggaaagctgtgcgaacaaaacaaagtgtag

SEQ ID NO: 31999 - DNA, 1386 bp, Artificial Sequence
  Description of Artificial Sequence: Synthetic coding sequence
atgaataattttggtaatgaggaatttgattgccacttcctagatgaggggttcaccgccaaggatatcctcgaccagaagataaatgaagtcagcagtagcgatgataaggacgcattttatgtcgccgacctaggagacattctgaagaagcacttgaggtggctgaaagctcttcccagagtgacccctttttatgcagtgaaatgtaacgactctaaggctatcgttaaaaccctcgcagcaaccggcactggattcgactgtgcgtctaaaaccgaaatccagctggtacaatcccttggagttcccccagaaaggattatctacgcgaacccttgtaaacaagtttctcagatcaaatatgccgccaataacggcgtgcaaatgatgactttcgattcagaggtggaactcatgaaggttgcccgggcacacccaaaggctaaactcgtccttcgcatcgcaacagacgatagcaaggctgtttgcagactgagcgtcaagtttggcgctactctccggacttctcgccttctgctggagcgcgctaaggagctcaacattgacgtggtcggagtgtccttccatgttgggtctggatgtacggacccagaaactttcgtccaggctatttccgacgcccgatgcgtgtttgacatgggggctgaagtaggctttagtatgtatttacttgacattggtggtggttttcctggcagtgaggacgtgaaactgaaatttgaggagattacgggggtgatcaaccccgccttggataagtacttcccatcggactcaggcgtgcgcatcattgctgagccaggtcggtactacgtggcatccgccttcacccttgcagtgaatataatcgcgaaaaaaatcgtactgaaagaacagacaggatcagacgatgaggacgagtctagcgaacagacctttatgtattacgtcaatgacggagtatacggcagctttaattgtatcctctatgatcatgctcatgttaagcccctattacagaagagaccaaaaccagacgagaagtactactccagctcaatctggggcccaacttgcgatggcctcgatcgtattgtagagcgttgcgaccttcctgaaatgcacgtcggtgactggatgctgttcgaaaacatgggggcctacaccgtggccgccgcaagcaccttcaacggatttcaacgtcccaccatttactacgtcatgtcaggtcctgcttggcagctgatgcaacaattccagaaccctgacttcccacctgaggtagaggagcaggacgcgtcaacactccccgtcagctgcgcctgggagtccggtatgaaaaggcatcgggctgcttgtgcctctgctagcataaacgtctag

SEQ ID NO: 32000 - DNA, 930 bp, Artificial Sequence
  Description of Artificial Sequence: Synthetic coding sequence
atggccttcgtgaaatcaggatggcttctcaggcagtcaacaatactgaaaagatggaagaagaattggttcgatctgtggtctgacgggcatttgatttactacgatgatcagacaaggcagaatatagaggacaaggttcacatgcctatggactgcatcaacattcgcactggccaggaatgtagagatacccagccacctgacggtaagtctaaggactgcatgctgcagatcgtatgcagggacgggaagacgatctccctgtgcgctgaaagtaccgatgactgcctcgcttggaaatttacactacaggattccagaactaacacggcgtatgttggcagcgctgtaatgacagacgaaacttccgtcgtgagctcgcccccaccctatacagcttatgcagctccagcgcccgaagaactgcacagcaagggtcctaaaatccatacaacgacctccgccaagactcaggccgtccttccgacccgatgcttctttccgtctgagagtcctattcggcgatcagtgcaaatctccgtcctactgcctgctgttaacatacggcgtagaatcaagttgacgttccctcagccggcacgcccgagggcccctcgaagcctgtgcctttggcagacctggtttgccggaaagcgcgcgccaagtctacccacagccgccactgctcccgccctacccagctgccctagtccccctgccccgtcacaggccctgccccctagccttgcaggctggcgcagcccctcctccgcgccactcccgccagaacaggcgttagcgccaagaagctttcagctgagcaagcatcaggctagaccaaggccacatcgacccggcaccccaccagtgcctgcatggccaggcgtacctccacctccgcctgccagacctcccgctctacgctag

SEQ ID NO: 32001 - DNA, 669 bp, Artificial Sequence
  Description of Artificial Sequence: Synthetic coding sequence
atggcatttgtgaaaagcgggtggctgcttagacagtctacgattctgaagagatggaaaaaaaattggttcgatctttggagcgatgggcacttgatctattatgatgatcagacgaggcaaaacatagaagataaagttcatatgcctatggattgtatcaatattcgtacgggacaagaatgccgggatacacagccccccgatggtaagtccaaggattgtatgttgcagattgtctgtagagacggtaaaaccatatcattgtgtgccgaaagcacagatgattgtctggcttggaagtttacgcttcaggattccaggaccaacactgcttacgtaggcagcgcggtgatgacagacgaaaccagcgtggtgtcaagtccacccccttatactgcttacgccgccccagctcctgaacaagcatacggatacggaccgtatggcggtgcttacccaccaggcacacaggtggtatacgctgctaatggccaggcgtatgctgttccctaccagtatccttacgccgggctctacggtcagcaacccgcgaaccaggtcatcatccgcgaaagatatcgcgacaatgatagtgatttggctttaggcatgcttgcgggagccgccacaggtatggcgttgggatccctcttctgggtcttctag

SEQ ID NO: 32002 - DNA, 930 bp, Artificial Sequence
  Description of Artificial Sequence: Synthetic coding sequence
atggcatttgtaaagtctgggtggcttctccgccaatctactatcctaaaaaggtggaaaaagaattggttcgacctgtggagcgatggacacttaatctactatgacgaccagacaagacagaacattgaggacaaggtgcatatgcctatggattgcattaatataagaaccggacaggaatgcagagatacgcaaccccccgacgggaaatccaaagactgcatgctgcagatagtctgcagggacggaaagacgatttctctgtgtgctgaatcgactgatgactgtctggcctggaagttcaccttgcaggacagccggactaacacggcctatgtgggctctgctgttatgactgatgaaaccagcgtagtgagcagcccgcctccatatacggcctatgctgcccccgcccctgaggaactccatagtaagggccccaagatacacaccactacatcggctaagacccaggctgtgctgcccaccagatgcttctttccttcagagagccctatccgacgaagtgtgcagatctccgtcctgttgcctgccgtcaacattcgtcgtcggattaagctgacgttcccacagcccgcccgtcctcgcgcgcccagatccctgtgcctgtggcagacatggttcgccggaaaaagagctccgtctctcccaacagcagccacggccccagcgctgcccagctgcccctcaccaccggcccctagccaagctctacccccatcacttgcaggatggaggagtcctagctccgctcctctcccgcccgaacaggcccttgcgcctagatctttccagctctcaaagcaccaggctagaccccgcccccaccgccccgggacaccccccgtgcctgcctggccaggcgttcctccaccaccacctgctcggcctcctgccctccggtag

SEQ ID NO: 32003 - DNA, 669 bp, Artificial Sequence
  Description of Artificial Sequence: Synthetic coding sequence
atggcattcgtcaaatcaggttggttgctccgtcaaagtacaatcctaaagcgctggaaaaagaactggttcgatctgtggagcgacggtcatctgatctattatgacgaccaaactcgtcaaaatatcgaggataaagtgcacatgccaatggattgtatcaatataagaacaggacaggaatgccgagatacacagccacccgacggcaagagcaaagactgtatgcttcagatagtgtgcagggatgggaaaactatttccctgtgtgccgaaagcactgatgactgcctcgcatggaagttcacccttcaggactctcgcactaacaccgcctatgtgggctctgcagtgatgaccgatgaaaccagtgttgtgagctctccccccccttatacagcgtacgctgctcctgcccctgaacaggcctacggctacgggccctacggcggagcatacccccctggaacgcaagtcgtctacgctgccaatggacaggcctacgcagtcccataccaatatccctatgccgggctgtacggacagcaaccagccaatcaagtgatcataagggagcggtaccgtgataatgactccgatctggccttggggatgcttgctggcgccgccactggtatggccctgggtagtttgttctgggtattttag

SEQ ID NO: 32004 - DNA, 669 bp, Artificial Sequence
  Description of Artificial Sequence: Synthetic coding sequence
atggctttcgttaaatccggatggctcttgcgccagtcaaccattctcaagcgctggaagaagaactggtttgacctctggagcgacggtcatttgatttactatgacgaccagaccaggcagaatatcgaggacaaggtccacatgcccatggattgtattaacatacgaacaggccaggaatgcagagatacccagccgccagatggcaagtccaaagattgtatgctgcaaatagtatgccgtgatggaaagactatctctctgtgtgctgagtccacggatgactgtctcgcctggaagttcacactgcaggacagtagaactaacacagcctatgttgggtcagccgtgatgaccgacgagactagcgttgtttcatcgccacccccgtacactgcgtatgctgcaccagctcctgagcaagcctacggctatggaccctacggaggggcttatccccccgggactcaggtcgtctacgccgcaaatggacaagcttacgccgtcccgtaccagtatccatacgcaggtctctacggccaacagcccgccaaccaagttatcatacgcgaaagatatagggataacgattctgatctggcactcggcatgttggcaggcgccgctacaggaatggccttaggatccctgttttgggttttttag

SEQ ID NO: 32005 - DNA, 537 bp, Artificial Sequence
  Description of Artificial Sequence: Synthetic coding sequence
atggccttcgtcaagagtggctggcttctacgtcagtccacaatcctgaaaagatggaaaaagaattggttcgacctgtggtcagacgggcacctcatttattacgacgatcagaccagacagaatatagaggataaagtgcacatgcctatggactgcattaacattcggacaggtcaggagtgtagagacacccagccaccagatggaaagtctaaggattgtatgttgcaaattgtctgtcgcgatgggaagacaatcagtctgtgcgctgagagcaccgacgactgcttggcctggaaatttacattgcaagactcaagaacaaacacagcatacgtggggtccgccgtcatgaccgacgagacgtctgtggtctcctcacctcccccatacacagcatacgccgcgcccgctccagaagatttcatggacagctctctgctaacgaagtcgagctttgagagcgccattgagaccactacggcgacatggcattgggcctgttggcaggaacaacctcgggcctggccatag

SEQ ID NO: 32006 - DNA, 513 bp, Artificial Sequence
  Description of Artificial Sequence: Synthetic coding sequence
atggcattcgtgaagagcggatggctgctcaggcaatcgacaattctgaagcgatggaagaaaaactggttcgatttgtggtccgatgggcacctcatctattacgatgaccaaacccggcagaatatcgaggataaagtccatatgccaatggattgtattaacattcggacaggccaagagtgcagagacacacaacctccagacgggaagagcaaggactgtatgctacaaatcgtctgcagggacggtaagacgatcagcctttgtgcagaatccactgacgattgcctccttatggcgatgggccatacagtagtgcgaaccaggcaggaactcaagctcagtacgcttaggatgggccggagaatgccctgcccaacaagtacccacatgcaggactttatggactcatccctgctaaccaaatcatcatttgagtctgctattgagacgacaactgcaacatggcactgggcctgctggcaagaacagcctcgagcttggccttag

SEQ ID NO: 32007 - DNA, 525 bp, Artificial Sequence
  Description of Artificial Sequence: Synthetic coding sequence
atgccaatggattgtatcaacattaggaccggccaggagtgtcgggacacacagcccccggatggaaaatctaaggattgtatgctccaaatcgtgtgtcgcgatggcaaaacaatctccctgtgtgccgaatccacagacgattgtctcgcttggaagttcactctccaagactccagaaccaacactgcatacgtgggcagcgctgtaatgacagacgagacctctgtggtgtcatcccctcccccatatacagcatatgctgcgccagccccagaacaggcatatggctacggcccatacggtggagcctatccccctggaacgcaggtagtctacgccgctaatgggcaggcatatgctgtcccttatcagtatccttatgccggtctgtacggacagcagcctgcaaatcaggtcataataagggagagataccgcgacaatgatagtgatctggccttggggatgctggcgggcgcagccaccggtatggccctggggagcctattctgggttttttag

SEQ ID NO: 32008 - DNA, 1521 bp, Artificial Sequence
  Description of Artificial Sequence: Synthetic coding sequence
atgttcactagtaaatcgaactcagtttctcctagcccttctctcgagcaagcagactcggatgctctggatatcagcactaaagtgcagttgtacggagtcctttggaaacgccctttcggccgcccatcagcaaaatggtcacgccggttctttattattaaagagtctttcctgctgtactactccgagtcagaaaagaagtcattcgagacgaacaagtacttcaatattcaccctaagggcgtgatcccactggggggatgccttgtagagcctaaggaggagccctcaatgccctatgccatgaagatcagccatcaagatttccatggtaatattctgctggcggccgagtccgagtttgagcagacccaatggctcgaaatgctgcaggagagtggcaaggttacatggaaaaatgcccagctgggtgaggccatgatcaagagcctggaggctcaggggctccaattggccaaagagaagcaagagtacctcgataaattgatggaagagacagaggagctttgtctgcagcgggagcaacgagaggagctggaacggctgaaccaggtgcttgaagcagaaaagcagcagttcgaggaggtggtgcaggagctcaggatggaacaggagcagattaagcgggagctggaattgaccgcacggtgcctgaagggggtagagcaggaaaaaaaagagctcagacacctgaccgagtccctccagcaaacgctggaagaactgtctattgaaaagaagaagactttggagatgctggaggagaacgagaatcatttgcagaccctcgcaaatcagtccgaacagcccccgccctcgggaggcttgcactctaaccttagacaaattgaggaaaaaatgcaacaactgctggaggagaagctgctggccgagaaaagaatgaaggagaacgaggagagatcccgcgcgctcgaggaggaacgggagttctattctagtcagtctcaggcgctgcagaactccttgcaggagctgactgccgaaaaacagcaggctgaacgcgaactaaaagctgaagtcaaggtgaggatggacctagaacgaagacttagggaagccgagggggccctgcgaagtctggaacaaggactgaattcaaaagtcagaaacaaagagaaggaagagcggatgcgagccgacgtgagtcatcttaagaggttcttcgaggaatgcatcaggaatgcggagctggaggcaaagatgccagtaatcatgaagaacagtgtgtacattcacaaggcggctacaagacgcattaaatcatgtcgcttccacaggagacgcagcagtacgtcatggaacgacatgaagccctcccagtcatttatgactagtcaactggacgctaacaatatggaagaactgaaggaggtggccaagcgactgagtcgcgaccagcgtttcagagaatcgatttatcacataatggcaacacaacctggggcgccatctgcccttagccgggggggcaagtag

SEQ ID NO: 32009 - DNA, 4158 bp, Artificial Sequence
  Description of Artificial Sequence: Synthetic coding sequence
atggagctctccgattccgatagacctgtgtcctttggaagcaccagtagctctgcaagttcacgggactcacacggctcattcggaagccggatgactctggtcagcaattcccacatgggcctctttaatcaggacaaggaggtgggagccatcaagctggaactgattcccgctagaccattcagcagctctgagctccagcgcgacaacccagccacaggacagcaaaacgcagatgaaggctctgagcgcccccctagggcacagtggcgggtcgattctaacggtgcccctaagaccattgccgacagtgctacctctcctaaattgctgtatgtcgatcgggtcgtccaggagattttggaaacagaacgcacttacgtgcaagacctgaaatccatcgtggaagattacctggattgtatccgtgatcagaccaagttgcccttggggaccgaggaacggtcagccctgtttgggaatattcaggatatttaccactttaactctgaactccttcaggatctcgagaactgcgagaatgatcctgttgctatcgccgagtgttttgtatctaaaagcgaggagtttcatatctacacccagtactgcacaaactaccccaggtccgtggctgtcttaacagagtgcatgcggaataaaattctagcgaaattttttagggaacggcaagagacactgaagcacagcttgccactgggaagttacctgctaaagcctgtgcagagaatattaaagtatcatttgctgcttcacgagatagagaaccacctggataaggacacagaggggtatgacgtggtgctcgatgccatcgacactatgcaacgggtggcctggcacattaacgacatgaaaaggaagcacgaacatgctgttagactccaagagattcagtctctgctgaccaactggaagggtcctgacttgacttcctatggcgagttggtactagaagggacgttcaggatacaaagagcgaaaaacgagagaacgctgttcctgtttgacaagcttttgcttataacgaaaaaacgcgatgacacatttacctataaggcacatattctgtgcgggaatctgatgctcgtggaggtgatccctaaggaaccactgtcctttagcgtctttcattacaagaatccgaagctccagcacaccgtgcaggctaagtctcaacaagacaagcggctctgggtgctccacttaaagcgcctgattctggaaaatcacgcagcaaagatccccgcaaaagccaaacaggcgatacttgagatggacgcaatccatcacccggggttttgttactcaccggaaggaggcacgaaggcattatttgggtcgaaagagggaagcgctccctacaggctgagacgcaagtctgaaccctcttctcgctcccacaaagtactcaaaactagcgaaaccgcccaggatattcagaaggtctcccgggaagagggtagcccacagctcagtagcgcccggccatccccagctcagcgtaattcacagccctccagctcgacaatgatatctgttctgagggccggaggggcactgaggaatatttggaccgaccaccaaatcagacaggcacttttcccctcaaggcggtcacctcaggagaacgaggacgacgaagacgattaccagatgttcgttcctagttttagtagtagcgatcttaattctactcgactctgtgaggacagcacatcttctcggccatgctcttggcacatggggcagatggagtctacagaaactagtagtagcggtcacaggatagttcgccgcgccagcagtgccggagagagtaatacctgcccacctgagatcggtacctccgataggacgagggaactgcagaacagcccaaaaacagaaggtcaggaagagatgaccccattcggtagcagtatcgagttgaccatcgatgatattgatcatgtttacgataacattagctatgaggacctcaagctgatggttgccaaacgggaggaggctgaaagcacccccagtaaaagtgcgcgggactctgtgcgacctaaaagtactcccgaattggcctttaccaagcggcaggccggccacagtaaggggagcctgtacgcccagacagacggaacgctatcaggaggtgaggcttcatcccagtccactcacgaactgcaggctgtggaggagaatatctacgacaccattgggctgcccgacccaccatccctcggatttaaatgttcaagtctcaagcgggctaagagatccaccttcctgggccttgaggcagactttgtttgttgcgactcactccgcccatttgtctcccaggattcattgcagctgagtgaagatgaggctccctatcatcaggccacaccagatcatggctacctctccctgctttacgatagtccttccgggaatctttctatgccacataaaccagtgagcgataagctgagcgaagaggtcgatgagatctggaacgacttagagaactacataaagaagaatgaagataaggctagagacaggctactcgcagcatttcctgtgtctaaagatgacgtgccggacaggctgcacgccgagagcaccccggaactatcccgcgacgtaggcaggtcagtgtctaccctgagcctgcctgaatcccaagcattattgaccccggtcaagagtagagccgggagggcttcaagagctaattgtccgttcgaagaagatcttatatctaaagaaggctcatttatgagtcttaatcgcttaagcctcgcctccgaaatgcccctgatggacaatccatatgatctggcaaatagtggattgtctcagactgatccggagaatcccgatttggggatggaggcaactgacaagaccaagagccgggtctttatgatggctagacagtattcccaaaagatcaagaaagccaaccaactgctcaaagtcaagtccctggaactggagcaacctccggcctctcagcaccaaaaaagtatgcataaggatctggctgcaattctagaggagaaaaagcaaggaggacctgctattggggctaggatagctgagtatagccagctatacgaccaaatcgtgttccgtgagtctccgctgaagatccagaaggatggttgggcatccccccaggagtctagtctgctccggagcgtcagcccctcccaagtgcatcatggatctggcgactggttactccacagtacctacagtaacggtgaactggcagatttctgcctgcctcccgaacaggacttacgctccagataccctacattcgagatcaatacaaaaagcacaccccgacagctttcagctgcctgtagtgtgccttccttgcaaacatccgaccccttgcccggcagcgttcagagatgtagtgtggtcgtgagccagcctaacaaggagaactggtgccaggaccacctgtacaattctctaggacgaaaaggcatcagcgccaaaagccagccctaccatcggtcgcagagctccagctcagtgctcattaacaaaagtatggactccattaactatcctagtgatgtgggtaagcagcagttgctgagtctgcatcgctcctcccgctgtgagtctcatcaggatctgcttcctgacatagctgactcccatcagcaagggacggaaaaactttctgacctgacactgcaagactcacagaaagttgtggtcgtgaatcgcaacttaccactgaacgcccagattgccacacagaattatttctcaaatttcaaagaaaccgacggtgatgaagacgactacgtggagattaagtcagaggaagatgaatctgagcttgaactgtcccacaatagaagacggaaatccgacagtaagtttgttgacgccgacttctcagacaatgtgtgctcagggaacactttgcactccctaaatagcccacgcactcccaagaagcccgtgaattctaaactcgggcttagtccttatctgacgccctacaatgacagcgacaagttgaatgactacctgtggagggggccttcgcccaaccagcagaacatagtgcagtctctgcgcgaaaagtttcaatgcctcagcagttccagttttgcatag

SEQ ID NO: 32010 - DNA, 141 bp, Artificial Sequence
  Description of Artificial Sequence: Synthetic coding sequence
atggaattatcagactccgatcggcctgttagctttggatcaacgtcaagctctgcatcaagccgcgactcacacggaagcttcgggtccagaatgacattagtctccaattcccatatgggcctctttaaccaagactag

SEQ ID NO: 32011 - DNA, 4158 bp, Artificial Sequence
  Description of Artificial Sequence: Synthetic coding sequence
atggagctcagcgattcggacagaccggtttcattcgggtccactagcagctctgcctcttctcgtgattctcacgggtcattcggctcccgcatgactctggtgtccaattctcatatggggcttttcaaccaggataaggaggtgggtgctatcaaactggaacttattccggcgagaccattctctagctccgagctccagagagacaacccggctaccgggcagcaaaacgccgatgagggctcagagcgccctccccgagcccaatggagggtcgatagcaacggcgcgccgaaaactatcgcggacagcgcaacttccccaaagctactttacgtggatagagtcgtccaggagatcctcgagaccgagcggacgtacgtccaggatctgaagagtatcgttgaggattatcttgactgcattagagatcagactaagctacctttgggaactgaggagcgcagcgccctgtttgggaacatccaggacatatatcatttcaattccgagttgttacaggacttagaaaattgcgaaaacgatccagttgcaattgctgaatgtttcgtcagtaagtctgaggagttccatatttacacccagtactgcacaaactacccacggagtgtggcagtgctgacagagtgcatgcgaaacaaaatcctggccaagttctttcgtgagagacaggaaacacttaaacactccttacccctcggcagctatctccttaagccagttcagagaattctgaagtatcatctgctcctacacgaaatcgaaaatcaccttgacaaggacactgagggctatgacgttgtgttagatgccatcgataccatgcagcgcgtggcttggcacattaacgacatgaagaggaaacatgaacatgctgtgaggcttcaggaaatccaatcccttctcaccaactggaaaggccccgatcttaccagctacggggaactggtgctcgagggaacctttcgtatccagcgggcaaagaatgagagaactctgttcttgttcgataaactgctcctgataaccaagaagcgcgatgacacattcacgtataaggcccacatcttgtgtggaaatctcatgctcgtggaagtgatccctaaagagccactgtcattttctgtgtttcattataagaacccaaagctacagcatacggtgcaggccaaaagtcaacaggataagcgtctgtgggtcctccatttgaagcgcctgattctggagaaccacgcagctaagattccagccaaggctaagcaggccattctggagatggacgccatccatcatccgggtttctgctatagtcctgaaggcgggactaaagcccttttcggatcaaaggaaggttctgcaccttaccgtctgcgacggaaaagtgagccaagttctcggagccacaaggttttaaaaacctccgaaaccgcccaggatattcagaaggtgagtcgggaggagggctctcctcagctgtctagcgcccgcccttccccagcccagagaaacagtcaaccgtcttcaagcactatgatttcagtccttcgggctggcggcgcccttagaaacatttggacagaccaccagattcggcaggccctgtttccaagtcgccgttcaccccaggagaacgaggacgacgaggatgactaccaaatgtttgtgccttcattttcgtcctccgatctgaacagtacaagactgtgcgaagattccacatcttccaggccgtgctcttggcatatgggccagatggagagtaccgagactagttcttccggtcaccggatagtccggcgagctagctctgccggcgaatcaaatacatgccccccagagattggaacaagcgatagaactcgagaactgcagaactcaccaaaaacggaaggccaggaagaaatgacacctttcggcagcagcattgagctgactatcgacgacatagatcacgtgtatgataatatttcctacgaggaccttaagttgatggtggctaagagagaggaagctgagagcacacctagtaagagtgcccgcgacagtgtgagaccaaagtctacccccgagctggcctttaccaaaaggcaagcgggccattccaaaggttctttgtatgcgcaaacagacggaacgctatcaggtggcgaagccagctctcagtcaactcacgagctccaagccgtggaggagaatatctacgacaccattggactccctgaccctccctcattggggttcaaatgcagttccctgaagagagccaagagaagcaccttcctgggactggaggccgacttcgtgtgctgcgattcacttagaccttttgtttcacaggacagcctgcagctgagcgaggacgaggccccatatcaccaggccacaccggatcacggctatctcagccttctttatgacagtcctagcggtaacctttccatgccccacaagccggtgtctgataagctgtcagaggaggtcgacgagatttggaatgacctcgaaaactacattaagaagaacgaggataaggcacgcgaccgcctgcttgctgcttttccagtctcaaaagatgatgtccccgaccggctgcacgctgaaagtactcctgagttatcacgggacgtcgggagatctgtctccacactgtctttgccggagtcccaggctctactaacaccagtgaaaagtagggcgggacgcgcctcccgagccaattgtcccttcgaagaggacctcatttctaaggaaggttcttttatgagtttaaaccggctatcactagcgagcgagatgcctctgatggataatccatatgacctggccaacagcggcttgtcgcagaccgaccccgaaaaccccgacttagggatggaggccactgataagacgaagtctcgggttttcatgatggctcggcaatacagccagaagatcaaaaaagctaaccagttactgaaggtgaagtcgcttgaactggaacagccccctgcttcacagcaccagaagtcaatgcacaaagacctggctgcaattctcgaagagaagaaacaggggggacccgcaatcggagcacgaatagcggagtactctcagctgtatgatcaaattgtgttccgggaatcaccacttaagatccaaaaggatggttgggcctcccctcaggagtcttcacttctcagatcagtgtctccatcgcaagttcatcatggctccggggattggttgcttcatagcacctactcaaacggagaacttgctgacttttgtttacctcctgagcaggacctgcgctcccgataccccactttcgagatcaacaccaagtcaactcctcgtcagcttagtgccgcttgctctgtcccctccctccaaacttctgaccctctgccaggaagcgtgcagcggtgctcggtggtggtgtctcagcctaataaagaaaactggtgccaggatcatctatataatagcctagggcgcaagggcatcagtgcaaagtcacagccatatcaccgaagccaatccagctcctcagtgctgataaacaaatccatggatagcattaattatccctccgacgtgggcaaacagcagcttctcagcttacaccgatcgtccagatgtgagtctcaccaagacctgttgccagatatagctgattcccaccagcagggtaccgaaaagcttagcgatttgacgctgcaggacagtcaaaaagtggttgtggttaatcgaaacctgccactcaacgcccagatcgccactcaaaactatttctccaattttaaggaaacggatggagatgaggacgattatgtggaaattaagagcgaggaggacgagagtgagctcgagctttctcacaatagacggcgcaagagtgacagcaagtttgttgacgccgatttttcagacaatgtctgttccggaaataccctgcactctttgaatagcccgcggacgcccaaaaagcctgtcaacagtaaactaggactgagcccctacctcactccttacaatgatagcgataaattaaatgactatctctggagaggcccaagccccaaccagcaaaatatcgtccaatcgttacgagagaagtttcaatgtctttcatccagcagtttcgcctag

SEQ ID NO: 32012 - DNA, 2859 bp, Artificial Sequence
  Description of Artificial Sequence: Synthetic coding sequence
atggaactgagtgattctgaccgtcccgtgtcatttgggagcacaagctccagtgcatcatcccgggattcacatggctcgtttggctccaggatgacactcgtgtccaatagccacatgggacttttcaatcaggataaagaggtgggagctatcaaactcgaactgataccagctcgaccttttagctcgtccgagctgcagcgcgacaatccagcaaccggtcagcagaacgccgacgagggatctgagcgtcctcctagggcccagtggcgcgttgatagcaacggcgcgcctaagaccatcgccgattctgccacctctcccaaacttctctatgtcgaccgggtagtccaagagatcttggagaccgagcgcacatacgtgcaggacctaaagtcaattgttgaagactatctcgattgcatccgcgatcaaacaaagttgccactggggactgaggagcgcagcgccctctttggtaatatccaggatatatatcacttcaacagtgagcttctccaggatcttgagaattgcgagaatgaccccgtggctattgccgagtgtttcgtgagcaagtcagaggaattccatatctacactcagtactgcacaaattacccccgaagcgtagcagtacttaccgagtgtatgcgtaacaaaatacttgcgaagtttttcagagaacgacaagagacgctcaaacacagcctgcccctcgggtcttacctgttaaaaccagtgcagagaatcctcaagtaccatctgctgctgcacgaaatagagaatcacttggacaaagataccgagggctacgatgtggtactcgacgccatcgatacaatgcaaagagtagcatggcacatcaacgacatgaagaggaagcacgaacatgctgtgaggttgcaagagatccaatcactgcttactaattggaaaggccctgatttaaccagctacggcgagcttgttctggaggggacctttcgcattcagagggcaaaaaacgaacggacattattcctgttcgataagctgctgctcattacaaaaaagagggatgatacgtttacctacaaggctcatatcctttgtggtaatctgatgctggttgaagtgatccccaaggagcccctaagctttagtgtgtttcactataaaaatccaaagctccagcatacagtgcaggccaagtcacaacaagacaaaaggctctgggtcctccacttaaaacgactgatattggaaaatcacgccgccaagatccccgcgaaagccaaacaggcaatcctggaaatggacgccattcaccaccccgggttctgctacagtccggaagggggcacaaaggccctctttgggtccaaggaagggtcggccccttaccggctgcgtagaaagagcgagccaagtagtcggtcacacaaggtcctcaaaacatcggagaccgcacaggacatccagaaggtgtctagggaagaagggtccccacagctgagtagcgcccgaccctccccggcccagagaaatagccaaccaagtagttcaactatgatctctgtcctccgggctggcggcgctctccgaaacatatggaccgaccatcagatcaggcaggctttgtttcccagccgacgtagcccccaggaaaatgaggacgacgaagacgactaccaaatgtttgtcccatcttttagttcttccgacctgaatagcactcgactctgtgaagactcaacttcctcgcggccatgctcatggcatatggggcagatggaatcaaccgaaacttcctcatccggccaccgcattgtgcggagagcctcgtcggcaggggagtcaaacacctgtcccccagagatcggcacgtcagacaggacccgagagctgcagaactcacctaagaccgaaggacaggaagaaatgaccccgtttggaagctccatcgaactgaccatcgacgatattgaccacgtatatgataatatctcgtatgaggacttaaagcttatggtggcgaagagagaggaagctgagagcacaccatctaaatccgcacgtgatagcgtgaggcccaagagtaccccagagttagcttttaccaaacgacaggccggccactccaaagggtctctttatgcccagaccgatggtacactttctgggggcgaagcctcaagtcagtccacccatgaactgcaggccgtggaagagaatatctacgacacgatcgggcttcctgacccaccatcacttggattcaaatgcagcagtcttaaacgcgcgaaaaggtcaacattcctgggacttgaagccgactttgtgtgctgtgactctttgcgtccttttgtgtctcaggattcactgcagttgagcgaggacgaagccccataccaccaagcgacaccagaccatggatacctgtcactcctttatgattcccctagtggaaatttgtccatgcctcacaaacccgttagcgataagctgtctgaggaggtcgacgaaatctggaacgacttggagaactatattaaaaaaaacgaagataaagcacgagaccggttgctggccgctttccctgtgtcaaaggacgatgtgccggaccggctccatgcagaaagcacaccagagctgagccgggatgtggggcgctctgttagcacattatcactgccagaaagccaagcacttctgacaccggttaagagccgagctggaagagcctcgagagccaattgcccatttgaggaagacttgatctccaaggagggatcctttatgtccctgaaccggctctccttagcctccgagatgacgctctgccaggccctctgtcgagacgccgcttggtag

SEQ ID NO: 32013 - DNA, 3492 bp, Artificial Sequence
  Description of Artificial Sequence: Synthetic coding sequence
atgcccgtgagcacgagccttcatcaggacggatcacaggagcggcccgtaagcctgaccagcaccacaagttcttcaggatcctcatgcgatagtcggagcgctatggaagaacccagctcctccgaagcacctgctaaaaacggagcagggtcattgaggagtcggcacctgcccaattcaaacaacaattcttcaagctggcttaacgtcaaaggccccttgtctccctttaattcccgcgcggcagccggcccagcccaccataagttaagttacttgggaagagttgtgagggaaattgtcgaaacagagcgcatgtacgtgcaggacctaagatccatcgtcgagtctcaggaattcgatatttacacccagtattgtaataattatccaaactccgtggccgcccttacggaatgcatgagggataaacaacaggccaaatttttcagagaccgccaggagttgctgcagcatagcctgcccttgggatcatatctgcttaaacccgtgcagaggatcctgaaataccacctgctgctccaggaaattgcaaaacattttgatgaggaagaagatggattcgaggttgttgaggacgccattgataccatgacgtgtgttgcttggtacattaacgacatgaagcgcagacacgaacatgcagtccggctgcaagaaattcagtcactgctaatcaattggaaaggccccgacctcacaacttatggcgaattggttcttgagggcaccttcagggtccacagagtgcggaatgagaggaccttctttctgttcgataagaccctgctgattacgaagaaacggggggatcacttcgtttataaggggaatatcccctgttcttccctgatgctcattgagtctacacgcgactccctgtgctttactgtgactcactataaacactcaaaacaacagtattccatccaggctaagactgtcgaggagaagagaaattggacccaccacataaagaggttgatcctagagaaccatcacgccactatcccacaaaaagctaaggaggccatcttagagatggattcttactatccaaacaggtatcgatgctcacctgaacgtttgaagaaggcatggtctagccaagatgaagtttctacaaacgtgcggcaggggagacgccagagcgaacccacaaaacatctcctgagacagctcaatgaaaaggcacgagccgccggcatgaagggcaaaggacggcgcgaatctgagagttcccgatcttcccggcgaccaagtggcagatcacccacatctacggagaagcgaatgagtttcgagtctatttcatctctgcccgaggtcgagcccgatccagaagccggcagcgagcaagaagtattttccgcagtcgaaggacccagcgccgaggaaaccccatccgacactgaatcacccgaagtgcttgagacacagttggatgcccaccaggggctgctgggaatggacccccccggggatatggtggattttgtggctgcagagagcacagaggatctgaaagcactatccagcgaggaggaggaagagatgggaggcgccgctcaggagcccgaaagcctgcttccccctagcgtgctcgatcaggcctctgtcatcgctgagcggtttgtctcctcttttagccggagatcgagtgtggcccaggaagattcgaagtcatctggcttcggctcgccccgtctagtgtcaaggagtagctccgttttatctctcgagggatccgagaaaggcttggctagacacggaagtgccaccgactcgctatcttgccagctgtccccggaggtagacatctccgtcggcgtggccaccgaggacagcccaagtgtcaacgggatggagcctccaagcccggggtgcccagtggagcccgacaggtcttcatgcaaaaaaaaagagagcgctctgagcactcgagacagattgttgttggacaaaattaaatcatattatgagaacgcggaacaccacgacgctgggttttctgtccggcgccgagagagcctgtcttatatcccgaagggcctggttcgaaacagcatctctagatttaattcgctacctcggccagaccccgagccagtgccccccgtggggtcaaaaaggcaggttggctcgcggccaacaagttgggctcttttcgagctacctggcccgagccaagccgttaagggagaccctccgcccatttcagacgcagagtttcgaccctcgtccgagatcgtcaaaatttgggagggaatggagtcgtccggcgggtctccaggcaaaggccccggacagggacaggccaatgggttcgacctccacgaaccgttgtttatactcgaggaacatgagcttggggcaatcaccgaagaaagtgccacagcctcgccagagtcttcatcccctactgaaggcagatccccagctcacctggccagggagctgaaggaattagtgaaggagctctcctccagcactcagggcgagctggtggcaccacttcatccccgaatcgttcaactgagccatgttatggactctcacgtgtccgagcgggtgaagaataaagtgtaccagctcgcaaggcaatattcccttagaatcaaatccaacaaacctgtgatggcacgcccgcctttacagtgggagaaggttgctcctgagcgggatggaaagtcgcccactgtgccttgtttacaggaagaggccggcgagccactaggtgggaagggcaagagaaagcctgtgctaagcctgttcgattacgaacagctgatggcccaggaacatagccctcccaagccttctagtgccggcgaaatgtcgccacagcgctttttcttcaacccatcggcggtatcgcaacgcactacatcgccaggggggcgaccaagtgcccgttcacctctcagccccaccgagactttcagttggcctgatgtgcgtgaactgtgtagtaaatatgctagtcgggacgaggctcggcgagcagggggaggaaggccccgtggcccgcccgtaaatcgtagtcactccgtcccggagaacatggtggaaccccccctgtcaggacgtgtgggccgatgcaggtcattgtcaaccaagcggggtagaggcggaggggaggccgctcagtcccctggcccgctcccgcaaagtaaacccgacggtggagagactttgtatgtcaccgctgacctgacccttgaggacaatcgccgcgttattgtaatggagaaggggccattgccatctccaaccgccggcttagaggagagttcaggccagggcccatcctctcctgtcgctctcttaggtcaagtccaggatttccagcagagtgcagagtgccagcccaaggaggagggttctcgggaccctgcagatccctctcaacaggggagggtacgcaacttacgggagaaattccaggccctcaatagcgtgggctag

SEQ ID NO: 32014 - DNA, 3660 bp, Artificial Sequence
  Description of Artificial Sequence: Synthetic coding sequence
atgcccgtgtcgacgtcattacaccaggatggtagccaggaaagacctgtgtccttaacatctaccacctcctcgtcaggctcaagttgcgattccaggtctgctatggaagagcccagcagctccgaagcccctgccaaaaatggtgccggatcactgcgttctcgacacctgcccaactcaaataacaatagttccagttggctgaatgtcaagggccccttatcacccttcaatagtagggccgccgccgggcccgcccatcataagctgtcctatctgggtagagttgtgcgcgaaatcgttgagaccgaacggatgtacgtgcaggacctgcgttctatcgttgaggactacctgctcaagattattgacacaccgggcctgcttaaacccgagcaggtttcagccctgtttggcaacatcgagaacatttatgcgttaaactcccagctgttgcgcgacttggactcctgtaacagcgatcccgtggccgttgcatcctgctttgttgaaagatcccaagaatttgatatttatactcaatactgtaataattaccccaatagcgttgccgcactgaccgagtgtatgagagacaagcagcaggccaaattctttcgtgataggcaggagctgttgcaacactctctgccactgggcagctacctgcttaagcccgtccagaggattctgaaatatcacctgttattgcaagagatcgcaaaacatttcgatgaggaggaggacggtttcgaggtcgttgaggatgccatcgataccatgacatgtgtggcatggtacatcaatgacatgaaacgtcggcacgagcatgccgtgaggctacaggaaatccagtctctgctgataaattggaagggccctgatttgactacgtatggtgagctggttcttgaaggaaccttccgggtgcaccgggtgcgtaacgagaggaccttcttcctcttcgataagaccctcctcatcacaaagaagaggggggaccatttcgtctacaagggaaacattccgtgctcctccctgatgcttattgaatctacccgcgatagtctttgttttacagtcactcactacaagcactccaagcagcagtatagtatccaggccaagacagtggaagaaaagcgaaactggactcaccacatcaaacggttgatattagagaatcaccacgccaccatcccccagaaagcaaaggaggccatcctcgaaatggacagttactaccctaaccgctatcggtgttcccctgaacgcctcaagaaggcctggtcctcacaggatgaagtgtccaccaacgtgaggcagggaagacgtcagtccgagccaactaagcacctactgcgccaacttaatgagaaggctcgagctgcaggcatgaagggaaagggcaggagagagagcgaatcatcacgctcctcccggcgcccatccggacgttctccaacatccacggaaaaaaggatgtccttcgagagtatctctagcctccctgaggtcgagcctgacccagaggccggctccgaacaggaggtattcagcgccgttgaaggacccagtgctgaagaaactccatcggatacagaaagcccagaggtgctggaaacacagttggatgctcatcagggacttttaggaatggatccccccggggacatggttgactttgttgctgccgagagtacagaggaccttaaggcgctgtctagcgaggaagaagaggagatggggggggctgcacaggagcccgagtctctgctccccccctcagtcctggaccaggcgtccgttatagcggaacgattcgtatcgtccttctcacggcgatcttcggttgcccaggaggacagcaagagcagcggcttcggtagtccccgactggttagcagatcgtctagcgtacttagtctcgagggatcggaaaagggattggctcgccacggtagtgcgactgattctctcagctgtcagcttagtcccgaggtagatatctctgtaggggtcgccaccgaggattctcccagcgttaacggcatggagccaccctcgccaggctgccccgtggagccagaccgctctagctgcaagaaaaaagagtccgccctgtccacacgggacagactgctgctggacaagattaagagctactacgagaacgccgaacaccatgacgcgggattctcggtccgccgccgcgagagtctgagctatatccccaaaggactggtgcgaaatagcatttctcgattcaacagcctcccccggcccgatccagaacctgtccctccagtcggctctaaacggcaggttggctccaggcctacctcctgggctctgtttgaattacctggcccgtcccaggccgtgaagggtgatcctccccctatctctgacgccgaatttagaccaagcagtgagatcgtgaagatctgggaaggcatggagagtagtggtgggtcacctggtaaaggacctggacagggacaggctaacgggtttgatctccatgagcctttattcattctcgaggaacacgaattaggagcaatcacagaggaaagtgctactgccagtcccgagtcctcctcccccacagaaggtcggtcccctgcccacttagccagggagctcaaagaactggtgaaagagttaagctcatccactcagggcgaactggtcgcccccctgcatcctcgaattgtgcagctcagccacgtgatggactcccacgtgtccgagcgcgtgaagaacaaagtttaccaactggcacgccaatatagcctgcgaatcaagtcgaacaaacctgttatggcgagaccaccactacagtgggagaaagtagccccagaacgcgatgggaaatctccaacagtgccttgtctgcaggaggaggcaggtgagccattgggaggcaaaggcaaacgtaaaccagtactctcattgttcgactatgaacagctcatggcccaagaacattccccacccaagccctcttctgcgggcgagatgtctccccagcggttcttttttaacccttctgcggtgtcacagagaactacgtccccaggcggcagaccttcagcacgtagtcccctgtcacccacagagaccttttcttggccagacgtgagagaactgtgcagcaagtatgcctcccgagacgaggcgagacgcgctggaggggggagaccacgaggaccccctgtcaatagaagccactcagtgcctgaaaatatggtcgagcccccattatctggtagagtcgggcgctgccgctcactatccaccaagcgaggacgcggtggcggagaagccgcgcagagcccgggacccctcccgcagtcgaaacccgacgggggggagacgctgtatgtgacagctgacctgaccctcgaggataaccgaagagtgatcgttatggagaaggggccactgcctagtcctaccgccggcctcgaagagagcagtgggcagggcccaagttctcccgtagcgctgttggggcaagtacaggattttcaacagagcgccgagtgtcagccgaaggaggaaggctcgcgagatcctgcggatccgtctcaacagggcagggtgcggaatctgcgggagaagtttcaagccttgaattctgtgggatag

SEQ ID NO: 32015 - DNA, 486 bp, Artificial Sequence
  Description of Artificial Sequence: Synthetic coding sequence
atgcctgtctcaacctcacttcaccaggatggatctcaggagcggcctgtatctctcaccagcaccacttccagtagcggcagctcgtgcgatagtagaagcgccatggaggaaccatcttcatctgaagcccccgctaagaatggggccgggagtctgcggagtagacacctgcccaacagtaataacaattcttcttcttggcttaacgtcaaaggccccctaagcccctttaattccagagctgcggcagggcccgctcaccacaaactcagttatctcggtcgcgttgtcagagagatcgtcgaaactgaaagaatgtacgtgcaggatctcaggtcaatcgtagaagattacctgctcaagattatcgatactcccgggttgttgaagccagaacaggtcagtgctctgtttggaaatatcgagaacatctacgctcttaactcccaactcttacgggatttggattcctgcaactcatag

SEQ ID NO: 32016 - DNA, 567 bp, Artificial Sequence
  Description of Artificial Sequence: Synthetic coding sequence
atgccagtgtccacatctcttcatcaggatggctcacaggagcgaccagtgtcgcttacctcaacaacgagcagctctggtagctcctgtgactctcggagtgccatggaggagccaagttcttcagaggcaccggctaagaacggcgcaggaagcctccgctcccgtcatctcccgaatagtaataataattcctcaagctggcttaacgtgaaaggcccactgtcaccattcaactcaagggctgctgcaggtcctgcgcaccataagcttagttatctggggagagttgtccgagagatcgtggagacagagcgaatgtacgttcaggaccttagaagtattgtggaagattaccttcttaaaattatcgataccccgggcctgctgaaacccgaacaggttagtgcattgtttggaaacattgaaaatatctacgcactcaactcacagctgctgagagatctggactcatgcaattcagatccagtcgccgtggcatcttgctttgtcgagcgctcccaagagttcgatatctacacacagtattgtaataactacccttag

SEQ ID NO: 32017 - DNA, 3816 bp, Artificial Sequence
  Description of Artificial Sequence: Synthetic coding sequence
atggaggccttgcgcaatcctatgccactgggctcgagcgaagaggccctcggggatctggcctgtagcagcttgacaggcgcgagtagggatctgggtacaggcgctgtggcatctgggactcaggaagaaacgtctggtccccgcggtgaccctcagcagaccccgagtctcgaaaaagaacggcatacacccagtcggaccggtccaggagctgctggccgtacactccccaggaggtcccggtcctgggagagggccccaaggtcatcaaggggggcacaagctgcagcttgccatactagccatcattcagccggatcaagaccaggcggacatctaggaggacaggctgttggcacacctaactgtgtccccgtagaaggtccgggctgcactaaggaagaggacgtgctggcatcatccgcatgtgtgtcaaccgacggaggatccctccactgccacaaccccagtggcccttccgacgtgccggccagacagcctcatcctgagcaggaggggtggccccctggaaccggagacttcccttcccaggtgccaaagcaagtcttagacgtcagccaggagttgctgcagtctggggtcgtgacacttccgggcacacgggatcgccacggaagagccgttgtccaggtacggacgcgtagtctgctgtggacgagggagcactccagctgtgctgagctgactcgccttctactgtacttccacagcattcctcgtaaagaggtccgagacctcggattggtggtgctagttgacgcaaggaggagtccggcggccccagctgtctcacaagccctctctggactccaaaataatactagccccatcatacacagcattctgctgcttgtggataaagagtccgcttttaggccagataaggatgctattattcaatgtgaggtcgttagcagcctaaaggccgttcataaatttgtggacagctgccagctaaccgcggacttagacggctcgtttccatatagccatggcgactggatctgtttcaggcaacggctggaacactttgccgctaactgtgaagaagctattatatttttacagaactcattttgtagccttaatactcatcggacaccacgcaccgctcaggaggtagctgaactgatcgaccaacacgagacgatgatgaaacttgtattggaggatcctcttctggttagtctgcgactggagggtggcaccgtgctcgcaaggctgcgcagagaggagcttggcactgaggacagcagagatactcttgaagccgccacttcgctgtatgatcgggtcgatgaagaggtgcaccgcctggtcttaacatccaataatcgcttacagcaattagaacacctaagggagcttgcgtccctactcgaaggcaacgatcagcagtcttgtcagaagggcttgcagcttgccaaggagaacccccaacgcactgaggagatggtgcaagacttcagaagagggctgagtgcagtggtcagtcaggctgaatgcagggaaggcgagctggcacggtggaccagatctagcgaactgtgtgagaccgtgagctcctggatgggcccactcgacccggaggcatgtccttcatcccctgtcgctgagtgcctgcgatcgtgtcaccaggaggccacatctgtggctgcagaagcctttcctggcgccggcgtcgctgtgctgaaaccacacgctctggggaagccctgggcgtcgcaacaggatctgtggctgcagtatcctcaaacccgactgaggctggaggaggccctttcggaagccgctccggatccatcactgcccccactagcccagtcaccccctaaacatgagagggcacaggaagccatgagacggcatcaaaagcctccaagtttcccttccactgattccggagggggggcctgggagcctgcccagcccctttcaggactccccgggcgggctctcctttgtgggcaggatggcgagaccttgagacctggtctttgtgccctgtgggatccactttccttgctgcggggattgcctggagcaggcgcaaccacggcacaccttgaggatagttcggcctgctctagcgagcccactcagacattagccagtagaccgcggaaacaccctcagaagaagatgataaagaaaactcagagcttcgagatcccccagcccgatagcgggccccgtgacagttgtcagcccgatcacacaagcgttttctctaagggcctggaggttacatctacagtcgcgaccgagaagaagctgcccctgtggcaacatgccaggtccccacccgtcacgcagtctcgatccctgagcagcccttctgggcttcaccctgcagaggaagacggcaggcaacaagtgggctccagtaggctgcggcatatcatggccgagatgattgccacagagagagaatacataagatgcctggggtatgtaattgacaattacttcccagagatggagcgaatggacttgccgcagggactgagaggaaagcaccacgtaatctttggaaatctggagaaactgcatgattttcaccagcagcacttcctacgtgaacttgaacggtgccagcactgccccctggccgtcgggagatcatttctgcgacacgaagagcagtttggaatgtatgttatttacagcaagaacaagcctcagtcagacgccctgctcagctcccacgggaatgctttctttaaggataaacagagggaacttggggacaagatggatctggcatcctaccttctgaggcctgtgcagcgcgttgctaagtatgccctcttgctccaggacttactgaaggaggctagttgcggcctcgcccaaggccaggagctcggcgagctgagagccgctgaagtggtggtctgtttccagctccgtcacggaaatgacttgctcgctatggacgccattagagggtgcgatgtcaatctcaaagaacagggtcaactaaggtgtagagacgaattcattgtttgctgcggacgcaagaagtacttgcgccatgtgtttctctttgaggacctgattctgtttagtaagacgcagaaggttgaaggatcacacgacgtttacctctataagcagtctttcaaaaccgcagaaatcggtatgacggaaaatgtaggcgacagcggtcttcgcttcgagatctggtttagaaggagacgcaagtcacaagatacctacatactccaggcttctagcgccgaggtgaagagcgcctggaccgatgtcataggccgaatcctatggaggcaggccctgaagtcccgagaattgcgaattcaagaaatggcttcgatggggattggaaaccagccatttatggacgtcaagcctagagaccgaacccccgattgtgccgttattagcgatcgggcacctaagtgcgcagtgatgtctgacagggtacccgactctatcgtcaagggcacagagtcgcaaatgaggggatctaccgccgtcagcagctccgaccacgccgcacccttcaaaaggcctcattcaacgatttccgatagtagtacatcttcgagctcaagccaatcatcttctatcctgggctcactgggcctgctcgtcagcagtagccccgcacaccccggtctgtggagtcctgctcatagtccctggagctcggacattagggcgtgcgtggaggaagatgagccggagccagagcttgaaaccggcactcaggccgccgtatgcgaaggggctccagccgttctgcttagccgcacgagacaggcctag

SEQ ID NO: 32018 - DNA, 1140 bp, Artificial Sequence
  Description of Artificial Sequence: Synthetic coding sequence
atgatctttatgaataccctacgatatctccagacccatgagtacctacttgacgtggacctctggcgcttattcgcaaatttggaggaacttacacagacaagtctaggattcgttaactccctgtttgggataatcaaggactacgttgatgccagcgaaattagttcaagccttgactttatttcagtgctgaccaagtatttccgggggtcactgtgtcagagccaccagacctattgcctgaattattccgctgccatcttctatctggaatccctcaggcaacgagatgacttcggcatctaccttaagtggtgtgaacagaacgaacagtgtaggcgactgcacgttcctgagctcctcgtggccccactacaacgtttaactcgctaccctctgctgctgaagaacatttggaaacgctcaatggatagtgccgagaagatcatgatctacagcatcaaggaaaaggttgagaaatctatcagagatctggagggaaaggtgaaatggctcgacaactttcagaagttccgctacttacaagagattatcgtctggccccccctctgggaccgggacaagaggttctttatccccgagtgccttaaacatattttcaaggagcatatggccgaaaacatactttcccccaccagcagacacctcctgtacgaaggaaaactaacactcgcggagagcacaaggtttttggatgtttatctatttctgtttaacgacttcctgctggtgaccaaaaccaaatgtaataaaaagaaactcggagggtccgaccctggactgatgtgccccagcctaacccctgagctgcaggctgttatcaaggagggggggagctgcaccgttttagatcaacctattcccctggatcggctcgtcgtgaaaagtatagagcctttacacgtatctgtgttcgggctgaggaacgcttttctgatccagcacgagaacaggtatagacagtgcattgccgcattcctccttcaagctcagacagagaatatcaagaagacatggatggcacagatcacaactgcaatctcatgcttcactaagtcacaggagaccaagaaaatcagcctgtttacactaccagcagaaagctcggagatttag

SEQ ID NO: 32019 - DNA, 4095 bp, Artificial Sequence
  Description of Artificial Sequence: Synthetic coding sequence
atggcagagcttaaagtagaggctcccgcatctgtggactggcaaaaaaggtgcctgacgttggagacccaactgtttaggtttagactgcaggcaagtaagattcgagagcttctggctgataagatgcaagagcttgagcagcgattactagaggcggaacagcgcgccgaaaatgccgagacccaggttggcgtcatggaggagaaagtaaaactgtctaatctcaaaaatgtagacagcgagggcagcctacatcgcaaatatcaggagctcctgaaggccataaagggtaaagacgagctgatttcccaactggaggcccagctggagaagcagaaacaaatgagagccgaagaggcaaaaacagtgcaagaaaaagcagccaaaattaaggagtgggtaacactcaagttggcaaagctggagatggagaaccagcacctaaagagtcacaaccagcggcttgtagagcaggtcgggtctctgcaggacgcgctagaagcaatccaaatcgcccccagtagaaaacttcttgtcccaccatatggtgccgcagagcaggactccgtgccttccgaacctgggattcagccgatgggccaggacagcggatcacaagcccaggggctgaaagcagccgtcctcgcaccatcccctggagcactccaaagtaaagattccgtgagcgaggccgcaagcccgctagaagacagtagttcatcaacagtgcatagcggtgagacagtggaggcaaagccgttacagccacacctgggaagggaatctccgccccaccagccctgcatgaaactgctgacattcagatgctccagcgcttcttggggggagggtctggtcacagctcagagaggcatgctacccggcacgaagaccagcgcgcgcgagggaggccccggatcctctttgaccctgcctaaggtcagggcaccagggactccccgagattctatccaattggccaagaggcatcattctcagccacaagtggggcacgggcattttggccgcgtggtgaacatcgagacagaagctttctcagccctccaccctagcggactccccgaactcgagtcaagagcgagatcaagggaagaaccagaaaaaatggagatggaggagccaccacccgctggcaagaacgaggagcgagaatcccctaaagctctgggcgctgaacttgaggaagttgagctgggcaacaagccccccacccctccactccaccagttttcgtcttgggaaagtaggatctacgccgtggctacctccggaatgcggctgagcgacatgtctcctcgatcaaataccgcatgttgcgcctcttcgcctcccgcactggtgtctcccgggtctttctcaggcttggtgtacaagaatgtcacagttcctgtgtatacagccctgaaaggacgagctacacagatcagcaacatgcccttcatggatgagtcatccggctccgatgatgactgctccagccaggcctcattccggatcagtgtcccatcatcagagagcaggaaaactagcgggctgggcagtccaagagctatcaagagaggggtgtcaatgtccagtctcagttcagagggcgactacgccattcctccagatgcatgcagtcttgattctgactatagtgagccggagcacaaactccaacgtaccagctcgtactctaccgatggccttggcctaggcggggagagcctggagaaatccggctacctgcttaaaatgggatcacaggtaaaaacatggaagcggcgctggtttgtcctgcgacagggccagatcatgtactataagagcccttccgacgtgatcaggaaacctcagggtcaggtggacctgaattctaggtgccagattgtgcgcggagaagggagtcagacctttcaactgatatccgaaaagaagacctactatctgaccgccgattcccctagcctcctcgaagaatggatcagagtattgcaatctctactgaaagttcaggcgaccggcccaccggctctgctcagaggaggcactaagcctaccgtcaagggatggctcacgaaagtaaagcacggacattcgaaagtagtatggtgcgctcttgtggggaagatcttctattactataggtcccatgaggacaaacggcccctcggatgcttacccgttcgcgacgcccatatcgaagaagtggaccggtcgtgcgactcggatgaggattacgaagctggcgggactagacggctgctgagtagccactgcaccctcgttattcacccgaccgagcatagccccacctatttattgattggaactaagcacgaaaaagacacctggctttaccacctcaccgtggccgccggaggtagctccgctaaggttggaaccgcttatgagcagctgattgggaaactcatggatggtgaaggagatcctgattccccattgtggcgtcatcccatgctttgctactcgaaagacggcctttacgcctctttgacaaccttgccaagtgaagccttgcagactgaggctctgaaactgttcaagtcctgtcagctgtttattaatgttcctgttgaagctgcaagcgtggattaccacgtgagccttgctcagactgccttacaggtatgtttggtgcacccggaacttcaatcggagatctactgtcagctgatgaagcaaacaagctgccggccaccccagaagtactcgctgatgcagtgctggcagctcctggctctgtgtgcaccccttttcctcccacagcatcactttctctggtacgtgaagcagcagttgcagcggcacgccgaccctcgcagtgagacagggcagtatgcaacctattgccagcgggcggtcgagagaacgctgagaactggcgagcgggaggccagacccagtagaatggaggtggtgtctattctgctgcgaaaccccttccaccacagcctccctttttccatcccagttcattttacaaatgggacatatcacgtagtgggcttcgatggcagttctacagttgacgaattcctccaaagactgaatcaggaaattggcatgaggaagccttcacattccgggttcgctctttttacggatgacccgtctggaagggacctggaacattgcctgcaaggatccgtcaagatttgcgacgccattagtaagtgggagcaggcaatgaaggagcttcatcctggcaaatcagaaggcggcacccgggtagttaagcttatgtacaaaaaccgactgtacttcagatcccaggtcaaaggtgagaccgatcgggagcgacttctgttagcctcccagacatctcgggaaattgtcgccggacgctttccaatcaataaggagctcgccctcgaaatggctgctctgatggcgcaggttgaatacggagatttagaaaagccggcgctgcccggtcctggggggactagcccagccaaggcccagcatctcctccagcaagtgttagacagatttcaccctagacggtataggcacggtgcccctgccgaacagctaaggcatttagcagatatgctaactactaagtgggcaactctccaggggtgcagtccccccgagtgcattagaatatacctgacagtggccaggaagtggccttttttcggggcaaagctcttcgctgcacaaccggcgcagctaagttcaaaggagaacgccctcgtctggattgcagtgaatgaagacggcgtcagtatcctcgatcacaacacgatgcaggtccacatcacatacccgtattccagcgtaactacatttggggggtgccgggacgacttcatgctggtaatcagaagcatccccgacaagtcctccgggaagagccatattgagaagctgattttcagaatggctgcgcccaagattgccgaggctacgttcattatggccagttatatgaaccattgcactacaactgttaacccccccaccaacccccctggagcttgccagctctgggagctcgacggtcggcagtttttcagcagcgttagctgtgccacgaagggtccaaccctactctag

SEQ ID NO: 32020 - DNA, 990 bp, Artificial Sequence
  Description of Artificial Sequence: Synthetic coding sequence
atggccgcactgatggctcaggtcgagtatggcgacttggaaaagccagcgctcccaggcccaggtgggacatcacctgccaaagcacagcacctgctgcagcaggtgcttgatcgattccacccgaggaggtatcgccacggggccccagccgagcagttgaggcaccttgcagacatgctgacaaccaaatgggccactctgcagggatgtagccccccagaatgcatccggatctatcttacagtggcacgaaagtggcccttttttggtgccaagctctttgccgcccagccagcccaattgtcaagcaaagagaatgctcttgtgtggatcgccgttaacgaggacggtgtgtccatcctagatcacaataccatgcaggtgcatataacatacccttattcttccgttactacttttgggggctgcagagacgactttatgcttgtaatcaggtcgattcctgacaagtcttccggtaagtcacatatagaaaagttaatctttcgtatggccgcgcctaagccccagcaccacgccgtcttatcttgggtgcttacatgttcatccctgccctgctcttcaccccaaggacgggccgacagtagcctcagagcgaaccaatccagaactctagggctcctgttttcggaggggcactgtgctagcgaacggatcagtcggccaaccggagctcatacgacaggccctctgaactccactgtgatgattccattcggctatttccttcccgattgcagatcttaccttcatcatggccaactctacgagccactgcactacaactgcgaaccaccacatcaacccactcgatccctccccgcagtcggaaccgggtggacaacagttctctttttctgcttcttgtgttaccagggggcaaatgttgcagtaaatattagccccacaagattcccgaacacgacgtccgcgtccggttttcgggacatttacccaagagtgtag

SEQ ID NO: 32021 - DNA, 2382 bp, Artificial Sequence
  Description of Artificial Sequence: Synthetic coding sequence
atgccgctgcccggaggactgtggtggctgctttgctgccgtagaggatttactctcttgcacagagactacggagacggcgagctgtccggtgatggagacgaagatgaagatgaggaaacattcgaactgaggacacccagtcccgcggggggaggcagaggcccactcgaagtgaccttgacccagcctgtccgtagcggacccgtgagcaacaggctgcagagctgggaagagacatggtccctgattcctgagaaggggctccccgaagacgatccagacatagtcgtgaaaggatggctctatagggagccaagaggaggaggagctcggccatggctccccccacgacgggcctggtttgtgctgactagagattctctggaccaattttcctcttcaggaaaaggggctcgccgtcttggttcattagtattgacatcgctgtgtagcgtgaccggccctgaaaggcgcaggaaagagaccgggctctggagcgtgaccgtgtccgggcgaaagcactccgtgagactctgttcccctagacaagccgaggctgaaaggtggggggtggccctgcgggaggtgatagctagtaaggcccccctggaaacccccactcagctgttgctccgcgacatccaggagtcgtgcggcgaccccgaggcggttgctcttatatacctgaggaatcctattctccggcacacttccggcgccctctatgccccccttttaccgctgccctacggggtgagcgctccgggaccagggtacgctccactgcgggaggaggctgtacgtctgttcttggctctgcaggctctcgagggcgcacgacggcccggccctctcatgcagggagtcctacaaacatgccgcgatcttccggctctccgagatgagctattcctgcagctggctaagcagacaagcgggcctgctggtcctccgggcctgccggccacccaggatccagccgctttgaggtactggcagctactgacctgtatgagctgtaccttccgccccggcggcgccgttagagggcacctacttggacatctggaacgcactgagcaagctctcccagactctgagctagccgagtacgcacggttcattcgaaaggccctaggccgcacaaggggtcgcgagcttgtcccgtctctggccgagatttcagccttaagccaacgacaagagctgctgtgcaccgttcactgccctggtgcaggggcatgtgcagtggccatcgacagccacacaacagctggggaggttgcccgtgagcttgtgggacggctgggtctggctagatcccgcaatgcatttgcactgtacgaacagagaggcgctcaggaacgagcattagcaggcggtacgctggtggccgatgtccttacgcgcttcgaaaatttagctgccgaagaggcaggcctagaggactcgccagattctggctggagattgtgtctgaggctccatggccctttacatcctgaaggcttgtcacccgatggacacgagctgccctttcttttcgaacaggcccacgctctcttactgcgcggacgcccaccccccccagacgatactttaagggctctagcggcacttcgtttgcagtctctgcagagagatttctctcctagagtgcctctgccgagactggacaggctgctccctccccccgcaccacctagggaggatcctcccaggcccacccctcggccccctccgtcagcagcgctcctggcaggggctctgtggagtccgggcctggccaaaaggcgagctgagagggctagacggggaggggccggcagaaccgccgggagcatcgctagagaaggtggtggcggcgccggcacggctgcggccgtgcttggaggatggaaacgcttgcggggcatgggccgggcagaagccatggccgcatacctggcacttgcggcacaatgccccggatttggagcagcacggtacgatgtactggagctcagcaccgaacctggccgcggcgccccccagaagctttgcttagggttaggtgcaaaggcaatgagcctgtcccggccaggcgaaaccgaaccgatacactctgtctcttacggccacgtggccgcctgccagcttatggggccccacaccttagcactcagagtgggagagagccaactcttgctgcagtcaccgcaggttgaagagatcatgcaacttgttaatgcgtatctggcgaacccctcaccagagcgcccgtgctcaagtagtagtcccccctgtcaggacctacccgacactagccctccctcccaacggcctggcctggacgagccacagggacagtccggctgcttaggacagttgcaggattag

SEQ ID NO: 32022 - DNA, 1851 bp, Artificial Sequence
  Description of Artificial Sequence: Synthetic coding sequence
atgcccttgccaggaggtttgtggtggttactgtgctgtcgccgcggtttcacactgctgcacagggattacggagatggcgagctctccggggatggggacgaagatgaagatgaagagacttttgagcttagaacgcccagtcctgctggaggtggtaggggcccgttggaggtgaccctgacccaaccggtgaggtcaggcccggtctccaatcgtcttcagtcatgggaggagacgtggtcattgattcctgagaagggcctgcccgaggacgatcccgatattgtggttaaaggctggctgtacagggagccgcgaggaggaggggcaagaccctggcttcccccaaggcgggcctggttcgtcctgacaagagatagtctggaccaattttcttcatctggtaagggcgctcgacgccttggttctctggttctgacaagtctatgttcagtgacaggcccagagcgcaggagaaaggagacagggctgtggtccgtgactgtgagtggcaggaaacacagcgtaaggctgtgctcaccacgacaggccgaagccgagagatggggggttgcgctgagggaagtgatcgcctccaaggctcccttagaaacgccaacccaactgctgctgagggatatacaggagtcgtgtggcgatcccgaagccgttgccctcatctacctccggaatccgatattgaggcacacctccggcgctctgtatgcacccctgctccctctgccttatggcgtttcagctccgggacccgggtacgcaccactacgcgaagaggcagtcagactgtttctcgcattgcaagccctagagggggccaggagacccggccccctgatgcaaggtgtcctgcagacttgcagggacctccctgcgctgcgtgatgagctgttcctgcaactggccaagcaaacttccgggccagctggccctcccggcctaccagcaactcaggacccggctgcccttcgttactggcaactgctgacatgcatgtcatgcacatttaggcccggcggcgccgtcagggggcacctcctcggtcatctggagcgcacagaacaggcactgccagattctgagcttgccgagtatgcccggttcatccggaaggcgttggggaggacacgcgggcgtgaactagtgcctagcctggctgaaatatccgccctatcacaaagacaggagttgctgtgtaccgtccactgccctggcgcaggggcctgtgcagttgcgatagatagtcacacaacagccggcgaggtcgctagagaactggtgggtaggctcggtttggcaagaagcagaaatgcttttgctctatacgaacagaggggcgctcaagaacgagcccttgcgggcggtacactcgtcgcggacgtgctcaccagcttagctgccgaagaggcaggcttagaagacagtccagactcggggtggaggttgtgcctccgcctacatggtcccctgcaccctgaaggattgagtccagatgggcacgagttacctttcctgtttgagcagcccgactccgcctctctgtccgccggagcatggtcgggctacggacatgtggccgcctgtcagcttatggggccccacactttagcattacgcgttggtgagtcccagctgctgctccagtcaccccaagtggaggagattatgcaactggtcaatgcatatctggcaaacccatcccctgagaggccgtgcagcagttcgagccctccttgccaggatttgcctgacacttctcccccctcgcaaaggccaggcttagacgagccacagggacagtctggctgtctcggacaactgcaagattag

SEQ ID NO: 32023 - DNA, 1095 bp, Artificial Sequence
  Description of Artificial Sequence: Synthetic coding sequence
atgagttgcacattccgacctgggggagcagtgcgcgggcacctgctggggcacctggaacggacggaacaggcactgccagactccgagctggcggaatatgcacgatttattcgaaaggcccttggacggactcggggcagagaactggttccctcattggccgaaatcagcgctctgagtcagaggcaggagttactctgcactgtgcattgcccaggagccggagcttgcgctgtggctatcgacagtcacacaacagccggggaggttgcaagggagttagtggggagattaggcttagcaaggtcgcggaatgccttcgcactttatgaacagaggggcgcccaggagcgggctctggcaggcgggactcttgttgccgacgttttgacatccctggccgcagaagaggccggccttgaagactccccagattcaggctggcggctctgcctgagactacacggacctcttcaccccgaaggactctcccccgatggacacgaactcccattcctgttcgagcaggcccatgctctgctacttcgtggtcggccccccccgcctgacgataccttgcgtgctctggccgctctgaggctacagagtttgcagcgggatttctctcctcgggtgccactgccacgtttggaccggttgcttcccccccctgcacccccccgtgaggatccgccacgccctaccccccggcccccaccctctgccgcgctgctggcgggtgccttgtggtctccaggactcgcgaagagaagagccgagcgcgcccggagaggtggtgccggtagaactgcaggctctatcgcaagggagggagggggcggagcggggactgctgcagccgtcctcggcggatggaagagacttcgcggcatgggcagggccgaagctatggctgcttacctcgccctcgccgcccagtgcccaggctttggcgccgcacggagcttggttggtgtgctgcaccgatcttgcgcttgggcgtgggaaccccggccttgccccagtcccggccagggccgaagatctccctctaccgtctcagcaatggccatgtggcctcccgcttcctag

SEQ ID NO: 32024 - DNA, 450 bp, Artificial Sequence
  Description of Artificial Sequence: Synthetic coding sequence
atgaggtacaatgagaaagaactccaggcactgtctcgtcaaccagcagaaatggctgctgagttgggcatgagaggcccaaagaaaggttcagtccttaagcgtcgattagtgaagctcgtggttaactttttattctattttcgaacagacgaagctgaacctgtgggcgccctgctcctggagaggtgccgcgtcgtaagggaggaacccggcaccttcagcatttccttcatcgaggacccggagcggaagtatcattttgagtgctcatcggaagagcagtgtcaggagtggatggaggccttgcggcgagcctcttatgagttcatgcgcaggagtctgattttttacaggaatgaaataagaaaggtcacaggcaaagatcccttggagcagttcggaatctccgaggaggcacggtttcaactgagtggtctccaagcatag

SEQ ID NO: 32025 - DNA, 3000 bp, Artificial Sequence
  Description of Artificial Sequence: Synthetic coding sequence
atggagcccggagaagtgaaagatagaatcctggaaaacatctcattgtccgtcaagaagcttcaatcgtactttgccgcttgcgaggacgagattcctgccatccggaaccacgacaaagttctgcagaggctttgcgagcatctagaccacgcactcctgtacggcctgcaggacttgtcttcgggctattgggtcctggtagtgcacttcacccgccgagaggctattaaacagattgaagtgttgcagcatgtcgcaacaaatcttggcagatcacgcgcctggctctacctcgcccttaatgaaaatagcctggagtcctatctgcgactcttccaagaaaatcttggcctgcttcacaaatattatgtgaagaatgcactcgtttgcagccatgatcatctcacactgttcctcactcttgtgtcggggctcgaatttatccgcttcgaattggatctggatgccccttacctggatttggccccatacatgcctgattattataagcctcagtatctgttagatttcgaggaccgactgccaagcagcgtgcatggctccgactctctcagcttgaattcctttaacagtgtcacttcaaccaacctcgagtgggacgactctgctatcgccccttccagcgaggacggtgatctcaccgacacagtaagcggcccacggtcaaccgcttctgacctgacctcaagcaaagctagcacacggagcccaactcagcggcaaaatcccttcaatgaagaacctgctgagactgttagtagcagtgacaccactccagtgcacactacatcacaggagaaagaggaagctcaggcacttgacccccccgacgcatgcacagagctcgaagtgatcagagttactaagaagaaaaaaatcggtaagaaaaaaaagtccaggtctgacgaagaggcctcacctcttcatcctgcgtgctctcagaaaaaatgcgccaagcagggggatggggactctcgaaatggttcacctagccttggccgggatagcccagatactatgctggcttcacctcaggaagagggtgaagggcccagcagcacaacagaaagtagcgaaaggtcagagcccggtctgctgatccccgagatgaaggacacttcgatggagcggctgggtcagcctttgtctaaagtgattgatcaattaaacggccaactggatcccagcacatggtgtagtcgtgccgaaccacctgaccagtcctttaggaccggcagcccaggggacgcaccggaaaggccccctttatgtgacttttctgaaggactgagcgcccctatggatttctatagattcaccgtcgaatcgccgtccacagtgacttcggggggaggacatcacgaccctgccggcttgggccagcccttgcacgtaccaagttcacctgaagccgcggggcaggaggaagaaggcggggggggggagggccagacacctcgccccttagaggacaccactagagaagcccaagaactggaggctcagctcagcctggtgagagagggaccagtgtccgaaccggaaccaggaactcaagaggttctatgccagctgaaacgggaccagccgagtccctgtctttcctctgcagaggattctggtgtagacgaaggtcagggctcgccgagcgaaatggtgcactctagcgagttccgggtggataataaccatctcttgcttctgatgatccatgtgttccgtgaaaacgaggaacaattgtttaaaatgatccgaatgagtaccgggcatatggaaggcaatctccaactgctatatgtgctgctgaccgactgttacgtctacttgttgcgaaagggagcaacagaaaagccctatctcgtagaggaggccgtgagctacaatgagctggactatgtttcggtgggactagatcagcagactgtgaaactcgtctgcacaaaccgaaggaaacagttcctgttagataccgccgacgttgcactggctgaatttttcctcgccagcctcaagtctgctatgataaagggatgcagagagccaccgtacccttcaattctgaccgacgctacaatggaaaagctggccctggctaagttcgtggcgcaggaatcaaagtgtgaagcatcagccgtaactgtgcggttttatgggctggtgcactgggaagatccgacagacgagtccttgggccccacaccctgccactgttcacctcctgagggaaccatcactaaagagggtatgctccactacaaggccggcactagctacctcggtaaggagcattggaagacttgctttgtcgtgctttccaacggaattctttatcagtacccagaccggaccgatgtgatacctctgttgagcgtgaatatgggcggagagcagtgcggaggctgtcgacgagccaacactaccgacaggcctcatgcttttcaggtgatcttgagcgacaggccgtgcctggaactgtccgcagaaagcgaggccgagatggctgaatggatgcagcacttgtgtcaggctgtttccaagggagtgatccctcagggagtggcaccgagcccctgcatcccatgctgtttggtcctgacggatgaccggctcttcacctgccatgaggactgtcagacgtcctttttcagaagcctggggaccgctaaacttggggatatctcagctgtctctaccgagccaggcaaggagtactgcgtgctggagtttagccaagacagtcagcagcttctgcccccatgggtgatataccttagctgtacctctgagttagaccggttactcagtgcgctgaacagtggctggaagacgatataccaggtagatctgcctcacaccgcaatacaggaggcctccaacaagaagaaattcgaggatgcgctgagtctgatccacagtgcatggcagcggagcgattccctgtgtcgcggtcgggcatcccgcgacccttggtgttag

SEQ ID NO: 32026 - DNA, 2154 bp, Artificial Sequence
  Description of Artificial Sequence: Synthetic coding sequence
atggaagcactggaggtggatgatattagccccgctctcgaggtgacggaggagtttttctctactttagacagcaatctggagaaagctgtacagcaggcagaggtgtacgggatccaggaggtgccagaactggtcggacatgaggtactttctaatattacagacaacggcgccatgcgcaacgttaccagtctagggaaaggaggaatgatctgggaccactgcaagtcccgccttttggagacaaaagcccaaaacgtgttccccgcaaaagaacagtttatggtgcagaggggaactaccccggataatctgagctggatggaacaaaaagaggccagtaccttcaatttctttaacatctgtcagcgtcgtcgagaccggccgagaagcgtaaacgatctcctggatgaaacctccacattcaaacctgggcacgcccgatccagatccgacataacacaagtcgattggagagtggtgctgaagactacccccctgcagcaacaacagcaacagcagcctttgctgcagggacctcatgtgactaggcctagtttcttgcttcccagcccaaacaagattgaggacgcccagggtaacacagagcacaaacaaacctttcctaacatcctaaagaaaggataccttgagattcggaaagatcacgatagctactggcagtcctgctacgcagaattgtcaccctataatctgtatttttacagtctcgactcctccggaaaccaaaatctttacgctacgtaccaactgagtcatttccaaagcatctctgtactcggtaatttagaggcaaggatggtcgacactgtgctatatgataatacccagttacagctcaaagcggagagcccctgggaagccctcgactggggacagaagctgtgggaggtagtgcatgctgccgttcccgggtacatggggagacagaacgagttgactatatcccctggcctggggcatcacgacgattacacacagaatcactcatttcagaaaaaaacttcaggtctcctaccaccgtcccctgtacttgatagcagcaaacagtatcagaatattctcaaatctggcactctttaccggctcaccgtgcagaacaactggaaagccttcacgttcgttctcagtagggcctaccttatggctttccagcccgggaaactggacgaagatccccttctgagttataatgtcgacgtctgtttagcagtccagatggataacttagatggctgtgattcatgctttcaggtaatcttcccacaagatgtcttacggttgcgggccgagacccggcagagggctcaggaatggatggaggcgttgaaaatcgccgcaaacgtggctcggtctagcgaacagaacctccaggtgaccctgcgtaacaaacccaaggaccagatgggagggcatgaactacgcaagaacaagcgacagtccgtgacgacttccttcttgagtatcttaaccacactctctctcgaacggggcctgaccgcccaatccttcaaatgcgcggggtgtcaaagatcaattggattatctaacggcaaagctaaggtgtgtaattattcagggtggtattattgctccagctgtcacgtggatgacagtttcttgatccccgcccggatcgtgcataattgggacacttccaagtataaagtgagtaagcaggccaaggagtttctagagtatgtttacgaagaacctctaatcgatatacaacaggaaaatgccatgctttatcaccacgctgaacctctggcagccgtattgagactgcgtcagcgcctcaagagcctccgcgcttacctcttctcttgtagggccgctgttgcagaagacttaaggagaagaatttttccccgggagtacttacttcagcagatccatctgtacagcttggctgacctacagcaagtgatcgaaggcaagcttgcccccttcctgggtaaggtcataaaatttgccacgtcccacgtgtactcctgctcattgtgctctcagaagggcttcatctgcgagatatgtaataacggggagattttatatccattcgaggacatatctactagtcgctttggcgacccgtatgctgacctcttgcagggctacgtggcttag

SEQ ID NO: 32027 - DNA, 2286 bp, Artificial Sequence
  Description of Artificial Sequence: Synthetic coding sequence
atggaggccttggaggttgacgacatcagccccgctctggaagtcaccgaggagttcttctctacactcgatagcaatcttgagaaggcagttcagcaggccgaagtctacggcatacaggaggttcccgaacttgtgggtcatgaagttctgagcaatataactgataacggagcaatgaggaacgtgacaagccttggcaagggtgggatgatttgggaccactgcaaaagtaggctactagagactaaggcgcaaaatgtttttccagctaaggaacaatttatggtgcagcgtgggaccacacctgataacctcagctggatggagcagaaagaggcctccacatttaacttctttaacatctgtcagcggagacgagaccgtccccggagcgttaacgatcttctggatgagacgagcacctttaagccagggcacgctcgctccaggtccgatattactcaggttgactggagagttgtgctgaagacaacgcctttgcaacagcaacagcagcagcagccccttctgcagggcccacatgtgaccaggccctcttttctcctgcccagtccaaataagatcgaggacgcacagggcaacaccgagcataaacagacattccctaatatcttgaagaaaggctacctagaaataagaaaagaccacgatagctattggcagtcctgttacgccgaactgagtccctacaacctgtatttctattctctcgatagttccggcaatcaaaacctatatgcgacgtaccaacttagccactttcagtctatcagcgttctgggtaatttggaagctcgaatggtggacacagtcctgtatgacaacactcagctgcagctcaaggccgagtctccatgggaagcactggactggggccagaaactgtgggaggtggtgcatgccgcagtgccgggatacatgggaagacagaacgaactgactatcagtcctggactcgggcatcatgacgattatacacagaaccactcattccagaagaagactagcggactcttacctccctcacccgtgctggacagtagcaaacaatatcagaacatccttaagagtgggactctgtaccgactgactgtccaaaataattggaaagctttcaccttcgtgttgtcacgtgcatatcttatggcctttcagccaggaaaactcgacgaagaccctttgctatcctacaacgtggacgtctgtctggcggttcagatggataatctggacggatgtgactcctgtttccaggtgatctttccacaggatgtgttgcgtctaagggccgagaccaggcagcgcgcccaggagtggatggaagcccttaagatcgccgcaaatgtggccagatcttccgagcagaacctgcaagttaccttgaggaacaagcctaaggaccaaatgggaggacacgagctacggaagaataagcggcagtccgtaactacgtcatttctttctattttgaccaccctatcgttagaacgcggcctgacggcgcagagcttcaaatgtgctggctgtcagcgatctattgggctaagtaatgggaaggccaaggtgtgtaactactctggctggtactactgctcctcatgtcatgtggatgactctttcctcatccctgcaagaatagtacataattgggatacttccaaatacaaggtgagtaagcaagccaaggaatttctggaatatgtgtatgaagagcccctgattgacatacagcaggagaacgcaatgctctatcatcacgccgagcccctcgctgctgtgttacgcttaaggcaacggctcaagtccctaagggcttatctcttttcatgccgagctgcagtggcggaagacctgagacgcaggatttttcctagggaatacctgctgcagcaaatccacctgtactctctcgcagatctgcagcaggtaattgaggggaaattggctccattccttggtaaagtgataaaattcgcaacctcacatgtgtattcttgcagcttgtgctcacaaaagggctttatctgcgaaatttgtaacaacggtgaaattctgtacccctttgaggacatttcaacttccagatgtgagagctgcggtgcggtgtttcacagcgaatgcaaggagaaaagtgtgccttgccctcgttgcgtgaggagggaactgcaaaaaaaacaaaaaagtttttggcagaggttgaatatggacgaatcattggaggaagcatgcaccatgttcgaattaagctaccagaacacctag

SEQ ID NO: 32028 - DNA, 1410 bp, Artificial Sequence
  Description of Artificial Sequence: Synthetic coding sequence
tagaatcagaacctgtatgccacttatcaactgtcccatttccagagtatttctgtgctgggaaacctggaagctagaatggttgacaccgtgctgtacgacaacacccagctccaattgaaggctgagtcaccctgggaggcccttgactggggccaaaaactgtgggaggtagtccacgccgctgtacccggctacatggggcgtcagaacgagctcaccatctcacccggcttggggcaccacgacgactatacccaaaaccattccttccagaaaaagacatccgggctcctgccaccgtcgcccgtgctcgactcaagcaagcaataccagaatattctgaaaagtggtacactctaccgacttaccgtccagaataattggaaggcctttacttttgtcctgtcccgggcctatctcatggccttccagcccggaaagctggatgaggatccgctgctatcttacaacgtggacgtctgcttagccgttcagatggataatctggacggttgtgacagttgttttcaggttatctttcctcaggatgtgttgcgcttaagggccgaaactcgacagagagcgcaagagtggatggaagctctcaagattgctgccaatgtggcccgtagctctgagcaaaatctccaggtaacactacggaataagccaaaggaccaaatgggcggccatgagcttaggaagaataagcgacaatccgttacaacgtcctttcttagcatcttgacaaccctgagcctggaacgggggttgacggctcagtcgttcaagtgcgctggatgccaacggtcgatcggtctgtccaatggtaaagccaaagtgtgcaactattccgggtggtactattgtagctcctgccacgtcgacgacagttttttgatcccagcacgaatcgtccacaattgggacaccagcaaatacaaagtgtccaaacaggcaaaggaatttctggagtacgtctacgaggagccactgatcgatattcagcaggaaaatgcaatgctgtatcaccacgccgagcctctcgcagccgtactgagactgaggcagcggttaaaaagtttaagggcatatctctttagctgcagagctgccgtggctgaggacttacgacggcgaatattcccccgggagtatttactccagcagattcacctgtattctcttgccgatctccagcaggtaattgaaggcaagctggctccatttctgggtaaagttattaaattcgccacctcacacgtttacagctgctcactgtgtagccaaaagggattcatttgcgaaatatgcaataatggcgagatcttatacccgtttgaggatattagtacgagccggtttggggacccatatgcggacctgcttcaagggtatgtggcctag

SEQ ID NO: 32029 - DNA, 1731 bp, Artificial Sequence
  Description of Artificial Sequence: Synthetic coding sequence
atgggcaatagtcactgcgtaccacaagcacccaggcgccttagggcctcattctcccgaaagccatcccttaaaggcaaccgcgaggacagcgcccggatgagcgctggattgcccggccctgaggcagcgaggtcaggagacgcggccgctaacaaactgttccattatatccccggtaccgacatcctcgaccttgaaaaccagcgggagaaccttgaacagcccttcctcagcgtgttcaagaaaggccggcgccgtgtaccggtgcgtaacttgggcaaggttgtgcactacgcaaaggttcagctgaggttccaacacagccaggacgtgtcagactgttacctggagctttttcctgcacatttgtatttccaggcacacggctctgaaggcctgaccttccagggcctgttaccattgaccgagctcagcgtttgccccctcgagggttcaagggagcacgcctttcaaataacgggccccctgcctgcccccctgctggtcctatgtccttcccgcgcagagctggaccgctggttatatcatctggaaaaacaaactgccctgctagggggcccccgtcgctgtcattccgcaccccctcaaggatcatgcggcgacgagctaccatggactctccagcgccgcctaactcgactgcgtaccgcgtccggacatgaaccaggaggctctgcagtgtgtgcatccagggtgaaattgcagcatctgccggcccaggagcagtgggaccgtcttcttgtcctgtatcccacgagccttgcgatcttctctgaggagctggacgggctgtgctttaagggcgagctgcctttgagagccgtgcacataaatctggaggagaaagagaagcagataagatctttcctaatcgaaggtcccctaatcaataccatccgagtggtgtgcgctagttacgaggactatggccactggctgctttgcctaagagccgtgacacatcgggagggggccccaccattaccaggcgctgaaagctttccggggagtcaggtcatgggcagtggacgcgggtcgctctcgtctggtgggcagacctcgtgggactcagggtgtctggccccgccgtctactagaacctcacacagtctcccagagtccagtgttccttctacagtgggttgttcctcccaacacactccccttcataggctgtctctcgaaagcagtcccgacgctcccgatcatacctccgagacatcacactctcccttgtacgctgatccctacaccccgccagctactagccacagaagggtgaccgatgtgaggggcttagaagagtttctgtccgccatgcagagtgcaaggggaccaacaccaagctctccactaccttctgtgccagtgtccgtacctgcttctgaccctagatcgtgctcatccggaccagccggaccgtacctcctgagcaaaaaaggagctctccagtcgcgggccgcccagcggcatcgaggctccgctaaagatggcggaccgcagcctcccgacgcaccacagctggtgtcgtccgcgcgggagggcagccccgagccttggctgccactgaccgatggcagaagcccgcggcgtagccgagatcccggttacgaccacctgtgggacgaaactctttcaagctcacaccaaaagtgtcctcagctcggcgggccagaggctagcggggggttggtccaatggatctag

SEQ ID NO: 32030 - DNA, 1992 bp, Artificial Sequence
  Description of Artificial Sequence: Synthetic coding sequence
atgggcaactcacattgcgtaccacaggcgcctagacgactgcgggcctctttctcccgaaagccgtccttgaaaggtaacagggaggatagtgcccggatgagcgcgggcttacccggccccgaagctgcacgttcaggggacgccgcagctaataagctctttcactacatcccgggaaccgacatacttgatctggagaaccaaagagagaatctggagcagccatttctctcagtattcaagaaaggccgacgacgcgtacccgtgaggaatcttggaaaggtggtgcactacgctaaggtgcagttgagattccagcactcccaagacgttagtgactgttacctggagctgtttccagcgcatctttacttccaggctcacgggtccgagggcctgaccttccaaggtctcctcccgctgacagagctgagcgtgtgccccctggagggctcccgggagcacgccttccagatcactggagtttgggacgcgtctagggcaccacggggaactccagacccagggctcggagaagggccagctctgtggttgagaagcacctgcgtgtatgtgtgtgccctttccgccttgcccgctggcccactgccagcacccctgcttgtgctctgtccaagcagagccgagcttgaccggtggttatatcatctggaaaagcagactgctcttctgggtggtccccggcggtgccacagcgcgcccccccaggggtcctgcggagatgaactcccctggacactgcaacggaggctcacgcgcttgagaactgcttccggtcatgagcctggggggtccgccgtttgcgcctcacgcgttaagcttcagcacctgcctgcccaagaacaatgggatagactgctggtgttatatccaacaagccttgccatattttctgaggaactggacggcctgtgcttcaagggggagctccctctgcgggctgtccatatcaacctcgaggagaaagaaaaacagatcagatctttcctgatcgagggaccccttataaacacaattagagtggtgtgcgcctcctatgaggattatggtcattggcttctctgcctgagggccgtcactcacagagaaggcgccccccccctgcccggcgcagagtcttttcctggatcccaggttatgggatccggtagaggctcactctcctccggaggacagacctcatgggattccgggtgtctcgcaccaccctctacccggacctctcacagcctgcccgagagcagcgttccaagcacagtcgggtgttcctcacaacacaccccagatcaggccaacagcgatagagcatctatagggcgccggcgtaccgagctccgccggtcaggatcttcgaggagtcctgggagtaaggcccgggccgaaggccggggccctgtgacccccctgcatcttgatttaacacagctgcatcgactgtcgctagagtcaagcccagacgcgccggaccatacttccgagacctcccactcccccctgtacgcagacccctatacaccaccagcaactagccaccggcgtgtgaccgatgtgagggggctggaagagtttctttcagcaatgcagagtgccagaggacccactccatctagccccttacctagcgttcccgtgagcgtacccgcatccgaccctaggtcttgctcttcgggccccgccggtccgtacctcttatccaagaaaggagcgctgcagtcccgcgcagcccagcggcaccggggctctgcgaaggatggcggcccccagcctccagatgccccccagcttgtttcctccgcgcgggaaggatcgccggaaccctggttgcctcttaccgacggcaggagcccccggcgatcaagagatccgggttacgatcacctctgggacgagaccctgtcatcctcccaccagaagtgtccacaactcgggggcccagaagcatcgggcgggctggtacagtggatttag

SEQ ID NO: 32031 - DNA, 1836 bp, Artificial Sequence
  Description of Artificial Sequence: Synthetic coding sequence
atgggaaactcccactgtgttccccaggccccacgcagactaagggcatctttttcccgcaaaccaagtctcaaaggaaaccgggaagacagtgccaggatgtctgccggactgccgggaccagaggccgcccggtcaggcgacgctgcagcaaataagctcttccactatatcccgggcactgatatattggacttggaaaaccagagagagaacctggagcaaccgtttctcagcgtcttcaagaaaggacggaggcgggtgccagttcgcaatcttggcaaagtggtgcactacgccaaagtgcagctgcgctttcagcatagtcaggatgtgtctgactgttacctcgagctgtttcctgcccatttgtacttccaggcacacggtagcgaggggctcacttttcaaggactgctcccgcttaccgaactgtcagtctgcccactggagggatcccgcgagcacgcatttcagatcacgggacccttacccgcccctctacttgtgttgtgcccaagccgggccgaactcgataggtggctgtaccaccttgagaaacaaactgcattactgggcggtccaagaagatgccacagtgctccccctcaaaggcgtctgaccagacttagaactgcctcaggacacgagcctggcgggtccgccgtctgtgccagccgggtgaaactgcagcatcttcccgctcaggaacaatgggacaggctgctggtactctatcccacaagtctggcgattttttctgaagagttagacggactctgtttcaaaggcgagttaccattacgggcagtgcatataaacctggaagaaaaagagaaacaaatacggtcattcttgatcgaaggaccgctgataaataccatacgtgtggtctgtgcctcatacgaagactacgggcattggctgctctgcttgagggcagttacccatcgtgagggcgcccctcctctgcccggggccgaatctttcccgggttcgcaggtcatgggaagtgggcgagggtcactatcctctggaggccagaccagctgggatagcggctgcctggcccctccatcaaccaggacttcgcacagcctgcctgaatcctctgttcccagtaccgtgggatgttcctcccagcacactccagatcaggcgaactcagacagagcaagcatcggaaggagaaggactgagcttcgccgtagcggcagctcaaggagccctggctccaaagccagagcagagggccggggtccagtgacccctctgcatctggatctaacacagctccaccgcctgagcctcgaatcctcaccagatgcacccgaccacactagcgaaaccagccatagtcctctgtacgccgatccttataccccccctgcaacctcccacagacgtgtgactgatgtccggggactggaggagttcctgtcagccatgcagagcgctagagggcccacaccttcgtctccccttccctctgttcctgtatccgttccggcctctgatccaagaagctgtagtagcggacctgccggcccttacttactgtcaaagaagggggccctgcagtctagagccgcccaacgccaccgaggttccgccaaagatggcggacctcaaccacctgatgccccccagctggtgtcatccgctcgagaagggagcccggaaccttggctccctttgactgatggtcgtagtccaagacgaagtcgggatccaggatatgaccacctgtgggacgaaaccctgtccagcagccatcaaaagtgccctcagctggggggcccagaagcgtctggggggctggtgcaatggatttag

SEQ ID NO: 32032 - DNA, 1473 bp, Artificial Sequence
  Description of Artificial Sequence: Synthetic coding sequence
atggaagaagaaggagtgaaagaagccggggagaagcctaggggcgcccagatggtggataaagcaggctggataaaaaaaagctcgggtggccttttaggcttttggaaagaccgttacctgcttctctgccaagcacaactcttagtttacgagaatgaggatgaccagaaatgcgtggagacagtcgaactcggctcttacgaaaaatgtcaggacctgagagccctgctcaagcggaagcatcggttcatactcctcagatcaccaggaaacaaggtgagtgatatcaagtttcaagcacccactggggaggaaaaggagtcctggatcaaagctctgaacgaagggatcaaccggggaaaaaacaaggcatttgacgaagtcaaggtggataaaagctgcgcactggagcacgtgacccgagatagagttcgcggaggccagcgtcgcaggcctcccactcgtgtgcatcttaaggaggtcgcctctgctgcgagcgacggcctgctgcgactagatctagacgtgccagacagcgggccccccgtctttgccccaagtaatcatgtttctgaggctcagccacgcgagacacctcgccccctcatgccccccacaaagcccttccttgcccctgaaacaactagtcctggggatcgcgtggaaacccctgtcggagaacgtgcccctacacccgtgtctgcgagctcagaagtgagcccagagtctcaggaggatagtgaaaccccagctgaggaagacagcggatctgaacaacctccaaacagcgttttgcccgataaactgaaagtgtcatgggaaaatccctcacctcaggaggcacctgctgccgaatccgccgaaccatcacaagccccatgctctgaaactagtgaagccgcaccacgagaaggtgggaagccccccacccccccaccaaaaatcctcagtgagaagcttaaggcctcaatgggagagatgcaggcatccggaccacccgcccccggaaccgtccaggtgagcgtaaacggcatggacgactctcctgaacccgcaaaaccatcccaggcagaaggcactcccgggacaccgccaaaagacgctacaacctccacggccctgcctccctgggacctgccgccgcaattccacccaaggtgttctagcctgggagacctgctcggggagggtcctcggcacccattgcagccccgcgagcggttgtaccgcgcgcagctcgaagtaaaggtagcctcggagcagactgaaaaactgctgaacaaagtactgggtagcgagccggcccccgtctctgctgagactttattgagtcaggctgtggagcagttgaggcaggctacacaagtgctgcaggaaatgagggacctgggtgagctgagccaggaggccccaggtctgagggagaagcgcaaagaactcgtaacattataccgtcgcagtgctccttag

SEQ ID NO: 32033 - DNA, 672 bp, Artificial Sequence
  Description of Artificial Sequence: Synthetic coding sequence
atggaggaagagggagtgaaggaggcaggcgagaagccaagaggcgcccagatggtggataaagctgggtggataaagaagtcttctggggggctcttaggattttggaaagaccgatacctactgttgtgtcaggcccaattgctggtctacgagaacgaagacgaccagaaatgcgttgaaactgtcgagctgggctcgtacgaaaaatgccaggacttaagggccttgctcaaacgcaagcaccgctttattttattgaggtcccccgggaataaagtcagtgatattaaatttcaggctcctaccggagaggagaaggaatcttggataaaagctctcaacgaaggaatcaatagaggaaagaacaaggcctttgacgaggtcaaagttgacaaatcatgcgctcttgagcatgtgacacgggacagagtccggggtggccagcggcgtcgcccccccacacgcgtgcatctcaaagaggtcgccagtgctgcttcagatggcctcctgaggctcgatttggatgtgcccgactctggacctccagtgtttgctccaagcaaccatgtcagcgaagcccaaccaagggaaactccacggcccctgatgccacccaccaagcccttcttggctccggaaacaactagcccctcttcacatcttttctag

SEQ ID NO: 32034 - DNA, 1923 bp, Artificial Sequence
  Description of Artificial Sequence: Synthetic coding sequence
atggggaccaggtccagccctgaggagggaactcctcccccactggtgcctgagtgcgacgtggaggtccagccccaaggacaccccgaggagagtcgcgaacaggaggcctcggaggtgctggctgagccctcatccagaggaggagctgagcaacaggctgaagaggaggaagtcggtgaggggtcaagcactgagtcttctcgcgacgcgcctgaagccacaccaccaatcgctatggcagccactccccccgcatcaacgtcatcccgagagggtgtcagaggcgcagccagaaggctgcagggccagcagctcgaggcccttaccagagtggccctcatggaacagagagttaaggaacttcaaagacaacgcaaagaattaaggattgaaatggaagtggaagtagcactgttgagaggcgagttagccggggagcgcgtcgccgcccggcgggaggaagaacagttgcgagaactgttagagcagcaggccgccagcgagcagagaggccgccagcagcgggaacaggagcagcggaggctgagtcaggaacgggataggcttgaaggtctccgtcagcgcctaagaaaagctcaaggccagttggattcacagccagaggatcagcgagaacgcctgttacagggggtgcaggagatgagggaacagctcgacgtggcccagagagcatatgaagacttggaattccagcagctggaacgtgagagcagacaggaggaggaggaccgcgatagccccgggccccaggttccagaccccaaagtgcaagagcttcaggcctccatggctcagcataggaggggcgctctgcagcacaggatacgggtgctggaagaacaactgaagtctcttggtgagcagatggcggcagagtcgcgtggcctctctagaaagaaggaagaggcgctacaagctttgagccaagaacgctcacgtcttctcgagctcaactgtctccagggaacaccgggtggtgatttcagtgaacccaaccccgctcttacgaaacttctcttcacacagaagactgatcgtcagctcctggtgctacaagatgcagtcgcccacagcgccgccacccccactagtagttgcctgttctccgtacactcctccttgcagggatccatcgggctgcagagaaccggtagtttacctaggaagagaggggagagaggcagccagcggggctctccaagacccctgtcttttcactgcacagagtcactggaggcatctgctttgccaccagctgtaggagatagcggcaggtatcctctctatcagttactgaattgcggacgcggaaactcttgtggcgccatccatcctgacatcgcccacatggaaaggttgttgcagcaggctatggctgagagagagcgcttactcaaggcacgggagggcacacgccgcggcacagaaggctcatctggccccgccgtgccagcaattacagcaccacctacgcccccacatccacccgggcctcgaatcctcgatctgaggcagcatctcgagggctgggggcacaaccccgaaaactgtccacacgtgcaggtcagtgggtgctgttgccgtggcccgctggtcaagatgggtgggaggatcaaaacctggaggaagaggtggttttgctttgatcgacaggcccggagacttgcatattacgctgacaaggaagaaactaagctcaagggggttatctattttcaagcgatcgaggaggtctattacgatcacctgcgatgcgctttcaagagcccaaacccacgactgacattctgcgtcaaaacatacgaacgcctgttctatatggtggccccatctcctgaagcgatgcgtatatggatggacgtgatcgttaccgctgctgacgaaaatcatgccccctag

SEQ ID NO: 32035 - DNA, 528 bp, Artificial Sequence
  Description of Artificial Sequence: Synthetic coding sequence
atggccgaagcatcttcagctaatctgggctcgggttgcgaggaaaagcgtcatgaaggaagcagctccgagtcggtgccacccggcaccactatatcccgtgttaaattgttggacaccatggtggatacttttctgcagaagctggtcgctgctggctcctaccagcgatttacagactgctacaagtgtttctatcagctccagccagcaatgacccagcagatctacgataagtttattgcccaactgcagacaagtattagagaggaaatcagtgatattaaggaggaagggaatctggaagctgtcctgaatgccctcgacaagattgtggaagagggtaaagtgcgaaaagagcccgcctggtgtgaggcacagagatgcagagtgcagcagcggtgttccctgtgcgtacaagcgggaggccaacggggctctgaggaaacacaggcactgcctgtgtctatggcaggtagtcctagccccctgcccggctcccctggcgctcaagaagggggtgtctag

SEQ ID NO: 32036 - DNA, 663 bp, Artificial Sequence
  Description of Artificial Sequence: Synthetic coding sequence
atggccgaggcatcatccgctaatctgggatctggctgcgaggaaaagcgccacgaaggatcctcgtcagaaagcgtccccccaggaaccactatctcaagagtaaaactcttggacacaatggtcgacacgttcctgcaaaagttagtggctgcagggtcctatcagcgctttaccgattgctacaagtgcttttaccagctccaaccagctatgacccagcaaatatatgataagtttattgcccagctgcaaacttcaatcagagaagagattagtgacatcaaggaagaaggtaatctggaggcggtactgaatgccctggacaagatagtagaggagggaaaggtacgcaaggaacctgcatgtaacggcacaccgtgcggggccatgtgtagaaatagaagacctagaacaagcagttggcagatgccaagctggcagggcggaggtagatggagatcatgctcctataggtcaaggcctagttcaaggccgggcagatgcgaggctcagagatgtagagtgcagcagcggtgttcattatgcgtgcaagcaggtggccaaaggggatcagaggagacacaggctctgcccgtcagcatggccggatccccatcaccgctccccggttctcctggggctcaagaaggaggagtctag

SEQ ID NO: 32037 - DNA, 2010 bp, Artificial Sequence
  Description of Artificial Sequence: Synthetic coding sequence
atggcacatcacctccccgcagctatggagtctcatcaggactttcgaagtattaaggccaaatttcaggcttcccagccggagccaagcgacctgcctaagaaaccgccaaaaccggagtttggcaagttgaagaagttcagccaacctgagctgtccgaacaccccaaaaaggctccactgccggaattcggggcagtgagtcttaagcctcctcctccagaggtgacagatctgcccaagaaacctcctccgcctgaggtgaccgacctgcctaagaaaccacccccccccgaagtgacggatctccctaagaaacccccccctcccgaagtcactgacctgcccaagaaaccgagtaaactggagctcagtgacctgagcaagaaattcccgcagctgggagccactccatttcctcgaaagcctctccagccagaagttggggaggctcccctgaaagcctcattgccggagccaggtgcccctgcgcgaaagcctctgcagcctgacgaactgtcccacccagcacgcccacccagtgagcctaagtccggcgcgtttccccgcaaattgtggcagccagaggcaggggaggctaccccaagatccccacaacctgaattaagtaccttccctaaaaaaccagcccagccagagttcaatgtctaccccaagaaacctccacagccacaagttggcgggttacccaaaaaaagtgtaccgcaacccgaattctccgaggcagcccagacgccactgtggaaaccccagtcttctgaacccaaacgcgacagcagtgcctttccgaaaaaagcgtctcagcctccactatccgactttcctaaaaaacccccacagcctgagctgggtgacctcactcgcactagtagcgaacccgaggtctccgtgctacctaagcgtccacgacctgcagagttcaaggcccttagcaaaaaacctccacagccagaactgggtgggctgccccggacttcgtctgagccggaatttaactcgctgccgcgaaaactcctgcagccagagcggagaggtcccccaagaaagttcagtcaaccagagccatcggcggtgcttaaacgacacccccagcccgagttctttggcgatctgcctaggaaaccacctctgccctcctccgctagcgaaagcagtctgcccgctgcggttgccggttttagctcgcgccaccctctgagtccaggattcggggcggctggcacccccagatggagatccgggggactcgtgcattccggaggcgccagacccggactcagaccctctcatcccccacgacggcgccctcttccacctgccagtagtttagggcatcctcccgccaaaccaccacttcctccgggaccggttgacatgcagagcttccggagaccctctgcggccagtatcgacctacggagaacccgcagcgctgccggactacactttcaggatagacagcccgaggacatacccgtccccgacgaaatttacgagctgtacgacgacgtggaaccccgggacgattctagccctagcccaaagggtagggatgaggcaccctccgtccaacaggctgccaggcggccacctcaggacccggccctgaggaaagagaaagacccccagccacagcagctgcctcccatggaccctaaattgctaaaacagctccgcaaagccgaaaaggcagaaagagaatttcgcaaaaagtttaaatttgaaggggagatcgttgtgcacacaaagatgatgatcgatccaaatgccaaaacccggaggggcggcggaaaacacctggggatacgccgaggggagattttggaagtcattgagttcacatctaacgaagagatgctctgccgcgaccctaaaggcaagtatggctacgtgcctcgtaccgctcttctgccactcgagactgaagtgtatgatgacgtggatttctgtgacccacttgaaaaccagcctcttcctctggggaggtag

SEQ ID NO: 32038 - DNA, 2013 bp, Artificial Sequence
  Description of Artificial Sequence: Synthetic coding sequence
atggcgcatcacttgccagccgccatggaaagccatcaagattttcgaagtatcaaggcaaagttccaagcctcccagcctgaaccttccgaccttccaaaaaagccccctaagccagagttcggcaaactgaagaagttttcccaacccgaattgtccgagcatcccaagaaggctccgttgcctgagtttggggccgtgtcactcaaaccaccccccccagaagtgacggatctcccaaaaaagccccctccaccagaggtgaccgaccttcctaagaaaccccctccccccgaagtaacagacttgcccaaaaagcctcctcccccggaggtgacagacctccctaaaaagccatccaagctggagctgtccgacctgtccaagaagttcccacagctgggtgctacaccgttcccccgaaagcctctccagcccgaagttggcgaggcgcctctcaaggcatcactccccgagcctggcgcacctgcgaggaaacctctgcagcctgacgaactgtctcaccctgcacggccacccagcgagccgaagtctggagccttcccacggaagctgtggcaaccagaagctggggaggcgaccccacggtcccctcaaccggagctttcaacctttcccaaaaaacctgcgcaacctgagtttaacgtctaccctaagaaacctccccagccacaggtcggcggcctcccgaaaaaatcggtacctcagcctgaattcagtgaagcagcacagacaccactgtggaagcctcaatcctctgaaccaaaacgtgactcctccgccttccctaagaaagcttcacagccaccattgagcgactttcctaagaagcctcctcagcccgagctcggcgacttaacacgaacgagctccgaaccagaggtgagcgtgcttcctaaacgtccaaggccagccgaatttaaggcgctgtccaaaaagccccctcaaccggaactcgggggattaccacgaacgtcaagcgagccagaattcaacagcttgccacgcaagctgctccagcccgaacggaggggccctccacgcaaattctcccagccggagccctccgccgtgctcaagaggcaccctcagcctgaatttttcggcgatctgccgcgcaaacctcccctcccatcatccgcgtctgagtccagcctacctgcagccgtggccggcttctctagccgtcatcctctctcacctggctttggtgccgccggtactccgaggtggaggagcggcggattggttcattcaggaggagccaggccagggttgagaccttcccatcccccccgaaggcgacccttgccaccagcatcaagcctcggccaccctccagccaaaccacccctcccgccaggccctgtggatatgcagtccttcagacggccttccgcagcgtctattgacctcagacggacgcgctctgcagccggtttgcacttccaggatcgccagcccgaggatatccctcaagtcccagacgaaatctatgaactgtatgatgacgttgagcctagagacgactcctccccgtcccccaaaggccgcgacgaggccccttcagtgcagcaagcagcccggcgccctcctcaggatccagcgctgaggaaggagaaggatccccaaccacagcaactgccccctatggatccgaaactcctaaagcagctacgtaaggctgaaaaagctgaaagggagtttcgcaaaaagttcaagtttgaaggagaaatcgtagtccataccaaaatgatgatcgatccaaacgccaaaaccagaagggggggaggcaaacatctcggcatcaggcggggggagatcctggaggtaatcgaatttaccagcaacgaagagatgctctgccgggacccaaaaggaaagtatggttatgtgcccaggacagccctgcttccccttgagactgaggtgtatgatgacgtagatttctgcgatccactcgagaatcagccacttcctctgggtcgatag

SEQ ID NO: 32039 - DNA, 72 bp, Artificial Sequence
  Description of Artificial Sequence: Synthetic coding sequence
aaattctcccagcctgaggtggcagagggcatgagtcgccaaaatctgggactgaaactcagagggcgatag

SEQ ID NO: 32040 - DNA, 1320 bp, Artificial Sequence
  Description of Artificial Sequence: Synthetic coding sequence
atgtctaagaccatggccatgaacttactagaggattggtgcagagggatggaggttgacatccatcggtccctcctggtcacaggtattccagaggactgtggacaagctgagatcgaggaaacattaaatggagtgttatctccccttggaccttatcgcgtgctaaacaagatcttcgtcagggaggagaacgtcaaggcagccctgatcgaggtaggagagggagtaaatcttagcacaattccccgggaattccccgggaggggcggcgtgtggagggtggtctgtcgggatcccacccaggatgcagaatttctgaagaacctgaacgagtttctcgacgctgagggcagaacctgggaggacgtcgtgagactgctgcagctgaaccaccctacgttgtcccagaaccaacaccaaccaccggagaactgggccgaggcgctgggcgttctgctcggcgcggtggtccaaataattttttgcatggatgcagaaatccggtcccgcgaggaggctcgggcacaggaggctgcggaattcgaggagatggccgcctgggcgctcgccgccgggaggaaggtgaaaaaagagccaggactggccgctgaggtaggctccgcactgaaggctgagacacccaacaactggaatgccacagaggatcagcatgagccgaccaagcccctggtgcggagagcaggcgcgaagagtaggagcagaaggaagaagcagaaaaagaacagtcggcaggaagctgtcccgtggaagaagccgaaggggatcaatagtaacagcacagcaaacttggaagatcccgaggtcggagacgccgaatccatggcaatttctgaaccaattaagggatctcgcaagccctgtgtaaacaaagaagagctggctctgaaaaagcccatggcgaagtgtgcatggaaaggcccccgtgagcctcctcaggatgctcgtgccgaggctgaaagccctggtggggcatccgagagcgatcaagatggaggccacgagagcccaccaaaaaaaaaggccgtagcgtgggtgtccgccaaaaatcccgccccaatgcgtaaaaagaagaaagtgtcactgggccccgtaagctacgtgttggtcgattcagaagatgggcgcaaaaaacccgtcatgccgaaaaaaggtcccgggtccaggagggaagctagcgatcagaaagctcctcggggccaacagcccgcagaagcaacagcctccacgagcaggggccccaaagcgaaacccgaagggtcaccgagacgcgcaacaaacgagagcaggaaagtgtag

SEQ ID NO: 32041 - DNA, 615 bp, Artificial Sequence
  Description of Artificial Sequence: Synthetic coding sequence
atgagtaagaccatggctatgaatcttctggaggactggtgtaggggcatggaggtcgacatccataggtctctcttagtgacagggattccagaagattgcggccaggccgaaatagaggagacgttgaatggcgtgctttctcccctggggccctaccgggttctgaataaaatattcgttcgggaggagaatgtgaaagctgcccttatagaagtgggtgagggcgttaatctttcgacaattccaagggagttccccggaagaggtggcgtatggcgcgtggtgtgcagagatcccactcaggacgcagagttccttaagaacttaaacgagttccttgacgctgagggccggacttgggaggatgtggtaaggcttctccagttgaaccatccaacgttgagtcagaaccaacatcagccacccgaaaactgggccgaggctctgggtgttctattgggtgcagtcgtccagataatattttgcatggatgccgaaattagaagccgtcgcgaagaaggcgaggagagaacaggtgcctgctctcgaggcgggttttgtctaaagggacgggacccacagcaattggaatgtcacgggcgacccgcctag

SEQ ID NO: 32042 - DNA, 1137 bp, Artificial Sequence
  Description of Artificial Sequence: Synthetic coding sequence
atgtctaagacaatggctatgaatttactggaggattggtgccggggtatggaggttgacatccacaggtccttgctggtgaccggtattcctgaagattgtgggcaggcagagatcgaagagacgctgaacggtgtcctgtcgccacttggaccgtatcgggtgctcaacaaaatatttgtcagggaagagaacgtcaaggcagccctcattgaagtcggagagggcgttaacctaagcacaattccaagggagttccctggccgggggggggtgtggagagtggtctgcagggacccaacgcaggatgctgaatttctaaaaaatctaaacgaattccttgatgcggaaggcaggacctgggaggacgtggtgcgtctgctgcagctcaaccatcccacgttgtcccagaaccagcatcaacctcccgagaattgggcggaagctttaggagttttactcggagctgttgttcaaatcattttctgtatggacgccgaaatacgatcacgtgaagaagccagggcacaggaagcggccgaattcgaggagatggccgcttgggcactggcagcaggtagaaaggtgaagaaggaaccaggcctcgctgccgaagtggggagcgcactcaaggccgaaacccccaacaactggaacgcgacagaagaccagcatgagccaacaaagccactggttagaagagcaggcgccaaaagcaggtcgcgacggaaaaaacagaagaagaactctcgccaagaggcagtgccctggaaaaaacctaaaggaataaacagcaatagcacagctaatcttgaagatccggaagtcggggacgccgagagcatggccatcagtgagcccatcaaaggcagtagaaaaccgtgcgtgaataaagaggagctcgcccttaagaagcctatggcaaaatgcgcctggaaggggccaagggagcccccccaggacgcgagggcagaggccgagagcccggggggcgcctccgagagcgaccaagacggggggcacgaaagtccccccaaaaagaaggctgtggcctgggtgtcggccaaaaacccagcccctatgaggaagaagaaaaagaacccagagagatttgatctgggagaccacccatactag

SEQ ID NO: 32043 - DNA, 840 bp, Artificial Sequence
  Description of Artificial Sequence: Synthetic coding sequence
atggccatgtccctattacaagactggtgtcggtcgcttgacgtagacgcccatcgggcgctgttggttacaggcatacccgaggggctcgaacaggcagatgtggaggctgtgctacagcccacccttctgcccctgggcacatttcgcttgaggcatatgaaagcactgatgaatgaaaaggcccaggcagctcttgtggaatttgttgaggatgtcaaccatgccgctataccaagggagataccgggcaaggatggcgtctggcgagttctttggaaggaccgcgcccaggataccagggtgctgaggcaaatgagacggctcctgctagacgacggacccacacaggcagcagaagccggcacacctggtgaagcgcccacccctcctgcttctgaaactcaggcacaagacagtggagaggtgactgggcaggcgggctccctgctgggagcagcccggaacccgcgccgaggtcgcagggggcgccgcaatcggacccggcggaaccgcctcacacagaagggaaagaaacggtcaagagggggacggccttccgccccggcgcggagtgaagctgaagactctagcgacgagtcccttggaattgtcattgaggagattgatcagggcgacctgagcggggaagaggaccaatccgccttatatgcgactctgcaggcagctgccagagagctggtcagacagtgggccccatgtaacagcgagggaggcccctgtccaacctgtccatgggagggcatcggggggtttggttgcgatctgactgtccaaacacggcttagccagagctatgtacgggacacccagatgtag

SEQ ID NO: 32044 - DNA, 1221 bp, Artificial Sequence
  Description of Artificial Sequence: Synthetic coding sequence
atggcttggtgcgtggccacagcggacccggcccatacaagcagacctttgtttactggcctcgctgtgtctagagggtcggctggccatgcttggtcagccgggtttgactgggcggctgtggtcgtggtgacggggagacggtgtcgttcaggtcagacagtgcccggagccgctcgttctcctctcctcccacacccattgcccagcccactcagagtgcctcctccaaccggggctctgggacgtcccctcccaagatggccgcaaccgcggcgtactcccttttggtctgtgatatcaaaagcgacgaagctgcggagcccaccctggaccagtgctcctaccgcatccaaccttgagcgagacagaaggatttcacgcatcgatcctatacggagtcctaccatggctggaggattgtttgccgtgtctaagaaatacttccagtatcttggcacctatgacaccggtatggaggtgtggggaggggaaaatctggagctctctttccgggtatggcagtgcggtgggaaattggaaattcatccctgctcgcacgtcggtcatgtcttccccaaacgtgcgccatacgctcgtcctaactttctgcagaacaccgctagagcagcagaggtatggatggatgaatacaaagaacacttctataatcggaacccgcccgcacgcaaagaggcatacggagacatcagcgagcgaaagctgctgagggagagactgcggtgtaaatccttcgactggtatctgaaaaacgtatttccaaatcttcacgtccctgaagaccgtcccggctggcatggagccattaggagccgcggtatctcgtccgaatgtttggactacaactctcctgataacaaccccaccggcgctaatctatctctatttgggtgccatgggcaaggaggcaaccagttttttgagtatacctctaataaggaaatccgctttaacagtgtcacagaactatgcgcagaggtacccgaacagaaaaactatgttgggatgcagaactgccctaaggacggcttcccagtgcctgccaacattatttggcatttcaaagaagatggcaccatttttcaccctcactctggtttgtgcctgtccgcctatcgcactccagaagggagacccgacgtccagatgcgtacctgcgacgcccttgataagaaccagatctggtctttcgagaagtag

SEQ ID NO: 32045 - DNA, 1728 bp, Artificial Sequence
  Description of Artificial Sequence: Synthetic coding sequence
atggcctccgcgaccgaggatcctgttcttgagaggtacttcaaaggacataaagcagccataacatcattagatctctctccgaacggcaagcagctgggggcgggaagggctcgggaactgggcagccgcaggctgtccgatctccagaagaataccgaagacctgagcaggccactgtacaaaaaaccaccagccgactccagagcactcggcgagtggggtaaggctagtaagttgcagttaaatgaggacgagctcaagcagcaagaggaactgatagagcgctacgcgatcaatatttacctcagcgaccgcatttccctgcataggcacattgaggacaagaggatgtatgaatgcaaatctcaaaaattcaattacagaactttacctacaacctcagtgattatcgccttctacaacgaagcttggtcaactttactcaggaccatacactccgtattagagacatcaccagcagttctgctgaaggagatcatcctcgtggatgatttgtctgacagagtttatcttaagactcagctggagacttatatctcaaatctcgacagggttcggctaatcaggaccaacaagagagaggggctggtgcgggcccgtcttattggagcaactttcgcaacaggcgacgtgctcaccttcctcgactgccactgtgaatgtaactcaggatggcttgagcctctcttggagagaatcgggagggacgagacggctgtggtgtgcccagtaattgataccatagactggaacaccttcgagttctatatgcagattggagaacctatgatcggcgggttcgactggagacttacgtttcagtggcatagtgtccctaagcaggaacgggatagaaggatctcgcgcatcgaccctatccggtcgccgactatggccggaggcctgttcgcagtcagtaagaaatactttcaatacctagggacctatgacactggaatggaggtgtggggaggtgagaaccttgagctcagttttcgggtttggcagtgcgggggcaagctcgagatacacccatgcagccacgttgggcacgtgttccccaagagagccccatacgctaggccaaactttctgcagaacaccgcccgagccgcagaggtatggatggacgagtacaaggagcacttttacaaccgaaacccccctgctcggaaggaagcgtatggggacatctccgaacgcaagcttttgcgggaaaggttacgctgtaaaagcttcgactggtacctcaagaacgtattcccgaacttgcacgtgcccgaagacagacctggctggcacggcgccatcaggagccgcgggatctccagcgaatgcctggattacaactccccagataacaaccccaccggagccaacctgagccttttcggatgtcacggccagggagggaaccagttttttgagtacactagtaataaggagattcgctttaattctgttaccgaattgtgtgcggaggttcctgaacagaaaaactacgtggggatgcagaattgccccaaggatggtttccccgtccctgccaacatcatctggcacttcaaggaggacggtactatcttccatccccactctggcttgtgcctgtcagcttaccgcacacccgagggcaggccggatgtgcagatgaggacctgcgatgcactggacaaaaaccagatttggtccttcgagaagtag

SEQ ID NO: 32046 - DNA, 1476 bp, Artificial Sequence
  Description of Artificial Sequence: Synthetic coding sequence
atggagaacgaagagtctgacgtgaaacctcctgactggcccaatcctatgaacgctaccagccagtttccacagcctcagcactttgactcctttggcctccggttacctagggacatcacagagttaccagaatggtcagaagggtacccattctatatggcaatgggctttcccggttatgacctatccgcagacgatattgcaggtaaattccagttctctagggggatgcgcagaagctacgatgcaggctttaagttgatggttgtcgaatatgccgagtcaaccaataactgtcaggccgccaaacaattcggggtgctggaaaaaaatgtgagggattggagaaaggttaaaccccagctgcagaatgcccacgcaatgagaagagctttccgcggtcccaaaaatggccgatttgctctagttgaccagcgagtggctgaatacgtcagatacatgcaggctaaaggcgatcccatcacccgggaggcaatgcagctgaaggctctggaaatcgcccaagaaatgaacattcctgaaaaaggcttcaaagcttcactcggatggtgtcgccggatgatgagaagatatgatctaagtctgcgacataaagtgccagttccacagcatctccctgaggacctgactgagaagcttgtgacctaccaacgcagcgtccttgctctgcgccgagcacacgactacgaggtggcccagatggggaatgccgacgagacacccatttgtctggaagtcccctcacgggttacggtggacaatcagggagaaaagcctgtccttgtgaagacacccggaagagagaagctgaagattaccgccatgctaggggtactggcagacggcaggaaactgcccccatacatcattctgcgtggaacttacatccctcctggcaaatttccttcggggatggaaatcagatgtcatagatatggatggatgacagaggacctcatgcaggactggctcgaggtggtgtggcggcgtcggacaggggcagttccgaagcagcgaggtatgttgattctcaacgggttccgaggacacgcaactgactcagtcaagaatagcatggagagtatgaacacagacatggtgatcattcctgggggtctgacctctcaattacaggtgctcgacgtcgtagtctataagcccctcaacgacagcgttagggcccagtacagcaactggctgctcgcgggtaacctagctctcagtcctacaggcaacgcgaagaaacctcccctgggactctttctggaatgggtgatggtcgcctggaattcgatctcctctgaatctattgtgcagggattcaaaaagtgccacataagctctaatcttgaagaagaagatgatgttctctgggagattgaatcggaactgcccggaggcggtgagccaccaaaggattgtgacaccgaatctatggcagagtcgaactag

SEQ ID NO: 32047 - DNA, 1011 bp, Artificial Sequence
  Description of Artificial Sequence: Synthetic coding sequence
atgtataccgtcctcactggaacacctccattcatggcctcgcctctgtccgagatgtatcagaatatacgtgagggccactaccctgagccagcacacttatccgcaaacgcccgacgcctgatcgttcaccttctcgcccccaatccagccgagagacctagcttagatcatctgcttcaggatgacttcttcacacagggattcaccccagacagattgcccgctcattcttgccattcccctcccatctttgccatccctcccccccttggacgaatcttccggaaagtcgggcaaaggttactgacgcagtgccgtcccccctgcccctttaccccaaaggaagctagtgggcctggtgaaggaggacccgaccctgactctatggaatgggatggggagtccagcctctccgcaaaggaggtgccatgtttagaggggccaattcaccttgttgctcaggggaccttgcagagcgacctggccggcccagagggtagccgcagacctgaagtggaagcggctttgcgccatttgcagttgtgcctcgatgtgggtccccccgctacacaagatccgcttggagagcagcaaccaattctgtgggcacctaagtgggtggattattcttctaagtacgggtttgggtatcagctgcttgacggtgggcgcaccgggagacatccacatggtcctgcaacccctaggagggagggaacactgcccactcccgtccctcctgcaggccctggcttgtgtctgttgcgcttcctagccagcgagcacgctttgctgctgctcttctctaatggtatggttcaggtctccttttccggcgtgccagcgcagttggtgctatctggggagggcgaaggcctgcaactgaccctgtgggagcagggctcacccggtacatcttactccctcgatgtgcctaggtcccatggttgtgcaccaacaacggggcagcacttgcaccacgctctcagaatgctccagagtatctag

SEQ ID NO: 32048 - DNA, 1893 bp, Artificial Sequence
  Description of Artificial Sequence: Synthetic coding sequence
atggacattaagggccagttctggaatgatgatgatagcgagggggataatgagagcgaggaatttttatacggtgtgcagggctcatgtgcggccgacctgtacagacatcctcaactcgatgcagatatcgaggccgttaaggaaatctacagcgagaattccgtgtccatcagggaatacggcactatcgatgatgtggatattgacctccacatcaacatcagcttcctggacgaagaagttagcacagcttggaaagtgctgcgaactgagcccatcgttcttagattaaggttctctctcagccagtatttagacggacctgagcctagcatcgaggtcttccaacctagcaataaggagggcttcggcctgggactgcagttgaagaaaatcttgggcatgttcacctctcagcagtggaagcaccttagcaatgacttcttgaagacccagcaggaaaagagacatagctggttcaaagcatcaggaactataaaaaaattccgtgctggactcagtatcttcagcccgatcccgaaatctccatcctttcccattatacaggactccatgctgaaggggaagttaggggttcctgagttgcgagtgggaagattgatgaacaggtccatttcctgcactatgaagaatcctaaggttgaggtgttcggttatccacctagcccccaggccggcctgctgtgtccacaacatgtgggtcttcctcctcctgcccgcacgtcacccctggtaagcggtcattgcaagaacatcccaactctcgaatacggattcctggtacaaattatgaaatacgccgaacagcgaatcccaactctgaacgagtattgcgtggtatgcgacgagcagcacgtttttcagaatggttctatgttgaagcctgctgtgtgcaccagagagctgtgcgtgttttccttttataccctgggagtgatgtcaggggccgccgaggaggtggccactggtgctgaagtggtcgacctcttagtggccatgtgcagggccgctctcgagagccctaggaaaagtattatctttgagccttacccgagtgtcgtggaccctactgaccctaagacactcgcgttcaatccaaagaaaaagaattatgagcggttgcagaaagccctggactctgttatgtctatccgggagatgacgcaaggctcttacctggaaattaaaaaacaaatggacaaattggatccactggcccatcccctgcttcagtggatcatctctagtaacagatcacacattgttaagctccccttgagtcgtcttaagttcatgcacacttcccaccagtttctgctgctgtcctcaccccctgccaaggaggccagattcagaacagcgaagaaactctacggcagtacttttgcattccacggctcccacatcgagaattggcattccatcctgcgtaacggtttggtcaacgcttcgtacaccaagctgcagttgcatggcgcagcttatggaaaagggatatacctatctcccatctcgtcgatctccttcggctacagtggcatgggaaaagggcagcacagaatgcccagcaaggatgagctcgtgcaacgctacaacagaatgaatacaatccctcagacccgttcaatccagtctagatttttgcaatctcgcaatctgaactgtatcgcactttgcgaggttatcacatccaaggacctacagaagcacggcaacatctgggtgtgtccggtgagtgatcacgtttgcacaaggttcttctttgtgtacgaggacgggcaggtgggagacgccaacatcaacactcaggacccgaagatccagaaggaaattatgcgggttatcggcacacaagtgtatactaattag

SEQ ID NO: 32049 - DNA, 405 bp, Artificial Sequence
  Description of Artificial Sequence: Synthetic coding sequence
atgctgctcgtgctgctctcagtagtcctgcttgcgctgtcttccgctcagagcaccgataatgatgtgaactatgaagatttcaccttcactattcccgatgtagaggacagctctcagagacccgatcagggccctcagaggcccccccccgaaggattgctgccacgtcctcccggcgacagcggcaaccaggacgacggcccccaacagagaccaccaaaacccggtggccatcaccgccacccaccgccccctccatttcagaatcagcagcgtccgccaaggcgagggcaccgtcagctctctctccctaggttcccatctgtcagcctgcaggaagcctcctccttcttccagcgcgaccggcccgccagacaccctcaagaacaacctctgtggtag

SEQ ID NO: 32050 - DNA, 699 bp, Artificial Sequence
  Description of Artificial Sequence: Synthetic coding sequence
atgttccacaaagcagaagagctgttctcgaaaaccacaaataatgaagtggacgacatggatacttcggatactcagtggggctggttttacctggctgagtgtgggaagtggcatatgttccagcctgataccaacagtcagtgtagtgtcagcagcgaggacatcgaaaagtcattcaaaacaaatccgtgcgggtctataagctttactacaagcaaattctcctacaaaatcgacttcgctgaaatgaagcagatgaacctgacaacaggcaagcagagattgattaagcgcgcacccttctcgattagcgctttttcttatatctgcgaaaatgaggccattccgatgcctccgcactgggagaatgttaatacgcaggttccgtatcagcttatacctctgcacaaccagacgcacgagtataacgaagtcgcaaacctatttggcaagaccatggatcgcaataggattaagaggattcagcgcatccagaatctggacctctgggaatttttctgccgaaaaaaggctcagttgaagaaaaaacggggagtccctcagataaatgagcagatgcttttccacgggacctcctccgagttcgtggaggctatttgcatccataacttcgactggcgcatcaacggtatacatggcgccgtgttcgggaaggataatatgtggaaactctag

SEQ ID NO: 32051 - DNA, 774 bp, Artificial Sequence
  Description of Artificial Sequence: Synthetic coding sequence
atgtgggaagtagcacatgtaagtgagatgaagcaaatgaacctgaccaccggcaagcagcggttgataaagcgagcgccgttcagcatcagtgcctttagctatatttgtgagaacgaagcaatacctatgcccccccattgggagaacgtgaatacacaggtaccatatcagctgatcccgctccataaccagacgcacgagtacaacgaagttgcaaacttgttcgggaagaccatggaccgcaatagaatcaaacgcatccagcggattcagaatttggatctgtgggagtttttctgccggaaaaaggctcagttaaagaaaaagcgaggtgtgccacagattaatgagcagatgttattccatgggacctcctccgagttcgtggaggccatttgtattcacaattttgactggaggatcaatggaattcacggtgcggtgtttggcaagggcacctactttgcgagggacgctgcctactcctcgcggttttgtaaggacgacatcaagcacggtaacacatttcagatccacggagtgagcttgcagcagcgccacttgttccgcacctacaaatcaatgtttctagcaagggtgttgataggggactacattaacggcgacagcaagtatatgcggccaccgtcgaaggatggaagttacgtaaacctgtatgactcctgcgtcgatgacacctggaatcccaagattttcgtcgtgttcgacgccaatcaaatttatcctgagtacctcattgacttccactag

SEQ ID NO: 32052 - DNA, 774 bp, Artificial Sequence
  Description of Artificial Sequence: Synthetic coding sequence
atgtgggaggtggcccacgtttctgagatgaagcagatgaatcttacgacgggcaaacagcgtctgattaagagggcaccattctctatcagtgccttttcgtacatctgtgagaacgaggcaatccccatgccgcctcactgggagaatgtaaacactcaggttccctaccagttaatcccattgcacaatcaaacacacgaatataatgaagtagcaaatctgtttggtaaaaccatggatcgtaataggattaagcgcatacaaaggatccagaacctggatctatgggagttcttctgtcgtaagaaagcacagctaaaaaaaaaaagaggcgtgccacagatcaacgaacagatgctttttcacgggacatccagcgaattcgttgaggcgatctgcatccataatttcgattggagaattaacgggatacacggagcagtctttggaaagggcacgtattttgcaagagatgctgcctattccagccggttctgcaaggacgacatcaagcatgggaacacctttcagatccatggcgtcagcctgcaacagcgccatctgttcaggacatacaagtcaatgttcctggcacgggtcttgattggcgactacattaacggggactccaaatatatgagacctccgtctaaggatggaagttacgtgaacctgtacgactcgtgtgttgacgatacatggaaccctaagatattcgtggtgttcgacgctaatcagatctatccagaatacctgatcgattttcactag

SEQ ID NO: 32053 - DNA, 141 bp, Artificial Sequence
  Description of Artificial Sequence: Synthetic coding sequence
atgaagtggatgacatggacacggcagataccatccggtgcagggttcacttggcagaatgttgggagcggaacatgtttcagcaggatcccaacagttagcgttcaattagcggtaaagatctctaagaaagcatcttag

SEQ ID NO: 32054 - DNA, 1557 bp, Artificial Sequence
  Description of Artificial Sequence: Synthetic coding sequence
atggacatcaagggacagttttggaacgatgacgacagcgagggtgacaacgagtctgaggagttcctgtatggggttcaagggtcttgtgccgccgacctgtaccgccacccccagctggacgctgatattgaggccgtcaaggagatttattccgagaactcagtgagcataagagaatatgggaccatcgatgacgtagacatagacctgcatatcaacatatctttccttgatgaagaggtgtccactgcttggaaagtattgcgcacagagccaatagtgctgagacttcgattttctctcagccagtacttagatggtcctgagccttctattgaagtgttccagccatccaataaggaaggattcggtctgggactacaattaaagaagatcttaggcatgtttacctcccagcagtggaagcatctctcaaatgacttcctgaaaacccagcaggagaaacgtcattcctggtttaaagcgagcggcactatcaaaaaattccgcgctggcctgtccatctttagcccgatccccaaatcaccctccttcccgattattcaggactccatgctgaaggggaagctgggcgtgccagagcttagagtcggccggctaatgaatcggtctatttcctgtaccatgaagaaccctaaggttgaggttttcggttatcctcctagcccccaagccgggttgttgtgtccgcagcacgttggattacctccacccgctcgtactagtcctctggttagtgggcattgtaaaaatattccaactctggagtatggatttctggtacagataatgaaatatgccgagcagcgaatcccaacattgaacgaatattgcgttgtgtgtgacgagcagcatgtcttccagaatgggtccatgctcaaacccgccgtctgcacccgagagctgtgtgtattttctttctatacgttaggtgtcatgagcggagcggccgaggaggtggcaactggcgcagaggtggtggatctgctggtggccatgtgtcgcgcagccctggaatcgccgagaaagtccataattttcgagccatacccatccgtggtagatcccaccgacccaaagactctcgcctttaatccgaagaaaaagaattacgaaagattgcagaaggctctggacagcgtaatgtccattcgcgaaatgacccagggaagctatcttgaaattaagaaacaaatggacaaattggatccgctggcccacccactgttacagtggatcataagctcaaatcggtctcacattgtcaagctgcctctgagtagacttaagttcatgcacacatcacatcaatttctgctactgtcctccccccccgcaaaggaggctcgtttcagaaccgcgaagaaactgtatggaagcacttttgcatttcacggttcccacatagaaaactggcattccatcctgcgtaatggcctggtgaacgcttcctataccaagctccaggagtgggaaaaggattccactggctgtccaccgaggatgtcatggtcccgtgacactaccggttag

SEQ ID NO: 32055 - DNA, 1893 bp, Artificial Sequence
  Description of Artificial Sequence: Synthetic coding sequence
atggacatcaaaggccagttctggaacgacgacgattccgagggcgacaatgagtctgaggagttcctgtatggggtgcaggggtcctgcgccgccgacctctatcggcacccccagcttgacgctgacattgaggctgtaaaggaaatctacagtgaaaatagtgtcagcatccgggagtatggcaccatcgacgacgttgatatcgatctgcatattaatatctctttcctggatgaggaagtctctaccgcatggaaggtgctcagaactgaacccatcgtgttacggctcaggttctcactgtcacagtatctggacggtccagagccttcaattgaggtcttccagccgtcaaacaaggaagggttcggcttgggactgcagctgaagaagattcttggaatgtttacttctcagcagtggaagcatctgtctaacgatttcctgaagacccaacaggagaaacggcacagctggttcaaagcatcaggcactattaaaaagttccgcgctggtctctctatcttctcccctattcccaaatctccttcttttcctatcatacaggattccatgctcaagggcaagctaggggtgcccgaattgagggtggggcggctcatgaacagatctatctcatgtaccatgaaaaacccaaaggtggaagtttttggctatcctccaagcccacaggccggactgctgtgtcctcagcatgttggcctccccccccctgcaagaacgtctcctctggtgtcaggccattgcaagaacattcctacccttgagtacggtttcctggtccagatcatgaagtatgccgagcagagaattcctaccctgaatgagtactgcgtggtctgcgacgaacagcacgtgttccagaatggtagcatgctcaagcctgcggtgtgcacccgggaactatgcgtattctctttctatacattgggcgtgatgagtggagccgctgaggaggtagcaacaggtgcagaagtggtcgatctgctggtggctatgtgcagagctgctctcgaatcccccaggaagagtataattttcgagccctacccctccgtggtggatcccacggatcccaaaacgctcgctttcaaccccaaaaaaaagaactatgaacgcttgcagaaagccctggattcagtcatgagcatcagagagatgacgcaaggttcgtatctagaaatcaaaaagcagatggataaattggatcccctggctcaccccttattgcagtggatcataagcagcaaccgttcccacattgttaaactcccactgagcaggttgaaattcatgcacacttctcatcaatttcttttattatcctctccgccagcaaaggaagccaggtttcgtaccgcgaagaagttgtatggttctacatttgcatttcacggatcccacatcgagaactggcattctattctcaggaatggtctggttaacgcgtcctataccaagctccaattacatggggctgcctatggcaagggtatttacttgagtccgatttccagcatcagtttcgggtactctggaatgggcaaaggacagcaccgcatgccttcaaaggacgaactggtgcaacgctacaatcgtatgaacactatccctcagaccagatccatccaaagcagattcctgcagagccgaaacctcaattgcattgccctgtgtgaggtaattacgagcaaagacttgcagaaacacggcaatatctgggtgtgccccgttagcgaccatgtgtgcacgcggttctttttcgtctatgaagacggccaggtgggtgacgcaaacataaatactcaagatcctaaaatccagaaggagattatgagggtgatagggacccaggtgtataccaattag

SEQ ID NO: 32056 - DNA, 1167 bp, Artificial Sequence
  Description of Artificial Sequence: Synthetic coding sequence
atggacatcaagggacagttctggaacgacgacgacagtgaaggagacaacgaatccgaggaatttctgtacggtgtacaggggagctgtgcggccgatctctatcggcaccctcagttggacgctgatattgaggccgtgaaagaaatatactctgaaaactcggtgtctatccgtgagtacggcactattgacgacgtggatatcgacctccacatcaatatctctttcctcgatgaggaagtgagcacagcctggaaagtgctccggacagagccaattgtgcttcgccttaggttctctctgtctcaatacctggatggccccgaacccagcatcgaggtcttccagccttcaaacaaggaaggatttgggctggggctacagttaaagaagatcctcggtatgttcacctctcagcagtggaaacacctttcaaacgactttttgaagactcagcaagaaaagagacacagttggtttaaggcaagcggcaccataaaaaagttcagggcgggcctttctatcttcagcccgattccaaaatcccccagcttccctataattcaagacagcatgttaaaaggcaagctgggggtgccagaactgcgcgtcggtaggctcatgaaccggagcatctcttgcactatgaagaatcccaaggtcgaggtctttgggtacccaccatcgcctcaggctggcctgctgtgtcctcagcatgttgggctgccacctccagctagaacttctcccctggttagtggtcactgcaaaaacatcccgactttggaatacgggttcttagtacagattatgaagtatgcagaacagagaatccccacactaaacgagtactgtgtagtctgcgatgagcaacatgtcttccagaatggctccatgctgaaacccgccgtatgtactcgagaattatgcgtttttagcttctacacattaggagtgatgtcgggcgcagcagaggaggtcgccacaggagcagaggttgtggacctgcttgtggctatgtgtcgcgcagctctcgaaagcccaaggaaaagtattattttcgagccttatccaagtgtggttgacccaacagatcccaaaactgtagcctttatggtcgagctcgacccacggacaaccccccactcagatggccctgattag

SEQ ID NO: 32057 - DNA, 858 bp, Artificial Sequence
  Description of Artificial Sequence: Synthetic coding sequence
atgtttacgtctcagcaatggaagcatctaagtaacgatttcctaaagacacaacaagagaaacggcacagctggtttaaggcatcagggactattaagaagtttagagccggactctcaatcttctccccaattccaaaaagcccttcgttcccaatcatccaagacagcatgttgaagggaaaactgggggtgcccgagctccgagtaggcaggttgatgaataggtcaatctcatgtacaatgaaaaatccgaaggtagaagttttcggctaccctccctcaccccaggtgagtggccactgtaagaatatcccgacattggaatacggctttctagttcaaattatgaagtacgcagagcaacgcatccctaccctgaatgagtattgtgttgtttgcgacgagcagcatgtattccagaacgggagtatgttaaagcctgcagtatgcacacgggagctgtgtgtctttagtttctacacactcggggtaatgtcaggagcagccgaggaggtcgcaactggcgccgaagtcgtggacctgctagttgcaatgtgcagagccgcactcgaatcccccaggaagtcgatcatattcgagccctatcccagcgttgtggatccgactgatccaaagactttagcttttaaccccaagaagaagaactatgagaggttacaaaaggccctggatagcgttatgagtatcagagaaatgacccaaggctcttatcttgaaatcaaaaaacaaatggataagctcgatccactggctcatcctctgctgcagtggatcatatcctccaacagaagccatattgtgaaactgcccttaagcagatgggttccgcactag

SEQ ID NO: 32058 - DNA, 1665 bp, Artificial Sequence
  Description of Artificial Sequence: Synthetic coding sequence
atggacatcaaaggacagttttggaacgatgatgattctgagggtgacaatgagagcgaagagttcctttatggagtgcaaggctcttgtgccgcagatctttatcgccacccacagctcgacgcagatatcgaggccgtcaaggagatttactctgagaatagtgtctcaattagggaatacggaaccattgacgacgttgacattgacctccatatcaatatcagcttcttagacgaggaggtgtcgaccgcctggaaagtactcagaaccgaaccaatagtgctcagattgcgcttcagtctgtcacaatatttggatggacctgaaccctctatcgaagtatttcagccctcaaataaagaagggtttggccttggcctgcagttgaagaagattttaggcatgttcacctcccaacagtggaaacatctatcaaacgatttcctcaagacacagcaggaaaagcgacacagttggttcaaagcctctgggacaattaagaagtttagagccggtctcagcattttcagccccatacccaagtcgccttcctttccaataatacaggatagtatgcttaaagggaagctcggcgtgcctgaactgcgagttggcagactgatgaatcgatcaatctcctgtacaatgaagaacccaaaagtcgaggtgttcggctatccgccaagcccccaggcaggcctcctgtgcccccaacatgtcggactgcccccacctgcccggacttctccattagtaagtggtcactgtaagaatattcctacacttgagtacggttttcttgtgcaaatcatgaaatacgccgagcagagaattccaacactgaacgaatattgcgtggtctgcgacgagcagcatgttttccagaacggctccatgctgaagcctgctgtgtgcacccgcgaattgtgcgtcttcagtttctatacactcggggtgatgtccggcgccgcggaggaagttgccactggcgctgaggttgtcgacttgttagtcgctatgtgtagagctgcactcgaatcacctagaaagtccataattttcgagccatatccctcagtggtcgacccaactgatcctaaaactttggcatttaatcctaaaaagaaaaactatgaacgactccagaaagctttggactctgtcatgtctattagagaaatgactcagggttcatacctagagattaagaagcagatggacaagttagaccccctggcccacccattactgcagtggattatttcatccaaccgcagccacatagtgaagctgccgttatccagacagctgaagtttatgcacacaagtcatcaatttctgcttctttcaagtccccctgccaaggaggcaaggttcaggactgccaaaaaactctatggaagcacgtttgcttttcatgggtcccacattgagaattggcattccatcttacgaaatggtctggtgaatgcgtcgtatacaaaactgcaactccacggcgcagcttatggcaaaggtatctacctgagccccatctcctccattagcttcggatattcgggcatgggcaaggggcagcatagaatgccaagtaaagacgaactggtgcagcggtacaaccggatgaacacaattccccagcgacgctcatttcagatttag

SEQ ID NO: 32059 - DNA, 750 bp, Artificial Sequence
  Description of Artificial Sequence: Synthetic coding sequence
atgtttactagccagcagtggaaacatctttccaacgactttctgaagacacagcaagaaaaaaggcactcatggtttaaagctagcggcaccatcaagaaatttagagcggggctgagcatttttagtcctattcccaaaagccctagcttccctataattcaggactccatgctcaaaggcaagcttggcgttcccgagctgagagtcggcaggctcatgaaccgcagcatatcttgtaccatgaagaacccaaaggtcgaggtgttcggttacccaccctcaccacaggtgtctggtcactgtaagaatatcccaaccctggagtacggatttctggttcagatcatgaaatacgccgaacagcgcatccccactctgaatgaatattgcgtcgtttgcgatgaacagcacgtgtttcagaacggcagcatgcttaagcccgcagtgtgtaccagggagctgtgtgtcttctccttctatacgctaggcgtgatgtccggagcagccgaagaggtcgctacaggtgccgaggtagtagacctgctggtggctatgtgccgggccgccttagaaagcccaaggaagtctatcatctttgaaccctatccttccgtggtggatcccaccgatccaaagaccctggcttttaatcccaagaagaagaattatgaacgcctccagaaggccctcgactcagtaatgagcatacgcgaaatgacacagggatgcagaaattgcatcaagtag

SEQ ID NO: 32060 - DNA, 2565 bp, Artificial Sequence
  Description of Artificial Sequence: Synthetic coding sequence
atgggtatgtgtagcaggcaggagcggatacagaaggacatagatgtggttattcagaaatcacgtgctgaaaaggactgtttatttgccgacttccggtattcagacagcactttcactttcacatatgtcggaggccctcggtccgtgagttattcggttcacgtatccgaggattatcccgacaatacttacgtatcaagcagtgaaaacgatgaagacgtcctggtgactacagagccgatccccgttatattccatcggatagctacagaactgcgcaagacaaacgacatcaactgttgtctcagcataaagagcaaattacagaaagagaacggagaggaaagcagacagaactccacagtggaagaggactctgaaggcgacaacgactctgaagaattctactatgggggccaagtaaactacgacggcgaactacataagcacccccagttggaagcggatctgagcgccgtcagggaaatttatggccctcacgctgtctcactgagggaatacggagcgatcgacgatgtggacattgatcttcacatcgatgtgtcttttctcgacgaggagatagcagtcgcctgggaggtcattcgcactgaaccaattatcgtaagactgcactgctcacttacccaatacttaaacggacccgttccgacagtcgatgtttttcagatttccactaaagaacgatttggactcggccaccagcttaaaaaaattatgcagacttttgtgactcagcagtggaagcagtctaaggagaagtcgaactgtctccacaataagaagcttagtgagaagaaggtgaagtcacctctccacctcttcagcacactgcgacgcagtcccagttacccccccccagggtgtggaaagtccaagtcaaaattgaagtctgagcaggacggcatctccaagacacacaaactcctccgccgtacctgctccagcactgtgaaaaccgacgatgtatgtgtgaccaagagccacagaacattcggacgcagcttgtctagtgacccacgggccgagcaagcgatgacggccattaaatctcacaagctcctgaataggccttgccccgcagcagtcaaatctgaagaatgcctaaccttgaagtcacacaggctcctgacacgatcttgctcaggagatccaaggtgcgagcacaacaccaatcttaaacctcacaagctgttaagcagatcttactcttcaaatctgagaatggaggaactgtacggccttaaaaatcacaaactactcagtaaatcatattctagcgcaccaaagagctctaaaaccgagctcttcaaagaacccaatgctgaaggacgtcgcctgtctctcaccagtggcctgattggaatcttaactccaagtagttcttcctcttcccagcttgcccctaacggtgcaaagtgtattcccgttcgagatcgcggcttcctggtccagaccatcgaatttgcggagcagcgcatcccagtcttgaacgagtattgcgtggtgtgtgatgaacctcacgtctttcagaatgggcccatgttgcgccccactgtttgtgagcgagagttgtgcgtcttcgcgttccagactctgggcgtcatgaatgaggcggctgacgagattgccacgggggctcaggtggtcgacctgctggtctctatgtgccgtagtgcccttgagtctcccaggaaggtggttatattcgaaccctatcccagtgttgtggaccccaacgaccctcagatgttggcctttaacccgaggaaaaaaaactacgacagagtgatgaaggcacttgattccattacctccatccgcgagatgacccaggccccctatctggagatcaaaaaacagatggataagcaggatcctttagcacacccactgttacagtgggtgatttcatccaacagaagccatatagtgaaactccccgtcaacaggcagctgaagtttatgcatacacctcaccagttcctgctgctttccagccctcccgccaaggaatctaatttcagggcagctaagaaactgtttggatctacattcgcatttcacggcagtcacattgaaaactggcattccattcttagaaacggactggtggttgccagcaatacaagattgcagctccacggcgctatgtatggcagcggtatctatttgagccccatgtcatctatatcattcggctactccggtatgaacaagaaacagaaggtttcggccaaagatgagccggccagctcgtcgaagtcctccaatacgtctcagtctcagaaaaagggccagcagagccaattcttgcagtctcgcaatctgaagtgtattgccctgtgcgaggtgatcacttcctcagacctccacaagcatggagaaatttgggtggtccctaacacagatcacgtctgtacacgcttcttctttgtgtacgaggacggacaggttggcgacgccaacatcaacacacaggaaggcggaatccacaaagagatcttgcgggtcatcggtaaccagactgctacgggctag

SEQ ID NO: 32061 - DNA, 1482 bp, Artificial Sequence
  Description of Artificial Sequence: Synthetic coding sequence
atgcagaccttcgttacacagcaatggaagcagagcaaagagaaaagtaactgcttacataacaagaagctgagtgagaaaaaggtgaaatctccactgcacctgttcagcaccttgcgacggtcccccagttaccctcctcctgggtgcggaaagagtaagagtaagttaaaatcagaacaggacggtatctccaagacccataaattgctgaggaggacttgtagctcaaccgttaagactgatgacgtttgcgtcaccaaatctcatcggacttttggtcgaagcctctctagcgaccctcgtgcggagcaggccatgactgctatcaaatctcataagttactgaatcgtccctgtccagcagctgtcaaaagcgaggaatgcctgacccttaaaagtcacagactgttgacacgatcatgtagtggagacccaaggtgcgagcacaacactaaccttaaacctcataagctcctatctagaagctatagcagcaacttgcgcatggaagagctctacggcttgaaaaaccataagctgctcagcaagtcctattctagtgcccccaaatccagtaagaccgaactctttaaagagcccaatgccgagggccggagattatccctgaccagtgggctaataggcattctgactccctcatcttcatcctcttcccagctggcccccaacggcgcgaaatgcattccagttcgagaccggggcttcctcgtgcagacgattgagttcgcagagcaaaggatcccagtactaaacgagtactgtgtggtctgtgatgaaccgcatgttttccaaaacggaccaatgctccgacctactgtgtgtgagcgggagctgtgtgtgttcgcttttcagaccttaggagttatgaatgaggccgcggatgagatcgccaccggagctcagaaaaaaaactatgacagagtcatgaaggcactcgactccattacctctatccgcgaaatgacccaggccccctatctggagattaaaaaacagatggacaaacaggatccgttggctcaccctctcctacagtgggtcatctcatctaataggtcccatatcgtgaaattgcccgtgaaccgtcagctcaagttcatgcatacccctcatcagttcctgctgctgagcagccctcctgcaaaagagagcaatttccgcgcagcaaagaagctgtttggctccacttttgcattccacggttcccacattgagaactggcactctatcctgcggaacggattggtcgtggcctcaaacacacggctacagctccacggcgcaatgtatggtagtgggatttacctcagccccatgtcaagcatctcgttcggctatagtgggatgaataaaaaacagaaggtttcagccaaggacgagcctgcttcgtcgtccaaatcaagcaacacttcacagtcacagaagcgtactgcaatccccatcccagcgaagccttag

SEQ ID NO: 32062 - DNA, 174 bp, Artificial Sequence
  Description of Artificial Sequence: Synthetic coding sequence
atgggaatgtgttctcgacaggaacggatacaaaaggatattgacgtcgttatccaaaagtcccgggccgagaaggattgcctgttcgcagatttcagatatagtgatagcacttttacctttacttatgtcggggggcccaggcgaaattctgagctcgccccaggaatgtag

SEQ ID NO: 32063 - DNA, 2439 bp, Artificial Sequence
  Description of Artificial Sequence: Synthetic coding sequence
atgggaatgtgtagcaggcaggagagaattcagaaagatattgacgtagtcattcagaagtccagggctgaaaaagactgtttgtttgccgacttccgctattccgattcaacttttactttcacctacgtcgggggaccgagatccgttagctacagcgtacatgtctcagaggactaccctgataatacctatgtgtctagttccgaaaatgatgaagacgttctggtcaccaccgaaccaattcccgttattttccatcggatcgcaaccgaactcagaaaaacgaatgatatcaactgttgcctgagcatcaagagcaagctgcaaaaagaaaatggagaagaatctcgtcagaattcaaccgtggaagaggattccgaaggtgataacgactcggaagagttttattacgggggacaagtaaattacgatggggagctgcataaacatccgcagctggaagcggatctgagcgcagtaagagagatatacggcccccacgcagtaagcttgcgcgagtacggcgccatagacgacgtcgacattgaccttcacatagatgtgtcatttctagatgaggagattgccgtggcttgggaagtaatacgtactgaaccaattatagtgagattacactgctccttgactcagtacctgaacggccctgtcccaaccgtcgatgtgtttcagatctctacgaaggaacgtttcggcttgggacaccagctgaaaaagataatgcagacattcgttacacagcagtggaaacagagtaaagagaagagtaactgtttgcacaacaaaaagctttcagagaaaaaggtaaagtcgccactccacttattttccaccctgaggagatcaccaagctacccgccgcccggttgcggcaagagtaaatctaagctcaagtccgaacaagatgggattagcaagacgcataaattgttgcgccgaacatgctcatcaacggtcaaaacagatgatgtatgtgtaactaagagccaccgcacattcggcaggagtctttcatctgacccaagggctgaacaggccatgaccgcgatcaagagccataagctgcttaataggccctgcccagccgccgttaagagcgaagagtgtctgacacttaagtcccaccgtctactgacgagaagttgttcaggggaccctcgttgcgagcataacactaatctgaagccacacaaactcctgagtaggtcatattcgtcgaatttgcggatggaagagctttatggcctgaaaaatcataaattactgtccaagagttacagttcagcccccaagtccagcaagacagaactatttaaagagcccaatgccgaaggccggaggttgtctttgacttccggtctgattgggattttgactcccagtagcagttcctcttctcaactcgccccaaatggtgccaagtgcatcccggtgagggatcggggctttctcgtgcagaccatcgaatttgcagagcaaaggattcctgtactgaacgagtattgtgtagtgtgcgatgagccccacgtctttcagaacggccccatgctaagaccgaccgtgtgcgaacgcgagctgtgcgtgttcgccttccaaaccttaggggtgatgaatgaggcggctgacgagattgccacgggcgcacagaagaagaactacgatcgtgttatgaaagctctagactcaattacaagcatcagggaaatgacgcaagcaccttatctggagataaaaaaacaaatggacaaacaggatccgttagcacatccgctactacaatgggtaatctcctccaatagatcccacattgtgaagctccctgtgaatcgtcaattaaagttcatgcatacccctcatcaattcctgctactgagctcaccccccgccaaggaaagcaacttccgggcggctaaaaagttattcggctctacgttcgcctttcacggcagccacattgaaaattggcattctattctcaggaacggtttggtagtcgcctctaacacacgtctgcagctccacggcgccatgtacggttcaggcatatacctgtcaccgatgagctcaataagcttcggttactctggaatgaataaaaagcagaaagtttccgctaaggatgaaccagcaagcagcagtaaaagcagcaatacgagtcagagtcagaagaagggtcaacagagccaattcttgcaatcacgaaatctcaaatgcatcgccctgtgcgaggttattacttctagtgaccttcacaagcatggggagatttgggtagtccccaacacagaccacgtgtgtacaagatttttctttgtttacgaggatgggcaagtaggcgacgcaaacataaacacacaagagggcggaattcacaaagagatattgagggttatcgggaaccagactgctacagggtag

SEQ ID NO: 32064 - DNA, 2502 bp, Artificial Sequence
  Description of Artificial Sequence: Synthetic coding sequence
atggagcccgctgccttacgctgcgcttatttccgatactcggacagtacctttactttcacctacgtgggtggacccaggtctgtcagctacagtgtgcacgtctcagaggattatcctgataacacttacgttagttcttccgagaacgatgaggatgtgctagtaacaactgaacctatcccagtgatctttcaccgtattgctacggagctgcgcaaaaccaatgatatcaactgttgtctctccatcaagtccaagctgcagaaggagaacggcgaggagtccagacagaatagtacagtcgaggaggatagcgagggcgacaacgactcagaggagttctactacggaggccaggtgaattacgacggggagttgcacaagcacccccaacttgaagctgacctatcagcagtgagagaaatttacgggcctcatgccgtgagccttcgagagtacggcgccatcgacgatgttgatatagatctgcacatcgacgtgagctttctcgatgaggaaatcgccgtggcctgggaagttattaggactgagccgatcattgtacgcctgcactgctcgctgacccagtatctgaacggtcccgtccctactgtcgacgtctttcagatctctaccaaggaaaggtttggtctcgggcaccagttaaagaagatcatgcagactttcgttacacaacagtggaagcaatcgaaggagaaaagcaattgcctacacaacaagaagttgagtgaaaaaaaagtgaaaagcccactccacttattctccacactccgcaggagcccatcatatccccccccagggtgcgggaagtcaaagtctaagttgaagagtgaacaagacggaatcagtaaaacccataaactcctccgtcggacatgttcttccaccgtgaagacagatgatgtctgcgtaacaaagtcacatagaacgtttgggcgatctctgagttccgacccgcgtgctgagcaggctatgactgccataaaatcacacaagctactcaatagaccgtgccccgccgccgttaagagcgaagaatgcctgacactcaaatcccacaggcttctgactaggagctgctctggtgatccaagatgcgagcataataccaatctgaagcctcacaagttgctcagtcggtcctacagttcaaaccttagaatggaggagctgtatggcttaaagaatcacaaactgttgtccaaatcatattcatcagccccaaaatcttctaagaccgaactgtttaaagaaccaaacgccgaggggaggcggctgagtctcactagtggattgatcggcattctaacaccttcaagcagctcgtcttcccagcttgctcctaatggcgcaaagtgcatcccggttagagaccgagggtttttggtacaaactatcgagtttgcggagcagagaatccctgttctgaatgagtattgcgttgtctgtgacgaaccccatgtgttccaaaatggccccatgctccggccaactgtgtgtgagcgcgagctctgcgtgtttgctttccagaccctgggggtaatgaatgaggccgccgacgagattgctaccggcgcacaggtggtggacttactggtgtccatgtgccgttccgcgctcgagtctccgaggaaggtggttatattcgagccataccccagcgtagtcgaccccaatgatccccagatgctagcttttaatccccgaaagaagaattatgatagggtcatgaaggcactggattcgatcaccagtatcagagaaatgactcaggcaccttatcttgaaataaagaagcagatggataagcaggacccacttgcccacccattgctgcaatgggtcatcagctctaatcggagtcacatagtcaagctccctgttaatcgccagcttaaatttatgcataccccccaccagttcttgctccttagtagcccacctgccaaggagtccaacttcagggccgccaaaaaactgttcggtagcaccttcgctttccatgggtctcatatcgagaactggcacagtattctgcgtaatggcctggtggtggcgtcgaatacccggttgcaactccacggcgccatgtatggcagtgggatctatttgtcacccatgagtagcatctctttcgggtactctgggatgaataaaaaacagaaggtttcagctaaggacgaacctgcaagctccagcaaaagttccaatacatcccaaagccaaaaaaagggccaacagtcacagttccttcagagtagaaatctgaaatgcatagccctttgtgaagtcatcaccagttctgatctgcataaacatggcgagatctgggtcgtgcccaataccgaccacgtttgcacccgatttttcttcgtgtacgaggatgggcaggttggggatgctaatatcaacacacaagagggcggaattcataaggaaatccttagggtgattgggaaccagaccgcaacaggctag

SEQ ID NO: 32065 - DNA, 2565 bp, Artificial Sequence
  Description of Artificial Sequence: Synthetic coding sequence
atgggcatgtgctccagacaggaacggatccagaaggacatcgatgtagttatccagaaaagtcgcgcagagaaagactgtctcttcgcagacttcaggtacagtgacagcactttcaccttcacctatgtcgggggacctcggtctgtgagttactcagtgcacgtgagtgaagactaccccgataatacctacgtgtcatcctctgaaaacgatgaagatgtactggtgacgacagagcccatccctgtgattttccataggattgccacagaacttcgtaagacaaatgacatcaactgctgtctgagtatcaaatctaaactacaaaaggaaaatggggaggaatctcggcagaacagcaccgtcgaagaggactctgaaggcgacaatgatagcgaggagttttactatgggggtcaagtgaattacgacggcgagcttcataagcatcctcagctggaggcagacctgtccgccgtgagggaaatttatggaccccacgccgttagcctacgtgaatatggcgctatcgacgatgtcgacattgacctgcacattgatgtcagcttcctcgacgaggagatcgccgtggcttgggaggttataaggacagagccaatcatcgtgcggttgcactgctctctcacccagtacctgaatggccctgtgcctaccgtggacgtttttcaaattagtactaaagagcgcttcggattagggcaccagttgaagaaaatcatgcagaccttcgttacccagcagtggaaacaatccaaggaaaaatccaattgccttcataacaaaaagctgtctgagaaaaaggtaaagtcccctctgcatctgttttccactctgagacggagtccatcctatccccccccgggatgcggaaagagcaaaagcaagctcaaatctgaacaggacgggatctccaagacacacaagctgctgagacgaacatgctcatctaccgtgaaaacagatgacgtatgtgtgacgaagtcgcatcggacttttggacgaagtctgtcttctgacccacgcgctgaacaggctatgactgcaatcaaatctcataaacttctgaatagaccttgcccagcagctgtgaaatctgaggagtgtctgacactgaagagtcatagacttctgacccgttcttgttcaggagaccctcggtgcgagcacaataccaatttgaaacctcacaaactgctgagtaggtcctattcctcaaacttaagaatggaggagttatatgggctgaagaaccacaaacttctgtcaaagtcttatagctctgcccctaagtcctctaagaccgaactgttcaaggaacctaacgccgagggccgacgtctatcactcacaagcggcttgatcgggattctcacaccttcatcctcctcctcttcccaactggcccccaacggggctaagtgtatcccggttagggatcggggctttcttgtccagactatagaatttgctgaacagcggatccccgtgttaaacgaatactgtgttgtgtgtgatgaaccccacgtcttccagaacgggcccatgttgaggccaaccgtctgcgaaagagaactttgcgttttcgccttccaaaccctcggtgttatgaatgaagccgccgatgagatcgctaccggcgcacaagtggtggacttactcgtgagcatgtgtcggtccgccttggaatcaccccgcaaagttgtgatttttgaaccctaccctagtgttgttgatcccaacgatccgcagatgctggcatttaatccacgaaaaaaaaattacgacagagtaatgaaggcgttagattctatcaccagcattcgggaaatgactcaggctccctatttggagataaaaaaacaaatggataagcaagacccactggcccatccattgttgcagtgggtgatatccagcaatcgcagtcacattgtgaaactgccagtgaaccgacaactgaaattcatgcacacaccgcaccaatttttactgttgtcctcacctcctgccaaagagagtaactttagagccgcgaaaaaacttttcggctctacatttgcctttcacgggagccacatcgagaattggcattccatattaagaaacgggcttgttgtcgcatccaatactagactgcagttgcacggcgctatgtacggtagcggaatctacctttcgcccatgtcctctatcagctttgggtactccggaatgaataagaaacaaaaagtaagtgccaaggatgagccagcctcctcatcaaagtctagcaatacctcccagagccagaaaaaaggacaacagtctcagtttttacaatccagaaatctcaagtgcatcgccctatgtgaagtgatcaccagttcagatttgcacaagcatggggagatctgggtcgtccccaacacggaccacgtgtgtacacgatttttttttgtctacgaagatggccaggttggggatgcaaacattaatacacaggaaggaggaatccacaaagagattctcagggtgattggaaatcagactgcaacaggatag

SEQ ID NO: 32066 - DNA, 2439 bp, Artificial Sequence
  Description of Artificial Sequence: Synthetic coding sequence
atggggatgtgtagccggcaggagaggatccagaaggatattgacgtggtaattcagaaatcccgcgccgagaaggattgtttgtttgctgatttcagatactcagatagtacttttacgtttacatacgtaggaggtcctagatccgtctcctactctgtccacgtgtccgaagactaccctgataatacatatgtcagctcctcggagaatgatgaagacgtgctagtgacaaccgagcctatccctgtgattttccacaggattgcaaccgagcttcgaaagacaaatgatataaactgctgtctctcaatcaaaagcaagctgcaaaaagagaacggtgaagaaagtcgccagaacagtaccgtggaggaggattccgagggggataatgatagcgaggaattctactatggaggacaagtgaattacgatggggagctacacaagcacccgcagcttgaggcagatctctctgctgtgcgtgagatctatggacctcatgccgtctctttgagggaatatggggcaatcgacgatgttgatatagatctacacattgatgtgtcgtttctcgatgaagaaattgctgttgcgtgggaggttatcaggacggagcctatcattgtgaggctgcactgctcactaacgcagtatctcaacggaccggtgccaaccgtagatgtgtttcaaattagtaccaaggagcgttttggactcggccatcagttaaagaagatcatgcagacattcgtgacgcaacagtggaagcagtcaaaggagaaatccaattgccttcacaataaaaagcttagtgaaaagaaggtaaagtctccgcttcatttatttagcaccctgagacgcagcccaagctaccccccacccggatgtggtaaatcgaagagcaagctgaagtctgaacaggacgggatctcgaagactcacaaactcctgaggagaacctgttccagcacagtcaagacagacgatgtgtgtgtgaccaagtctcatagaacattcgggagatccctcagcagtgatccgagagccgaacaggccatgactgcgattaaaagtcataaactgctgaacagaccgtgccctgccgccgttaagtctgaggaatgtttgacacttaagtcccaccgactcttgactcgttcttgcagcggagatccgaggtgcgagcataacaccaacctcaaaccccacaagctcttgtctagatcatatagcagtaacctgcggatggaagagctgtatgggctcaagaatcataaactcctgtctaagtcctacagttcagctcctaaatccagtaaaaccgagctgttcaaggaacccaacgcagagggccggcggctctcccttactagcgggctcattggcattttgacaccctccagcagtagcagttcccagctcgcgcctaacggggcaaagtgcattcccgtgcgtgatcgggggtttctggtccaaactatcgaatttgccgagcagaggatacccgtgctcaacgagtactgcgtcgtctgcgatgagcctcacgttttccagaatggccccatgctgcgcccaaccgtgtgcgaacgggagctgtgtgtctttgcatttcaaacactgggcgtgatgaacgaagccgcagatgagatcgccacaggcgctcagaaaaaaaactacgatagggtgatgaaggcgctcgactcaattacatctatcagggagatgacccaggccccttacctggagatcaagaagcagatggacaagcaggaccccctggcccatcctctgctgcagtgggttatatctagtaacagatcccacattgtgaagctccccgtgaacagacaactgaagttcatgcataccccccatcaattcctcttgctgtcctctccacctgcaaaagagagtaatttccgtgcagccaagaagctgttcgggagcacctttgccttccatggcagtcacatcgaaaattggcactccattttaaggaatggtttggtggtcgctagtaacacacgccttcagctccatggggccatgtacggttccggaatttatctgagccctatgtctagtatctccttcggatacagcggcatgaacaaaaaacaaaaagttagcgctaaggatgagccagcctcatcatctaaatcatcaaacacctcacagagccaaaagaaggggcaacaaagccagtttctccagtctcgtaacctcaagtgcatagcactgtgtgaagtcattactagttcagacctgcataagcacggcgagatttgggttgtccctaacacggaccacgtatgtacccgcttcttcttcgtctacgaggacggacaggtaggagatgcgaatataaacacgcaggagggaggtatccacaaagagatcctcagggtgatcggcaaccagacagctaccgggtag

SEQ ID NO: 32067 - DNA, 1485 bp, Artificial Sequence
  Description of Artificial Sequence: Synthetic coding sequence
atgcaaacttttgttactcagcagtggaagcagtccaaggaaaaatcaaactgcctgcataataagaaactgtcagaaaaaaaagtcaagtcaccactgcatctgtttagcaccctgcggcgtagcccgtcctacccccctccagggtgcggaaaaagtaagtccaagctgaagtccgaacaggacggtatttcaaaaactcataagctgctgcgccgaacttgcagctcaaccgtgaagaccgacgacgtgtgcgtaacgaagtcacatcgcacttttgggagatccctatccagtgacccgcgggccgagcaggcaatgactgccatcaaaagtcataagctgctgaatagaccatgccccgccgcagtgaaaagcgaagagtgtctgaccctgaagagccatcgccttctgacccggagttgcagcggggacccacggtgtgaacacaacaccaacctgaaaccgcataagctactatcacgcagctatagtagcaatctgagaatggaggaattgtatgggcttaagaatcataagcttttgtccaaatcatactcttctgctccaaaaagctctaagaccgagctttttaaggagcccaacgctgagggccgtcgcttgagtctgacctccgggctgataggtatcctgaccccgtcctcatcgagtagcagtcagctggcgccgaatggcgctaaatgtattcccgttcgggatagagggttcctcgtgcagacaatcgaattcgctgagcagaggattcctgtcctgaacgagtactgtgtggtgtgtgacgagcctcatgtgttccagaacggccctatgctgagacctacggtgtgtgaacgggaactatgtgtttttgcctttcagacactcggagtgatgaacgaagccgccgacgagatcgcgacgggtgcccagaaaaaaaattatgacagagtgatgaaggcgttagactccattacgtctatacgcgaaatgacccaagcaccttacctcgagattaaaaagcaaatggataaacaggacccactcgcccacccactcctgcagtgggttatttcctctaaccgcagtcacattgtgaaacttcctgtaaaccgccagcttaagtttatgcacaccccccaccagttcctactactttcttcaccccccgctaaagagtcaaactttcgagccgccaagaagcttttcggcagtacgtttgcattccacggtagtcacattgagaattggcacagcatccttcggaatggtttggttgttgccagcaataccaggctccagctccatggtgcaatgtacgggagtggaatttacctgtccccgatgtcatcgatttccttcgggtattcaggcatgaacaagaagcagaaagttagcgccaaggacgaacccgcaagctctagcaagtcctccaacaccagccaaaaaactaagaaaagaaccgcgatacccatacctgccaagccatag

SEQ ID NO: 32068 - DNA, 603 bp, Artificial Sequence
  Description of Artificial Sequence: Synthetic coding sequence
atggcttcgctctatgtcggggacctacaccccgaagttacagaagctatgctgtacgaaaagttctcaccagccggaccaattttatcaatcagaatctgcagagacaagataacgcgcagatcacttggttacgcctatgtgaactatcaacagcctgtggacgctaagagagctctggaaaccctgaatttcgacgtgatcaaggggaggccagtccgaatcatgtggagtcaacgggatccctctctgagaaagtctggcgttgggaatgtgttcatcaagaaccttgggaaaacaatcgacaataaagctctgtataatatttttagcgccttcggaaacatactcagctgtaaagttgcttgcgacgaaaaggggccaaaggggtatggcttcgttcacttccagaaacaagaatccgcggagcgggccatcgacgtaatgaacggcatgtttctgaactatcgcaagatcttcgtgggacgattcaaatcccataaggaacgagaagccgagagaggggcctgggctagacaaagtacgtctgcagatgttaaggacttcgaggaggatactgacgaagaagcaactctgagatag

SEQ ID NO: 32069 - DNA, 603 bp, Artificial Sequence
  Description of Artificial Sequence: Synthetic coding sequence
atggcatctttgtacgtgggggatctccatcctgaagtaactgaagctatgctgtacgagaagtttagcccggccgggcctatactgtctattaggatttgtcgcgataagattactaggcggagtctcggttatgcttacgtgaactatcagcaacctgtcgatgcaaagagggccctcgaaacattgaacttcgacgtcattaagggccgccctgtgagaatcatgtggagtcagagagacccaagcctaaggaagtcaggggttggaaacgtgttcataaagaatctggggaaaactatcgacaataaggccctatacaacatttttagtgccttcggcaatattcttagttgcaaagtcgcctgcgacgagaagggacccaaagggtacggctttgtccacttccagaagcaagaatctgctgagcgtgccattgacgtcatgaacggcatgttccttaattacagaaaaatatttgtgggacgatttaagtctcataaggaaagggaggctgaaagaggcgcatgggcccgacaatccacgagcgccgacgtgaaagatttcgaagaagatactgacgaggaggcaacattacgctag

SEQ ID NO: 32070 - DNA, 1113 bp, Artificial Sequence
  Description of Artificial Sequence: Synthetic coding sequence
atgaacgtagctgccaagtacagaatggcatccttatatgtaggcgaccttcacgccgacgtgaccgaggatctcttattccggaagtttagtaccgtgggtcctgtacttagtattaggatatgccgtgaccaggttactaggaggagtttggggtatgcctatgttaacttcctccagctggcagatgcccagaaggccctggacacaatgaattttgacattattaaaggaaagtctattagactcatgtggtctcaacgggatgcctacttgcgccgatccggaatcggcaacgtgtttatcaaaaacctggataagagcattgataacaagacactgtatgaacatttttctgcattcgggaagatactctctagcaaagttatgagtgatgatcagggctctaaaggttacgcattcgtacacttccagaaccagtcagctgctgatcgcgccattgaggagatgaatggaaaacttctcaaagggtgcaaggtgttcgtgggtcggtttaagaatcgaaaggaccgagaggctgagctgcggtccaaggcatctgagttcactaacgtgtacatcaagaatttcggcggagacatggatgatgagcgcttgaaggatgtgttctcaaagtacggtaaaacactctcagtgaaggtcatgaccgactccagcggcaagtctaaggggttcggtttcgtgtcgttcgactcccatgaagcggcgaaaaaggctgttgaagagatgaacggtagggatatcaatggccaactgattttcgtgggccgcgcccaaaaaaaggtcgagcggcaagctgaactcaaacagatgttcgaacaactcaagagggaacgaattcgcggctgccagggagtaaaactgtacattaagaatctggatgatactatcgatgacgagaaacttcgcaatgagttttcaagttttggctccatcagtagggtcaaagtgatgcaggaggaggggcagtccaagggattcggactgatatgcttctcctccccggaagatgctactaaggctatgaccgaaatgaatggccggatactggggagtaaacctctgagcatcgcgttggcacagagacactag

SEQ ID NO: 32071 - DNA, 1287 bp, Artificial Sequence
  Description of Artificial Sequence: Synthetic coding sequence
atgagggtcctgcctgaattaggagagtcttgtctaaattcaatcgcctggccactttgcggagaccctgaggctagcaccttagaacccgggcaatcttgtgacttagtgtcaccccaccgcgactgttctaagaattcaaggggccaaacccactccggaaaggacaaagaaatgaatgtcgcagccaaatataggatggcgagtctctatgtgggagacttgcacgcggatgtgaccgaagacttgctcttccggaaattttctaccgttggacccgtgctgagcatacgcatttgtagagatcaggtgactagacggagcctaggctacgcctacgtcaattttcttcagctggcggatgcccagaaggccctcgatactatgaattttgatattatcaagggcaaaagtattaggctgatgtggtctcagagggacgcctaccttcgcagaagtggcatcggaaacgtgttcataaagaatctggacaaatccatcgacaataaaaccctgtacgaacacttttcagcgttcggtaagatcctcagctctaaggttatgagtgacgaccagggatcgaaaggctacgctttcgtccactttcagaaccagagcgccgcggacagggcaattgaggaaatgaacgggaaattgctgaagggatgtaaagtttttgttgggaggtttaaaaatcggaaagaccgagaggccgagctacggtcaaaggcctccgagtttaccaacgtgtacatcaagaattttggcggggacatggacgacgaaaggttgaaagatgtcttttctaagtacggtaaaactctgtctgtcaaggttatgaccgacagctccggaaagtccaaaggctttggattcgtatcattcgattcgcatgaagccgctaagaaagctgttgaggaaatgaatggccgtgacattaatgggcagcttattttcgtcggtagagcccaaaaaaaggtagaacgccaggcagaactcaaacaaatgtttgaacaattaaagcgtgaacgcatccgagggtgccagggggttaaactgtacattaagaatctcgacgacactatcgatgatgagaagctgcgcaatgagttttccagttttggcagcatttcacgagtgaaagtgatgcaggaggaaggacagagcaagggattcggactgatctgcttcagctccccggaagacgctacaaaagcgatgacagagatgaacggccgaatactcgggtctaagcccctcagcatagcactagctcagaggcattag

SEQ ID NO: 32072 - DNA, 762 bp, Artificial Sequence
  Description of Artificial Sequence: Synthetic coding sequence
atgccactgctaccaagcaccgtgggcctggcaggactattgttctgggcaggtcaggccgtgaacgcattgattatgccaaacgccacacctgcccctgctcagcccgagagcactgccatgcggctgctgagcggcctcgaggtgccccggtaccggcgtaaaagacacatttcggtgagggacatgaacgcattattggattaccacaatcatatccgcgcctcagtgtaccccccagcggccaatatggagtatatggtgtgggataaaaggctggcacgagcggcagaagcatgggcaacgcaatgtatctgggcccatggtccaagccaattgatgaggtatgtgggccagaatctctcaatccattccggtcaatataggagcgtcgtggacctaatgaaatcctggagtgaggagaaatggcactatctcttccccgccccaagagactgtaatccccactgcccttggcggtgcgatggccccacatgcagccattatacccagatggtctgggcgtcgtccaatcgtctcggctgcgccatccatacctgtagctctataagtgtgtggggaaacacttggcatcgcgctgcctacctcgtctgtaattatgcaatcaaggggaattggattggggagtccccctataaaatggggaagccttgctcctcgtgccccccgagttaccagggttcgtgtaattccaacatgtgctttaagggactaaagagcaataaatttacatggttctag

SEQ ID NO: 32073 - DNA, 1845 bp, Artificial Sequence
  Description of Artificial Sequence: Synthetic coding sequence
atgaatgcatctggtagcggttacccactggcatccctgtatgttggagacctgcaccccgacgtgacggaagcaatgctgtacgagaaattttcgcccgcaggacctatcttgtcaataagagtgtgccgggatgtcgccactcgccgttccttagggtacgcgtacatcaattttcagcaacccgccgacgcagagcgagcactggatacaatgaactttgaaatgctcaaagggcagcccattcggattatgtggtctcaacgggatcccggcctccggaaaagcggggtgggcaatatcttcatcaaaaatctagaggatagtattgacaacaaggccctctatgataccttctctacattcggcaacatcctttcttgcaaagtggcctgcgacgagcatggttctaggggtttcggattcgtccatttcgaaactcatgaggctgcccagcaagcaataaataccatgaatggcatgttgcttaatgacaggaaggtgttcgttggacactttaagagcaggagggagcgggaggccgaactaggagccagagccctggagtttactaacatctatgtgaaaaatctgcctgtcgatgtagatgagcaggggttacaggatctcttcagccaatttggtaaaatgttaagcgtgaaagttatgcgggacaattcagggcacagccggtgtttcggattcgtgaactttgagaagcacgaggaggcacagaaggcagtggtgcatatgaatgggaaagaagtcagcggcaggctgttgtatgccggtagggcacagaaacgtgtggagcggcagaacgaactgaagcggcgcttcgaacaaatgaagcaggatagacttcgccgctaccaaggagtgaacttatatgtcaagaaccttgacgactctatcgacgatgacaaattgcgcaaggaatttagtccctatggcgtgattacctccgcaaaggttatgacagagggtgggcattccaagggttttggctttgtctgctttagcagtcccgaggaagcgacaaaggctgtgactgagatgaacgggcggatcgtgggtacaaagccactctatgtggcgcttgcacaacgcaaggaggagcgtaaggccatcttgacaaatcagtatatgcaacgtcttagcacgatgcggaccctgtctaaccctttattgggtagcttccagcagccctcatcttactttcttccagcaatgccacagccccctgctcaggccgcttactacggttgcgggccagtgaccccaacgcagccagcccccagatggacgagccaaccaccaaggcccagctgcgccagtatggtgcgcccccctgtggtgcccaggagacccccggcccatatctcgtccgtgcgacaggcatcaacacaggttccacggacagtccctcacacacaacgggtggcaaacattggtacgcagacaaccggccctagtggcgtgggatgttgcactcccggacggcccctgttgccgtgcaaatgcagcagtgctgcccattccacgtacagagtgcaggagcctgcagtccatattcccggccaggagccactgaccgcttctatgctggccgccgctccactgcatgaacagaagcagatgattggcgagaggctgtacccactgattcacgacgtgcatacgcagttggctggcaaaatcaccggaatgttgctcgagattgataattctgagctgcttcttatgttggagtctccggagagccttcacgctaagatcgatgaagcagtggccgtgcttcaagcacaccaggccatggaacaacctaaggcttacatgcattag

SEQ ID NO: 32074 - DNA, 993 bp, Artificial Sequence
  Description of Artificial Sequence: Synthetic coding sequence
atgaatgccagtggctcaggctatccgcttgcgagcctgtacgtgggcgacttacatccagacgtaaccgaagccatgctttatgaaaagtttagtccggccggaccgattctaagtattcgggtctgtcgcgatgtggctaccaggagatctctcggatacgcatacatcaacttccagcagcccgccgacgcagagcgagccctggatacgatgaattttgaaatgttaaaaggacagccaatccgtattatgtggtcccagcgcgaccctggactcagaaaatccggagtggggaacatttttatcaagaatctggaggatagcattgacaataaagcattatatgacacattttccactttcggaaacatcctgagctgtaaagtggcatgtgacgagcatggctcaagaggatttggctttgtgcattttgaaacccacgaggctgcccaacaggctataaacaccatgaacggtatgctcttgaacgataggaaggtcttcgttgggcacttcaagtcaagacgggagagagaggctgagctgggggctagggcacttgaattcaccaatatatatgtgaaaaatctccccgtggatgtcgacgagcaaggccttcaggatctgttctcccagtttggaaaaatgctctccgttaaagtgatgagggataatagcggacactcaaggtgttttggattcgtcaattttgagaaacacgaggaggcccagaaagccgtggtccatatgaacggaaaagaagtctctggccgcttgctgtacgccgggcgggcccagaagagagtggagagacaaaacgaactcaaacggcggtttgagcagatgaagcaagataggctgaggcgctaccagggggtgaacctgtatgttaaaaacctagacgactccatcgacgatgacaaacttcgaaaggagttcagcccttacggagtgatcacctccgcaaaaaagcgcagacaaagaccgtag

SEQ ID NO: 32075 - DNA, 1845 bp, Artificial Sequence
  Description of Artificial Sequence: Synthetic coding sequence
atgaacgcgtcaggctcaggctacccactggctagtctgtacgtgggagaccttcatcccgacgtcacggaggccatgctatacgagaagttttccccagcaggtcccattttgagtatccgggtctgtcgagacgtagccacccgacgatcactgggctacgcatatatcaacttccagcaacctgctgacgctgagcgggcactggatacaatgaatttcgagatgctaaagggtcagcctatccgcatcatgtggtcccaacgggatcccggactcaggaaatccggcgtgggaaatatctttatcaaaaatctggaagactcgatcgataacaaggccctgtacgatactttttccacatttggaaatattcttagctgtaaggtggcctgcgatgagcatgggtctcgggggtttgggttcgtgcatttcgaaacgcatgaggcagctcagcaagccatcaatacaatgaacggaatgcttctaaatgatcgcaaagtgtttgtgggccacttcaaaagccggcgagagcgagaagcagaattgggcgcaagggccttagagttcaccaacatctatgtgaagaacctgcccgttgatgtggacgaacaagggctgcaggacctattctcccagttcggcaaaatgctgtctgtgaaggtaatgcgggataattcaggacatagtcgctgctttgggttcgtcaatttcgagaagcacgaggaggctcagaaagccgtggttcacatgaacggaaaggaagtgtccgggaggctgctgtatgccggtagagcccaaaaaagagtggagaggcagaatgaactcaaaagacggttcgagcagatgaaacaggacagactgcggaggtaccagggagtaaatctgtacgtgaagaacctcgatgatagtatcgatgatgacaaactgcgaaaggagttttcaccatacggggtcattacctctgcgaaagtgatgaccgaggggggacatagcaaggggtttggatttgtctgcttctctagcccagaagaggcaaccaaggccgtcacggaaatgaacgggaggattgtggggactaaaccactctacgtcgcactggcacagcgtaaagaggagcgaaaggccatcctaacaaaccagtacatgcaaagactgagcaccatgcggacactgtcgaaccccctactaggctcatttcaacagcctagcagttactttttaccagctatgccgcagcccccagctcaggccgcgtactatggctgcggccccgtaacgcccactcagccagccccccgatggactagccagcccccccggccatcgtgcgctagcatggtgagacctcctgtggttcctcggcgtcccccggcccacatttcaagcgtacggcaggcgtctacgcaagtcccccgaaccgtgcctcatacccagcgggttgccaacatcggcacgcaaaccacaggccccagcggcgttggatgttgcacacctggccgccctctgttgccctgcaagtgctcttcagctgctcattctacttacagagtacaagagcctgctgtgcatatccccggtcaggaacctctcacagccagtatgttagcggccgctcctctgcacgagcagaaacagatgattggtgaacgactgtaccccctaatccacgacgtacacacccaactggcaggcaagataaccggtatgttgctggaaatcgataactcagagctgctgctcatgttggaatctccagagtccctacacgccaaaatagacgaggccgtagcagtgctgcaggctcaccaagctatggagcagcctaaagcctacatgcattag

SEQ ID NO: 32076 - DNA, 450 bp, Artificial Sequence
  Description of Artificial Sequence: Synthetic coding sequence
atggtgcgcccccctgttgtcccacggagacctccagcacacataagttctgtgcgccaggcctccacacaggtgcctagaacggtcccacatacccaacgtgtcgctaacatcgggacgcaaaccacgggaccgagcggagtagggtgttgtacacctggtcgccctctgctcccgtgtaaatgctcttcagctgctcactccacctacagggtgcaggaacccgctgtgcatatccctggacaggaacccttgacggcatcgatgctcgccgccgcgcctctccacgagcaaaaacaaatgattggtgagcggctgtaccccttgattcacgacgtgcacactcagctcgccgggaagatcacgggcatgctgctggagatcgacaactccgagctcctgctgatgctcgagtctccagagtcacttcacgctaaaatatccgcatag

SEQ ID NO: 32077 - DNA, 582 bp, Artificial Sequence
  Description of Artificial Sequence: Synthetic coding sequence
atggtcaggccacctgttgttcctcggaggcccccagcccacatttccagcgtcagacaggctagtactcaagtgccaaggacggtcccccatacccagagagtggcaaatatcggaacccagaccacaggtccaagcggggttggctgttgcacccccgggaggccgctgctcccttgcaagtgttctagcgccgctcattcaacctacagagttcaggaacccgccgtccatatccccggccaggaaccactcacggcatcaatgttggctgccgctcctctccacgaacaaaagcagatgattggcacttgctacttggtgctgaaaagatggtctgattggatggttctaagcttcctgcctctgctgctgtcctgcgattttgaaggatctgtatctacacccctctcaatgatgagcacaccctcatggcttgctcggagcagagcctgctgctggcgcctcaccacccagtcttgttgttcatgctggagccttcagaatccgtccatgcctcgtaagggcaaccccaggtttcacggctgtcaaaaagacagtgtcagcggatctcaaccgtag

SEQ ID NO: 32078 - DNA, 405 bp, Artificial Sequence
  Description of Artificial Sequence: Synthetic coding sequence
tgcaaatgcagttcggcagctcacagtacatatcgcgtgcaagaaccagcagtgcacattcctggtcaggagcctctgacagcatctatgctggctgcagcccccctgcatgaacagaagcagatgattgggacatgttatttggtcctcaaacgctggtctgattggatggtgttgtcctttctccctctccttctatcttgtgattttgaggggtcagtgtccactcccttgtctatgatgagtactccctcatggctggcccggtctagagcgtgctgttggcgattgacaacacagtcatgctgctcatgttggagcctccagaatccaagcatgcctcgtaagggaaatccccgctttcacggctgtcaaaaagactctgtgtccgggagtcagccttag

SEQ ID NO: 32079 - DNA, 507 bp, Artificial Sequence
  Description of Artificial Sequence: Synthetic coding sequence
atggtgcgacctcccgtggtgcctcgcaggccccccgcccacatctcttctgttcggcaggccagtacccaagtgcccaggaccgtccctcacactcaaagagtggctaatattgggacccagaccacaggaccttctggagtgggctgttgcacaccaggacgacccttactgccctgtaaatgctcatctgcagcccacagcacctatagagttcaggagcctgctgtgcacatccctgggcaagaacctttgactgccagtatgttagccgccgccccactccacgagcaaaagcagatgatcggcgagagactgtatcctttaatccacgacgttcacactcagctggctgggaagatcaccggaatgctgctggaaatcgacaactcagagcttttactgatgctagaatctccggaaagcctacacgctaagatcgacgaagctgtggctgttctgcaggcccatcaggcaatggagcagccaaaggcatatatgcattag

SEQ ID NO: 32080 - DNA, 459 bp, Artificial Sequence
  Description of Artificial Sequence: Synthetic coding sequence
tgacaagcctccacacaagtcccgaggaccgtgccgcacactcagcgcgtagctaatatcgggactcagacaacaggcccctcaggtgtggggtgctgtacgcccggtcggcccttgttgccatgcaagtgtagctctgccgcccattccacttatagggttcaggagcccgcggtccacatccctggacaagagcctcttactgccagcatgctggctgcagctccactgcacgagcagaagcaaatgattggagagcgcctgtacccccttattcacgatgtgcacacccagctggctggaaagatcacagggatgctactggaaattgataacagcgaacttttgctcatgcttgagagtcccgagtcacttcatgctaaagcccagaggaggaaggtgcaacggctcgtcaaatatattctagccctgaaagaactgagcacgcaaaatctgtag

SEQ ID NO: 32081 - DNA, 513 bp, Artificial Sequence
  Description of Artificial Sequence: Synthetic coding sequence
atggttcggcccccggtggtgcctaggcggccaccagcccatatctcttctgtacggcaagcttcaactcaggtgccccgaactgtgcctcatacccagcgagtggcaaatattggaacgcagacgactggcccaagcggagtgggctgttgcacaccgggcaggcctctactcccgtgtaaatgctcaagcgccgctcattcaacctacagagtgcaggagcctgcagtccatattcccggccaggaaccgttgactgcctccatgctggctgccgcccccctccatgaacagaaacagatgattggggaaagactgtaccctttgattcacgacgtacatactcagctggctggaaagattacagggatgctcctggagatagacaactcagagctgctgctgatgctagaatctccagagagtctgcatgcgaaggcccagcgcagaaaggtgcagcggctggtgaaatacattctggctctcaaggagctgtcaacccagaacctctag

SEQ ID NO: 32082 - DNA, 993 bp, Artificial Sequence
  Description of Artificial Sequence: Synthetic coding sequence
atgaacgcgtcaggctcagggtacccccttgcctcgctttacgtgggcgatctgcaccctgacgtgaccgaggccatgctctacgaaaaattttcaccggccggacccatcctgtcaattcgggtgtgccgagacgtggctacaagacggtccctcggatatgcctacatcaactttcagcagcctgcagacgccgagcgggccttggacaccatgaacttcgaaatgcttaagggacagcccattcggattatgtggtcccaaagggacccagggctgcgaaaaagcggggtggggaacatcttcatcaagaatttggaagattccatcgataataaagcgctgtacgatacgttcagcacattcggtaacatcctcagctgtaaggtggcatgcgacgaacatgggagccgaggattcggttttgtgcactttgagacccacgaggcagcccagcaggccattaatacaatgaacggaatgctcttgaatgaccggaaagttttcgtggggcacttcaaatctagacgggagcgggaagccgaactaggtgcacgagccctcgaatttactaatatctacgtaaaaaatctgcccgttgatgtggatgagcagggccttcaggatctgttctcccaattcggcaaaatgctatcagtgaaagttatgagggacaacagtggtcattctaggtgtttcggatttgtcaacttcgagaagcatgaggaggcacagaaagccgtggtgcacatgaatggcaaggaagtgagcgggcggttgttatatgcaggaagggcacagaaacgcgtggaacgccagaatgaactgaaaagacggttcgagcagatgaagcaagaccgtctaaggagataccaaggagttaacctgtacgtaaagaatctggatgacagcattgatgacgacaaacttcggaaggagttttccccatatggggtgattaccagcgcaaagaagcgacgccagcgaccctag

SEQ ID NO: 32083 - DNA, 603 bp, Artificial Sequence
  Description of Artificial Sequence: Synthetic coding sequence
atggcctcgctctacgttggggatctacacccagaggtgacagaagccatgctgtacgagaagttttcacccgccggacccatcctctctattagaatctgtagggacaaaatcacccgcagatctcttggctacgcatacgtcaactatcagcagcctgttgatgccaagagagcactggaaaccttgaactttgacgtgatcaaaggaagaccagtcaggattatgtggagtcaaagggatccatccctcaggaagtcgggggttggtaatgtctttatcaaaaatctcggcaagactatcgataataaagccctctataacatcttcagtgcttttgggaatatcctgtcctgcaaggtggcctgtgatgaaaaaggacctaaagggtacggattcgtacactttcagaaacaggagtctgccgagagggcaatagacgtgatgaatggaatgtttctgaattacagaaagatttttgtgggcagattcaaaagtcacaaagaacgcgaagccgaaaggggcgcttgggctcggcagtccacttccgctgacgtgaaggactttgaagaggatacagacgaggaggcgaccctgagatag

SEQ ID NO: 32084 - DNA, 603 bp, Artificial Sequence
  Description of Artificial Sequence: Synthetic coding sequence
atggcatcactctacgtcggagatcttcaccccgaagtcacggaggccatgctgtacgagaagttcagtccagcaggaccaatcctgtccatcaggatttgtagggataagattacacgccgctccttggggtacgcttatgtgaattaccaacagccagtggacgcaaagagagcgctcgagactctgaatttcgatgtgattaaaggtcgtcccgtaaggattatgtggtcacagcgggatccttccctgcggaaatctggggtcgggaatgtgttcataaagaacctgggtaagacaattgacaataaggctctgtataacatcttttcagctttcggaaacatcttgagctgtaaagtggcctgtgatgaaaagggacccaaaggttatggatttgtgcattttcaaaagcaggaatcagctgaacgggcaattgatgttatgaatggaatgttcttgaattacaggaagatctttgtgggaagatttaagagtcataaagagcgggaggccgaacgaggcgcctgggctaggcaaagtacaagcgccgacgtaaaggacttcgaggaggacactgacgaagaagctacgctcagatag

SEQ ID NO: 32085 - DNA, 603 bp, Artificial Sequence
  Description of Artificial Sequence: Synthetic coding sequence
atggctagtctgtatgtcggagacctccacccagaggtaactgaggcaatgttgtacgaaaaattttctccagcaggacctatccttagcattaggatctgccgtgataagatcacacgccggagcctgggatatgcctacgtgaattaccaacagccagtcgacgccaagcgggcactggagaccctcaatttcgatgttattaaaggtaggccagtcaggataatgtggtctcaaagagatcctagccttagaaaatctggggtgggcaacgtgtttataaaaaacctgggcaagacaatcgataataaggcgctctataatatcttttctgcatttggcaacattctgtcctgcaaagtcgcctgtgatgaaaaaggcccgaagggctatgggttcgttcatttccaaaaacaggagagcgctgagcgagccattgatgtgatgaatggaatgttccttaattatcgcaagattttcgtcggcaggtttaagtcccataaagaacgagaagctgaaagaggggcctgggctaggcagagtacctcagcagacgttaaggatttcgaggaggacaccgatgaagaagccacactccggtag

SEQ ID NO: 32086 - DNA, 603 bp, Artificial Sequence
  Description of Artificial Sequence: Synthetic coding sequence
atggccagtctgtacgtgggcgacctacatccagaagtgacagaggctatgctttacgaaaagttttctccagcaggccccatcctgtccatccgcatatgtagagacaaaatcacgcggagatccttagggtatgcctacgttaattaccagcaacctgtggatgctaagcgggctttggagacactcaattttgacgttatcaaggggcggcccgtgcgaattatgtggagtcagcgtgacccctccctgagaaaatcaggagtcggaaatgtcttcattaaaaacctaggcaagaccatcgacaacaaagccctgtacaatatattttccgctttcggaaacatcctcagttgtaaggtggcatgcgatgagaaaggaccaaaaggctatggcttcgtgcacttccaaaagcaggagtcagcagagcgtgctatcgatgttatgaacggcatgtttttaaactatcgaaagatctttgtgggacgcttcaagtcccacaaggaacgtgaagcagagagaggggcgtgggctagacagtccacttcagctgacgtgaaagattttgaagaagatactgacgaagaggcaacccttcgctag

SEQ ID NO: 32087 - DNA, 1134 bp, Artificial Sequence
  Description of Artificial Sequence: Synthetic coding sequence
atgtccggcagcgatgggggcctagaggaagaaccagaactgtctatcactctaactctccggatgctgatgcatgggaaggaagtaggttcaattatcggtaagaagggggagactgtcaagaggatcagagagcagagcagtgcccgcataactatctcagagggttcatgcccagaaagaatcaccaccatcacaggctcaacagctgctgtgtttcatgcagtttccatgatagcattcaagctggatgaagacctgtgcgccgcccctgctaatggcggtaatgtttccaggccgccagtcacactgagactagttattccggcgtctcagtgtggatccctgattggaaaagcgggtactaaaatcaaggagattcgggagaccaccggcgcccaagtccaagtcgcaggcgatttactgcccaacagcacagagcgggcagtcaccgtctcaggagtgcccgacgcgattatcttgtgtgtgaggcagatatgcgcagtgattttagagtcaccccccaaaggagctacaatcccctatcacccgtccttgtcattagggacggtcttgctttctgccaaccaaggcttcagcgtacaagggcagtatggagcagtgacacctgcagaggtgaccaaacttcaacaattatcttcacatgcggttcccttcgcgaccccttccgttgtccctggcttagatccgggaacacagacttcctcccaagagttcctggtgccaaatgatctgatcgggtgcgtcatagggcgccaggggagcaagataagtgaaataagacagatgtccggcgcccacataaagatcggtaatcaggccgagggtgctggagagcgacatgtgacgatcacaggatctccagtttctatagcactggctcaatacctcattactgcttgcctggaaaccgccaagtccacctccggtggaacgccatcaagcgcacccgccgacctcccagctcccttctcaccccccttaaccgctcctcagctgcccctcgcatgttgggctcaccccatgccttctcctagccccacaagttcagctcaagctcatgccctgctggggttcacgacctgttttccaagagctgccgccggtctctag

SEQ ID NO: 32088 - DNA, 732 bp, Artificial Sequence
  Description of Artificial Sequence: Synthetic coding sequence
atgatcgcctttaaactcgatgaggacttatgcgcagcacccgcaaacggtggcaacgtctctcgcccacctgttactctccggttggtaatccctgcgagtcagtgcggaagcctcataggtaaagcggggaccaaaatcaaagaaatcagggaggtgactaagctgcagcagctttcctcccatgcggtgcccttcgccacgccgtcagttgttcccggtttagatccgggaactcagacctcctctcaggagtttctggtgcctaatgacctgattggctgcgtgatcgggcggcagggatcaaagatctccgaaattcgccaaatgagcggagcgcacattaaaattggcaaccaagccgaaggggcaggcgagcgccatgtcacgatcactgggtctcccgtctcaatcgcgctggcacagtacctaatcacggcctgcctagagactgcgaaatccacgtcaggtgggaccccttcatctgcgcctgcagatctcccggccccattcagccctcccctgacagcgttgccaaccgcccccccgggcctgcttggtaccccatacgcaattagtctgtcaaacttcatcggtctcaagcctatgcctttcctggctctgcctcccgcctccccaggaccaccaccgggtctggcagcgtatacagctaaaatggctgccgcgaacggcagcaagaaggccgaaagacaaaagttctcaccctattag

SEQ ID NO: 32089 - DNA, 1275 bp, Artificial Sequence
  Description of Artificial Sequence: Synthetic coding sequence
atgccgaggtgccccgcactgatcctttatcttcagagcagcgctaggattacaatttccgagggcagttgtcccgagcggatcaccactatcaccggctcaacggctgctgtcttccacgcagttagtatgatcgctttcaaacttgacgaggacctgtgtgctgccccagcgaacggcggaaacgtctcacggccaccagtaacactacgtctcgtgatcccagcctcacagtgcggcagcctcataggaaaagcaggtacgaagattaaggagatacgggaagttaggggtgaaatataccaccctcagggcatccgcggcaaaggggcggtcgtgagaggggttttggggttgtggagaccaccacatctcgagagcagcgagcccggacagcctttttctgggctttgggagcagcctgaagttgcccccgtgctgtgtctccaaaccaccggggcccaggtgcaggtggccggggacctcttgccgaacagcactgagcgcgcagtcacggtgtcgggcgtccccgacgcgatcatcctttgtgtgaggcagatctgtgcagtcatattggaatcaccccctaagggagctactattccttaccatccttcactgtccctggggacggtgctgctgagtgctaatcaggggttcagtgtccagggacaatacggcgcggtgacccctgccgaagtcacaaagctgcagcaactgtctagccacgccgtaccctttgcaaccccctccgtagtacctggcttagacccaggaactcagacatcttcacaggaatttctcgtaccaaatgatctcataggatgtgtgatagggcgccagggaagcaagatttcagagataaggcagatgagtggagctcacatcaagatcgggaatcaagctgagggagccggtgaacgccacgtgactattactggctctcccgtgtctatcgcgctagcccagtatctgataaccgcctgcctggagactgcgaagagcacgtctggcggtaccccttccagtgctcctgccgatttgccagccccgttctcgccgccgcttaccgcactgccgactgctccgccgggcctattgggaaccccatacgccatcagtttgtccaatttcatcggcctcaaacctatgccttttctcgctctgccacctgcctctcctgggcctcctccggggcttgcggcttatacggcaaagatggccgccgccaatggatctaaaaaagccgagcggcagaagttctcaccctactag

SEQ ID NO: 32090 - DNA, 1083 bp, Artificial Sequence
  Description of Artificial Sequence: Synthetic coding sequence
atgagtggatccgacggaggtctggaagaagagcctgaactgagcattactctgacactccgcatgcttatgcatggtaaggaggtcggttctatcatcgggaaaaaaggggaaacagtgaagcggatccgggaacagagctctgcacgcataacaatctctgagggaagctgccctgagagaatcacaacaataactggtagtactgctgctgtgttccatgcagtgtctatgatagcatttaaacttgacgaggatctgtgcgccgcccccgccaatggagggaacgtgagccgtccacctgtgacactccggctagtcatacccgctagccaatgcggcagtctaataggcaaagccggcactaagattaaggaaatccgcgagtctccaccaaagggggccaccatcccatatcacccctccctgtccttagggaccgtgcttttatccgccaaccagggtttcagcgtgcagggccagtacggagccgtgacccccgctgaggttacaaagctccagcaactctcgagccacgcggtcccattcgccacaccatccgtcgtgcctggactcgacccaggaactcagactagtagccaggaatttctggtccccaacgacctgattggttgtgtgatcggccgccagggcagtaagattagcgagatcagacagatgtccggagcccacatcaagatcggaaatcaggccgagggcgccggggaaaggcatgtgactatcaccggatcccctgtaagtattgctctggcccagtacctcattacagcttgtctggaaaccgccaaaagtacatcaggtggcactccaagctctgcacctgccgatctcccagctccctttagcccgcctttgacagcgctgccaacagctcctccgggcctcctgggcaccccctatgccatctctctgagtaactttatcggccttaaacccatgccatttctcgccctcccccctgcctcgcctggcccccccccgggtctggcagcctacaccgccaaaatggctgcagccaacggctcaaaaaaagctgagagacaaaaatttagcccttactag

SEQ ID NO: 32091 - DNA, 141 bp, Artificial Sequence
  Description of Artificial Sequence: Synthetic coding sequence
atgtccggatcagacggcgggctggaggaagaacccgaactcagtatcacattaactttgagaatgctgatgcacggcaaggaggtcgggtctattatagggaagaagggcgaaaccgtgaagaggatcagggagcaatag

SEQ ID NO: 32092 - DNA, 375 bp, Artificial Sequence
  Description of Artificial Sequence: Synthetic coding sequence
atgtccggctcagacggaggtcttgaagaggaaccagagttgtcgatcacgctgactctgaggatgttgatgcatggcaaagaggtcggaagcatcattggtaagaagggagagaccgtaaaaagaattcgagagcagtctagtgcccgtataaccatcagtgagggatcttgtcctgaacggatcactacaatcactggatcaaccgctgcggtgttccacgccgtctcgatgatagcatttaaactggacgaggacctgtgcgccgccccagcgaacggcggaaacgttagtcgtcccccagtgacattgaggctcgtgatacctgcttctcaatgcggttctctgattggcaaagctgggaccaaaatttag

SEQ ID NO: 32093 - DNA, 507 bp, Artificial Sequence
  Description of Artificial Sequence: Synthetic coding sequence
atgtccggcagcgacggagggctcgaagaggagcctgagctgagcattacattgactctgaggatgctcatgcacgggaaagaagtcggctcaatcatcggaaagaaaggagagaccgtgaaacgtatcagggaacagagctccgcaaggatcacaatttccgagggatcctgcccagaaaggattacaaccattacaggcagcaccgccgctgtttttcatgcagtgagtatgattgccttcaaactggacgaggatctgtgcgccgccccagcaaacggagggaacgtgtcacgtccacctgttaccctgcgactcgtgatacctgcgagccagtgcggttccctgattggaaaagccggcactaaaatcaaagaaatcagagaaactactggtgcccaggtacaagtggctggggatttgctgcccaatagtacagaaagggcagtcacggtgtccggcgtgccagatgctatcatcctgtgcgtgaggcaaatctgcgcctag

SEQ ID NO: 32094 - DNA, 228 bp, Artificial Sequence
  Description of Artificial Sequence: Synthetic coding sequence
atgagcggttcggacggaggtctcgaggaggaacctgaactgtccataacattgacattgcggatgcttatgcacggcaaagaagtgggcagcatcatcggcaagaaaggtgagaccgtcaaaaggatccgtgaacagagtagcgcccggataaccatctccgagggcagttgcccagaaaggattaccacgataaccggttccaccgctgccgtcttccacgcctag

SEQ ID NO: 32095 - DNA, 1083 bp, Artificial Sequence
  Description of Artificial Sequence: Synthetic coding sequence
atgagcgggtcagacggcggccttgaggaagagcctgaactttcgatcaccctcacgctccgcatgctgatgcatggtaaggaagtcggctccattataggcaaaaaaggagagactgtgaagaggattcgagagcagtcctccgctaggatcaccattagcgagggttcctgtcctgaacggatcactactataactggatcaacagctgcggttttccatgctgtgagcatgattgcatttaagctggatgaggacctgtgcgccgctccagccaacggggggaacgtgtcaaggcctcctgtcaccctacgcctcgtaataccagcttctcaatgtggcagcctaattggaaaagctgggacaaagatcaaggagattcgggaaagtccaccaaaaggagccaccattccctaccatcctagcctctctttggggacggtgctgctttcagcgaaccagggtttcagcgtgcagggacagtatggcgcagttactccagccgaagtgacaaaacttcagcagctgtcaagccacgccgtgcctttcgctaccccttctgtggtcccaggtctcgatcccgggactcagaccagcagtcaggaatttttagttcccaacgatctgatcggctgcgttataggcagacagggctcaaaaatttcagaaatcagacagatgtctggggcccatatcaagattgggaaccaggcagagggtgccggagagagacatgtgacgattacaggatctcctgtgtcaatcgcgctggcgcagtacctgattactgcctgcctggaaacggcaaagtcaacgtctggtggaacccccagcagcgcccccgcggacttacccgcccccttcagtcccccactgaccgctctgcctactgccccccctgggttgctgggaacgccttacgccatctccttgtccaattttattggcctcaaacctatgcccttcttggcactccccccagcttcacctgggccacctcccgggctggcggcttatactgcaaagatggccgcagccaacggatcaaagaaggctgagcggcagaaattctccccctattag

SEQ ID NO: 32096 - DNA, 279 bp, Artificial Sequence
  Description of Artificial Sequence: Synthetic coding sequence
atgagcgggtccgacggcggactggaagaggagcctgagctgtccatcacgctgacgctcagaatgttaatgcacgggaaagaggttggctccattattggcaagaagggcgagaccgtgaagcgcatccgcgagcagagtagtgcacgaatcaccattagtgaaggtagctgtccagagcgaataaccacaatcactggaagcacagcagctgtgtttcatgcagtgagtatgatcgccttcaaactcgatgaagacttatgtgccgccccagcatag

SEQ ID NO: 32097 - DNA, 261 bp, Artificial Sequence
  Description of Artificial Sequence: Synthetic coding sequence
atgagtggtagcgatggaggactggaggaggagccagaactttccattaccctgaccctccggatgctgatgcacggcaaggaagtgggcagcattatagggaagaagggcgagacagtgaaacgcatccgggaacagagcagtgcaaggattacaatctctgaaggcagctgtcctgaacgtattactactatcactggcagtaccgccgccgttttccatgctgtatccatgatagccttcaagcttgatgaagtctag

SEQ ID NO: 32098 - DNA, 324 bp, Artificial Sequence
  Description of Artificial Sequence: Synthetic coding sequence
atgagcgggagcgatgggggcctggaggaggagcctgaactgagcattacactgacactgaggatgctgatgcacggtaaagaggtgggatccattattgggaagaagggggaaactgtgaagcgaattcgggagcagagcagcgcgcgaatcactattagcgagggctcatgtcctgagagaattactactatcacgggtagtacagcagccgttttccacgcagttagcatgattgcattcaagctggatgaggacctgtgtgccgcgccagcaaacggcggcaatgtgagcaggccaccagtgacactgagattagtgtag

SEQ ID NO: 32099 - DNA, 3024 bp, Artificial Sequence
  Description of Artificial Sequence: Synthetic coding sequence
atgaaggacgaggccggggaaagagacagggaggtgtcctcactgaatagcaaattgctgagcctgcagctggatatcaagaatctccacgacgtgtgcaaacgacagcggaaaactcttcaggataatcagctctgtatggaggaggcaatgaattcaagccacgacaagaagcaggctcaggcgcttgcattcgaggagtccgaagtggagtttggctcctctaaacagtgccacctgagacagctccagcagctgaagaaaaaactattagtgctgcagcaggagctggagtttcacacagaagagctgcaaacctcctactactccttaagacagtaccagagcatactggagaagcaaacatcagacctggtcctgcttcaccaccactgtaaacttaaggaagacgaggtcatcttgtacgaggaagaaatgggcaatcataatgagaacaccggggaaaaactgcatctagcccaggaacagctggccttagccggcgacaagatcgcttctctggagcggagcttaaatctgtacagagataaataccagagctcactgtcaaacatcgagctcctcgagtgccaggtgaagatgctgcagggggaattaggaggaatcatgggccaggagcccgagaacaaaggcgatcactccaaagtgcgcatctacacctcgccatgtatgattcaagagcaccaggagacgcagaagcgtctcagcgaagtctggcagaaggtgagtcagcaggatgatctgattcaggaactgcgcaataagctcgcttgttccaacgctttggtgctggagagagaaaaggctttgatcaagcttcaagctgactttgcctcttgcacagcgacgcatagatatccgcccagcagcagcgaggagtgtgaagatatcaaaaagattctgaagcacttacaagagcagaaggattcccaatgcctgcacgttgaggagtaccaaaatctggtcaaggatctccgggtagaattggaggcagttagtgagcagaagcgcaacataatgaaggatatgatgaaactggaactggacctgcatggcctcagagaagaaacatctgcccatattgagcgcaaggacaaggacatcaccatcctgcagtgccgactgcaagagttacagcttgagtttactgagactcaaaagttgacactgaagaaagataagtttctccaggaaaaggatgaaatgttgcaggaacttgagaagaagcttacacaggtgcagaactcactactgaaaaaggagaaagaattggaaaagcagcaatgcatggcgaccgagctggagatgaccgtgaaagaagccaagcaagacaaatccaaggaggctgagtgtaaagccctgcaggccgaggtgcagaagctgaagaactcattggaggaagccaagcaacaggagcgcctcgccgcccagcaggccgcccagtgtaaggaggaagcagcacttgccggatgtcatctcgaagacacacaaaggaaactgcagaaaggacttctcctggacaagcagaaagctgacacaattcaagaactgcaacgcgagctgcagatgctccagaaggaaagttccatggcagagaaagaacagacaagcaatcgtaagagggtcgaagaactttctttagagcttagtgaggccttgcggaagctggagaacagcgataaagagaagcggcagctgcagaaaacagtagcagagcaggatatgaaaatgaacgatatgctggataggattaagcaccaacatcgggaacaaggttcgataaagtgcaagctcgaggaagacttgcaagaggcgaccaaactgctcgaagacaagagggagcaactgaaaaaatcaaaggagcatgaaaagttgatggagggcgagctggaggcactgcggcaggaatttaaaaagaaagacaaaactttgaaggagaattcgaggaagcttgaggaggaaaatgagaatttgcgcgccgagctgcagtgctgtagcactcagctggagagtagcctgaataaatacaatacttcccagcaggttattcaagacctcaacaaagaaatagctctccagaaagagagcctgatgtccctgcaagcccagctggacaaggcgctgcagaaggaaaaacactacctgcagactacaatcaccaaagaggcctatgacgccctgtcccggaagtcggccgcttgtcaggacgacctcacccaggccctggaaaagttgaatcatgttacctctgagaccaaatcccttcaacagtcgttaacacagacccaggagaagaaagcccagcttgaggaagaaataatcgcgtacgaagaaagaatgaaaaagcttaataccgaactcaggaagctacggggcttccaccaggaaagcgagctcgaggtgcacgccttcgacaaaaagctcgaagaaatgtcatgccaggtccttcagtggcagaaacagcaccagaatgatctaaaaatgttggctgccaaggaggagcaactaagagaattccaggaggagatggcggctctgaaagaaaatttactggaggatgacaaggaaccttgttgcctgcctcagtggagcgtgcctaaagatacctgcaggttgtataggggcaacgatcagatcatgaccaatctggaacagtgggccaagcagcaaaaagtcgccaatgagaagctgggtaaccaactgagggaacaggtgaagtacatcgccaaactgagtggggaaaaagatcacctccactcagtgatggtgcaccttcagcaagaaaacaagaaactcaaaaaagaaattgaggaaaaaaaaatgaaggccgagaataccagactctgcaccaaggccctgggaccctcgcgcactgaatcaacccagagagaaaaggtctgtggtacgctgggatggaagggcttgccacaggatatgggtcagcgcatggatcttactaaatatattggcatgccacattgccctggctcctcatactgctag

SEQ ID NO: 32100 - DNA, 2649 bp, Artificial Sequence
  Description of Artificial Sequence: Synthetic coding sequence
atgggcaaccacaatgaaaacactggcgaaaaactccacctggcccaggaacagttggcccttgccggagataaaatagctagtctggaacgctctttgaacttgtatcgggacaaataccagtcatcactgtccaatatcgagttactggaatgtcaggtgaagatgttgcagggagagctggggggcataatggggcaggagccagaaaacaaaggcgaccactccaaggtccggatttataccagtccctgtatgattcaggagcatcaggagacgcagaagaggttgtccgaggtgtggcagaaagtcagccagcaggatgacctgatccaggagctccgcaacaagctcgcatgctccaacgctctggttctcgaaagagagaaggctctcattaaattgcaggctgactttgcatcgtgcacggccacgcataggtatcctcccagcagcagcgaggaatgtgaggatatcaaaaaaatcctgaaacacttgcaggaacagaaagattcccagtgtcttcacgtggaggaataccagaacttggtgaaagacctgcgggttgagctagaagccgtgtccgagcagaaacggaatatcatgaaggacatgatgaaactggaactagatctgcatggcttgcgggaggaaactagcgctcatattgaaaggaaggacaaagatatcactatcttacagtgcaggcttcaggagcttcagctggagttcaccgaaacccagaaactgaccctcaagaaggacaaattccttcaggagaaagacgagatgttgcaggaactggagaagaaacttacgcaggtgcaaaattccctgctgaagaaggagaaggagctggaaaagcaacagtgcatggcgacagaattggagatgacagtgaaagaagcaaagcaggataaatccaaggaggccgagtgcaaggccttgcaggccgaagtccaaaagctgaaaaattcactcgaggaggcgaagcagcaggaaaggctcgcagcccagcaggctgcccagtgcaaagaggaggctgctctggcaggatgtcacctggaggacacacaacggaagctgcagaagggcctcttgcttgacaaacagaaagccgacaccatccaggagctgcaacgcgagctacagatgcttcagaaggaaagttctatggccgaaaaggagcaaacttctaacaggaaacgcgtggaagaactatccctggagctgagcgaggctctgaggaagctggaaaatagcgataaggagaaacggcagctgcagaagactgtcgctgagcaagacatgaaaatgaacgacatgttggatagaattaaacaccagcaccgagagcaaggctcaatcaagtgtaagctggaagaggacctgcaagaggccacgaagctcctggaggacaagcgcgaacaactcaagaagagtaaggagcacgagaaactcatggaaggagagcttgaggctctacggcaggagttcaagaagaaagataagacccttaaggagaactcccgcaagcttgaggaagaaaatgaaaaccttagggcagagctgcaatgctgttctacgcagctggaatctagtctgaacaagtataatacttcccagcaggtgatacaagatctgaataaggagatcgctctccagaaggagagcttgatgtctctgcaggcacaactcgacaaggctctccaaaaagagaaacattatcttcagacaaccataactaaggaagcttacgatgccttgtccagaaagtccgctgcgtgtcaggacgatttgacacaggccctggaaaaactgaatcacgtgacgagtgagacaaaatccctccagcagagcttgacacaaacgcaggagaagaaggcacagttggaagaagaaataatcgcttatgaagaaaggatgaagaaattgaatacagaactgcgcaaattgcgaggcttccaccaagagagcgaacttgaagttcacgcattcgataaaaaactggaggagatgagttgtcaggttttgcaatggcagaaacaacaccaaaatgatctcaagatgcttgctgccaaggaagagcagcttcgagagtttcaggaggaaatggctgccctgaaggaaaacctgctagaggacgacaaagagccatgttgtctacctcagtggtctgtgccaaaggatacctgcaggctgtacagggggaatgatcagataatgacgaacttggaacagtgggccaagcagcagaaagtggccaacgagaaactggggaatcagctgcgcgagcaggtaaaatacatagctaagctctcaggagaaaaagacagggagccgacaagagcgtctagtcccaacacaacccgtccttcttccccctctcacagtcatctccatagcgttatggtgcatcttcaacaggaaaacaaaaagctgaaaaaggagatcgaagaaaaaaaaatgaaggcagaaaacacacgtctgtgcacaaaggcccttgggccttcacgcactgaatcgacgcaaagagagaaagtatgtggtacgctaggatggaagggcctgcctcaggacatgggccagcgcatggacctaacgaaatacatcggcatgcctcattgtcccggatcctcatactgttag

SEQ ID NO: 32101 - DNA, 474 bp, Artificial Sequence
  Description of Artificial Sequence: Synthetic coding sequence
atgaaggatgaagcaggggagcgggatagggaggtgtcctctcttaacagcaaactcctgtccctgcaattagacatcaaaaaccttcatgacgtttgcaagaggcagcgcaagacactccaggataaccagctgtgcatggaggaagctatgaactcaagccatgacaaaaagcaggctcaggctctggcattcgaagagagtgaggtggaatttggaagctctaaacagtgtcacctgaggcagctacagcagctgaaaaagaagctattagtgctgcaacaagaactggagtttcacacagaggaactgcagacctcttactactccctgagacagtatcaaagtattttggagaaacagacctcagacctcgtgctgttacatcatcactgcaagctgaaagaagatgaggtgatcctatacgaagaggaaatgggcaatcacaatgaaaatacaggcgagaaactgtag

SEQ ID NO: 32102 - DNA, 207 bp, Artificial Sequence
  Description of Artificial Sequence: Synthetic coding sequence
atgaaggacgaggcaggggagagggacagggaagtgtcatctctcaacagtaaactgctgtcattgcagctcgacatcaaaaacctgcacgatgtttgcaagaggcagagaaagaccctgcaagacaatcagctttgcatggaggaagcgatgaacagttcacatgataaaaaacaggcccaggccctcgcatttgaggagtcctag

SEQ ID NO: 32103 - DNA, 3069 bp, Artificial Sequence
  Description of Artificial Sequence: Synthetic coding sequence
atgaaggacgaagcaggagagcgtgatcgggaggtctctagcctcaattcaaagctcctgtctctgcagctggatattaagaacctacacgacgtttgcaaacgccagcgtaaaactctgcaggacaaccaactgtgtatggaggaagctatgaactcttctcacgacaaaaagcaggctcaggccttggcctttgaagagagcgaggtggagtttggctcttctaagcagtgccacctgaggcaactccagcagctgaagaaaaagctgttggtactacaacaggagcttgagtttcacacagaagaacttcagacttcttattattcactgcgccagtaccaaagcatcctggaaaaacagacctccgatctagtgctgctgcatcaccattgtaagctcaaggaggatgaagtgatcctctacgaggaggagatgggaaaccacaacgagaacaccggcgagaagttacacctggcacaggagcagttagctctcgccggagataagatcgccagtctggagcgaagcctgaacctttatcgggataagtaccagtcttccctgtccaatattgaactcctagagtgccaggtgaaaatgcttcagggagagttgggcggtatcatggggcaggagccagagaacaaaggggatcacagtaaggtgcggatctatactagcccttgtatgatccaggagcatcaggagacacagaagaggctgagcgaggtgtggcaaaaggtgagtcagcaggacgacttaatccaggaactccgaaataagctggcctgttcgaatgctctcgtactcgagagggaaaaagcactcatcaagctgcaagccgatttcgcgtcgtgcaccgctactcatcggtatcccccaagcagctccgaagaatgcgaagatattaaaaaaatactcaagcatctccaagagcagaaggactcacagtgtctgcatgtcgaagagtatcagaatctcgtgaaggatctgcgggtggaactggaggctgtctcagaacagaagaggaacataatgaaagatatgatgaagcttgaactcgacctgcacggccttagggaggaaacatcagcccacatcgaaaggaaggataaggacataaccatcctgcagtgtcggttgcaggagttgcagttggagtttactgaaacacaaaagctgaccctgaaaaaggacaaattcttgcaggagaaggatgagatgttgcaggagctggagaaaaagctgacacaagtgcagaactctttattgaagaaggagaaggagctcgagaagcagcagtgtatggcaaccgagttagagatgactgtgaaagaagcgaagcaggataagtctaaagaagcggagtgtaaggccctgcaggccgaagtgcaaaagctcaagaactcactggaggaggccaaacaacaggagcgcctcgccggagaagcccctgctgcccagcaagctgctcaatgcaaagaggaagcagccctagccggttgccacctggaggatacgcagagaaagctgcagaagggactgttgctggataagcagaaagcagacaccattcaagagctgcagagggagttgcaaatgcttcaaaaggaaagttccatggccgagaaggaacagacttccaatcgcaagagagtggaggaactgtcacttgagttgtccgaagcactgcgcaagctagagaacagtgacaaagaaaagaggcagctccagaaaactgtggccgagcaagatatgaagatgaatgatatgctggaccgaatcaaacaccagcatcgcgagcagggcagtatcaagtgcaaacttgaggaggatctgcaggaagcgactaaattgctggaagacaagcgagaacagcttaaaaagagcaaggagcatgaaaagctcatggagggggagttggaggccctgagacaggagtttaagaaaaaggacaaaaccttgaaggagaactctagaaagttggaggaggagaatgagaacctgcgagccgagcttcagtgctgctccacccagctggagagctccctgaacaagtataatacctcgcagcaggttatacaggatctgaataaggaaatagccctgcaaaaggaaagccttatgtctctgcaggctcagcttgacaaggccctgcaaaaggaaaagcattacttacagacaaccatcaccaaggaggcctacgacgcactgtcccgtaagagtgctgcctgtcaggatgaccttacccaagcactggagaagctgaaccatgtgactagcgagaccaagagcctgcaacagagcctcacacagacacaggagaagaaagctcagctggaggaggaaattatcgcctacgaggagcgcatgaaaaagcttaatacagagttgcgcaagctgagaggatttcaccaagagtccgagctggaggtgcacgcctttgataagaaattagaagaaatgtcttgtcaggtgttacaatggcaaaagcagcatcagaatgacctcaaaatgctggctgccaaagaagaacaactccgggaatttcaggaggaaatggccgctttgaaggagaatctccttgaagatgacaaggagccatgctgtctgcctcagtggtccgtgcctaaggatacttgccgcctgtaccgaggaaatgatcaaatcatgactaacctggaacagtgggctaagcagcagaaagtcgctaatgaaaagttggggaaccaattgcgcgaacaggtcaagtacatcgcgaagctgagtggcgaaaaggaccacctgcatagcgtgatggtgcacctccagcaggaaaataaaaagcttaagaaagaaatcgaagagaagaagatgaaggcagagaatacgcgcctgtgtacaaaagctctgggtccttctaggactgaatccacacagagggagaaagtgtgtggaacccttggctggaaagggttaccccaagatatgggacagaggatggacctgaccaaatacattggcatgcctcactgtcccggcacttctgcgatctgtcagaagaataaatgtgacttcttcctatag

SEQ ID NO: 32104 - DNA, 333 bp, Artificial Sequence
  Description of Artificial Sequence: Synthetic coding sequence
atgaaagacgaggctggggaaagagatagagaggtctcatccctgaattccaagcttctttcgcttcaactcgatatcaagaatttgcatgatgtatgcaagcgccagaggaaaacgttacaggataatcaattatgcatggaggaagctatgaactcctctcacgataaaaagcaggcgcaagcgctggccttcgaggagtcggaggtggagtttgggtcttcaaagcagtgccatctcaggcagctgcaacagctcaaaaaaaaactgttagtgctgcagcaggagctggaattccacacagaagaactgcagaccagctattactcatag

SEQ ID NO: 32105 - DNA, 144 bp, Artificial Sequence
  Description of Artificial Sequence: Synthetic coding sequence
atgaaggacgaggccggggagcgggatagagaagtgtcgtcactgaacagtaaactgctttccctgcagctggatatcaaaaacttgcatgatgtctgcaagagacaacgaaagacactgcaggacaatcaattgtgcatgtag

SEQ ID NO: 32106 - DNA, 1536 bp, Artificial Sequence
  Description of Artificial Sequence: Synthetic coding sequence
atggaaagtaccggatccgtgggagaggccccgggcggaccccgggtgctggtggtgggagggggtatcgcggggctcggcgcggctcagcggctgtgtggacactccgccttccctcacctgagggtgctagaagccaccgcacgcgcgggaggacgcatacgtagcgagagatgctttggcggagtagtcgaggtgggggctcattggatacacggccccagccgggggaaccctgtgtttcaactggccgccgagtacggtttacttggggagaaggagctgagtcaagagaaccagcttgtcgagaccggcgggcatgtcgggcttccctctgtctcctacgcctcctctggcgcctccgtgagtcttcaattagttgcagaaatggctaccctgttttatggtctcattgaccagacgcgcgaatttcttcatgccgctgaaacacccgtcccatccgtgggggagtacctgaagaaggagattgggcagcacgtcgctggatggactgaagatgaagagacacgcaaacttaaactagccgtcttgaacagctttttcaacctcgagtgctgtgtaagtggcacacactctatggatttagtggcgttagcgcctttcggggaatacaccgtgctgccaggacttgattgtaccttctcaaagggctaccaggggcttaccaactgtatgatggctgcgcttccggaagatacggtggtttttgaaaaaccagtcaaaaccatccattggaatggatcttttcaggaggcagcgtttcccggtgagacatttccagttagtgtggagtgtgaagacggtgaccgttttccagctcatcatgtgatcgtgacagtgcctttaggattcctgcgagagcacctcgacaccttctttgatccacctttgccagcagagaaggccgaggctatccggaagattggcttcggaaccaataataagatatttttagaattcgaggagccgttctgggagcccgattgccagctgatccagctggtctgggaggatacctcgcctctcgaggatgcagcccccgagttacaggatgcttggttccggaagcttatcgggtttgtagtcctccccgccttcgcctccgtgcatgttttatgcggctttattgctggcctggagagtgaattcatggaaaccctgtccgacgaggaggtacttttatgcctgactcaggtactgcgcagagttactggtaatccacgattacccgcccccaaatcagtgctacggtcaaggtggcacagtgctccgtacaccaggggaagctattcttacgtggctgtcggctcaaccggcggagatttggacttactggcccagcctctcccagcagacggtgctggcgcacagttgcagatcctatttgctggcgaggccacgcaccggactttttattctactacgcatggcgcgctgctgtcagggtggagggaggccgatagattgttgagtctctgggcaccacaggtccagcagccgcgcccacggctttag

SEQ ID NO: 32107 - DNA, 1461 bp, Artificial Sequence
  Description of Artificial Sequence: Synthetic coding sequence
atggaatcaacaggaagcgtgggggaggccccgggagggcccagagtactggtggtggggggggggatcgccggtttaggggccgcacaaaggctttgcggccacagcgccttccctcatctacgcgttctagaggctactgcccgcgccggcgggcggatccgctctgaacggtgcttcggcggtgtggtggaggtcggcgcacactggatccatggcccctctagggggaatcctgtattccagttggctgcagagtacggattgctcggagagaaggagctgagtcaggagaatcagctggtggagacgggaggtcacgtgggtctcccctcagtgtcctacgccagtagcggagcatcggtctcactgcaacttgttgctgagatggcgaccctgttctacgggcttattgatcagacaagagagtttcttcacgccgccgagacacctgtgccttcagtgggcgagtatctcaagaaagaaattgggcagcacgtagccggatggacggaggatgaagagactcggaagttgaaactggccgttctcaactctttctttaacctggaatgttgcgtgagcggtactcactccatggaccttgtcgcacttgctccattcggtgagtacactgtcctcccaggccttgactgtactttttctaagggatatcaaggcctaaccaattgtatgatggccgctctgccagaagataccgtggtgtttgagaagcccgtgaagacaatccactggaatgggtccttccaggaagcagcctttcctggggaaaccttcccagtgtcagtggaatgtgaggacggcgaccgctttcctgctcatcacgttattgttactgtgcctcttggatttctgcgagaacatctcgacacattctttgatcctccactgcccgccgagaaggcggaagccattaggaaaattggctttggtactaataacaagatttttctcgaatttgaggaacccttctgggagcccgattgccagctaatccagttggtctgggaggatacatccccattggaggacgctgcaccagaactgcaggatgcctggtttcgcaagctgatagggttcgttgtgctgcccgcatttgcgtctgtgcacgtcctctgtgggttcatagccggactcgagagcgagttcatggaaactctgagcgacgaggaggtcctcctttgcctgacccaagtgctgaggagggtgaccgcaccagacccagtttgcgggggaagccacacctctcacgtccttttacatgacgcgcgaggtagtgcagtgggcatggagggaggccgccctcccccccagagcgtcggaccagcgggtgcagctgctcaggctcaggcactggccggccccagcctgttatgcagtaccagagtaggaggcaggctagggccctccttcctgctgacggatttttccttggcatag

SEQ ID NO: 32108 - DNA, 342 bp, Artificial Sequence
  Description of Artificial Sequence: Synthetic coding sequence
atggccacgcttttctacgggctgattgaccagacccgggagttcctccacgcggcagaaacaccggtgcctagcgtgggagagtatctgaagaaagagataggccagcacgttgctggctggacggaggacgaggaaacacgcaaactgaaactggccgtgctgaactcattcttcaacttggagtgctgcgtctcgggaacacacaggagaaccggtctgtgctgcagagatggggggagaccgaccgcctcaagcgtctgtggccctagacgctgtagctctccgggacccgggtcttcttgggctcaacctaccctgttccacccttgcagggggtag

SEQ ID NO: 32109 - DNA, 699 bp, Artificial Sequence
  Description of Artificial Sequence: Synthetic coding sequence
atggagtcaactggtagtgtaggggaggcgcccggagggccacgggttctcgtggtggggggggggatagctggccttggagccgctcagaggctgtgcggtcacagcgcttttcctcatctgagagtgctggaagccacagcgcgggccggcgggagaatacggagcgagcgctgtttcggaggtgtcgttgaggtgggggcccactggatccacgctgcgccggagctgcaggacgcatggttcagaaagctgatcggatttgtagttctgcccgctttcgcctccgtgcacgtcctgtgcggcttcatcgctggactggagagtgagttcatggaaactttgagcgacgaagaggtgcttctttgcctgacccaggttctccggcgggttaccggcaacccgcgactgccagcccctaagagcgtcttgaggtcaaggtggcattccgcaccttacacccggggatcttacagctatgtggccgttggaagtacaggtggggacttggatctcctcgcccagcccttacccgccgacggagccggcgcccaattgcagatacttttcgcaggggaagcaactcatcgcactttctactccactacacacggcgcgcttttgtctgggtggcgcgaagcagacagactgctgagtctttgggccccccaggtacagcagccccgccctaggctgtag

SEQ ID NO: 32110 - DNA, 210 bp, Artificial Sequence
  Description of Artificial Sequence: Synthetic coding sequence
atggagtctactggcagcgtcggcgaggctccgggaggtccccgtgtgctggtggtgggagggggaattgctggcctgggcgcggcccagagactctgcgggcactccgcattcccccatctgagggtgctcgaagcaacggccagggcaggggggcgaatcagatccgagcgctgcttcggcgccatcaaggactcgcagaccgcttag

SEQ ID NO: 32111 - DNA, 1392 bp, Artificial Sequence
  Description of Artificial Sequence: Synthetic coding sequence
atggaatccactggatccgtgggggaagcgcctgggggaccaagagtgcttgtggtgggtggcgggatcgcaggcctgggagcggcccagagactgtgcggccactcggctttcccacacctgcgcgtattggaggccacggcaagggccggggggcgcatcagaagtgagaggtgcttcggcggggttgtagaggtcggagcgcactggatacacggtccaagccgcggtaatccggtttttcaactggcagcggaatatggcctgctgggcgaaaaagagttgagccaagagaaccagctcgtggaaacaggtggacatgttggtttgcctagcgtcagttacgcaagcagcggcgcttccgtttcactacagctggtcgctgagatggcaactctgttctacggtctgatcgatcagactcgtgagtttttgcatgccgctgagacaccggtgccatctgttggcgagtacttgaagaaagaaataggacaacacgtggccggctggacggaggacgaagagactcgaaaactgaaacttgccgtattaaatagctttttcaatctcgaatgctgtgtgtctggcacccatagcatggatttagtcgcactagccccattcggcgaatacacggtgttgcccggcctagactgcacatttagcaaaggctaccagggcctgacaaattgcatgatggccgcgctcccagaggatactgtcgtgttcgagaaacccgtgaagactatccattggaatggatcatttcaggaggcggccttccctggagaaacctttcccgtatcagtggagtgcgaagatggtgatcgttttcccgcccatcatgtaatagtcactgtccctctagggtttctccgcgagcacttggatacttcgcctctggaggatgctgcacctgaactccaggacgcctggttccggaaactcattggttttgtcgtgctgcccgcttttgcttcggtccatgtgctctgtgggttcatcgccggccttgaatcggagtttatggaaacgctgtccgacgaagaggtactcctttgtctgactcaggtgctgcggagagtgactggaaaccctcggctacccgcgccaaagtcagtcctcagatcacgatggcacagtgccccatatacacgggggtcatattcatatgtcgccgtgggaagtaccggaggtgacttagacctcctggcccaacccttgcctgccgatggggccggcgctcagcttcaaatactgtttgcaggtgaagctacccaccggacgttctacagtacaactcacggcgccctcctgagcgggtggcgggaagcagacaggttgctgagcctctgggctccccaggtacaacagcctcgaccaagattgtag

SEQ ID NO: 32112 - DNA, 252 bp, Artificial Sequence
  Description of Artificial Sequence: Synthetic coding sequence
atggagagtaccggatcggtgggtgaggcgccgggcggaccgcgcgttctggtcgtaggtggaggaatttcgcgctcttgtctacggggcaagccccacattgcacgttttaccccccggcggacaggactttgctgccgggacggaggccgcccaacagcatcatctgtgtgtggccctcgccgttgcagttcccctggtcctgggagttcatgggcacaacccaccttatttcacccttgcaggggctag

SEQ ID NO: 32113 - DNA, 978 bp, Artificial Sequence
  Description of Artificial Sequence: Synthetic coding sequence
atggagagtaccggcagcgtgggggaggcaccgggggggccaagggtcctggtggtcggaggaggaatagctggcctgggcgcggcccaaaggctgtgcggacacagcgcattcccacatctgcgtgttcttgaggccaccgcacgggccggtggcaggatcaggtctgaaagatgttttggtggggtggtcgaggttggagcacactggatccatggcccatcacgcggaaaccccgtgtttcaactggccgccgagtatggtcttctgggagagaaggagctaagtcaggaaaaccagctcgtcgagaccggaggccatgtgggcctgcccagcgttagctacgccagttcaggggcctcagtgtcactgcagcttgtcgcggagatggcaactctcttctacggactgattgaccagacacgggagtttctgcacgcagccgaaactcccgtgccgtccgtgggcgagtacctgaagaaggagatagggcagcatgtggccggctggaccgaggacgaggagacaagaaaattgaagcttgctgtgctaaatagttttttcaatttagaatgctgcgtgagcggtacacatagcatggatctggtggcactggccccttttggcgagtacacagtgctgcccgggttggactgcacattcagcaaaggataccaaggcctaacaaactgcatgatggccgctttacccgaggacaccgtggtgttcgagaagcccgttaagactattcactggaatggctcttttcaggaggcagcattccccggagaaactttccctgtgtccgttgagtgtgaagatggtgaccgctttcctgcgcatcatgtgattgtgactgtcccccttggattatcaacattttccgtggggtcgcttcccgacctgagcctatcttcgtggcggctctgcagaatgaaaaaatacttctgtgtgtcaccaaaatgctctggcgaatag

SEQ ID NO: 32114 - DNA, 132 bp, Artificial Sequence
  Description of Artificial Sequence: Synthetic coding sequence
atggagtctacgggcagcgtcggcgaagctccaggcggtagacacggcccccggcggggtccccaccctctgggggctctcctcagatggaggggcggaggcgggagagctctggacccttgctgtccctag

SEQ ID NO: 32115 - DNA, 2976 bp, Artificial Sequence
  Description of Artificial Sequence: Synthetic coding sequence
atgagcgccgtgggtctcgttcttctcgtgctcgctctccgtcttcgggccacgaccgtgaaaccagaggaaggatctttctgttctaacagtcaggttgcgtttcgcgatgcctgttacgaattcgtccctctgggccgcacctttcgggacgctcagagttggtgcgaaggccaaggcgggcatttagtctttattcaggacgagggtacccagtggttcctgcagaagcatattagccaggatcgcgagtggtggatagggcttacctggaaccttgctcgaaatgggacaacagaggggcctgggacctggctcgacacctccaatgtgacatactccaactggcatggcgggcaggcggccgcagcccctgatacgtgtgggcacatcgggaggggacccagctcagaatgggtgacctctgactgcgcacagactttcgcatttatgtgcgaatttagagtgggacaaagtttagcctgtgagggtctaaacgctaccgtgcactgtgggcttgggcaggtgatccaggtacaggacgcagtgtacggccgtcagaatcctcacttttgcacacaggatgctgggaggcccagcgatctggagcagggatgttcatgggccaacgttaaggaggaggtcgcgggacagtgccaggagctgcagagctgtcaggtggcagccgatgaaacctactttggtaacctctgtccaacccaaggaagctacctgtgggtgcagtaccaatgtagagaggctctccaactgatggtgagcagcgagtctttcatctttgataacgttacgattagtctcacttggcttttgagtccctacatcggtaatctatcttgcatcatctcaacaggcgattctcacacatttgatccatataatccgccgagtgtgagcagtaatgtgactcaccagttcacctccccgggagagttcacggtctttgctgaatgcaccacctccgaatggcacgtgaccgcccaacgacaggttaccgtcagggacaaaatggaaacgctgagtgtgacagcatgtagtgggctgtctcagtccggagcaggaccactgtgccaggcagtgttcggagatccactctggattcaagttgaattggacggcgggactggcgttacctacactgtcttgctgggagatattaccctcgcggaatccacaactcagaaaggatcgctgccatacaaccttattttggatagggagacgcaaaaactgatgggacccggccggcacagactggagatccaggccaccggcaatactactacctccacaatttcccgcaacatcactgtgcacctagtagaacttctgtcaggtctgcaggcctcctgggcgtcagaccacctggaactgggtcaggatctgcttatcacaatctctctggcgcagggcacacccgaagaactcacatttgaggtcgccggactgaacgctacgttcagccatgagcaggtttcattcggggaacccttcggaatctgtaggcttgccgtgccagtggagggcacatttctggtcactatgctggtgcgtaacgcattttcaaatctctccctagagattggcaacataacgataacagcaccatcaggccttcaggaaccctctggtatgaacgccgagggtaaatctaaagataagggggacatggaggtgtatatccagccgggaccctacgtagatcctttcactaccgtcacgctgggatggcccgataatgacaaagagctgagatttcaatggagttgtggctcctgctgggcactatggtcctcctgtgtggaacggcaattgctcaggacggaccagagagaattagttgtgccagcttcgtgtttgcccccacctgatagcgctgtgaccttgagactggccgtgctcagaggacaggaactcgagaacagagcagagcaatgcctctacgtgtctgccccctgggagctcaggccccgcgtcagttgcgaaagaaattgtaggccagttaatgcatccaaagacattctgttgcgcgtgacaatgggcgaagatagtcctgtagcgatgttctcatggtacctggacaatactccgacagaacaggcggagcccttattagacgcgtgcaggctgagaggcttctggcctaggtctttgactctgctgcagagtaacactagtactctgctccttaatagttccttcctccagtctcggggagaggtcattcgcatccgtgccactgccctcaccaggcacgcttatggagaggatacttatgtaatcagcacagtgccaccccgggaggtaccggcctgcactatcgccccagaagaggggaccgttctgacttccttcgccatcttctgtaacgcatcgacggccttggggcctcttgagttctgtttttgtttggaatctggctcatgcctccattgtggccctgagccggccctgccttctgtttatctgcccctgggagaagaaaacaatgatttcgttctaacagtggtgattagcgccacaaaccgggctggagatacccaacagacgcaggcaatggctaaggtggccctgggggacacctgcgtggaggatgtcgccttccaggcagccgtgagcgaaaagattcctactgcgctgcaaggtgagggaggccccgagcagctattacagctcgccaaagctgtctcatctatgctcaaccaggagcacgagagccaggggtctggccagtccctctcaattgacgttcgccagaaagttcgcgaacatgtactgggaagcctctctgcagtgacaaccggactggaggatgtgcagagagtacaggaattggcggaggtgttaagggaggtcacgtgtcggagcaaagaactgacaccgagcgctcagggttcttgcatgggcgatagctgggaaggtgctcctcctgcggcacatgtgtcgcatgctagatag

SEQ ID NO: 32116 - DNA, 1560 bp, Artificial Sequence
  Description of Artificial Sequence: Synthetic coding sequence
taactggcccagggcacacccgaagaactcacattcgaggttgcaggattgaacgcgaccttcagccatgagcaggtctcgttcggcgaaccattcggaatatgccggttggcagtgccggtcgaagggacatttctggtgactatgctggtgcgcaacgctttctccaacctgagcctggagattggtaacattactattaccgccccttccgggctgcaggagccatccggcatgaatgcagagggcaaatccaaggataaaggtgatatggaagtgtacatccagccggggccatacgtcgatccctttactacagttaccttagggtggcctgataacgacaaggagctccgcttccagtggagttgtggttcttgttgggcactctggtccagttgtgtggaacggcaactgctgaggaccgaccaacgcgaactggtggttccagcttcctgtctccctcctccagacagcgcagttacacttagactcgccgtgctgcggggccaggagctagaaaacagagctgagcaatgcctctatgtgagtgccccatgggaacttagaccccgagtctcctgcgagagaaactgccgccccgttaatgctagtaaagacattttgctgagggtgacgatgggtgaggattctccagtcgcaatgttctcttggtacctagacaacactcccaccgaacaggccgaaccactactcgacgcttgcaggctcaggggattctggcctcgctccctgaccctcctacagtctaacacctcgactttgcttttaaactcatccttcttgcagtcacggggcgaggtgatcagaattagagccacggctcttacacgacatgcatatggggaagatacatacgttatcagcacagtcccgcctcgtgaagtgcctgcatgcacgatcgccccagaagaaggtacagtgctgacaagtttcgctattttctgcaatgcgtcaacagccttggggcccctggagttctgtttctgtctcgagagcggaagctgcctgcactgcgggcccgaacctgcgctgcctagtgtctatttgcctctgggcgaagagaacaatgatttcgtgctcacggtggtgatctctgctacgaacagagccggagacacacagcagactcaagcaatggctaaggtggcgctgggcgacacctgcgtcgaagacgtagctttccaagcggcagtctccgaaaaaatcccaacagcgctgcagggcgaaggcgggcccgagcagttactgcagctggcaaaagccgtgagttcaatgcttaaccaggaacatgaaagccagggaagcggacagtccctgtcaatcgacgtgcgacagaaggtcagagagcatgttctgggcagtctgagcgcagttaccaccggactcgaggacgtccagcgcgtgcaagaactggccgaagtgcttcgggaagtgacatgcagatccaaggagctaacacctagtgcccaaggatcctgtatgggagatagctgggagggtgctccccccgcagcccacgtgtcccatgccagatag

SEQ ID NO: 32117 - DNA, 798 bp, Artificial Sequence
  Description of Artificial Sequence: Synthetic coding sequence
atgcctttgcccgtggcgttacagacccggttagccaagcggggtatattgaagcacctagaacccgagcccgaggaagaaattatagcggaagactatgatgatgatcccgttgattatgaggcaacacgcctagagggccttcccccatcatggtacaaagtgtttgacccaagctgtggcttaccatactactggaacgccgataccgacctcgtttcttggttgtctccacacgatcccaactctgtggtgaccaagtcagcaaaaaaactacggtccagtaacgctgacgccgaagagaaattagaccgaagccacgataagtccgaccgcggtcatgataaatccgaccgttcgcacgagaagcttgatagaggacacgataagtccgaccgcgggcacgataagtccgatcgcgaccgagaacgaggttacgataaggtcgacagagaaagggagagggatcgggagagggacagagaccgaggttacgacaaggctgaccgcgaagagggtaaagagcggcggcatcatagacgggaagagttggcgccatatccaaaatctaaaaaggccgtgtcacggaaagacgaagaattagatccaatggatccctcctcatactcagacgctccacgcggcacctggtcaacaggcctcccaaagcggaacgaagctaaaacaggcgccgacacgaccgccgcgggccctctgttccagcaaagaccatatcccagccccggcgccgtgctgagggctaatgcagaggcatctcggacaaagcagcaggactag

SEQ ID NO: 32118 - DNA, 798 bp, Artificial Sequence
  Description of Artificial Sequence: Synthetic coding sequence
atgccattgcccgtggcgctgcagacgcggttggcaaagcggggcatattaaagcatctagaacccgagcctgaagaagagatcattgccgaggattatgatgacgacccggtagattacgaggccaccaggctggagggtctgcccccaagttggtacaaagtcttcgacccgtcctgtgggctgccctattactggaacgccgataccgatttggtgagctggctgtcacctcacgatccaaacagcgttgtgaccaaatctgcaaaaaaactccggagctctaacgccgatgctgaagaaaaattggatagaagtcacgataagagcgatcgcggtcacgacaaaagcgaccgctcccacgagaagttggatcgcggacatgacaagtctgatagggggcatgacaagagtgatcgtgatagggagcgtggctacgacaaggtggatcgcgaacgagaaagagatcgggaacgcgatagagaccgaggatacgacaaagctgaccgtgaggaaggaaaagaacggcgccaccatcgacgagaggagcttgcaccgtaccctaaaagcaaaaaagcagtttctcgtaaagacgaggaacttgacccaatggatccttcatcatattcagacgcacccagaggaacctggtctacgggcttgccaaagagaaatgaagccaagaccggggccgatactactgccgcgggccccctgttccagcaaagaccctacccttcaccaggcgcggtcctgagggccaatgccgaagcctctaggactaaacagcaggactag

SEQ ID NO: 32119 - DNA, 798 bp, Artificial Sequence
  Description of Artificial Sequence: Synthetic coding sequence
atgccactgcccgtggcactgcaaactagactggccaagagaggaatcttgaagcacttagagccggagcctgaggaggaaataatcgctgaagattacgatgatgatccggtcgactacgaggccacgcgtctcgaaggcctgccgcccagctggtataaggtgtttgacccatcctgtggccttccatattattggaatgccgataccgatcttgttagttggttgagcccccatgatcctaacagcgttgtgaccaagagcgctaagaagttaaggtcctctaatgcagacgccgaagaaaagctggaccggtcacacgacaagagtgatcgaggccacgataaatccgacaggtcgcacgagaaactggatcgcggccacgacaagtccgaccggggccatgacaaatctgacagggaccgcgagcgggggtacgataaggtcgacagggaacgggaaagggatcgggaacgtgaccgggaccgtggatacgacaaagcggatcgcgaggaaggaaaagagaggagacatcataggagagaggagcttgctccctaccccaaatctaagaaggcggtgagtcggaaagacgaggagctggacccgatggatccatcctcttattccgacgctcctagggggacatggtctaccgggttaccgaaaaggaatgaggcgaaaaccggcgctgacaccactgccgcagggccgctctttcagcagcgtccatatccatctcctggagcagttctcagggccaacgccgaggcaagtcgcacaaaacaacaggattag

SEQ ID NO: 32120 - DNA, 513 bp, Artificial Sequence
  Description of Artificial Sequence: Synthetic coding sequence
atgccgctgcccgtcgccctacagacaaggctagccaaacgcggcattttgaaacaccttgagcccgaacctgaagaggagatcatagcagaggattatgacgatgacccagtggattatgaggcaacgcggcttgaaggactccccccatcctggtataaggtgttcgatccctcgtgtggactgccctactactggaatgcggacacagatcttgtctcttggctgagcccacacgaccccaattccgtagtaactaaatcagcaaagaaactgcgttcatccaacgcggcagtcagtcggaaggacgaagagttggaccccatggatcccagtagctattcggacgctcctaggggcacctggtccacagggctgcccaagagaaatgaggcaaagactggcgcagacacaactgctgccggccccctttttcagcagcgtccttatccctcacctggagcggtgctgagggccaacgctgaagcctcccgcaccaaacaacaagattag

SEQ ID NO: 32121 - DNA, 1446 bp, Artificial Sequence
  Description of Artificial Sequence: Synthetic coding sequence
atgtaccaggccagcgcagttagcctactgccccgggacattccttcttgtcactcaccctccccaggcttctctcacttgcctacctcctcatcccagctcgcgcctgatctattacagttccctctaggtcaggaccctagctttctcgctatccccatcctgacgctgccaccttctgatagcttggtgcccccttacatagtgtggtatatagtctggccctcagcacttatctccttcctcggctgtactttgaccgtccagttctcgaacggcaagctacagagtccagggaatatgcggttcacgctatacgagaacaaagattccactaacccccgcaagaggaaccaaagaatcctggctgccgagactgacagacttagctacgtggggaataattttggtacaggagccttgaagtgtaacactctctgtcgacacttcgtaggaatcctgaacaagacatccgggcaaatggaggtatatgacgctgagctgtttaacatgcaacccctcttcagtgatgtgtcagtcgagtcagaattagccctggaatcccagacaaagacctaccgggagaagatggacagttgtattgaggcattcggaacaacaaagcagaagagagccttgaatacaaggagaatgaatagggtagggaatgaatccttgaatcgagcagtggccaaagctgccgaaacaattattgacacaaagggagtaactgctttagtatccgacgctattcacaacgatcttcaagacgactctctgtatttgccaccatgttacgacgacgccgccaagcctgaagacgtctacaagttcgaggacctgttgtcaccagccgagtacgaggctctgcaaagtccctctgaagcctttcgtaatgttaccagcgaggagatcctgaagatgattgaggaaaatagtcattgcacttttgtcatcgaggcattaaaatcgcttccatctgacgtggagtcccgagatcgccaggccaggtgcatttggttccttgatacacttatcaagttcagagctcatagagtcgttaaacgtaaaagcgccctgggccctggcgtgccccatatcattaacacaaagctgctcaagcattttacctgcttgacttacaacaatggcaggctcagaaacctcatttcggatagtatgaaagcaaaaataacagcatatgttataatcctcgccttgcatattcacgatttccagatcgacctcacggttttacaacgagatttgaaactgtccgaaaaacggatgatggagatagccaaggctatgcgattaaagattagtaaaaggcgggtgagtgttgctgcagggtcagaagaagaccataaactggggactctttcactgccccttcccccagcccagactagcgatcggctcgcgaagagacggaaaatcacttag

SEQ ID NO: 32122 - DNA, 1260 bp, Artificial Sequence
  Description of Artificial Sequence: Synthetic coding sequence
atggctgcagaagttcttcccagcgcccgctggcagtattgtggagcacccgacggaagtcagagagccgtacttgtacagttttcaaacggaaaactgcaatctccagggaatatgagattcacgttatacgagaataaggatagtacaaaccctcggaaacggaatcagcgcattttggctgccgaaaccgacaggttatcgtatgtgggcaataattttgggacaggcgccctgaagtgtaatacgctctgtcggcactttgtagggatcctgaacaagacctcaggtcaaatggaggtctacgatgcagaattgtttaatatgcaacctctatttagcgacgtctctgttgaatccgagttggccctggagtcacaaaccaagacctacagagaaaagatggacagctgtatcgaggccttcggcaccacgaagcaaaagcgggccttgaatacaaggagaatgaacagagtagggaatgaatccttaaatcgagccgtggccaaagctgctgagactattattgataccaagggcgttaccgccctggtgtctgacgcgattcacaacgatcttcaggacgactccctgtacttgcccccctgttacgacgatgcggcaaagcctgaggatgtctataagtttgaggatcttttgtcacccgcggagtatgaggccctacagtcgccgtctgaagccttccgaaatgttactagtgaagagatcctgaagatgattgaagaaaactcccactgtactttcgtcatcgaggctttgaaaagcttgccttcagatgttgagtctcgcgataggcaggcccgctgcatttggttcctcgacacgctgattaaattccgggcacatagggtggtcaagcggaagtccgccctggggcctggagtcccccacatcattaacacgaagctgctcaaacactttacctgtcttacttacaacaatggtagacttagaaacctgatcagtgatagcatgaaggccaagatcaccgcatacgttattatcctggccctgcacattcatgattttcagattgacctgacagttctccaacgcgacttaaaactgagtgaaaagcggatgatggagatagctaaggcgatgcggctgaagatttccaagcgccgcgtgtcagtggctgcaggaagtgaagaggaccacaagctggggaccctgagcctgccactgccacctgcccagacctctgaccggctcgccaaacggaggaagattacatag

SEQ ID NO: 32123 - DNA, 561 bp, Artificial Sequence
  Description of Artificial Sequence: Synthetic coding sequence
atggcagcagaggtcctgccgagcgcacgatggcagtattgcggagctccagacgggtcccagcgtgctgttctggtgcagttctctaacggcaaacttcagtccccaggaaatatgcgtttcactctgtacgaaaacaaagattcaacgaacccacgcaagcggaatcaaagaattctggccgcagagaccgataggttgtcttatgttggaaataatttcggcactggcgcccttaaatgcaacaccctgtgtaggcacttcgttggcatattaaacaagacatccggccagatggaggtttatgatgcggagctcttcaatatgcagccacttttctctgacgtgagtgtggaatcagagctggcactcgagtctcagacaaagacttacagggaaaagatgaccccgtctaccttcctgccagctatgatgatgcagccctcacttaaaacctgtattaatctcaaaatatttttccccctgtggagagcagagacagcacggcctgatgcatatggattttggatccctagctctaatttcgagctgatagggtag

SEQ ID NO: 32124 - DNA, 1050 bp, Artificial Sequence
  Description of Artificial Sequence: Synthetic coding sequence
atgatgctgaattgttctacgtgttcacactattttcaagtgtttcaccaggagagcaagattattttttggaaagaaccaagaacctgcttcctgatcctgtccctgccacttcctggagaattaacttgggacgtgtccgttgaatccgaactggcccttgaaagccagacaaagacttatcgagaaaagatggactcatgcatcgaggcttttggtactactaaacaaaaacgcgctttaaatacacggcgcatgaacagagtgggcaatgaatcacttaacagagctgtagccaaggctgccgaaaccattatcgatacaaagggagtgacagccttggtgagcgacgcgatccataacgatctccaggatgacagcctgtatcttcccccatgttatgatgacgccgcaaaacccgaagacgtgtacaagttcgaagacctcctgtccccagcagagtatgaagcattgcagagcccatcagaggcctttcgtaacgttaccagcgaagaaatactcaagatgatcgaggaaaactcccactgcacattcgtcattgaagctctgaagtctctaccaagtgacgtagagagtcgagatcgtcaggccaggtgtatttggttcctggacacgctcatcaaattccgcgcacatcgcgtggttaaacgtaagtccgcactgggcccaggagtgccccatatcattaatactaagttgcttaaacacttcacttgccttacctacaacaatggccggctgcgtaacctcatcagcgactctatgaaggccaagatcacagcctatgtgattatcctcgcactacatatccacgactttcagattgatctcaccgtgctacagagggatctgaagttgtcggaaaaaaggatgatggagatcgccaaggcaatgagactgaaaatcagtaagcgccgcgtaagcgtggcagccggcagtgaggaggaccataaactgggcacactgtccctgccgctgccgccggcccaaacgagcgatagactggccaagagacggaagattacgtag

SEQ ID NO: 32125 - DNA, 588 bp, Artificial Sequence
  Description of Artificial Sequence: Synthetic coding sequence
atggcatcgaggggaggcggtagggggcggggacgtgggcagttgacattcaacgtagaagcggttgggattggaaaaggagatgccctacccccgccgactctgcaaccatcacctctgttcccccccctcgagttccggcccgtccctctcccgagcggtgaggaaggagaatacgtcctggccttaaagcaggagttgcggggggcaatgcggcagctcccatactttattcggcccgcagtgcccaagagagattggcggaggttacctagggagctcaaaatccgggtaagaaaactgcagaaggagcggatcaccattttattacctaagcggcctccaaaaacaactgaagacaaagaggagactatacagaaacttgaaactctggaaaaaaaagaggaagaggtgacttccgaagaggacgaggagaaggaagaagaggaagaaaaagaagaggaggaagaagaggaatatgatgaggaagaacacgaagaagaaaccgattatattatgtcgtatttcgacaacggcgaagactttggaggggattctgacgataacatggacgaggccatctattag

SEQ ID NO: 32126 - DNA, 657 bp, Artificial Sequence
  Description of Artificial Sequence: Synthetic coding sequence
atggccagccggggcgggggacgggggagaggccggggtcagctgacctttaacgtagaagccgtcggcattggtaagggggacgccctgcccccccccactctccagccaagtccccttttcccacccctcgagttccgcccggtgccgcttccatctggggaagaaggagagtatgttctcgccctgaagcaggagctccgtggagcaatgcggcagctgccttatttcatcaggcctgccgtgccgaaaagggatgtcgagcggtactccgacaagtaccagatgtctggaccaatcgacaatgctatcgactggaatccggattggcggcgcctgccaagggaacttaagatcagagtgcggaagctgcagaaagagagaattacaatcctgctgcctaaacggccccctaagacaacagaggataaggaagaaaccatccaaaagttagagactctggagaaaaaggaagaggaagtgacctccgaggaggacgaggaaaaggaggaagaggaggaaaaagaggaagaagaggaggaggaatacgacgaggaggagcacgaagaagaaaccgattacataatgtcctattttgataacggagaggatttcggtggtgactctgacgacaatatggatgaagctatctactag

SEQ ID NO: 32127 - DNA, 1680 bp, Artificial Sequence
  Description of Artificial Sequence: Synthetic coding sequence
atggcaactgccaccatcgcccttcaggtgaacggccaacagggtggcggtagcgagcctgccgctgccgcagccgttgtcgccgccggagataagtggaagcccccccaaggtaccgacagtatcaagatggaaaacggccaaagcaccgctgcaaaactggggctgcctcccctgacacctgaacagcaggaggctcttcaaaaggccaagaagtacgcaatggagcagtccattaagtctgtccttgtcaaacagaccatagcgcaccagcagcagcagctgactaatttgcaaatggctgccgtgacaatggggtttggggatcctcttagtcccctgcaatcaatggccgcccagaggcagcgtgcactggcgataatgtgcagggtatatgtgggcagcatctattatgaactgggggaggacaccattcggcaggcctttgcaccttttggcccaataaaaagcattgacatgtcatgggacagtgttacgatgaaacataaggggtttgcttttgtcgaatacgaggtgcctgaagcagcacagctggccctggagcaaatgaacagcgtcatgctgggcggaagaaacattaaagtgggaagaccttccaatattggtcaggcacagcctatcattgaccaattggcagaggaggcacgagctttcaacaggatctacgtggcatcagtgcaccaagatctcagcgacgacgacatcaagtctgtgtttgaggcttttggtaagatcaaatcatgcaccctggcgagagaccccacgaccggtaagcacaaggggtacggctttatagagtatgagaaagcccagagttcccaggacgctgtcagttcaatgaatctgtttgatctcgggggtcagtatcttagagtgggaaaagcagtcacaccccctatgcctctcttgacaccagctaccccaggaggcctaccgccagcagccgcagttgccgccgcagcggccaccgctaaaattacagcacaggaagcggtggccggagcggctgtgctggggaccctaggaacccctggattggtgtctcccgcgctgacgctggcccagcctctggggacactgcctcaagccgtaatggcagcccaggccccgggagttatcacaggtgtcactcctgcgagaccaccaatccccgtgaccatccccagcgtgggagtggtgaaccccatccttgccagtccgccgactcttggcctcctggaaccaaagaaagaaaaggaggaagaggaattattcccagagagcgaacgccctgaaatgctgtctgaacaggagcatatgtctattagtggaagttccgctcgacatatggtcatgcaaaagctgttgcgaaaacaagagtcgacggttatggttctcaggaacatggttgaccctaaagatattgatgacgacttagagggagaggtcaccgaagagtgcggtaaatttggtgctgtgaatcgtgtgattatctaccaggagaagcagggggaggaggaagacgcagagatcatcgttaagatatttgttgaattttcgatagcaagcgagactcacaaggcaatccaggccctcaatgggcgctggtttgcggggcgcaaggtagtggctgaggtttatgaccaggaacggtttgacaacagtgatctgtccgcttag

SEQ ID NO: 32128 - DNA, 1500 bp, Artificial Sequence
  Description of Artificial Sequence: Synthetic coding sequence
atggagaacggccagagcacagccgcgaagctgggtctccccccactcacaccagaacagcaggaggcgctccagaaggccaaaaagtacgctatggagcagagtatcaagagtgtgttagtgaaacaaactatcgctcatcagcaacaacagcttacgaatttgcaaatggccgctcagaggcagcgggccctcgctataatgtgcagagtttacgtcggctcaatctactatgagctcggggaggataccatacggcaagcctttgcccctttcggtccaataaaaagcatagacatgtcatgggatagcgtgacaatgaaacataaggggttcgctttcgtagaatatgaagtacctgaggctgcacagcttgcgctcgagcagatgaatagtgttatgcttgggggaagaaatattaaggtcggtaggccctccaacatcgggcaagcccagccaattatcgatcaattagctgaggaagcccgtgcattcaataggatttatgtagcgagcgtccaccaagacttgagcgatgacgatataaagagcgtattcgaggcctttgggaaaattaagtcatgcaccttggcacgagaccccacaacagggaagcacaagggctacgggtttattgaatatgaaaaggcacaatcctctcaggatgctgtctctagtatgaacctttttgaccttggcggacagtatctgagagtgggtaaagccgtgacaccccccatgccgttactcacgccggcgacaccaggtggtctgccgcccgccgctgctgtggccgcagctgccgctacggcgaagattaccgcccaagaagctgttgctggagctgcagtacttgggacacttggcactcccggcctggtgagtcctgccctgaccctcgcacaaccactcggaaccctaccgcaggcggtgatggccgcacaagctcctggcgtcattactggtgttacacctgccagacctcctattccagtcactatcccttcagtaggggttgtgaaccccattctggcaagtccaccaacactaggcttattggaacccaaaaaggaaaaggaagaggaggaacttttcccagaatccgaaaggcccgaaatgctgtccgagcaagagcacatgagcattagcgggagctcagcccggcatatggtaatgcagaaactgctgcgtaagcaggaatcaacagtgatggttctgcgcaacatggtcgaccctaaagatatcgacgacgacctcgagggtgaggtgaccgaggagtgtgggaagtttggcgcagtgaatcgagtgattatctatcaggagaagcagggagaggaggaagacgccgaaataatcgtaaaaatatttgtcgagttttctatcgcctcagagacacacaaggcaatccaggctcttaacgggagatggttcgcagggcggaaggtcgtggccgaagtgtacgatcaggagcgtttcgacaattccgatttgtccgcgtag

SEQ ID NO: 32129 - DNA, 1629 bp, Artificial Sequence
  Description of Artificial Sequence: Synthetic coding sequence
atggctaccgcaaccattgcccttcaagtgaatgggcagcaaggcggcggtagcgaaccggccgcagcagcagccgtggtcgccgcgggcgataaatggaagcccccccaggggactgactcaataaaaatggagaatggacagtcaacagcggccaaactgggactgcctccactcacccccgagcagcaggaagctctccagaaggcaaagaaatacgctatggagcagagcattaagagtgtgctggtgaaacagacgatcgcccaccagcagcaacagttgacaaatctacagatggccgcacagcgccagcgagcattggctattatgtgcagggtatatgtgggcagtatttactacgaacttggagaggacaccattcgacaggctttcgccccatttggtcccataaagagtatcgacatgtcatgggattctgtgaccatgaaacataaagggtttgcgttcgtggagtatgaagttcccgaagcagcacaactggcattagagcaaatgaatagcgtcatgctagggggaagaaacattaaagtaggaagaccctcgaacatcgggcaagcacaacctattatagaccagcttgcagaagaagctcgcgccttcaaccggatctacgttgcaagcgtgcatcaggatttgtctgatgacgacattaagtcagtgtttgaagcctttggcaaaattaaaagctgtacattggccagagaccctacgactggcaaacataaaggatatggctttattgagtatgaaaaggcgcaatcatctcaagatgcagtctcatctatgaacctctttgatttaggcggccagtatctccgcgtcggcaaggctgtgactccaccaatgcccctgcttactccagcgaccccaggggggctaccccccgccgcggccgtggctgcggctgctgctacagccaagattactgctcaggaggccgtggcaggcgcagccgttctgggaaccctggggacgccagggcttgttagtccagccttgactctagcccaacccctggggactctgccacaggcggtgatggccgcgcaggcgccgggagttattactggcgtaacaccggcccgaccacctattccagtcacaatccctagcgtgggggtggtcaatcccatcttagcctcgcccccaacacttggcctcctcgagcctaagaaggagaaagaagaagaagaattgtttcccgaatcagagaggcccgaaatgctgtctgagcaggagcatatgagcatctcaggttcttcagcacggcacatggtgatgcaaaagttgctgaggaagcaagagagcacggtcatggttctccgcaacatggtagaccccaaggatatcgacgatgacctggaaggtgaagtgaccgaagaatgcgggaaattcggcgcagtcaatcgggtcattatatatcaggagaagcagggggaggaagaggacgccgagattattgtaaaaattttcgtggaattttcaattgccagcgagactcacaaggctatacaggccctgaatggaagatggtttgccggaaggaaagtggtcgcagaagtgtatgatcaggagcgcttcgacaattcggaccttagtgcctag

SEQ ID NO: 32130 - DNA, 891 bp, Artificial Sequence
  Description of Artificial Sequence: Synthetic coding sequence
atgggagccgcagctcctgccgagagcgcagatctgggcaacttctggaaggccggggagccactcctgcaaggcccagatgccctggctgcgcctatgtcacgttcgccgagcacgcctcaaactactccctccccccagggcagacagagtccgtggcctctgcggtccctaactcagtcgcacattcagtactttcagtggggccgtcctgtcccatccactcatttgatagaagtcagaccaacccaggacccagcaaagccacagagagttgtctctgaaggatggagaaggcctgccctgccaggcgaaacggccctcgggcgggacctgtcctgcgcctgggaaggatgtatgaagggaggtctctgcagagcatggaatcctgggcgcacatggtctccagtgactatcggtatcgcacctcctgagaggcaggaatctccttggcgaagccccggccagcgtgcaagacccgccggcagaccggcggcccaggaactgctcgacccctgtactcgagagacgctgttgggggccttgtcccaatgtcccaaaggctcagctagattcgatggcccgctatggtttgaggtatctgacagcaagggaggaaggcggaatctgcagcctcgccctagcgctttcaagcccctatcaaaaaatggcgctgtggccagcttcgtcccaaggcctggccccctgaagccttctctcggtccttggtcgctgtctttctgtgacgacgcgtggccgtcagtgctggtgcagccagctccttccgccatttgggacttttgggaggcgactactccttcctgcggctcttgttcccgcgtgtccttcgccctggaggtgacacagagcgctggaccattcggatcatag

SEQ ID NO: 32131 - DNA, 2916 bp, Artificial Sequence
  Description of Artificial Sequence: Synthetic coding sequence
atgggctcattcttgagtaagctcgagctttctcctagctcacctgcccaggtaaggacggaccttccagaaaggcctacaaaacgccggccaccgcagccgttgcatcaggtgcaccgggtccagttcgtgcatcgggcccaccctgcccccaggtaccgacccgttagaagaaggccgaatctagacccagccaatcccaccacttggctcgctaacgaggcctggagacgttttccgatgaaaaaatctcagaattctccgctaggcccactgccttcagactggtgggaaagctacctgaagcggaccatttggagtctgagacatcctcggcccatatggtcgccagtgacaattcgcatcacaccccccgaccaacgagtcccaccaagtacctccccggaggatgtcatcgctctggcaggactcccaccgagtgaagagctcgccgacccttgcagcaaggagaccgtgctgcgggccttacgtgagtgtcggaaaggtaaaggaagactggaggagcctcttttccctgagtccctggatagtaagcgccgatcgcctgaaacgcggcccagtgcctttaaacctctgatgaagaatggcaccctcacttctttcgtccctcggcctggtcccctgaaacgctccctgcactcatggggctctgatcactctcttaccaaacgcccgaattgttctagtatgtcatcccttgccagtatctatcgcggcggcacgctgtctagcaagcggaatgccatcggctcctcctattcaagctgcagaaacttttcagatccatggaagcgaagcgtgcccagcgtgtcctttgagacacctgagtggccaatcaaaaaggaaaagagctgtcacagaccgtcatccccagtccctcttgtcagtgactttgagtcactcgggggctctgaatcttctgggcagcaaaatcagaagatcccacagctgccttcttcgccagaaaatctggtttccgaaatccctccaccacaactcggatatgccgtatccgacgagaaccttacattgggaaagaaggcagaattacaatctaccggagaggcaacgagcgttgcacattccccccttaagacaccatccctgcctacacccccaggttgttcacagtcggagctactccctgggacttctccagattctaagcccacagccacctttatcctactgacaccaaccagtccaacacttcctgtcactgatactacctggccgccttccacaagtcaggccgaccgctcgccgatgccacctgatccccccgccccccctactattcaatcgaccctactggggatggtttccagcccaacctctcacctgtccgcgtccgcgcccccagatgccacctccgctcatctcatgctgaagccgatactaggcccattgcacaacagcgagatcgggagtagttcctactctcgtatctccgtcaccgccgccgccagctccattagctccctgagcacgatacaaggcaccctcacccccacgtttaagcctatcttcggcagcatcgatccactgaagacaacccccatgattgccccgtttagctctaagcagacaccccctccctttacccatgcctccacacaccattttcatggactcgtgaaggccacctcggtggtgatgtcaaccaccttagctagcacctccaaagacagcgtttttaaaccccccctggatttcggagtggtgaatgtgacctcggccgttgggaacacgtattcggtgccatctacttgcgataccttccttttaggaacagcgcaagcctttagagctgattttactccggcaaccgggtttatttttccaccccaccaccacccaacaattcctacggtacacacggtgacaatgttcacacaggtactgtcttccgtcgtgcaaatttcaccccgaagctctacagccaacttccgcggcatgggatcaccactgcccgcaagcgccctggtgagtacaaattggcttgcatcaactccttctatatctaacttaactcccgcgataacaagtcccctcggatccagcagccggcctcccttccccctgtctcaaggagctaatccacagccagcgttcggggcaactaacggccagaagcaggggccatctcagcctgctctcatgcccagcgtaagctccagttttttgtttgggtcttctgcagtggcactccccacccccatgcctactcccgcccagcctgccttcatctccacaacacagtctgccctgggctgtctaactcctagcgcctccactagccagacacctgcctccacatggtccgggataggaggcattccggcaggtttcccaattagccaggcctcgaccaccgggttcagaattgtcatccagacccaccaatcaggggcttttggtagtgtgtttggcagccgagcacctcagccctttacatttggtgggtttgtcaccccgatggactgcgacgagtccggaattatcatgaccggacctgatatgtccccaacatccggagcatttagcattggggcactcccaagcggcaccaccaatacgatgattccctttggcaaaggctggtctcagaacacagagggcctgccgagccacaggactgccttcagccttggaagagggtccattagtgcgcgaaaaacgatggcacccatcgcccaaaacactccggttccaggtcaggcgaaggctggaagttctgtcggcttcgggatgccttttcccccagcacagggcagcgtgggtcgcggaccatttcgctcttccgcgtcatccttctctattggtgccaagtctaagaccccaaaaaaccgggaaaagggacattcaaggcgtcaccatgcatacaaaaaatag

SEQ ID NO: 32132 - DNA, 3108 bp, Artificial Sequence
  Description of Artificial Sequence: Synthetic coding sequence
atggggtcattcctctctaaactggagctgtctccatcaagtcccgctcaagtgagaacagacctgccggagcggccgactaagagaagacctccccagcccctgcaccaggtccatagggttcaatttgtccaccgagcacatcctgcccccagatatcggcctgttcggcgccgccccaaccttgatccagctaatccaacgacatggctggccaatgaggcttggcgccggtttcccatgaagaagtcacaaaatagtccactggggccactgccctccgattggtgggaatcctatctcaaacgcactatttggtctctcaggcatcctcggcctatatggagcccagttaccataaggatcaccccacccgatcagagagtgccgccttccacttcccccgaggatgtgatagctctcgcaggattgccaccttctgaagagctggcggacccgtgcagcaaagaaaccgtcctccgcgcccttcgggagtgccgaaaggggaaaggacgcttagaggaacctcttttcccagagtctttggacagcaagaggcgctcacccgaaaccaggccaagcgcttttaagccattgatgaaaaatggaaccttgaccagtttcgttccgagacccggacccttgaaacgttctcttcactcttggggaagtgaccattctttgaccaagcggcccaattgttcctcaatgtccagtttggcgagcatttacagaggcgggactctctcctccaaaaggaatgcgataggcagctcatattcttcttgcaggaatttcagtgacccttggaagcgaagtgtgccaagtgtctcgttcgagactcctgaatggcctattaagaaagaaaagtcatgccatcgcccctctagccctgtgcccctcgtctctgacttcgaatccctcggtggttccgaatcctctggtcagcagaatcagaagatcccccagctgccctcaagcccagagaacctcgtatctgaaatacccccaccgcagctggggtatgcggtcagcgatgagaacctcactctggggaagaaggccgagctccaggtaagtaataacgctggagaggatacaactgaggtgaacactgaccccttccccgaaacatggctggctatccagccctccctttctctggcactgccatcatccgagaccgaccttacgcagggcgccaatccacaacttgagaatctcagaaagatgcagaagtctctgggcccactggctagccctcagtcaacgggcgaggccaccagtgtcgcacattcacccctcaagacacctagcttgcccactccgcccggatgttctcaatccgaactactgcccgggacctccccagattccaaacccacagctacatttatcctgctaacccctacgagcccaacccttcctgtgaccgataccacttggccaccctccaccagtcaggccgatagatcgcccatgccacccgatccacctgccccaccaaccatccagtcgacgctgctgggcatggttagtagccccacttcccatctgagcgcgtctgcacccccagatgctactagcgcccacttgatgttaaagcctattttagggcccttgcacaattcagaaatagggtcatctagttactctagaatatctgttactgctgcagcatcaagcatctccagtctcagtaccatccagggaactttgacccccacgttcaagcctattttcggcagcatcgatccactcaagaccacgccgatgatcgctcccttcagcagcaagcagactcctccaccattcacacatgcgagcacacaccacttccacggtttggtgaaggctacttctgtagtgatgtcaacgacactggcctcaacctcaaaggacagcgttttcaagcctcctttggacttcggcgtcgtgaatgtgacgagcgccgtgggcaatacctactccgtacctagcacgtgcgatactttcctgcttggcactgcacaggcgtttcgtgccgatttcacacccgctacaggtttcattttcccccctcatcatcatccgactatcccaacagttcacaccgttacaatgtttacccaagttctgtcctcagtagtacagatttctcctcgcagctcaacagcaaattttcgcgggatgggttcccctcttcctgcctcggctctagtgtcaacaaattggctggcctccactcctagtatcagcaatttgactcctgctatcacctcaccgctgggatcatcctcacgtcccccattccctctatcccaaggagcaaatcctcaacccgcatttggagccactaacgggcagaaacaaggaccatctcagccagccctgatgccgagcgtgtcctcatccttcttatttggcagtagtgctgtagcattacctactcccatgcctacaccggcacagccagcattcatcagcactacccagtctgcgctgggatgcctgacaccttcagcaagcacatcacagaccccggcatctacatggtctggaataggcgggatccccgccgggtttcctatttcccaggcgtctacgactggcttccggatagtgattcagacccaccagagtggagccttcggcagcgtgttcggcagtcgcgctcctcagccatttacttttggtggctttgttacccccatggattgcgatgagtccgggattatcatgactgggccggatatgagccctacaagtggcgccttctccattggagccctgcctagcggaacaactaataccatgattccatttggaaaggggtggagtcagaacaccgaggggctgcccagtcacagaacggcgttttcactggggagaggctccataagtgctagaaagaccatggctcctatcgcacagaacactcccgttcctggccaggccaaagccggtagttctgtaggcttcgggatgccattccccccggctcagggctctgtgggccgcggacctttccggagttccgctagttcattcagcattggggccaagtctaagactcctaaaaaccgtgagaagggccatagtcgacgccaccatgcctataaaaaatag

SEQ ID NO: 32133 - DNA, 1374 bp, Artificial Sequence
  Description of Artificial Sequence: Synthetic coding sequence
atggattcactctggggacctggcgcaggatctcatcctttcggggtccacaacagtcggctgtcacccgacctctgcccaggaaagattgtattacgcgccttaaaagaatcaggcgccggtatgccggaacaggataaggatcctagagtacaagaaaacccaggcgatcagcgtcgggtgccagaagtcacgggtgacgctcccagtgctttccggcccctgagagataacggcggactaagcccatttgtccccggcccaggtcccctgcagaccgatctccacgcccagcggtcagagattcgctacgaccaatcctcccagacctcatggacctcgtcatgtaccaaccgtaacgccatctcctcttcctacagttccactgggggcctgccaggactcaagcgtaggagaggccctgcctcttcccattgtcaactaaccctaagctcttcaaagactgtttccgaggatcgcccgcaggccgtgagcagtggtcacactcagtgtgaaaaggtagctgagaaagcgccaggtcagactctggcactgcggaacgactcaagcaggtcagaggcctcacggccctccacacggaagtttcccctgctcccacaccgacgaggtgagccgttaatgttgcctccgccagtggaactcggctaccgcgtgaccgccgaagatttggactgggagaaggaagcggcctttcagtgtattaagtcagcgctgcaggtggaggataaagcgatatccgattgtcggccatctcgcccgagtcacacactgtcctctctggccaccggagcaagcggcctgcccgcagtgagtaaagcacccagcatggacgctcagcaggaaagacacaagtcccaggattgcttaggtctcgtggctcccctagcttctgcgactgaggttccctccacagcccctatgagcggggagaaacacaggcctcccggcccactgttttccagctccgatcctctgcccgcgacctcatctcatagtcaagattcagctcaagtcacctccctcattcccgctccattccccgccgcgagcatggatgctgggatgaggagaacgaggcctgggacctccgcccccgcagctgctgctgccgcgcccccccccagcacacttaataggacactgggctctctcctcgaatggatggaagcgttgcacatttcagggccccagccccagctgcagcaggtaccacggggtcagaaccagaggagccagaccagccgcacctcctcctgtcctaagagaaacgccatctcaagctcttgtagctcaacaggtgatttgccagggagaaagagaaaaagacgtcagccccacccaaccgccagctag

SEQ ID NO: 32134 - DNA, 1389 bp, Artificial Sequence
  Description of Artificial Sequence: Synthetic coding sequence
atggactctctatggggccctggagcgggatcccacccattcggtgtccacaatacgcgcctatccccagacctttgtcccgggaagatcgtactccgggccttgaaggagagcggtgctggtatgcccgaacaggataaggatccacgggtccaggaaaatccgggcgaccaacggcgggttccagaggtgactggcgacgctccttccgctttccgccctcttcgggataatggaggactgagcccattcgtacccggacctggccctctgcaaactgatctccacgctcagcgatctgagataaggtacaaccaaacttctcagacgagttggactagttcatgtacaaataggaatgcaatctccagctcatactcctctaccggcgggctgcctggcctgaagcggcgtcggggccccgcttccagtcactgccaactgaccctaagttcatcgaagactgtgtctgaggatcgcccccaggccgttagcagcgggcacactcaatgtgaaaaggccgctgatatagcccccggccagacattagccctgagaaacgacagctcaacctctgaagctagcagaccctcgactcataagttcccacttctaccaagacggaggggcgaacctttaatgctgcccccacccctggaattgggctatcgcgtgacagttgaggacctggaccgggaaaaagaagccgcattccagcgcattaatagtgcgttacaagtggaagacaaggctattagcgactgcaggccatccaggcctagccacacacttagtagccttgcaacaggcgcttcaggcctgccccccgtgagcaaggcaccgtccatggatgcccagcaggaaacccataaaagccaggattgcctgggcctgctggccccgttagcaagtgcggccggagtgccgagtacagcccccatgtccgggaaaaaacaccggccgccaggacctcttttttcttcttcagatcctctgcctgctacatcgtcccattctcaggacagcgctcaggtgacaagcctcatcccagcgccttttcccgccgcctctatggacgctgggatgcgacgcaccagatgtggtacttctgccccggccgcagctgccgcagcacccccgcccagtacactgaacccaacgctggggtctctcctggagtggatggaggctctccacatatcaggtcctcagccacagctacagcaggtaccaaggggccaaaaccagaggtcccagacctcaaggacctctagttgccccaaaagaaacgccatatctagcccctacagatctaccggaggactcccagagcgcaagagacgtcgcggtcctgcaagttcacattgccagctgaccttatccagttag

SEQ ID NO: 32135 - DNA, 1389 bp, Artificial Sequence
  Description of Artificial Sequence: Synthetic coding sequence
atggattccctctggggtccaggcgcgggatcccaccctttcggcgtccacaacacgagactgtcccctgatctttgccccgggaagattgtgctgagagctctaaaggaatctggagccggcatgcctgagcaggataaggaccctcgcgtgcaagagaatcctggtgatcaacgacgggtgccggaggtgactggagatgcacctagtgcattccgacccctgcgggataacggtggactaagtcctttcgtaccgggtcccgggcccctccagacggatctccacgctcaacgcagcgaaattcgatacaatcaaacctctcagacgtcttggacgtctagctgtacaaatagaaacgcaatttcatcaagctacagttctaccggggggttgccgggtctcaagagacggcggggacctgctagttcccattgtcagctaacgctgtcatctagcaagaccgtatccgaggatagaccccaggccgtatcatctgggcatactcagtgcgagaaggcagccgatattgcacccgggcagaccctggcactcagaaacgacagttctacatcggaagcttcccgccctagcacacacaagttcccgctccttccacgtaggcgaggggagccactcatgctgccgcctcccctggaactgggctatcgcgtgaccgtcgaagaccttgatagggagaaggaagccgcctttcagcgaattaattcggccctgcaagtggaggacaaagcaatcagcgactgcagaccttctaggccttcgcacaccctaagctccctcgccacaggagccagtggcctgccccctgtctctaaagcacctagtatggatgcccagcaggagactcacaagagtcaggattgcctcggcctgctggctcccctggctagcgctgccggtgtgccaagtacagcaccaatgagtgggaaaaagcaccgccccccagggccactgttttccagttcagatccacttcctgcaacctcatcccactctcaggatagtgctcaggtcacctcacttatccccgcacccttccctgcagccagcatggatgcagggatgcgtaggaccaggtgcggaacctccgctcctgctgcagctgccgccgccccaccaccaagcaccttaaaccctacgttgggtagtctcttagagtggatggaggctttacacatttctggcccccaaccccagctgcagcaagtgccaagggggcagaaccaaaggtctcagaccagcagaacatcttcttgtccaaagcgcaatgctatatcttctccatacaggagcactgggggcttgccagagaggaagaggcgcagagggcccgctagttcgcactgccagcttacgctgagttcttag

SEQ ID NO: 32136 - DNA, 3000 bp, Artificial Sequence
  Description of Artificial Sequence: Synthetic coding sequence
atggtatgcagccccgttaccgtgagaatcgccccacccgaccgccgatttagcagatctgctatcccagaacagataattagttccacactaagtagcccaagttctaatgcgcctgatccctgcgcaaaagaaacagtgctgagcgccctcaaggaaaaagaaaagaaaaggacagtcgaggaagaggaccaaatcttcctcgatgggcaggagaacaaacgaaggagacatgactcctccggatctggtcatagcgcttttgaacccctcgtggccaacggggttcctgcctctttcgtgcctaagcccggctctttgaagcgcggcctcaactcccagagcagcgacgaccacctgaacaagcggagccggagttcctcaatgtcttccctgacaggagcctacgccagcggcatccccagttcctctcgcaacgctattaccagcagttactctagcacgaggggcatttcacagttatggaagagaaatgggccatcctcttctcctttctcctcgcctgcctcttcaagaagtcaaacaccggaacggccagcaaaaaaaattcgagaagaagagctttgccatcacagctcgtcgtctactcctctggcggccgacagggaatcacagggagagaaagccgcagacaccactccacgcaagaaacagaacagtaatagccagagcaccccgggctcaagcgggcagaggaaaaggaaggtgcagctgctgcccagccggagaggcgaacagctgaccctgccacccccacctcagctgggttatagcattactgcagaagatctcgatcttgaaaaaaaggctagcctgcaatggttcaaccaggcgctggaggataagtccgacgccgcctcgaatagcgtgacagagacgccaccaatcacccagccaagttttacatttaccctccctgcagccgcaccggcctctccgcccaccagtttgctcgctccatccacaaaccctttactggagagcttaaagaagatgcagacgccccctagcctgcccccatgcccggaaagcgcaggcgccgccacaaccgaagctctttctccaccgaaaaccccttcactcctgccccccctgggtctatcacagtccgggcctcctggcctgctcccttctcccagtttcgattctaagccacccacgaccctcttaggcctcatacctgcccctagcatggtgcctgccaccgataccaaggccccacctactctgcaggcagaaaccgcaaccaaacctcaggcaacaagtgctcctagcccagcaccaaagcaaagctttctgttcgggacgcagaacacctcccccagttctcctgctgcccctgctgccagtagcgcccccccaatgttcaagcccatatttacagccccacctaagtccgaaaaggagggccccactccacccggacccagcgtgactgctaccgccccttctagttctagccttccaacaacaacatctaccaccgctccaacgttccaaccggtgtttagctcaatgggacctcctgcctcagtaccactgcccgcaccattcttcaagcaaaccaccactcctgctacggcccctacaaccactgccccgctgttcaccggtttggcctccgccacctctgccgtggcgccgattacctctgcctctcctagcacagattctgccagcaaacctgcctttgggtttggcataaattccgtgtccagttcatcagtttctaccacgacttcaactgccaccgctgcctctcagccctttctgttcggggcgccccaggctagcgcagccagctttacacccgctatgggttcaattttccagttcggtaagccccctgctttgcccaccaccacaacagtgacaacgttcagtcagagcctgcataccgccgtgcccacagccacctctagctcagcggccgacttctctggctttggatccactctagctaccagcgctcccgctactagctcccaacccacacttacattctcgaatacatccaccccaacctttaacattcctttcggatcgagtgcaaagtcaccacttccctcatacccgggggctaaccctcagcccgcctttggggcagcagagggccaacctccaggcgccgccaagcccgccctggccccatctttcggcagttccttcaccttcggaaactcggcggccccagccgcagcccccacacctgcgcccccaagcatgattaaggtcgtccccgcatacgtgcctactcctatccatcctatttttggtggcgccacccactcagcatttgggctgaaagcaaccgcctctgccttcggggcccccgcttcttcccagcccgcgttcggtggatctaccgcggtcttcttcggggccgccacctcttccgggtttggagctactacccagacagcgagctccggctcatccagttcggtatttggaagtaccacccccagccccttcaccttcggcggcagcgcggctccagcgggaagcggctccttcggcatcaatgtggctacgccgggaagctcaacaacaaccggtgccttttccttcggagccggacagagcggttcaacagctacctcaaccccctttgcaggagggctcgggcagaatgcacttgggacgactgggcagtctacaccattcgcgtttaatgtgtcaagcaccactgagtcgaaacctgtctttggcggaactgctacaccaacatttggactgaatactcctgcccctggagtcggaactagcggttcaagtctgtctttcggggccagctccgcacccgcccagggctttgttggagtagcccctttcggcaacacatttgctcaccagcaggagcactctccaaggaagggtccaaataacctgtctaaacgtaagttgctgcccgcagtgcgcgctcaaggcctccctcgaagagggcaggcctcctcatttccaacccgcaaagaatag

SEQ ID NO: 32137 - DNA, 1386 bp, Artificial Sequence
  Description of Artificial Sequence: Synthetic coding sequence
atggctacattttcgcgacaggagtttttccagcagttactgcagggatgcctgctgcccaccgcgcagcaggggctggatcagatctggctgttactagctatttgtcttgcctgtcgcttgttatggaggctgggcctgccttcctacctgaagcatgcttcaactgtagccggcggcttcttctcattatatcacttcttccagctgcacatggtgtgggttgtgctgctgagtctgctgtgctacttggttctattcttatgtagacatagctcccaccggggcgtattcctgtcagtgaccattttgatttacctcctgatgggggagatgcacatggttgacaccgtgacttggcataagatgcgaggggcccagatgatcgtcgctatgaaggccgtgtcactgggcttcgacctcgacaggggcgaagtcggcacagtgccgtcccctgtcgagttcatgggctacctctattttgtcggaactatagtcttcggtccatggatctcttttcactcatacctccaggcagtgcagggaaggcctctgtcatgtcgctggcttcagaaggtcgctcggtctctggcgttggctctgctatgcctggtcctcagcacttgtgtcggtccttacctgtttccatactttatccccctaaacggggaccggctcctcagaaacaagaagaggaaagcgcgcggaacgatggttcggtggctgcgggcatacgagagcgccgtgagctttcatttttctaattatttcgttggtttcctctcagaggctactgcaaccctggcaggtgcgggttttactgaggagaaggaccacttggaatgggatttgaccgtgtctaagccactcaacgtggagctcccccggagcatggtcgaggtagtgacctcatggaatttaccaatgtcatattggctcaacaattatgtcttcaagaatgccctcagactgggtaccttctcggccgtcctggtaacctacgccgcgtctgctctgctgcatggcttctcatttcaccttgccgcggtgctgctgagccttgccttcattacctatgttgaacacgttctgcggaaaagactcgccaggattctaagtgcatgcgtgttgtctaagagatgtccgccagattgctcacatcaacaccggctgggactcggagtgcgggcccttaacctgctctttggagcgctcgctatttttcacttagcctacctgggctctctctttgatgtcgacgtagatgataccaccgaagaacaggggtacggcatggcatatacagtccataagtggtccgaactttcatgggcttcacattgggtcacatttggttgttggattttttaccgactcatcgggtag

SEQ ID NO: 32138 - DNA, 1368 bp, Artificial Sequence
  Description of Artificial Sequence: Synthetic coding sequence
atggctacgttttctagacaggagttttttcaacagctgctccagggttgcttgcttcctacggcacaacagggcctggaccaaatctggctgctgcttgccatttgtctggcgtgccgcctgttgtggcgcctcggactcccgtcatacctgaaacacgcgagcacagtagcaggcggattcttctcgctgtatcactttttccaactgcacatggtgtgggtcgtgttgctgtctttgttatgttaccttgtcttgttcctttgccgccattcttcacacagaggggtgtttttgtctgtgaccattctgatctaccttttgatgggtgaaatgcacatggtggatactgtgacctggcacaaaatgaggggcgcccagatgatagtcgcaatgaaggccgtgtctttaggttttgacttggaccggggagaagtcggaaccgtgccatctccagtggaatttatgggatatttgtattttgtaggcacaatcgtcttcggcccatggatctcctttcatagctacctacaggctgtgcaggggcggccacttagttgccgttggcttcagaaggtggcgagaagcttggctttggcacttctttgtcttgtgctctcaacatgtgttggcccatatttatttccctattttattcccttgaatggagatcgcctgttacgaaaaggcaccatggtgaggtggctgcgcgcatacgagagcgcagtgtccttccacttctccaactacttcgttggctttttgtctgaagccaccgctacgctggcaggcgccggattcacagaagaaaaggatcatctggaatgggacctgacagtttctaagcctctcaatgtggaactgcctaggtcaatggttgaggttgttacgtcatggaatttgcctatgtcttactggctgaataactatgtttttaagaacgcactgagactcggcacattttctgctgtgcttgtgacttatgccgcatcagctttactacacggattctcatttcatttagctgcggttctgctgtccctagctttcatcacttatgttgagcatgtgctgcgcaagagattggccaggatactgagtgcctgcgtcctgagtaagaggtgcccacctgactgctcccatcagcaccgattgggcctgggagtgcgagcactaaaccttctatttggcgccctggccatctttcacttggcgtacctcggctccctttttgatgttgacgtggacgacaccactgaagaacagggatatgggatggcatataccgtgcacaagtggagtgaactttcttgggccagccattgggttaccttcgggtgctggattttttaccgcttaatcggatag

SEQ ID NO: 32139 - DNA, 1146 bp, Artificial Sequence
  Description of Artificial Sequence: Synthetic coding sequence
atgagccgccatgaaggggtaagctgcgatgcatgtctgaagggaaatttcagggggcgaagatataagtgcctgatctgttacgactatgacctatgtgcgagttgctatgagtcaggtgcaaccacgactagacacaccactgaccatcccatgcaatgcatcctgacgagagtggattttgacctctattacggaggggaagccttctccgtggaacagccccagtcctttacatgtccatattgtggcaaaatgggctacactgagacttctttgcaggagcatgttacctccgagcatgctgagactagtactgaagtgatctgtccaatctgcgccgccctgccagggggtgaccccaatcacgtgacagacgattttgccgctcacctcactctggagcacagggctcccagagacttagatgaaagttctggcgttaggcatgtccgacgcatgttccaccctgggagaggtctcggaggaccgagggcccgacgatcaaacatgcacttcacctcatctagtacaggaggcctgtcatcttctcagagttcttactccccatccaatcgcgaagctatggatcctatcgccgagctcctgtcccaactgtctggcgtccgccgatccgctgggggccagttaaactcctcagggccttcagcaagccagctccagcagctgcagatgcagctgcaactagagcggcaacacgctcaagcagcccgacagcagctggagaccgcccgaaatgccactcgcagaaccaatacctcttccgtgacgacaactattactcagtctacagctacaacaaatattgccaatacggagagctcacagcagaccctccagaattcacaattcctgcttaccaggctgaatgatcctaagatgagtgaaaccgagcggcagtccatggagagcgagcgagcggataggtccttgttcgtccaggagctccttctctctacacttgtgcgcgaggagagcagtagttccgacgaagacgaccgaggggagatggcggatttcggagcgatgggttgcgtcgatatcatgcccctggacgtggctctggagaacttgaacctgaaagagtcgaacaagggcaatgaaccccctccacctccactgtag

SEQ ID NO: 32140 - DNA, 705 bp, Artificial Sequence
  Description of Artificial Sequence: Synthetic coding sequence
atgccgcaccgcaaggagcgcccgagcgggtctagtctgcacactcatgggtccacaggaaccgcagagggtggcaacatgtcgcgcctgtccttgacacgcagtcctgtgagccctttggccgcccagggtataccacttcccgctcagctcactaaaagtaacgccccagtccatatagatgtgggagggcacatgtatacctcatccctggcaactctaaccaagtatcccgatagtcgcatttctaggctcttcaatgggactgaacccatagtcctggatagtttaaagcagcactactttatagatagagacggtgaaattttccggtacgtgctctcctttttacggactagcaaactactgctgcctgacgacttcaaagatttttcactgctttatgaggaggcaaggtattatcagctgcagcctatggtccgtgagctggaacggtggcaacaggagcaggagcagcgtcgtcgttcaagagcatgcgattgcctagtagtgcgggtcactcctgatctgggagaacgcattgcactctcaggagagaaggcgctcattgaagaagtgttccctgaaactggagacgtcatgtgcaactctgtgaatgcaggatggaatcaggatccaacccacgtgatccgttttccccttaacgggtactgtcggctgaattccgtgcaagatgttctgtag

SEQ ID NO: 32141 - DNA, 915 bp, Artificial Sequence
  Description of Artificial Sequence: Synthetic coding sequence
atgacactccgaacctccgtctgctgtaccagacgaagggcaacaataagttcatctccatggtgcgccagttggtcagcaggctcccggagtcgctccagcggagccgccgcagggccggtgacagcctggtggtgcgcaagccgacccacttgggccagcggctcccacagtgccgcccgacgtcccagttcaaggagatcctctcctagaccagagacaagctgcgccactccgagcactccggcaggaactaggacaccacgtacttccagcgcttcgaggtcaatggccaccgctggatccacccgctaccgttcatggtctggttgttcgagaggcgtttcagcctggttacggccagtgggcgctgtatggacacccccaagttccgcctctatgtgttttgccggaagatcaggagggcggtctccccctcccctgctgttcgagtcttcccgcaatccttggacgcggccttgcttttcagcacatctcgggcctccccgtgatctcgagaccgttttaggctcttcagcctgcgtataccttgccgtgggcatgcggccacgtgtgagacttgaggggcctaaactggcacagagagctcctggcagccaggtgagctggcagcaaaacgtgggctgctggcgacatgcatgtcggagaaccgtggacgccacacagagatactccgggggcatttctgccgcttctagtccatccccctctgcgtctcagcctggagccgcgtccagcgaggcaccaggaccagtcggagccggattagaggaacccagtgccgccacttcagaggagctatttatccctttgcatgccggtcagaccttagcgggacttctggcctccgaacgctggctgatctttcagtaccttaagtggatgcaaccatag

SEQ ID NO: 32142 - DNA, 498 bp, Artificial Sequence
  Description of Artificial Sequence: Synthetic coding sequence
atgtcagaccctatcactctcaatgtggggggaaagctttatactacctcactggctactctgacttctttccctgactctatgctgggagccatgttttctggtaagatgcccactaaaagggattctcaggggaactgtttcatcgacagggatggaaaggtttttagatatatcttgaatttcctgaggacttcacacctggacctccccgaggattttcaggagatgggtttgctgcgcagggaggccgacttttaccaggttcaacctttaattgaagcactgcaggagaaggaagtggaactgagtaaagccgagaaaaatgccatgctaaatatcacactcaatcagcgcgtacagaccgtgcactttacggtgagagaggctccacagatttatagtctgagcagctcttccatggaggtgtttaacgcgaatatcttttctacttcctgcctgttcctgaagttgctggggtcaaagttattttactag

SEQ ID NO: 32143 - DNA, 114 bp, Artificial Sequence
  Description of Artificial Sequence: Synthetic coding sequence
atgagtgatccgattaccttgaatgtaggcggtaagctgtacacgacaagcctcgcaactctcacttcattcccagattctatgttgggagctatgttcagtggcaaaatgtag

SEQ ID NO: 32144 - DNA, 351 bp, Artificial Sequence
  Description of Artificial Sequence: Synthetic coding sequence
atgtcagatccaattaccttgaatgttgggggcaagctgtacacaactagccttgcaaccctgacgagctttcctgactcaatgctaggggcgatgttttctgggaagatgccaaccaaacgagattcacagggcaactgcttcattgacagggacgggaaagttttcagatacatcttgaacttccttcgaacctcccatctggacttgcccgaggacttccaggagatgggactcttgagaagagaggctgacttttatcaggtgcagcccctgatcgaggcactgcaggagaaggaggtagaattgagtaaggccgagaaaaatgcgatgctgaacattaccctatag

SEQ ID NO: 32145 - DNA, 216 bp, Artificial Sequence
  Description of Artificial Sequence: Synthetic coding sequence
atgtccgacccgatcacgctgaacgttggtgggaaattgtatacaaccagcttagccactctcacgtcctttcctgattcaatgttaggagcaatgttcagtggaaaaatgcccacaaagcgcgactcacaggggaattgctttattgatcgggatggcaaggtgtttcgctacatcctgaacttcctccgcacctcccatttggacttaccatag

SEQ ID NO: 32146 - DNA, 3450 bp, Artificial Sequence
  Description of Artificial Sequence: Synthetic coding sequence
atgttccaaaccaaactacggaacgagacatgggaagatctgccaaaaatgagttgtaccacagaaattcaagccgcttttatactgtcgagttttgtaacttttttcagcggactcattattctgctgatctttaggctgatatggcgcagtgtgaagaaatggcagattatcaagggaaccggcatcatcctcgaactgtttaccagcggcaccatcgcacgttcccatgttagaagtcttcattttcagggccaatttcgagatcatattgagatgttgctttcagcacagacgttcgtcgggcaggtcttggtcatcctggtgttcgtgctcagtatcggaagtctcatcatctacttcatcaactccgccgatcctgtaggtagctgttcaagttacgaggataagaccatacccattgaccttgtgttcaatgcgtttttttcgttctacttcggccttcggttcatggccgctgacgacaaaattaagttctggcttgagatgaattccatcgtggatattttcaccatccctccaactttcattagttactacctaaaatctaactggctcggattgcggttcttaagagccctgcggttactggagttgccgcaaattctgcagatcctgcgggcgatcaaaacgtcaaatagcgtgaaattctcaaaactgctgtccatcatcctctcaacatggttcaccgcagcgggttttattcaccttgtggaaaattcaggggacccatggctgaaagggcgaaattctcagaatatcagttacttcgagtctatctatcttgttatggccaccacaagcaccgtagggtttggcgatgtggtcgccaagacctccctcggaagaacattcatcatgttcttcactttaggatccctaattctgtttgccaattatatacccgagatggtggagctgttcgccaataaaaggaaatacacctccagctatgaggcccttaaaggaaagaaattcatcgttgtgtgcggcaacatcacagtggattccgtcaccgctttcctgaggaacttccttcgtgacaagagcggggagataaacacagagatcgtttttttgggagagacgccgccttccttggaactggaaactatattcaagtgttatttggcatacacgacctttatatccgggtcagcaatgaagtgggaggatctgcgccgggttgccgtcgagtccgcagaggcttgcctgatcatagcaaatccattgtgctccgattctcatgccgaggatatctctaacattatgagggtcctgtctattaagaactatgactccactactcgaatcataattcagatcctgcagtcacataataaggtttatctcccaaaaatcccttcttggaattgggacactggtgacaatattatttgcttcgccgaactgaagttggggtttatcgcccagggctgtcttgtgcctggcctgtgtacctttctgacttcattgttcgtggaacagaacaagaaggtgatgcctaaacagacctggaaaaaacacttcttgaattctatgaaaaataaaattcttacacaacgcctgtcagacgacttcgccgggatgagctttcccgaagtggccagactttgctttctcaagatgcatctgctgctcatagccatcgagtacaaatcactgtttaccgatggtttttgtggcttaatcctcaacccgccaccacaggtgagaattagaaaaaacacactcggcttttttatcgccgagacacctaaagacgtgagaagggctctgttttattgttcagtgtgccacgacgacgtcttcattcctgaactgatcacaaactgtggctgtaaatctcgatcccgccaacacataactgtgccctcggtgaagcgaatgaagaaatgcctgaaaggtataagcagtagaatctctggtcaggactcccctccccgagtgtcagccagcactagcagtatctccaatttcactactagaaccctgcaacacgatgtcgaacaggactcagatcaactggacagcagcggaatgtttcactggtgtaagcccacttctctcgacaaagtgactctgaagagaaccggaaagtcaaaatacaagttcaggaatcatatcgttgcatgtgtgtttggggacgcccatagcgctcctatgggacttcgcaattttgtcatgcctctgcgagcttcgaattacacgcgtaaggaactcaaggatatagtttttattggctcacttgattaccttcagagagagtggcgatttctttggaactttccgcagatctatatacttcctgggtgtgctctatacagcggagatcttcacgccgcgaacatcgagcaatgtagcatgtgcgcagtgctctccccaccacctcaaccatccagcaatcagaccctggttgatactgaagccattatggctaccctgacaataggaagcctgcagattgactcctcgagcgatccatccccgtcagtcagtgaggaaacacccggctacaccaacggccacaatgagaaatccaattgtaggaaagtacccatactaactgagttgaaaaacccaagtaatatccatttcattgaacagttgggagggctggagggttccctgcaggagaccaatctgcatttgagtacagcattttcaactggaacagtatttagtggctcgttcctggactccctgctggccaccgccttctacaactatcacgtcctggaactccttcagatgctggtgacagggggcgtctcaagccagctggagcagcatctggacaaggacaaggtgtacggcgttgctgactcctgcacatctctcctcagtggcaggaacaggtgtaagcttggactcctcagcctccacgaaacaatcttatctgacgtcaacccccggaacactttcggacagctgttctgcgggtcattggacctgttcggcatcttatgtgtcggcctctacaggattatagatgaggaagagctgaacccagaaaacaagaggttcgttatcaccagaccagccaacgaatttaaactgctaccatccgatctggtgttctgtgcaattccttttagtacagcatgttataagaggaacgaggagttctcactgcagaaaagttatgagatcgtgaataaggctagtcagaccaccgagacccactcagatacgaattgccctcccacaatagattcggtgaccgagacactgtacagtccagtgtatagttaccagcctagaactaactctttgtctttcccaaagcagatagcgtggaaccaatcgcgaaccaactccatcatctcttctcaaatcccactgggggacaatgcaaaagaaaatgagcgtaaaacaagcgacgaggtatatgacgaggaccctttcgcatatagcgaacctctttag

SEQ ID NO: 32147 - DNA, 1302 bp, Artificial Sequence
  Description of Artificial Sequence: Synthetic coding sequence
atgacagcagctagccgagccaacccatactctatcgtgagcctggaagaagacggattgcacctggtgaccatgagcggtgcaaacggttttggcaatggtaaagtccacaccagaaggaggtgtagaaatcgcttcgtgaagaagaacggacagtgtaatatcgccttcgcaaatatggatgaaaaatcccagagataccttgcggacatgtttacaacttgtgtggacatacggtggcggtacatgttattgatttttagcctagctttcctggccagttggcttctctttggcgtgatcttctgggtgatcgccgtggcccacggcgatctggagcccgccgaaggtcacggccgaaccccctgtgtcatgcaggttcatggttttatggccgcctttctgttctccattgagactcaaacaacaatcggatatggactccgctgcgtcacagaggagtgcctcgtagccgtgttcatggttgttgcacagtccatcgttggctgtattatcgattctttcatgattggggctatcatggcgaagatggcgaggccaaagaaacgagctcagaccctccttttcagtcacaacgccgtggtagccttacgggacggtaagctctgccttatgtggcgcgtgggcaacctgagaaaatcccatatcgtggaggcgcacgtgcgcgcgcaattgataaagcctcgggtgactgaggagggggaatatattccgttggatcagatcgatatcgacgtggggtttgacaaagggcttgatcgtatctttctggtttctccgatcacaattctgcacgagattgacgaggcctcccctctgttcggcatctcacgccaggacctcgagacagacgacttcgaaattgtggtcattctcgaaggaatggtggaagctaccgccatgaccactcaggccaggtcctcatacctggcaaatgagattctctggggacatagatttgaacccgtgctgtttgaagaaaaaaaccagtacaaaattgactattcacattttcacaagacctatgaggttccatctaccccgaggtgctcagccaaggacttagttgagaacaaattcttgctgccatcagccaacagcttttgctacgaaaacgagctggcctttctgagtagggacgaagaggatgaagccgacggggatcaggatggcaggagccgtgacgggttgagccctcaggccagacacgattttgaccgcttacaggccggcgggggcgtgctggagcagcgcccatatcggcgcggatccgaaatttag

SEQ ID NO: 32148 - DNA, 1875 bp, Artificial Sequence
  Description of Artificial Sequence: Synthetic coding sequence
atgcagaagtcatccacctgttcatttatgtatggtgagctgaccgataagaaaactattgaaaaagtgcgtcaaacctttgacaactatgaatctaactgctttgaggttctcctgtataaaaagaatcgaactcccgtgtggttctatatgcagatcgcccctattcgaaatgagcatgagaaggtcgtgctcttcctttgtacatttaaagacatcactctgttcaagcagcctatcgaggatgactctacgaaaggctggacaaagttcgcccggctcactagagcccttacaaacagcaggagtgtcctgcagcaactcactccaatgaataagactgaggttgtgcacaaacactcgcgtctcgcggaggttctgcaactgggctctgacattctgcctcagtacaaacaagaggctcccaaaaccccccctcacatcatcctgcactactgcgcatttaagaccacctgggactgggtcattctcatactgactttctacaccgcaatcatggtcccatataacgtcagcttcaaaaccaagcagaataacattgcttggttagtcttggattctgttgtcgatgtaatcttccttgtggacattgtcttaaatttccataccactttcgttgggccgggaggtgaagtcatctccgatcctaaactcatcagaatgaactacctgaaaacttggtttgtgatagatctgctgtcttgcctcccatatgatattatcaacgcgttcgagaatgtcgacgaagggattagtagtctgttcagcagtctgaaggtggtccgtctgctgaggctggggcgagttgcaaggaaactggaccattatttggagtatggtgcggcagtgctggtgctgcttgtgtgtgtctttgggctggtggcacactggctggcgtgcatttggtactcaatcggagattatgaagtcatcgacgaagtcacaaatacaatccagatcgattcttggctataccagttggctttgtctattggaacaccatataggtacaacacaagtgctggcatatgggaggggggaccctcgaaagacagtctttacgtctcctccctgtatttcactatgacttccctgacaacaatagggttcggtaacatagcccccactactgacgtagaaaagatgttctccgtggcaatgatgatggtcggcagtctcttatacgccaccatcttcggtaacgtcacaacaattttccaacagatgtacgccaacactaacagatatcatgagatgcttaacaacgtgagggacttcctcaagttgtaccaagtgccgaaaggtctgtccgaacgcgtgatggactacatcgtgagcacctggtctatgagcaagggtattgacacagaaaaggtcctgtcaatatgtccaaaagacatgagagcagacatttgcgtgcacctgaatcgtaaggtattcaacgagcatccggccttccgactggctagcgacggttgtctccgcgctctagccgttgaattccagaccatacactgcgccccgggcgacctcatttatcacgcaggggaaagcgtagatgcactttgcttcgtggtctccgggtccctggaggttatccaggacgatgaagtggttgccatcctgggtaagggagatgtattcggagacattttttggaaagagacaaccctggcccatgcatgtgctaatgtgcgtgccttaacatactgtgacctgcacatcatcaaaagggaggccctgttgaaagtgcttgatttttacaccgctttcgctaacagctttagccgcaaccttaccctgacgtgtaatctaagaaagagggggtggttttcaatggctaatgccctgtag

SEQ ID NO: 32149 - DNA, 1836 bp, Artificial Sequence
  Description of Artificial Sequence: Synthetic coding sequence
atgcccggggggaaaaggggactggtggcccctcaaaatacattcctggagaacattgttcgtagaagctcggaaagtagctttcttcttggaaacgcgcagatagtcgattggcctgtggtgtacagcaacgacggattttgcaagctgtcaggataccatagagccgacgtgatgcagaagtcttctacctgctctttcatgtacggcgaattgaccgacaagaagacgatcgagaaggtgcgccagacattcgacaactatgagagtaactgcttcgaggtattactttacaagaaaaaccgtacaccagtatggttctatatgcagatcgcccccattcgcaatgaacatgagaaagtggtcctgtttctgtgcaccttcaaggatattacactgtttaaacagccaattgaagacgattctacaaaaggctggaccaaattcgctaggcttaccagggccctgaccaacagtaggtcagtgctgcaacagctgacacctatgaacaagaccgaggttgtccacaagcacagtagactcgcagaggtcctgcagctgggctctgatattctgcctcagtataagcaggaggccccgaagactcctccccatattattttgcactactgcgctttcaagacgacctgggattgggtgattctgattcttaccttctacacagcgatcatggttccatacaatgtgtcattcaagaccaaacagaacaatatcgcttggctcgtgctggattccgtagtcgacgtaatctttctcgtggacatcgtgctcaatttccatacaacttttgtgggcccaggtggagaagtcatctcggaccccaagctgatcagaatgaactacctcaagacttggttcgtcattgatcttctttcctgtttaccttacgatataattaatgcttttgagaatgtcgatgagggtatctcatcgctgttctcttctctgaaggtggttcgtttgctcagactcggcagggttgccaggaaattggatcattatcttgagtacggcgcggccgtattagtgctcctcgtgtgtgtgttcggactggtggcccattggctggcatgtatttggtacagtatcggtgattacgaagtgatcgatgaggtcactaacaccatccagatcgatagctggctgtaccagctagcactctcaatcggcactccgtatcgttataatacatcagccggaatctgggagggaggcccatccaaggattcgctgtatgtgagctctctatacttcaccatgacatcactgactaccatcggcttcggcaacatagcacccaccaccgacgtggaaaaaatgtttagtgtcgctatgatgatggtaggctcactgctctacgcaacaatttttggtaatgtcacaaccatttttcaacagatgtacgccaacaccaaccgataccacgagatgttgaacaatgttcgtgactttctcaaactataccaggtgcccaaagggcttagcgaacgtgtgatggactatatcgtaagcacgtggagtatgtcaaaaggaatcgatacagaaaaagtgttgagcatctgccctaaagacatgagagcggacatctgcgtacacttgaatcggaaagtgtttaatgagcacccagccttccggcttgcctctgatgggtgtctccgggccctggccgttgagtttcagacgattcactgtgctccaggagatctgatataccatgcaggagagtcagttgacgctctatgtttcgtggttagcggcagcttagaagtaatacaagacgatgaggtggtcgctattttagaccacctctcctag

SEQ ID NO: 32150 - DNA, 1755 bp, Artificial Sequence
  Description of Artificial Sequence: Synthetic coding sequence
atggtggccgaggtctgctccatgccaacagcttccactgtcaaaaaacctttcgacctccggtccaagatgggaaaatggtgtcaccataggtttccatgctgtagaggatcaggcaagtccaatatggggacctcaggagaccatgacgacagcttcatgaaaatgttaagatccaaaatgggaaaatgttgccgccattgcttcccctgttgtaggggtagcgggaccagtaacgtgggtacctccggtgatcatgagaattcctttatgaagatgctgagatcaaagatgggtaagtggtgttgtcactgctttccttgctgccgaggtagtagtaaaagtaatgttggtgcttggggcgattacgatcacagcgcgtttatggagcctcggtatcacgtcaggagagaggatctggacaaactccaccgggccgcatggtgggggaaagtacctcggaaagacttaatcgtcatgctgagagatactgacatgaacaaacgcgataaggaaaaaagaacagctctccacctggcatctgctaacggtaacagcgaggtggtccagctcctgctagataggaggtgccagctgaatgttctggacaacaaaaaacggaccgccctcatcaaggccatccagtgccaggaggatgagtgcgtcctcatgttacttgaacatggtgcagaccgcaatatccccgacgagtacggcaacactgcactgcactatgccatctacaacgaagataagctgatggcgaaggctttgctgctgtatggcgccgatatcgagagtaaaaataaatgcggcctgacaccattgcttctgggtgtgcacgaacagaaacagcaggttgtgaaatttttgatcaagaaaaaggccaacctgaacgtgctcgatcgctatggccggactgccctgattctggccgtgtgttgtggatctgctagtatcgtgaacctcttattggaacagaacgtggatgtcagcagtcaagatttgtcaggacaaactgcgagggaatatgcggtgtcctcacaccaccatgtcatctgcgagctgctttcagattacaaggaaaagcagatgctgaagatttcaagtgaaaactccaatcccgagcaggatctgaagctgacttccgaagaagagtcccaacggcttaaggtcagtgaaaattcccagcctgagaaaatgagtcaggaacctgagatcaataaggactgtgacagagaggttgaagaggagattaagaaacatggttcaaatcccgtcggtctgcctgaaaacctgaccaatggcgcctccgcgggtaacggtgacgatggattgatcccccagagaaggtccagaaagcccgagaatcaacagtttccagacaccgaaaatgaagagtaccatagcgatgagcagaatgatacaaggaagcaactcagcgaagagcagaatactggaatttctcaagatgagattttaacaaataaacaaaaacagattgaggtggcagagcagaaaatgaactcagaactctccctgagccataagaaggaggaggacctgctccgggagaacagcgtgcttcaggaggaaatagcagtcctcaggttggaactggacgagacaaagcaccagaaccaactcagggagaacaagatactggaggaaatcgagtccgtcaaggagaaaacagataaactcctgagggccatgcaactgaacgaagaggcactcactaagaccaacatctag

SEQ ID NO: 32151 - DNA, 3228 bp, Artificial Sequence
  Description of Artificial Sequence: Synthetic coding sequence
atggtggtggaagtagattctatgcctgctgcttcctccgtcaagaaaccgttcggactcagatcaaaaatggggaagtggtgctgcagatgcttcccctgctaccgagagagtggcaagagcaacgtgggcacatccggagatcatgacgacagtgccatgaaaacactcaggagtaaaatgggaaagtggtgccatcattgcttcccttgttgtcgtggatctggaaagtcaaacgtcggcgcgagcggcgaccatgatgactcagccatgaaaactctgcgcaataagatgggcaagtggtgttgccattgtttcccttgctgtaggggctcaggaaaatccaaagtcggggcttggggcgactacgacgacagcgcattcatggagccgcgttatcacgtccgcggagaagaccttgataagctgcaccgagcagcctggtggggaaaagtccccagaaaggatttgatcgtaatgctgcgtgacacggatgtgaataaaaaggacaaacagaagcgaacggcactgcatctggctagcgccaatggaaactcagaggtagtgaaattacttctggacagaagatgccagctgaacgttctcgataataaaaaacgcacagcgctgataaaggccgtgcagtgccaggaagacgagtgcgcactgatgctcctcgagcacggtactgaccctaacatcccagatgaatacggcaacacaactctgcactacgcaatttataacgaagataaattaatggccaaggctttacttctctatggagctgatattgaaagtaaaaataagcacgggcttacccccctccttctgggagtacacgagcagaaacagcaggtcgttaaatttttaatcaaaaaaaaggccaacctcaacgccctggataggtacggcagaacagccctgattctcgctgtttgctgcggtagtgcctcgattgtaagcctgctcttggaacaaaatattgacgtgagtagccaggatttgagtggccagacagccagggagtacgccgtctcctcacatcatcacgttatatgccaactcctctccgactataaagagaagcaaatgctgaaaataagtagcgaaaactcgaaccctgaacaggagttgaagctcacatccgaagaggagtcgcagcggtttaagggcagtgagaactcccagcccgaaaaaatgagccaggagcttgaaatcaacaaagatggggaccgggaagttgaagaagaaatgaagaagcatgagtcgaataacgttggccttctggaaaaccttaccaacggcgtaacggctggcaacggggacaatggacttattcctcagcgtaagagtcggactcccgagaaccaacaatttcctgataatgagagcgaggaataccacaggatttgcgaactgttgtcagattataaggaaaaacagatgccaaaatacagctctgagaactctaatcctgaacaggatctcaagctgacgtccgaggaggagagtcaaagactcaagggaagcgagaacggccagcccgaaaagcggtcacaggagcccgagataaataaagacggggacagggagctggaaaatttcatggccattgaggagatgaaaaagcatggatccactcacgtggggttccccgagaatttgaccaatggcgctacggcgggtaacggcgatgacggattgatcccacccagaaaaagccgcaccccagaatcccagcagttccccgatacggagaacgaagagtaccactccgacgaacaaaatgacactcagaagcagttctgcgaagagcagaatacaggtatcctacatgacgagatcctcatccacgaggagaaacagatcgaggtggtggaaaagatgaattctgaactcagtttaagttgtaaaaaagaaaaggacgtgctccacgaaaacagcacccttcgggaggaaattgctatgctgcggctggagctggatactatgaagcaccagagccagttaagggaaaagaagtatttggaagacatcgaatccgtgaagaaaaaaaatgataacctgctgaaggctctgcaactcaatgaattaaccatggacgacgatacggcagtcttagtaatcgataatggatccgggatgtgtaaagccggctttgccggagacgatgcccctcgcgccgttttccctagcattgtgggtagacctaggcagcagggcatgatgggaggaatgcaccaaaaggaatcttacgtggggaaggaggcccaaagcaaaagaggtatccttacgcttaaatatcccatggagcacggcatcataactaactgggacgacatggagaaaatttggcaccacacgttctataacgagctgagggtagcccccgaggagcacccgattctactgacagaagctccgcttaatcctaaggccaatcgcgagaagatgacacagattatgttcgagacctttaacacgccagcgatgtacgtcgccattcaggccgttccttcactgtacaccagcgggcgtaccacagggattgtgatggacagcggtgacggcgtcacgcacaccgtgccaatttacgaaggtaacgcgttgcctcacgctacactcagattggatttggccggcagagagctaccggactatctgatgaaaatcctcactgaacgggggtacaggtttacgacaatggcagagcgcgaaattgtccgggacatcaaggagaagttgtgttatgtggcgctggacttcgagcaggaaatggccacagcagccagctcttccagcttggagaagtcttacgagctgcccgacggtcaagtgattactataggtaatgagagatttcggtgccccgaggccttgtttcagccatgcttcttagggatggaatcttgcgggatccacgagaccactttcaatagcatcatgaagtcagacgttgacatacgcaaggacttgtacacaaacaccgtcctcagcggcggtacaactatgtaccccggcatggcgcaccgcatgcaaaaagagatagccgccctggcccctagcatgatgaaaatacgcataattgccccacccaaacgtaagtattcggtatgggttggcggatccatcctagctagtctgagcactttccagcagatgtggattagtaagcaggagtatgacgagtcaggtccatcgattgtgcatcgcaaatgtttttag

SEQ ID NO: 32152 - DNA, 1185 bp, Artificial Sequence
  Description of Artificial Sequence: Synthetic coding sequence
atggtcgtcgaggtcgatagcatgcccgctgccagctccgtaaaaaagccctttggtttgcggagcaaaatggggaaatggtgctgccgatgctttccatgttatcgggaaagcggaaagagcaacgtgggtaccagtggcgaccatgacgattcagcgatgaagaccctgaggtccaagatgggtaagtggtgccatcactgttttccctgttgtcggggcagcgggaagtcaaacgttggggcctccggcgaccacgatgatagcgccatgaagacactgaggaacaagatgggcaagtggtgctgtcattgctttccttgttgtcgtggcagcggaaaaagtaaagtgggcgcctggggtgactacgatgactccgctttcatggagccacggtaccatgtccggggcgaagacctcgacaaactccacagggcggcctggtggggcaaagtaccgcgcaaggatctaatcgtaatgcttcgcgatactgatgtaaataaaaaggataaacagaagaggaccgcactccacctcgcctcagctaatggaaactctgaggtggtgaagctcctcctagatcgacgctgccagctgaacgtcctcgataataaaaagcggacagctctgatcaaagtctgtagttctcagctgtaccagcacgaggccgtgcagtgccaggaagatgagtgcgcactgatgctcttggaacatggaactgatcccaacattcccgatgaatatggtaacacaacactgcattacgctatctacaatgaggataaattgatggctaaagccctcctgctgtacggggccgacattgagtccaaaaacaagcatggcttaacccctttgctgctgggcgtgcacgagcagaagcaacaggtggtgaaattcctcataaagaagaaggccaacctaaatgcactggaccgctacggccggacagcactgatcctggctgtgtgctgcggcagcgctagcattgtgtctctcctccttgagcagaatatagatgttagcagccaagacctgagcggccagacagcgcgcgaatatgcggtcagctctcaccatcacgtcatctgccagcttctgtctgactataaagagaagcagatgctaaagatctcttctgaaaactcgaaccctgaaaacgtgtcgaggacaagaaacaagtag

SEQ ID NO: 32153 - DNA, 1527 bp, Artificial Sequence
  Description of Artificial Sequence: Synthetic coding sequence
atggtggccgaggctggttccatgcctgccgcttcctcagtgaaaaaaccgttcggcctccgctctaaaatgggaaagtggtgtcgacattgctttccgtggtgtcggggcagcggaaagtcaaacgtcggcacttccggagatcacgatgattcggcaatgaaaacactgagaagtaagatgggaaagtggtgccgccattgtttcccctggtgcaggggctccggaaagagtaacgtgggcacaagcggcgaccatgacgactcggctatgaagacgctcagaagcaagatgggtaaatggtgctgtcattgctttccttgctgtaggggcagtggcaagagtaaggtgggcccctggggcgactatgacgactccgcgtttatggaaccacgttaccacgttcgaagggaggaccttgacaagctgcaccgggcagcctggtggggaaaggtgccgcgcaaggacctaattgtgatgctgaaagatacggatatgaataagaaggataaacagaaaagaacagccctgcatctcgctagtgccaacggcaattccgaggtcgttaagttacttctggacaggagatgccagttgaacatcctcgacaacaaaaagaggactgcccttactaaggctgtccaatgtcaggaggatgaatgcgcactaatgctactggaacacggaacggacccaaatatccctgatgagtacggcaacacagcactccattacgccatttataacgaggacaagctgatggcaaaagctctcttgctgtacggagccgacatagaatcgaagaataagcatgggttaacaccattgctgttaggagttcacgaacagaagcagcaagtggtcaaatttctgatcaagaaaaaggctaacctaaatgctctagatcgttatggcaggacagtcctgatcctagccgtgtgttgcggatcggcaagcatcgtttcccttttgctggaacagaacattgacgtgagctcccaggacctcagtgggcagaccgcgcgcgaatacgcggtgtcttccaggcataatgtcatctgtcagcttctgtccgactataaggagaagcagatcctcaaggttagcagcgagaactcgaatccagaacaggacttgaagctgacaagcgaggaggagtcccagcgactgaaagggagtgaaaatagccagcctgaagagatgagccaggagccagagattaataaagggggggaccgcaaggttgaggaggagatgaagaaacacggcagcacccacatgggcttcccggaaaatctccccaacggagctaccgcggacaatggcgacgacgggttgattcctccacggaagagtcgtacacccgagagtcagcaattccccgacaccgaaaacgaacagtatcacagtgacgagcagaacgacacccagaagcagctgtccgaagagcagaataccggcattctgcaggatgagattctgatacacgaagagaagcagatcgaggtagccgagaatgagttctag

SEQ ID NO: 32154 - DNA, 1629 bp, Artificial Sequence
  Description of Artificial Sequence: Synthetic coding sequence
atggtcaccgaggtttgttcaatgcccgccgcttccgcagtgaagaagccatttgacctgcgctcgaagatgggaaagtggttccatcaccggtttccctgttgtaaaggaagtgggaagtcgaatatgggcacatctggcgaccacgatgacagctttatgaagatgctccgcagtaagatggggaaatgctgccatcattgcttcccttgctgtagagggtccggcacctctaatgtcggcacctctggagatcacgataatagtttcatgaaaacgttgagatccaaaatgggcaaatggtgctgccactgcttcccttgttgcaggggctccgggaaatccaatgtgggcgcttggggcgattacgacgattctgcgtttatggagccccgttatcacgtgcgccgcgaggacctggataagctgcaccgcgctgcttggtggggcaaagtccctcgcaaggacctcattgtcatgctcagagacactgacatgaacaagcgtgacaagcagaagcgaaccgccttgcatttagcttctgctaatggaaatagtgaagtcgttcagctcctgttggacagacggtgccagctcaacgtgctggacaataaaaagcggaccgccctgattaaagccgttcagtgccaagaagatgaatgtgtcctgatgctactcgagcatggggccgaccagaatatcccggatgaatatgggaataccacgttgcactacgccgttcacaacgaggacaagttgatggctaaagcgctgctcttgtatggcgctgacatcgagtccaaaaataagtgcgggctgacacctttgcttctcggcgttcacgagcaaaagcagcaggttgttaaatttcttatcaagaagaaagccaatctgaacgccctcgatcgctatgggcgcactgctcttatcctcgctgtctgctgtgggtccgcctccatcgtgaatctcctactagagcagaatgtcgatgtctcttctcaggatttgtctggccagactgcccgggagtacgccgtcagttcgcatcaccacgtcatctgtgaattgctctccgactacaaagaaaagcagatgctgaagatcagtagtgagaatagcaatccagagcaggacctgaaactgacctcagaggaggagtcccaacgtcttaaagttagcgagaactctcagcctgaaaagatgtcccaggaaccagaaatcaataaggactgtgaccgcgaagtggaagaggagatcaaaaagcatggttccaacccagtcggactgccagagaatctgaccaatggggctagtgccgggaatggcgatgacggccttatcccccaaaggcggagcaggaagcccgaaaatcagcaatttcccgacacggaaaacgaagaatatcactcagatgagcagaatgacactagaaaacagctgagcgaagaacagaacacagggatctcacaggatgaaattctgaccaacaagcagaaacagatagaggtggctgagaagaaaatgaacagcgagctttccttgtctcataaaaaggaagaggaccttctcagagaaaatagcatgctacaggaagaaattgccatgcttatatctggtgactggaattag

SEQ ID NO: 32155 - DNA, 1146 bp, Artificial Sequence
  Description of Artificial Sequence: Synthetic coding sequence
atggtaaccgaagtctgcagcatgccagccgcaagcgccgtgaagaaaccattcgatctacggtccaaaatgggcaagtggtttcatcatcgctttccctgctgtaagggatcggggaagagcaacatgggcacctctggggaccatgatgatagctttatgaagatgctcaggtccaagatgggaaagtgctgccaccactgctttccgtgttgtcggggcagcggtacctccaacgttggcacttcaggcgatcacgataatagcttcatgaagacgctgcgctctaagatgggtaaatggtgctgtcattgctttccttgctgccgcgggagtgggaaatctaatgtgggggcgtggggcgactacgatgatagcgctttcatggagccccggtaccacgtgcggcgagaagacctcgacaagctccatcgtgctgcttggtggggaaaggtgccgcgcaaagacttgatcgtgatgcttagggatacggatatgaataaaagagacaaacagaagcgcacggcactgcacctggcttcagcgaacggcaacagcgaagttgtccagttgttgttagaccgtcggtgccagctgaacgtattggacaataagaaacgcacagccttgatcaaagcagtgcagtgtcaggaggatgagtgtgtactaatgcttttagagcacggtgccgaccagaacatccccgatgagtacggcaacaccacactgcattacgctgtgcataatgaagacaagttgatggcaaaagctctcttactgtacggcgccgatattgagtctaaaaacaagtgtggccttacacccctcctgcttggcgtgcatgagcagaagcagcaggttgtcaaattcctgattaaaaaaaaggctaaccttaatgcacttgatcgttatggccgaaccgctctgatcttggccgtgtgttgcggttccgcttcaatcgttaacttgctgctcgagcaaaacgtggacgtgtcatcccaagatctgagtgggcaaaccgccagagaatacgctgtaagctcacatcatcacgtgatctgtgagctgttgtctgactacaaagaaaaacagatgctgaagatctcgagtgagaattcaaacccaggaaaggaagccgaggagtag

SEQ ID NO: 32156 - DNA, 1527 bp, Artificial Sequence
  Description of Artificial Sequence: Synthetic coding sequence
atggtagccgaggcagggtccatgcctgcagcatcctctgtgaaaaagccattcggtttgagatccaaaatgggcaagtggtgccggcactgctttccttggtgcagaggctccgggaagtcaaacgtgggcacgtccggtgatcacgatgacagtgctatgaagacgctgagaagtaaaatgggcaagtggtgtagacactgtttcccttggtgccgcggcagcagcaagagcaatgtgggcacatccggggatcatgatgattctgccatgaagacgctaaggtccaagatggggaaatggtgctgccactgcttcccctgctgccgaggaagcggtaaatccaaggtcggcccgtggggcgactatgacgactccgcctttatggagccccggtaccatgttcggcgtgaggacctcgataagctccatcgcgcagcgtggtggggcaaggtcccacgaaaggacttgatcgtgatgttgaaagacactgacatgaataagaaagacaagcagaagaggacagctctacacctcgctagcgcgaacggcaatagtgaagttgttaaactgcttctggatcgccggtgtcagctgaacatcctggacaacaagaagagaacggccctgactaaggcagtgcagtgccgcgaagacgagtgtgctttgatgcttttagagcacggaaccgaccctaacatccccgatgagtacggaaacactgcactgcattatgctatatacaacgaggacaagctgatggcgaaagccctcctgctttacggtgccgatattgaaagtaagaacaagcatgggctcacccctctgctactgggggtgcatgagcagaagcagcaggtggtgaagttcctgatcaaaaaaaaagccaatctcaacgctctggacaggtatggcaggactgcacttatattggctgtgtgctgtgggtcagcttcaatcgtgtcgttgctgctcgagcaaaatatcgacgtcagttcacaggacctgtcaggccagaccgctagggaatacgcagtgtcttctcatcataatgtcatatgtcaattattatcggactataaggaaaagcagatgctcaaggtttcctcggaaaacagcaatccagaacaggaccttaaactgacctcagaggaggagagccagaggttaaaaggttccgaaaattcccagccagaggagatgtcccaggaaccggaaatcaataaaggcggtgatcgcaaggttgaggaggagatgaagaagcacggcagtacgcatatgggctttcccgaaaacttgcctaatggagccacagccgacaacggagacgatgggctcattccgcccagaaagagtaggacacccgaaagtcagcaattcccggatacggagaatgagcagtatcactcagacgagcagaatgacacccagaagcagctttcagaagaacaaaatacaggcatcctgcaggatgagattctcatccacgaagagaagcagatagaagtcgccgagaacgagttctag

SEQ ID NO: 32157 - DNA, 1461 bp, Artificial Sequence
  Description of Artificial Sequence: Synthetic coding sequence
atggtggctgaagccggaagcatgccagccgctagctcagtgaagaagcctttcggcctgcgctccaagatgggcaagtggtgtcgccattgcttcccatggtgccggggctcggggaagtctaatgtgggaacgtcaggcgatcacgacgactctgcgatgaaaacattgcggtccaagatgggtaagtggtgtagacactgctttccttggtgtaggggttcagggaagtcaaatgtggggacttccggagatcacgacgatagcgccatgaagacactgcggtccaagatggggaagtggtgttgtcactgctttccctgctgcagaggaagcggcaagagcaaagtagggccctggggcgactatgatgatagtgcatttatggaaccacgttatcacgtgcgacgcgaagacctggataaactccatcgggcggcttggtgggggaaagtccctagaaaggatctgatagtcatgcttaaagatacagacatgaacaaaaaagataaacagaaaagaaccgcccttcatttggcctctgccaatggcaattcggaagtggtgaagttgctgctggaccggagatgtcagctgaatatcctcgacaataaaaaaagaaccgctttgaccaaagcagtacagtgccaagaagatgaatgcgccctgatgctgctggagcacggcactgacccaaatattccagacgagtatggtaacacggccctacattacgccatatataatgaggacaagctcatggccaaggcactcctgctgtacggagccgatattgaaagcaagaacaaacatggactgacaccattgctactaggcgtgcacgaacagaagcaacaggttgtgaaattcctgattaaaaagaaagcaaacctaaacgcattagaccgatacggcaggactgtcttaatcctcgccgtctgttgtggatccgccagcattgtcagcctcctgctggagcagaatattgacgttagtagtcaggacctgtcaggacagacagctagagagtacgccgtttcgtcccgccacaacgtcatctgccagctcctttcagattacaaggaaaaacagatcctgaaggtgtcctctgaaaactcaaatccagagcaggatctcaagctaacaagcgaagaagaatctcagcggctgaagggctcagagaactctcagccggaagagatgtcgcaggaacctgagattaataagggcggagacaggaaggtggaagaggaaatgaagaaacacggctccactcacatggggtttcctgaaaacctgccaaatggtgctacagcagacaacggtgacgacggactgatacccccaaggaagtctcgaacaccagagagccagcagttcccggacaccgaaaacgagcagtaccatcgggattttagtggacaccctaactttccaaccacacttcccattaagcagtag

SEQ ID NO: 32158 - DNA, 1782 bp, Artificial Sequence
  Description of Artificial Sequence: Synthetic coding sequence
atggttgccgaagcggggtccatgcctgcggcatcctccgtgaaaaaaccattcggcctgcgctccaagatgggtaaatggtgcaggcattgcttcccatggtgtcgaggcagtgggaagtctaatgtgggcaccagtggggaccatgacgattctgcaatgaagacactgcgaagtaaaatgggcaaatggtgccggcactgctttccgtggtgccgcgggtctggcaaatcgaatgttgggacgtccggtgatcacgacgactccgcgatgaagacattaagaagtaaaatgggcaaatggtgctgtcattgtttcccttgttgcagaggctctggcaagtccaaagtgggtccttggggggattacgacgactctgccttcatggaaccgagatatcacgttcggagagaggatctcgataagctgcacagggctgcttggtgggggaaagttcccaggaaagaccttatcgtcatgcttaaggacactgatatgaacaaaaaggataaacagaagagaacggcactgcatcttgcttcagccaacgggaatagcgaggtcgtcaaactgctgctggacagacgctgtcagctgaatattttagataacaagaagcgcactgctctgaccaaggcggtccaatgccaggaggatgagtgtgccctgatgttgcttgagcacggcacagatccgaacatcccggacgaatatgggaataccgcgcttcattacgctatttataacgaagacaagttgatggcgaaagctctgctgctctacggggccgatattgagtcaaagaacaaaatcgagtcccattctgtgagtcaggcaggcgttcaatggtgcgatcatagcagccttcagccccggccccccgaagcccagatggtgttacagccacaaccacagttcttcttcttgtcattctttctcttcctgtttctctttctgttttttttcagtagggacgaggtattcgccatgtttctgaggctggtcctgaactcatgggcgcaagccatccatcccccccagccacctaaggtactcggtctccagcatggattaacccctctgctcctgggagtgcacgagcaaaagcagcaggtggtgaagttcttgatcaagaagaaagcgaatcttaacgccctggacaggtacggccgcaccgttctcatactggccgtttgttgtggatcagcttccattgtcagcctcctacttgaacagaacattgatgtttcctctcaggacctgagcgggcaaaccgcaagggaatatgccgtcagttcccggcacaacgttatctgtcagctccttagtgactacaaggagaaacagattttgaaggtgtccagtgaaaatagtaatccagagcaggatttgaagctgacatccgaggaggaaagtcaaagattgaagggcagtgaaaattcccaacccgaagaaatgtcacaggaacctgagataaacaaggggggagacagaaaggtggaggaagaaatgaagaagcacgggtcaactcatatgggcttccctgagaatctgccaaacggggcgactgcagataacggtgacgatggactgatccccccacgcaaaagcaggacacctgaatcacagcagttcccagatacggagaatgagcagtaccattctgacgaacagaacgatacacagaaacagctgtccgaagagcaaaataccgggattttacaggacgagattctcatccatgaggagaaacaaattgaggtggccgaaaacgaattttag

SEQ ID NO: 32159 - DNA, 1080 bp, Artificial Sequence
  Description of Artificial Sequence: Synthetic coding sequence
atggctggccatcttgccagcgatttcgcattcagtccgccccccggcgggggaggagacggaccctggggagcagaaccaggatgggtagacccacttacatggttaagcttccaaggcccaccaggtggacccggaatcggcccaggagtcggcccaggctccgaagtgtggggaatacctccttgtccccctccgtatgagctgtgtggaggaatggcatattgtggcccccaagtgggtgtgggtctcgtcccccaaggcggcttggaaacctcacaacctgagtccgaggccggcgttggtgtggagtctaactctaatggagcttcccccgagccctgcaccgtgccccctggagccgtgaaattggagaaggagaagctggaacagaaccctgaaaagtctcaggatataaaagctctgcaaaaggagcttgaacaattcgcaaagctgttaaaacaaaagagaattacactggggtatacccaggcggatgttggacttatcttgggcgtcttgtttggcaaggtttttagccagaaaactatatgccgcttcgaggcattgcagctcagtttcaaaaatatgtgtaagctgcggccccttctgcagaagtgggtggaggaggcggacaataatgaaaacctgcaggagatctgtaaggctgaaactctgatgcaggccaggaaaagaaagcgcacaagcattgaaaatcgggtacgaggaaacttggaaaatcttttcctgcaatgccctaagccgactcttcagataagccatattgcccagcaacttggtctggaaaaggatgtggtccgggtctggttttgcaacaggaggcagaagggaaagcggagctccagtgattacgcacagagagaggacttcgaggctgcaggatcacctttttctggggggccagtgtccttccctcccgcgccaggcccgcattttgggacacccggctatggctccccccacttcactgcactgtatagctccgttccattccccgaaggggaggtgtttccgcctgtatctgttataacactcggctcacccatgcattcgaattag

SEQ ID NO: 32160 - DNA, 1080 bp, Artificial Sequence
  Description of Artificial Sequence: Synthetic coding sequence
atggcgggccacttagccagcgactttgcttttagccctccacccggcggaggtggtgatgggccttggggcgctgaacctggttgggtcgatccattaacctggttaagttttcagggaccacccggcggacctggaatcggccccggggtcggtcccggatctgaagtgtggggaatcccaccttgtcctcctccgtatgagctatgtggaggcatggcctactgtggccctcaggttggtgtgggcttagtacctcaaggcggtctggagacttcccaacctgagagcgaggccggagttggggtagaaagtaatagcaacggcgccagcccagagccttgtactgttcctcccggtgctgtcaagttggagaaagagaaactggagcagaatccagagaagtcccaagacatcaaagcgcttcagaaggagctagagcagtttgccaagctactgaagcaaaagagaatcactcttggttacacacaagctgatgtggggttgattttgggcgtgctatttgggaaagtgttttctcagaagaccatttgccgatttgaggccctgcagctgtctttcaaaaatatgtgcaagctgcggccactgcttcagaaatgggtcgaggaggcagataacaatgagaacctgcaagagatttgtaaagcagaaaccctgatgcaggccagaaaacggaagaggacttctattgagaacagggtacgcggaaatctcgaaaacctgttcttgcagtgtcccaagcctaccctgcagatatcacatatagcgcagcagctcggcctagagaaggatgttgtgcgagtctggttttgcaaccgcaggcagaaagggaagcggagctcttcagattacgcacagcgcgaagactttgaggccgctgggagcccgttttcgggcggacccgtgagcttcccccccgccccgggccctcatttcgggactcctgggtacggctccccacacttcaccgccttgtactcctctgtgccatttccagagggggaagtcttcccccccgtatccgtgataactctcggtagccccatgcactctaattag

SEQ ID NO: 32161 - DNA, 987 bp, Artificial Sequence
  Description of Artificial Sequence: Synthetic coding sequence
atggccggtcataggccctctaaccatttctgtccacttcccggaagcgggggcgggggcccgcggggccccatgcccctgcgggttgatactctgacctggctctccacacaggccgctccaggtagagtgatggtgtggccggccgtccgaccaggcatttgccctggccctgatgtgtggagaatacctcttggaccactaccacacgagttccgcggttggatcgctccctgcaggccacgacttggggcaagtgaagccggcgattggctgcggcggcccagtgagggtgctctgccgggcccgtacattgctctgcggagcatacccaagctgccacccccagaggacatctctggtatcctaaaggaactgcagcaacttgcaaaagagcttcggcagaaaaggctgtcactcggatactcacaggcagatgtgggcatcgccgtgggagccctctttggaaaagttctaagtcaaacaacaatctgcaggtttgaggcacaacaattgtctgtcgccaatatgtggaagctgcgaccattgttaaaaaagtggctgaaggaggtggaagcggaaaatctcctgggcctgtgcaaaatggaaatgattttacagcaaagcggcaaatggcggagggctagcagagaacggagaattggaaattcacttgagaaatttttccagcggtgtcctaagcccacccctcaacagatctctcacatcgctgggtgcctgcagttgcaaaaagacgtggtacgggtgtggttttacaacagaagtaaaatgggttccaggcccaccaacgacgcctcacctcgagaaatcgttggaaccgctggcccaccctgtccgggggctccagtctgctttcacctgggcctgggtctgccagttgacattccccactacaccaggctctactcagcgggcgtggcccactcaagcgctcctgcgaccaccctggggcttttgaggttctag

SEQ ID NO: 32162 - DNA, 2385 bp, Artificial Sequence
  Description of Artificial Sequence: Synthetic coding sequence
atgggccagagcggccggagccggcaccagaaaagagctagggcccaggcacagctacgcaacttggaagcctacgccgctaatcctcacagtttcgttttcacaagaggatgcacaggcaggaatatccggcagctgtcgcttgatgtgcgccgtgtgatggagccattgacggcttcccggcttcaagtgcgtaagaagaattccctgaaggactgtgtggcagtcgcaggccctctcggcgttacccatttcctgatcctcagcaaaacggagaccaacgtttacttcaagctgatgagactgccgggaggaccaacattaactttccaggtgaagaaatatagtttggtgcgggatgttgtgtcttctttgaggcgtcacagaatgcacgagcagcagtttgcacaccccccactgttagtgctgaatagctttggtccccatggtatgcacgtcaagttgatggcaacaatgttccagaatctcttcccatctatcaacgtgcataaagtgaatctcaataccatcaagagatgcctcctaatcgattacaaccccgattcacaggaattggattttcgacattatagcataaaggtggtgccagttggcgcttccagaggcatgaaaaaattgctgcaggaaaagttccctaatatgtctcggttacaagacattagtgaacttctggcgactggagctggcctctccgagagcgaggcggaaccagacggggatcacaatataacagaactccctcaagctgtggccggtaggggcaacatgcgggctcagcaatccgccgtgaggcttactgagataggtcccagaatgacgttgcagcttatcaaggtccaggagggagtgggcgagggtaaagtgatgttccattcttttgtgtctaagacagaggaggaactgcaggctatcctcgaggcgaaggaaaagaagctcagactcaaggcccagcgccaggcacagcaggcccaaaacgtacaaagaaaacaagaacagcgcgaagctcaccggaaaaagtcgcttgagggcatgaaaaaagctcgggtcggcggatctgacgaggaggcttctggcataccctcacgtactgctagcctggagttaggtgaggacgacgacgagcaggaagacgacgatatcgagtacttctgccaagctgtaggggaagccccctcagaagatctcttcccagaggccaaacaaaagcgactcgcaaaaagcccgggcagaaagcgcaaacgctgggaaatggatcggggcgcaaaaagctgtcccgccaacttcctggcagccgcagacgacaaattatccggatttcagggtgatttcctctggccgatcctggtagtcgagtttctcgtggcagtcgcaagcaatggactggcactatatcgcttttctataaggaagcaacgcccctggcacccagccgtagtgtttagcgtgcaactcgccgtatccgatctgctgtgcgcactgacgctgccgccactagctgcctatctttacccaccaaagcactggaggtacggcgaagcagcttgcaggttggagagatttctttttacctgtaacttgcttggcagcgttatcttcattacctgtatctcactgaacagatatcttggcatcgtccaccccttcttcgcgagaagtcatcttcggcctaaacacgcctgggcagtcagcgcggccggctgggtcctggccgccctcctagccatgcccacactatcattcagtcatctgaaacggccccagcagggcgcaggaaattgttcagtggcccgcccagaggcctgtattaagtgcctcggaacagctgaccacggcctggcggcataccgcgcatattcattagtccttgctgggttggggtgtggcctgcctttattactaacgctggccgcatatggcgctctgggccgggctgtgctacggtcgccaggcatgaccgtcgcagagaaactccgcgtagccgcattggtcgccagcggcgttgccttatacgcatcttcttatgtaccctatcacatcatgcgcgtgctgaacgtcgatgcccggcgcagatggtctactcggtgtccaagcttcgcagatatcgcccaggctaccgccgccctcgagttgggcccttatgtggggtaccaggtcatgagaggcttgatgccacttgctttttgtgtgcatcctctcttatatatggcagccgttccctcgctggggtgctgctgtcgccactgtcctggctatcgcgatagttggaaccccgaagacgccaagagcacgggacaggcgctgcccctcaacgccacggcggcccctaagccctccgagccccagtcgcgtgaactgtcccaatag

SEQ ID NO: 32163 - DNA, 1563 bp, Artificial Sequence
  Description of Artificial Sequence: Synthetic coding sequence
atgggtcagagcggaagaagtaggcaccagaaacgggcacgcgcccaggcacagctgaggaacttagaggcctatgcagcaaatcctcacagctttgtcttcaccaggggatgcactggcaggaacattagacagctgagcttggacgtgagaagggtcatggagcctctgaccgcctcacggttgcaggtgagaaagaagaattctcttaaagactgtgtggctgtagcaggcccactgggggtgactcacttcttaatcctgagcaagaccgagacaaacgtgtattttaagctgatgcggctgccaggggggcccaccttaacgttccaagtaaagaaatatagcctagtcagagacgtggtttcctctctccgacgtcatcgtatgcatgagcagcaatttgcacacccgccgttactcgtgttaaactcctttggtccacacggcatgcatgtgaagctcatggctacaatgtttcaaaacctctttccaagcatcaatgttcataaggttaatctgaacacaatcaagcggtgcctgctgatcgactataacccggattcccaggagcttgacttcagacattattccatcaaagttgtgcccgtgggagcctctcgcgggatgaagaagttactgcaggagaaatttcctaatatgagccggctgcaggatattagtgaactgctggcaacgggggctgggctatccgagtccgaagcggaacccgacggagaccacaatatcacagaattgccccaggctgtggctggtcgcgggaatatgagggcccagcaaagtgccgtgcggctgaccgagattgggcctcggatgaccttacagttaatcaaagtgcaggagggtgtgggcgagggtaaagtgatgtttcattcctttgtgtccaaaacagaggaggagttgcaggcaatcctggaggctaaagagaaaaaactgagattgaaggcacaacgtcaagcccagcaggcgcagaacgtacagcgaaaacaggagcagagggaagcccatcgtaagaaatcactggaagggatgaagaaagctcgcgtcgggggcagtgatgaagaggcatcgggaatacctagccgaaccgcatctctcgaactcggagaggacgatgatgaacaagaagatgacgacattgagtatttttgccaggcggtgggcgaggccccctcggaggacttgttccccgaagccaagcagaagagacttgctaaatctccaggccggaaacgtaagaggtgggaaatggaccgtgggagaggccggctgtgcgaccagaagtttccaaagaccaaagataagtcacagggggcccaggtgccttcaccagccctacccacctcatggcagctcccaacaacaaattcagtaggtagtcgtgggacatcatgcggcccctattggtggctctcaagttggtggccttggccggccatggcttggccgtgcactgccagcgccagtggatcaagcgctcacgggacaccaccctggagctccctcagtagttggcagagcgctacttgtagtgccccctag

SEQ ID NO: 32164 - DNA, 378 bp, Artificial Sequence
  Description of Artificial Sequence: Synthetic coding sequence
tgatctctacaatgtgttaagctgggacgggctaccgcaaggtggtggtgggtggtcaaagtcaaaccccacgataaagacgctaaaatgaaataccaagaatgtaataaaatcgtgaagcagaaagcattcgagcgcgcaattgcaggcgacgagcataagcggtcagtggtggattctctggatatagagtctatgactatcgaaggcgaatattctggccccaagcttgaggatgataaggttacaattacttttatgaaaggtctaatgcagtggtacaaggatcagaagaaactgcatcaaaagtgtgcttaccaagatttccggcagaagtctggaatcattacatcacaagactgtgtgcaaacgacatag

SEQ ID NO: 32165 - DNA, 486 bp, Artificial Sequence
  Description of Artificial Sequence: Synthetic coding sequence
atgggggccaatcagctggtggtccttaacgtttacgatatgtattggatgaatgagtatacgtcttccatcggcattggcgtctttcatagcggaatagaggtatacggtagggccgtcgtgttgggtagcaccgacttcctggaggatgatatcgagaagatcgtcgaggagttaggtaaggaatacaagggcaacgcttaccatttgatgcacaagaattgcaatcatttttccagcgccctctcagaaatcctgtgcgggaaggagattccccggtggatcaaccgcttggcttacttcagcagctgcatcccatttctgcagagctgcctccctaaagaatggctgaccccagcggcgttgcagtcctccgtatctcaggagctgcaagatgagctggaggaggcagaggatgccgccgcctcggcttcagtagcctcgactgcagccgggtccagaccgggtcggcacactaaactgtag

SEQ ID NO: 32166 - DNA, 585 bp, Artificial Sequence
  Description of Artificial Sequence: Synthetic coding sequence
atgggagctaatcagctggtggtcctaaatgtgtacgacatgtactggatgaacgaatatactagctccatcggaatcggcgtgttccattcaggaatcgaagtgtacggacgcgaatttgcttatggaggccatccttacccatttagtgggatcttcgagattagccctggcaatgcgagtgagcttggcgagacttttaagttcaaggaggctgtcgtcctaggcagcacagacttcctagaggacgatatcgagaaaatcgtggaagagctgggaaaagaatataagggcaatgcctaccacctgatgcataaaaactgtaatcattttagctccgctttgagtgaaattctgtgtggaaaagagatccctcggtggattaatagactggcctatttcagcagctgtattcccttcttgcagtcctgcttgcctaaagaatggcttactcctgccgctctgcaatctagcgtttctcaggaacttcaagacgagcttgaggaggcagaggacgccgccgcatccgcctccgtagctagcactgccgcagggtcccgccctggacgccatacaaagttgtag

SEQ ID NO: 32167 - DNA, 306 bp, Artificial Sequence
  Description of Artificial Sequence: Synthetic coding sequence
atgagactaacgtttctgaaaaagatcgcgcagctcaactacttggaaatcctggtggtcttactgtcctacactttgaagacaacatttcaatactggatgaacgaatacacctcgtccatcggcataggcgtatttcattccggcatcgaggtctacggccgtgaattcgcctacggcgggcatccctatcccttctccggtatcttcgaaatcagcccaggaaatgcttctgagcttggagagacctttaaattcaaggaggctgtcgtccttgggtcaaccgactttctcgaagatgactag

SEQ ID NO: 32168 - DNA, 3072 bp, Artificial Sequence
  Description of Artificial Sequence: Synthetic coding sequence
atgagcgcatattcggtaccatctacatttgctcaggcatccctgcctgtccacaaccaggtgctgccctccatcgagtcagtggacggctccgaccctctcgccactcttcagacaccccttggacggcttgaggccaaagaggaggaagacgaggatgaagatgaggatacagaggaagatgaggaggaagacggcgaggatactgatctggatgactgggagcccgacccaccccgcccatttgacccacatgatctctggtgcgaagagtgtaacaacgcacacgcaagcgtatgtcccaagcacggaccgcttcaccctatccccaaccggcccgtgcttaccagggcaagggcctcccttcccctcgttctctacattgaccgctttctgggtggcgtttttagcaagcgacgcatccccaaacgcacacagtttggccctgtagagggtcctctggtgcgcggctctgagctcaaggattgttacatccacctgaaggtctcgctggacaagggtgaccgaaaggagcgagatctccatgaggatctttggtttgaattgagcgatgagacattgtgcaattggatgatgtttgtgcgccccgcacagaaccaccttgaacagaacctcgtggcttaccagtatgggcatcacgtgtactacacgaccatcaagaacgtggagccaaagcaggaactgaaagtgtggtatgcagcttcgtacgctgaatttgtgaaccaaaagatccatgatatcagcgaggaggaaaggaaggttctccgcgagcaggaaaagaattggccatgctatgaatgtaatagacggttcatatcgagcgaacagctgcagcagcaccttaattctcacgatgaaaaactggatgtgtttagccgcacgaggggcaggggacgagggcgcggaaagaggaggttcggccccggccggcggcctggacgccctccaaaatttatcagactcgagattacctctgaaaacggcgaaaagagtgatgatggcactcaggaccttttgcacttccccacaaaagagcagttcgacgaggcggagccggcaactctgaatgggctggaccagccagagcagaccacaatccctattcctcaacttccacaagagacccagtcaagcctggaacatgagcctgagacccacacactgcacttgcagccgcagcatgaagaaagcgtagtgccaactcaatctactctgacggcagacgatatgaggcgtgccaagcggatcaggaatgcagctctgcagcatcttttcatcagaaagtcctttcgacctttcaagtgtttgcagtgtggaaaggccttcagagaaaaagataagctggaccagcatctgcgcttccacggcagggaagggaactgccccctcacatgtgacttatgcaataaaggttttattagttcaacaagcctagagagccacatgaagctgcactccgaccagaagacttacagctgcatcttttgccctgagagcttcgataggctcgaccttctgaaggaccatgtggccattcacataaatgacggttacttcacttgtccaacctgtaaaaagcggttcccagacttcatccaggtgaaaaagcatgtgcggagcttccactctgagaaaatttaccagtgtacagaatgcgacaaggccttttgcagaccagacaagcttaggctccacatgctgcgccattcagacagaaaggatttcttgtgttctacgtgcgggaagcaatttaaaaggaaggacaaactccgtgaacacatgcagagaatgcataaccccgagcgcgaggccaaaaaggccgaccgcatttcaaggtccaagacgttcaaaccacggataacgagcacggactacgattccttcacgtttaaatgtcgactgtgcatgatggggttccgacgcaggggcatgttggtgaatcatctgagtaagcggcaccccgacatgaagatcgaggaagttcccgaactcactttacctataattaagcccaaccgcgactacttctgccaatattgcgataaagtgtataagtccgcttctaagagaaaggcacatatccttaagaatcaccctggagccgaattaccgccatccataagaaagctgcggcctgccggccccggagagccagatcctatgctgagcacccacacacagctgaccggcactattgcaacgcctccagtttgctgccctcactgttctaagcagtattcctctaaaacgaagatggtgcaacacattcgcaagaaacaccctgagtttgctcagctttctaatactattcatacacctttgaccacggcagttattagcgcgactcccgcagtcctgacaactgattcagcgactggggagaccgtagttacaaccgacctgctaacacaagccatgaccgaattatctcaaacacttactactgactacaggacccctcagggagattatcaacggatccagtacattccagtgtcacagagcgcctccgggttgcagcagccacagcacatccagctgcaggtcgtgcaggtcgcctctgtgagcgggcagcctctctcccctagtgcccagcaagcgcagcaggggcttagtcccagccacatacaggggagctcctccacacaggggcaggcactgcaacaacaacaacaacaacagcagaactcttctgtgcagcacacttacctgccctcagcatggaacagtttccgtggctattctagcgagatccagatgatgacattgccaccgggtcagtttgtgataaccgattctggcgtcgccacccctgtgacaacaggacaggtcaaggccgtcacttccggccactacgtcctgtctgagagccagagtgagctagaggaaaagcagacaagcgcactgtccggaggggtccaggttgaaccccctgctcacagtgatagcctggacccccagacaaattcccagcaacagactacccagtatatcattacaaccacaacaaacggcaatggctcctctgaggttcatatcacgaaaccttag

SEQ ID NO: 32169 - DNA, 3483 bp, Artificial Sequence
  Description of Artificial Sequence: Synthetic coding sequence
atggatagcaaagatgagtcttcccacgtctggccaacatcagccgagcacgagcaaaatgctgcccaggtccactttgtgcctgacaccggcaccgtcgctcagatcgtgtacacggacgatcaggtcaggcctccgcagcaggtcgtctatactgctgatggagcaagttacacttctgtagacgggccagagcacactctcgtctatattcatcccgtggaagcagctcaaaccctgttcaccgacccgggccaagtggcctacgtccagcaggatgctaccgcccagcaggcgtccctgcctgtgcacaatcaagtattgccatcgattgaatctgttgatgggtccgacccgcttgctactctgcagacaccgctagggaggctggaggcaaaggaagaggaagacgaggatgaggatgaggacaccgaagaagacgaggaagaggatggggaagacaccgacttggacgattgggaaccagaccctccccgtccatttgaccctcatgatctgtggtgcgaggagtgcaataacgcacacgcttccgtttgtcccaagcacgggccattacaccccatccctaatcggccggttttaaccagggcgagagcttccctgcctctcgttttatacattgaccgatttctgggcggtgttttttccaagcgacgtataccgaagcggacgcagttcgggccggtcgagggccctctggtgcggggctccgagttgaaagattgttatatccacctcaaggtctccctggacaagggagatagaaaggaaagggacctccatgaagacctgtggtttgagttatctgacgagaccctctgtaactggatgatgtttgtaagacccgcccaaaatcatctcgaacaaaacctggtggcttaccaatatgggcaccatgtttattacaccacaataaagaacgtggaacctaagcaagagttgaaggtgtggtacgccgcttcctacgccgagttcgtgaaccagaaaatccatgatatctccgaggaagaacgaaaagttttgcgcgaacaggaaaagaactggccctgttacgagtgcaacaggcggttcatcagtagtgaacagctgcagcagcatctgaactcacacgatgaaaaactggatgtgtttagcagaacaaggggccgaggtaggggccgcggcaagcggaggtttgggccaggcagacggccaggcagacctccaaaattcatccggctggagataaccagcgagaatggagaaaagtctgacgatggaacacaggacctgttgcactttcctactaaggaacagttcgacgaggccgagcccgccacgttgaacggattggaccagcctgaacagacaaccatacccattcctcagctgccacaggaaactcaatcgtccctggagcacgaacctgagacccatacactgcatctccagccacagcatgaagagagcgtagtgcccactcagagcacactgacagctgatgacatgcgccgggcaaaaagaattcgattggaactgcagaacgccgcgcttcagcatctttttattcggaagtcattccgtcccttcaaatgcctacagtgtggcaaagcctttagggaaaaagataaattggatcagcacctccgattccatgggagagagggaaattgccccctgacctgcgacttgtgcaacaaaggcttcatttctagtacatctcttgaaagccatatgaagcttcacagcgaccagaaaacttacagttgcatcttttgccctgagagctttgacaggctcgacctgttgaaggaccacgtggcgattcacatcaacgatggctattttacctgccccacatgtaaaaagcgattccctgactttatacaggtgaaaaagcatgtaaggagtttccatagtgagaagatctaccagtgcaccgaatgcgataaagctttctgtcgccccgacaagctgcgactccacatgctccgccattccgacagaaaggatttcctgtgctcaacatgcggaaagcagtttaaacggaaagacaaactgcgtgagcacatgcagaggatgcataaccccgaaagagaagcaaagaaggccgatagaattagccggagcaagaccttcaagcctagaatcacctctaccgactacgacagcttcacctttaagtgtagactctgcatgatgggattccgccgccggggtatgcttgtcaatcatctcagcaaaagacatccagacatgaagattgaggaggtgccagaactgaccctccccataatcaagccaaacagagattacttttgtcagtactgcgataaagtctacaagagcgcaagcaaaagaaaagcacacatcctgaagaatcatcctggtgccgaacttcccccctctatcaggaagctgcgccccgcaggccccggtgaacctgatcctatgttgagcacacatactcagctaaccggaaccatagctactcctcccgtgtgctgcccccactgctccaagcagtattctagcaagacaaagatggtgcagcacatacggaaaaaacacccagagtttgctcagctcagtaatacaatccacactcctctgacaactgctgttatcagcgctacccccgcagtgctaactacagactcggccaccggagagacagtcgtcaccacagaccttctgactcaggcgatgacagagctatcacagaccttgacaaccgactacaggacaccccagggtgattatcaaagaattcagtacattccagtatcgcagtctgcatctggattacagcaaccacagcatatccaactgcaagttgtacaggttgcctcagctactagtcctcatcagtcccaacagagcaccgttgatgtcggtcaattgcatgacccccagccttatccacagcacgcaatccaggtgcagcatatccaggtgagcgagcccaccgcttcagctccctcaagcgcacaagtctcagggcaacctctctccccttccgcacagcaggcccagcagggactgagccccagccacattcaaggttccagttccacgcagggccaagctttgcagcagcagcagcaacagcagcagaatagctctgtgcagcatacgtatttaccgagtgcatggaacagcttccgcgggtattctagcgagattcagatgatgactctgcccccagggcagttcgtgatcacagactcaggggttgcaaccccagtgaccactggtcaggttaaagcggtaacctcaggacactatgtactgagtgaatcacaatccgaactggaggagaaacagacgagcgctctctccggaggtgttcaggtggagccacctgcccatagcgacagcctggacccgcagacgaattcccagcaacagacaacacagtatatcatcacgaccaccaccaatggaaacgggtctagtgaggtgcacattaccaagccctag

SEQ ID NO: 32170 - DNA, 3471 bp, Artificial Sequence
  Description of Artificial Sequence: Synthetic coding sequence
atggactctaaagacgaaagctcacacgtttggcctacgagcgccgagcatgagcagaatgctgcgcaggtacacttcgtgcccgacacgggaaccgtagcccagattgtctatacagacgatcaggtccgcccaccacagcaggttgtgtatacagccgatggagcatcgtatacctcagtagatggcccagaacatacattagtctatatccacccagtggaggcagctcagactttgttcaccgaccctggacaggtggcctatgtccaacaggacgcaacagctcagcaggctagcctgcccgtgcacaatcaggttctcccttctatcgagagtgtggacggctctgatccactggcgactctgcagacccctctgggacgactcgaagcaaaagaggaggaagatgaggacgaagacgaggacaccgaagaagatgaggaggaggacggagaagataccgatctggacgactgggagcctgatccccccagaccatttgacccgcacgacctttggtgtgaagaatgcaataacgcccatgcaagtgtgtgccctaagcacgggccccttcatccaatcccaaaccgccctgtgttaactagagccagggcaagtttgccacttgtactttatattgataggtttttgggtggagtgttctctaaacgtcgtattccaaagcgcacacaattcggccctgtggaaggtccactcgttcgcggctctgagctgaaggactgctacatccatctgaaggtcagtcttgataaaggggatagaaaagagcgcgatctgcatgaggacctgtggttcgagctatcggacgagacactgtgtaactggatgatgttcgtgaggcccgcacaaaaccatctcgagcaaaatcttgtggcgtaccagtatgggcatcatgtgtactacacgacaatcaagaacgtcgagcctaagcaggagcttaaggtgtggtatgccgcgtcctatgctgagtttgtaaaccagaagattcacgacatctcagaggaagagcggaaggttcttcgagagcaggaaaagaactggccatgctatgaatgtaatcggcggtttatttcaagcgaacagctgcagcaacatttgaattcgcacgacgagaagctagacgttttctcacgcacgaggggtcgtggacgtgggcgtgggaaacgtcgctttggcccaggccggcgtcctgggcgcccccccaaattcatccggctggaaataacttctgaaaatggagagaagagcgatgatggcactcaagacctgctgcattttccaactaaagagcagttcgacgaagccgaacctgccacccttaacgggcttgatcaaccagagcagaccactattccgatcccacaactgccacaagagacccaatcttctctggagcatgaacccgagacccacactttgcacctgcagccacagcatgaagagtccgtggttccgacacagtcgacgctcactgccgatgacatgagaagagccaagagaattcgtaatgcggctctgcagcatctgtttattagaaagagtttccgaccatttaaatgcctccagtgcggaaaggcctttagggaaaaggacaagttggaccagcatttgcgattccacggccgtgagggcaactgcccactcacatgtgatctgtgcaacaagggttttatctcttccacatctcttgagtcgcatatgaaactgcactctgatcaaaaaacctatagttgcatcttttgtcccgaaagtttcgatcgactagatctgctcaaggaccacgtagctatccacataaatgacggctacttcacttgtcccacgtgtaagaagcgcttccccgacttcatacaggtaaaaaagcatgtgagatcatttcacagcgagaaaatttaccagtgcaccgagtgcgacaaggctttctgcaggcccgacaaacttcggctgcacatgctacgccattccgacagaaaggattttttatgttctacatgtgggaaacagttcaaacggaaggacaagttgcgagagcacatgcagcgcatgcataatcctgaacgcgaggcgaagaaagctgatcgcatatcgcggagcaaaacattcaaacccagaatcaccagcactgactatgattcttttacattcaagtgtaggttgtgtatgatgggatttcgaaggcgggggatgctggtgaatcacctgagtaaaagacaccctgatatgaagatcgaagaagtaccggagctcaccttgccaataattaagccaaaccgggactacttctgccagtactgcgataaggtatacaagtccgcctcgaaacgtaaggcccacatcctaaaaaaccatcccggagccgagctgcccccatcaatacgcaagctgcggcctgccggccccggcgagcccgatccgatgctaagtacacacacccagttaaccggcacaatcgccaccccccctgtctgctgcccacattgctctaagcagtactctagcaaaacgaagatggtgcagcatattcggaaaaaacaccccgaatttgcacagttgtccaataccattcataccccgttgacaaccgccgtgatcagtgcaacacctgctgtcctgaccacagactctgccacaggcgaaaccgtggtcactacagacttgcttacacaggcgatgacagagctttctcaaacactcactacagattatagaacaccccagggggattatcagaggattcagtatattcctgtgtcacaaagtgcttccgggctgcaacagccacagcatattcaactgcaggtggtgcaggttgcatcggcaacatcaccgcatcagtctcagcagagtaccgtggacgttggccagttgcatgacccccagccctatccccaacatgcgatccaggttcaacatatccaggtcagcgaaccgaccgcatccgccccatcatctgcccaggtgagtgggcaacctctgagcccatcagctcagcaggctcagcagggtctcagtcccagccacatccagggatctagctcaacccagggacaagctcttcagcaacagcagcagcagcagcagaactccagtgttcagcacacatacctcccttctgcctggaattcatttcgtggatactcaagtgaaatccagatgatgactttgcctccagggcagttcgtcatcaccgattctggcgtagctacacccgtcacaacagggcaagtcaaagccgttacctcaggacattacgtgctgagtgagagtcagtccgaattagaggaaaagcagacctccgcactctctgggggagtacaggtggaaccccctgcccattctgacagcctggacccccagactaattcccagcagcagaccactcaatacattattacaaccactactaatgggaatggctcttcggaagtgcatatcaccaaaccatag

SEQ ID NO: 32171 - DNA, 3186 bp, Artificial Sequence
  Description of Artificial Sequence: Synthetic coding sequence
atgtctgcctactcagtgccatccacatttgctcaggcatcgttgcctgtccataatcaggtgctgccaagtatcgaatccgtggatggctccgacccactggctaccttgcaaacccctttgggtcgcctagaggctaaagaagaggaagatgaagatgaggacgaagatacagaggaagacgaggaggaggatggcgaagatacagatttggatgactgggaacccgacccaccacggcctttcgaccctcacgacctttggtgtgaagagtgtaataatgcccacgcttcggtctgccctaaacatggcccccttcatccaatccccaatcgacctgttcttacgcgggcccgtgcctccctgcccctggtgctgtacatcgacagattcctggggggcgtgttcagcaaacgccgtataccgaaacggacacaatttggtcccgtggaggggcccttagttagaggctctgagctcaaagactgctacatacatttgaaggtcagcctggacaaaggagaccgtaaggaacgggacctccatgaagatttgtggtttgaactgtcggatgagaccctgtgtaactggatgatgtttgtcagacctgcccagaatcaccttgaacaaaatttggttgcatatcaatatgggcatcacgtttactataccacgatcaagaatgtggaacccaagcaggagcttaaagtgtggtacgccgcctcctacgccgagtttgtcaatcagaagatacatgatatttcagaagaagagagaaaagtgcttagagaacaggaaaaaaactggccatgttacgaatgcaatcgtaggttcatttcttccgaacagctgcagcagcacttaaacagtcatgatgaaaaacttgacgtgttttccaggacgcgcggacgtggccggggccggggcaaacgtcgcttcggccccggacgcaggcccggccgcccgcctaagtttattcggctggagatcacatccgagaatggcgaaaagtctgacgacggcactcaggacttgctgcacttccctactaaagagcagtttgacgaagccgagcctgcaacactgaatggcctcgaccagccagagcagacgaccatcccgattccacagctccctcaggagacccagtcttcactggaacatgagccagagacccacacgctacatttgcagccccagcacgaggaatcggtcgtgcccacccagtctactctcactgcggatgatatgcgtcgcgcaaaacgcataagactggagctacagaacgcagccttgcagcatctctttatacgcaagtcgtttaggcccttcaaatgcctgcagtgcggtaaagcattccgggaaaaagacaagctcgaccagcatctccgcttccatgggagggaagggaattgtccccttacatgtgacttgtgtaataaggggttcatatcttccacaagcctcgagtctcacatgaaacttcacagcgaccagaagacctactcttgtatattttgccccgaatctttcgaccgtttagacttacttaaggatcacgtcgccatccacataaacgacggttattttacgtgccccacctgcaagaaacggttcccagacttcatccaggtgaaaaaacacgtacggtcctttcattcagagaaaatataccagtgtacagaatgcgataaagcattttgtaggccggataaactgcgattgcacatgctgcgtcactctgatagaaaggatttcctgtgcagtacctgtggaaagcagtttaaacgcaaggacaagctgcgtgaacatatgcagaggatgcacaatccagaacgggaggccaaaaaggccgacaggatctccagatcaaaaaccttcaagccccggattacctctacggattacgattccttcacatttaaatgccggttgtgcatgatggggtttagaagaagggggatgctggtgaatcacttaagcaagagacatccagacatgaagatcgaggaagtcccggaattaacgctccctatcataaaaccaaaccgagattatttctgtcagtattgtgataaggtgtataagagcgcctctaagcggaaagctcatatcttaaagaatcatcccggcgcggaactacctccgtccatacgcaagctgaggccagcgggtccaggtgagcccgacccaatgttgtccactcacacccagctgactggaacgatagcgacacccccagtttgctgtccgcactgctcaaagcagtacagctcaaagacaaagatggtgcagcatattcgcaagaagcaccctgaattcgcgcaactgagcaatacgatccacaccccactcaccaccgcagtgatctccgccacacctgctgttctgaccaccgattcagccacaggagaaaccgttgtgaccaccgatctacttacccaggccatgactgagctgtcgcagactctgacaaccgattatcggaccccccagggtgattaccagcggatccagtatattcctgtgtctcagtctgcttctggtctgcagcagccacagcatatccagttgcaggttgttcaggtagcttcggccacctctccccaccaatctcagcaaagtaccgtggatgtaggtcagcttcacgaccctcagccctatccacagcatgccatccaggtccagcacatacaggtgagcggtcagcccctgagccctagcgcccaacaggcccaacaaggactaagccctagccatattcagggatctagctctacccagggccaggcgcttcagcagcagcaacagcagcagcagaactcaagtgtacagcatacgtacttaccatctgcttggaatagtttcagaggatatagctccgaaatacaaatgatgaccctcccacctgggcagtttgtcatcactgattccggagtggcgacaccagtgactactgggcaggttaaagcagtaacatctggtcactacgtcttatctgaatctcagtcggaattggaggagaaacagaccagtgcactgtccggcggcgtgcaggtcgagcctcctgctcatagcgatagccttgacccacagaccaactctcagcaacagaccacccagtacattattacaacgaccaccaatggcaacgggtccagcgaagtgcacatcactaagccatag

SEQ ID NO: 32172 - DNA, 3225 bp, Artificial Sequence
  Description of Artificial Sequence: Synthetic coding sequence
atgagcgcctattctgtgccatccacatttgcccaagcttcactccccgtccataaccaggttctgcctagcatcgaaagcgtggatgggtcggaccccctagcaactttgcaaacccctctcggcagactagaagctaaggaggaggaagacgaagacgaggatgaggacacagaggaagatgaggaagaagatggtgaggatacagacctagatgactgggagcctgatcctcctagaccattcgatcctcacgatctgtggtgcgaggagtgtaataatgctcatgcttcagtgtgtccaaaacacggcccactccaccctattcctaatcgtcctgtgctgactagagcaagggcatcgctgcccttggtgctgtacatcgatagatttctggggggagtttttagtaaaagacggattcccaagagaacccagtttggtcctgtcgaggggcctctcgtgcggggctcagagctgaaggactgctacattcatctgaaagtgtcacttgataagggcgacagaaaggagcgtgatctgcatgaggacctctggttcgagctgtccgatgaaaccttgtgcaactggatgatgtttgtcaggcctgctcagaatcatctggaacagaacctggttgcttatcaatacgggcaccatgtgtactacaccacaatcaagaacgtggagccaaagcaggagctgaaggtttggtacgctgcctcctacgctgaattcgtgaatcagaaaattcacgatattagcgaggaggagaggaaggtcttgagagagcaagagaaaaattggccctgttacgaatgcaacaggagattcattagttccgagcagctgcaacagcacttgaatagccatgatgaaaaactggatgttttttccagaacgagaggccgaggtcggggcagaggaaaaaggcgctttggcccaggaagacggccaggccgtccaccaaaattcatcaggctggaaatcacgtccgaaaatggagagaaatcagacgatgggactcaggaccttcttcactttcccacgaaagaacagtttgatgaggccgaaccggcaaccctaaacggcctagatcaacccgagcagactacgattcccatcccccagttaccacaggagacccaaagctccctggaacatgaaccggaaacacacacgttgcatttacagcctcagcatgaggagtctgtggtacctactcagtctaccctgactgccgacgacatgcgcagagccaagagaatccgtcttgagctacaaaatgctgccttacagcacttgtttattagaaagtcgtttcgcccttttaagtgcctacagtgtgggaaggcattccgcgagaaagataagctggatcaacacctgcgctttcacggcagagaaggcaactgccccctcacatgcgatctgtgcaacaaggggtttattagtagcacctctctggagtctcacatgaagctgcacagcgatcaaaaaacttactcctgtatcttttgccctgagagtttcgaccgcctggacctcctgaaggaccatgtggcaatccatatcaacgacgggtactttacatgccccacttgcaagaagcggttccccgacttcatccaggtcaaaaagcacgtccggtcatttcattccgagaagatctatcagtgtaccgagtgcgataaggctttctgccgtccagacaaactgcgactacatatgctgagacactccgaccggaaagactttctgtgttccacctgtggcaagcagttcaagagaaaagataaactgagggagcacatgcagcggatgcacaaccccgaaagagaggctaagaaagctgatcgcatcagtcggtctaagacatttaaaccacggataactagcaccgattacgatagtttcacctttaagtgccgcctgtgtatgatgggctttagacggcgtgggatgcttgtgaaccacctgtcgaaacgccatccagacatgaagattgaagaagttcccgagttaacactgcctattatcaagccgaatagggattatttttgccagtactgtgacaaggtttataagtccgctagtaagcgaaaagcccacattctgaagaaccatcctggggcagagttgccccccagtattcgtaagctccgccccgcaggaccaggtgaaccagaccctatgctttctacccacacacagctgacaggcacgatcgcaactccccctgtgtgctgcccacattgctctaagcagtattcgagtaagaccaagatggtgcagcacatccggaaaaagcatcctgaatttgcgcaattgtccaacacgattcatactccactaacgacagcagttatcagcgccacacccgctgttctgaccaccgattcggccacgggcgagactgtggtaaccaccgacttactaacccaggccatgaccgagctgtcccaaaccctaaccaccgactacagaacaccgcagggggattaccagcggatccagtatattccagtttcccaaagtgcaagcggacttcagcagccccagcacatacaattacaggttgtgcaggtggcaagcgccacaagtccacatcagagtcaacagtcaaccgtggatgtgggtcagttgcacgacccacagccctatcctcagcacgccatccaggtgcagcacatccaggtctccgagcctaccgcttcagcaccgagttctgctcaggtgtccgggcagccattgtcacctagcgctcagcaggcccagcagggtctttccccatcgcacattcaaggatcatcatcaacccaaggccaggccctgcaacagcagcagcaacaacagcagaactcttcagtgcagcacacataccttccgtcagcctggaatagtttccgaggatatagctcagaaattcagatgatgacattaccccccggtcagttcgtgattacagattctggagtagctactcctgtgacgacaggtcaagtgaaggccgttaccagcggacattacgtgctttcagagagtcagagcgagctggaggagaaacaaacgtcagctctgagcggaggtgtgcaagttgagccaccagcacactccgacagcctcgacccccaaaccaattctcagcagcagacaacacaatacattatcacgaccactacgaatggcaacggcagcagcgaggttcacataaccaaaccctag

SEQ ID NO: 32173 - DNA, 1536 bp, Artificial Sequence
  Description of Artificial Sequence: Synthetic coding sequence
atgctgaagatggctgagcccatagcttctctgatgattgtggaatgcagagcatgtcttcgatgttctccactgttcctgtaccagagagaaaaggacaggatgactgagaatatgaaagaatgccttgcccagaccaatgccgcggtgggcgatatggtcaccgtagttaagacggaagtgtgttcccccctgagggatcaagaatatggccagccatgtagccgtcgcccagacagttctgccatggaagtcgagcctaaaaaactcaagggtaagagagacctcattgttcccaaatcttttcaacaagtggacttttggttttgcgagtcttgtcaagagtattttgtcgacgaatgccccaaccatggcccaccagtgttcgtgagtgatacccctgtgcctgtaggaatcccggaccgcgctgcgcttacaatccctcagggaatggaggtagtaaaagatacctcaggggagtctgacgtgcgatgtgttaatgaggtgatcccaaaggggcacatcttcggcccttacgaaggtcagatttccactcaggataagagcgccggcttcttctcctggctgatcgttgataagaacaatcgctacaagtctattgacgggagcgacgagactaaggccaattggatgagatatgtggtgatttctcgggaagagagagagcagaaccttctggcatttcaacatagcgagaggatttacttccgggcttgcagagacataaggcctggggagtggctgagagtctggtactccgaggactacatgaagaggctgcattctatgagccaagaaaccatacaccggaatcttgcacgcggcgagaaacggctccagagagagaagtcagaacaggtgctagacaatcctgaggatctgcgcgggcccatccacctctcagtcctgagacagggtaagtcaccatacaagagaggatttgacgagggggacgtacatcctcaagctaagaaaaagaaaatcgatttaatcttcaaggacgttcttgaggcaagtttggagagcgccaaggtggaagctcatcagctcgcactaagtacgtccctggttatccgcaaggttcctaagtaccaggatgatgcctattctcagtgcgctaccactatgacccacggagtccaaaacatcggtcagacacagggagagggggattggaaagttccccagggtgtatcgaaggaacccggacaactcgaggacgaagaggaggagcctagctctttcaaggctgatagcccagccgaggcatcgttagcctcagacccccatgagctgcccaccacctcattttgccccaattgcattcggctgaagaaaaaggtccgagaactgcaggccgagttggacatgctgaagagtggaaagcttcctgagcccccagtgttacctcctcaagtgctggagctgcccgagttttccgatcccgctggcaagctcgtatggatgcgactgctaagcgaaggacgggtcaggagtgggctgtgcggcggctag

SEQ ID NO: 32174 - DNA, 1536 bp, Artificial Sequence
  Description of Artificial Sequence: Synthetic coding sequence
atgctgaagatggccgagcctatcgcatccctcatgattgtggagtgtcgagcatgcctcagatgcagccctctattcctctaccagcgcgagaaagaccgcatgaccgagaatatgaaagagtgtctggctcagactaatgctgcggtgggtgatatggtgactgtggtgaaaacagaggtatgtagcccactgcgcgatcaggagtatggtcagccctgcagtcggcgaccagattctagtgcaatggaggtagaacccaagaagctgaaggggaaacgcgatttaatcgtccccaagtcattccagcaggtggatttttggttctgcgagtcttgtcaggagtactttgtggacgaatgcccaaaccatggtccacctgtcttcgtgtccgacacccccgtgcccgtaggcatacccgatagagcagcgttgactattccgcaaggcatggaagtggtgaaagacaccagcggagagagcgacgtgaggtgcgttaatgaagtgatacccaaaggacatatttttgggccgtacgagggacagatcagcacacaggataaatctgcaggatttttttcatggctgattgtggataagaataatcgttacaagtctattgacggctctgacgagactaaggccaattggatgcggtacgtggttatcagccgagaagagcgggagcaaaatctcttagcattccagcattctgagagaatttatttcagggcttgccgggatatcagacctggcgaatggctgcgcgtgtggtatagcgaagattatatgaagcgtctgcactctatgagccaggagaccattcaccggaaccttgcccggggggaaaaacgcctccagagagaaaaaagtgagcaggttctggacaatcctgaggacctgcgaggacctattcacctgtcagtcctccggcaggggaagtctccctataagcgaggcttcgatgagggggatgttcatccacaagctaagaaaaaaaaaatagatctcatcttcaaagatgtcctggaggccagtttggagtctgcaaaagtcgaggcccatcagttggcattgtctaccagtttggtcattcggaaagtgccgaagtaccaggatgacgcctacagtcaatgcgccacaacaatgacccacggcgtgcaaaatataggccaaacacagggggaaggcgactggaaagtgccacaaggcgtgagcaaagagcccggtcagctggaggacgaagaagaggagccctcaagctttaaagctgactctcccgcggaggcttcgctggcatccgatccccatgaactcccgaccacttccttctgtcccaattgcatcagattaaagaagaaggtgcgggaattgcaggctgagcttgacatgctgaaatccggcaagctgcccgaaccgcctgtacttccaccccaagtgcttgagcttccagaatttagcgatccagcgggaaagctcgtttggatgaggttgctttcggaagggcgagtaaggtccggcctttgtggcggctag

SEQ ID NO: 32175 - DNA, 1434 bp, Artificial Sequence
  Description of Artificial Sequence: Synthetic coding sequence
atgaccgagaacatgaaagagtgtctggctcagacgaacgcagccgttggcgatatggttacagtcgtgaaaaccgaggtctgttctcccctgcgtgaccaagaatatgggcagccttgctctagacgccccgatagctctgcaatggaggtggaacccaaaaagctgaagggcaaacgggatctgatagtaccgaagtcattccaacaggtcgacttttggttttgcgagtcctgccaagaatattttgtggatgaatgcccgaaccacgggcctccagtctttgtatcagacaccccagtccctgtcggcatcccggacagagccgccttgacaatacctcagggaatggaggtggtcaaggacacatccggggagagcgatgtgcgatgcgtgaacgaagttatacctaaaggccatatctttggcccctatgagggccagatatcgacccaggacaagtccgctggtttctttagctggttgatcgtggataagaacaatcgctataaaagcattgatgggagtgacgaaaccaaagcgaactggatgcgctacgtagttatttctcgggaagaaagggagcagaatcttctagccttccagcattccgagagaatttacttccgtgcttgtcgtgacatccggccaggtgaatggctgagggtgtggtactctgaagattacatgaaacgcctgcatagcatgtcccaagagactattcaccgaaacctcgcccgcggtgagaagcgcttacaaagagaaaagagcgagcaagtcctcgataaccctgaagatttacgagggcctattcacctctctgtcctgcgccaaggcaagagtccttacaaacgcggatttgacgaaggcgacgttcatccacaggcaaagaaaaaaaagatagacctcatctttaaggacgtgcttgaggctagtctcgaatcagcaaaagtcgaagcccatcaattggctctcagtacctcacttgtcatccgaaaggtgccaaaatatcaggacgatgcctactcccagtgcgcaacaactatgactcacggcgtacagaacataggacagacacagggtgagggagactggaaggtgccccagggggtcagcaaggagccgggacagttagaggatgaggaggaagaacctagttcatttaaggctgactccccagcagaagccagcctggcctcggatccccacgagctcccgactacctccttctgtcctaactgcatacgactgaagaagaaggtgagggaactccaggctgagctcgatatgctgaagagcgggaaactgcctgagcccccggtcttgccgccccaggttctggagttgccagaatttagtgatcccgccggaaagctcgtgtggatgagactgctctccgagggcagggtgagaagtggtctatgcggtggctag

SEQ ID NO: 32176 - DNA, 1425 bp, Artificial Sequence
  Description of Artificial Sequence: Synthetic coding sequence
atgagtatccaagcccccccaaggcttctagaacttgccggccagtccttactccgtgatcaagccctgtcaatttccgctatggaggagctcccgcgcgtactgtatctgcccttgtttatggaggcattttccagaagacacttccagaccctgacagtgatggtccaggcttggcccttcacgtgtctgcctctgggctcactgatgaaaaccctgcatctggagaccctgaaagctctgctggaaggactgcatatgcttttgacacagaaagatcgaccacgtaggtggaagctgcaggtattagacctgcgggatgttgatgagaatttctgggctcgctggcccggagcctgggcactgtcatgttttcctgagaccacttcgaagcgtcagacggccgaggactgtccccgcatgggcgaacaccaacctttaaaggtgtttattgacatttgcttaaaagagattccacaggacgaatgtctcagatatctttttcagtgggtgtatcaacgtcgggggctggtgcatctgtgctgttctaaactggtaaattacctcactcctattaaatacttgcggaagagtcttaagataatctatctgaactctattcaggaactggaaatcagaaacatgtcttggcccagactgattaggaaactccggtgctatctaaaggaaatgaagaacttgagaaagctggttttttccagatgtcaccactatacaagcgataatgagttacagggcaggctggtcgctaagttttcgagcgtgttcttgagattggagcatctgcaactactgaaaataaaactgattacgttcttctcagggcaccttgagcagttgatacgatgccttcaaaaccccttggagaacctggaactgacttacggttatctcttggaggaagacatgaagtgcctgtcacagtacccctcactcgggtacttgaagcacttaaacctgtcctacgtgctcctcttccggatttccttggagccccttggagcgctcttggagaaaatcgcggcatctttaaagaccctgatccttgagggctgtcagatacattactctcagctcagtgcgatccttcctgccctttcacgatgtagccagctgaccacattttacttcgggcggaactgcatgagcatagatgcattgaaagatctcctgcgccataccagtggcctgtctaagctttcacttgagacttatcctgcccctgaggaatctctgaactcgctggtccgggtgaactgggagatttttacacccctgcgtgctgagctgatgtgtactctacgggaggttaggcagcccaaaaggatcttcatcggtccaaccccttgcccttcctgcgggagttcgccgtctgaagagctggagttgcacctctgttgttag

SEQ ID NO: 32177 - DNA, 690 bp, Artificial Sequence
  Description of Artificial Sequence: Synthetic coding sequence
atgaaaggaggcaaagcccaccagacctgccctttccacaataggactagtgtcctcacaggactagtgattacaaatgatccagtgtccgattctctgtttgtgaagggctgctttgagctgcaggaaaggtgtttacaaaaccctctggagaatcttgagctgacatacggatatttgctggaggaagacatgaaatgcctgtcacagtatcccagccttggttacctgaagcacttaaatctctcctacgttctactgtttcggatttcactggagcccttaggcgcattgctggagaagatcgccgcttcactgaagacactgatactagaggggtgccaaatacattattcgcagttgtccgccattctccccgccttgtctcgatgttcccagctcaccaccttctatttcgggagaaattgcatgagtatagacgctctgaaggatttgctccgccatactagtgggctgtccaagctaagtcttgagacctacccagccccagaagagtcacttaattcgttggtaagggtgaattgggaaatttttaccccccttcgcgctgaactgatgtgcaccctccgcgaggttaggcaacctaagagaatcttcatcgggcccaccccatgcccatcatgcgggagttctccatccgaggagttggagctgcacctgtgctgttag

SEQ ID NO: 32178 - DNA, 1425 bp, Artificial Sequence
  Description of Artificial Sequence: Synthetic coding sequence
atgtcactccaggcacccagtagactgctggagttggctggccagtcactcctgcgcaatcagtttctcaccattttcacactggacgagctgccacgagaggtttttccattgatgttcatggaggcattttccatgcggcggtttgaagctctaaaattaatggttcaggcctggccatttctgtcactacccctggggtcactgatgaaaactctacatctcgagacattgcaagccgtccttaggggtctggacactttggtcgcccagaaggtgaggcctagaagatggaaactgcaagtgttagacctgagggacgtggacgaaaacttttggacaatctggtccggcgcccgggtgctgagctgcagccctgaagcgatgtcaaagcgccagacagtggaagattgcccaaggatgggcgaacaccagccactgaaagttttcatcgatctgtgtctgaaggagagtaccttggacgaatgcctcagctatctgttcgggtggatccactatagaagaggactggtccacctctgctgtagtaaggtccagaactactcgatgcctacatcttcttttagaaacctgctcgaacggatctacccagacagcattcaggagcttgaggtgtggaaaaaatgctccctgaacaaaacggggaaattcgctccctacctcagccagatgtcgaacctccgagagcttttcttggcatttggctatgagcgagagctttatgtatccgtgcagtggccttgcattcccgatttagattccccttttctgtgcctgtactacccgcagatgttgtatattaagaagatatctaatatcaaggaacacctagaacacctgctgcggtacttaaagaaccctcttggcgctttcattttcagtgatgcttacctcactgaccgtgacatggagtgtctaagccagtatcccagtctgtcccaactgaaggaactcaggctcatccacattcttatgtggaccactcacctggagccccttggggtgttactggaaaaagtggctgccacactgaagacgctcgtcctgaaggattgccggattcaggacccccagcttcgtgtgctgcttcctgctctctctcattgcagccaacttactaccttcaacttccatggtaatgagacatcaatgaacgccttaaaggacctgctgagacatactggcgggttaagtaaactcggattggagttatatcccgccccactcgagagcctagactataaggggcacgtgaactgggagattttgacccccataagagccgaactgatgcgaacgcttcgtgaggtgcggcagcctaagaggatcttctttggacctgtgccatgcccaaactgtggtagctggccgtctgagaaggtggattttcatctatgctcttag

SEQ ID NO: 32179 - DNA, 1434 bp, Artificial Sequence
  Description of Artificial Sequence: Synthetic coding sequence
atgaaaatgtcgattcgaatcccccctagactgctggaacttggcagaagtctgttgcgcgaccaagcccttgccgtcagcacattggaggaactccctacggagctcttcccccctctgtttatggaggctttttcacgccgtcggtgtgaagctctcaagttaatggtgcaggcctggcccttcaggagactgcctcttagaccactgatcaagatgccatgtctcgaggcctttcaagcagttttggacggcctggacgcgctccttactcagggtgtaaggcctagacgttggaaactgcaggtgttggacctgcaggacgtgtgtgagaatttttggatggtgtggagtgaagctatggcccatggatgcttcttgaatgccaagaggaataaaacccccgtacaagactgtccacgaatgagggagcgccagcctctaacagtcttcgtggagttatggctgaaaaatcgtaccctggatgaatacctgacctgtttactgctgtgggtgaaacagaggagagatctgctccacctgtgctgcaaaaagctaaagatcctaggaatgccattccgaaacatccggtctatcctgaaaatggtcaatctggactgcatccaggaagtagaggtcaactgcaaatggattctgccgatcctcacgcagttcacaccataccttggccatctccgcaatctgcagaaacttgtcctcagtcacatggacgtgtctcgctatgtgtcacccgaacagaagaaggagattgtaacccagttcacaacccaattcctgaagctccggtgtcttcagaagttgtacatgaattccgtaagttttcttgaaggccaccttgaccaacttctgtcctgcttgaaaacctccttgaaggtgctgaccattacaaactgcgttctgttggagagtgacctaaagcatctgagccaatgcccctccatatcacagctcaagactttggacctctccgggatccgcctgactaactactccttggtaccgttacagatattgctggaaaaagtggccgccactctggaatacttggacttggatgattgtgggataatcgactcccaagtgaacgccatattgcctgcactatcgcgatgttttgaattgaacaccttcagcttctgtggtaacccgatctgtatggctactctcgagaacctgttaagccacacaattatcttaaagaacctctgcctagagctgtatcccgcaccacaggagtcctatggcgccgatggaaccctgtgctggtctcggttcgcccagatacgcgcagaattgatgaaaaaggtcaggcacctgcgtcaccccaagcggatcctgttttgcactgataattgccctgatcacggcgaccggtctttctatgatttggaggctgatcagtactgttgctag

SEQ ID NO: 32180 - DNA, 1308 bp, Artificial Sequence
  Description of Artificial Sequence: Synthetic coding sequence
atggaagcgttctcacgtcgccgatgcgaggctctgaagctgatggtccaggcatggccatttaggaggttgccccttcgacccttaattaagatgccttgcctggaagcttttcaagccgtattggatgggcttgacgctctgctcactcagggcgtgcgaccacgtagatggaagcttcaggttttagatctccaggatgtctgtgagaacttttggatggtgtggagtgaggcaatggcacatggttgtttccttaacgccaagagaaataagactcccgtccaggactgtcctaggatgagagaacgtcagccccttaccgtgtttgtggagttatggctgaagaatcggaccctagacgaatatctcacctgcctcctgctttgggtgaagcagcgtcgagatctcctgcacctctgttgtaaaaaactgaagatcctggggatgccttttagaaacattagaagcattctgaaaatggtcaatctcgactgcatccaggaggttgaggttaattgtaagtggattctacctatccttacacagttcaccccatatctcggccacctgaggaacctgcaaaagttagtcttaagtcacatggatgtgtccaggtacgtttcccccgagcaaaagaaagagattgtcacccagtttaccactcaatttctgaaactgagatgtctgcagaagctatacatgaattcagtctcatttctggagggacatctggaccagctgctgagctgcctgaagacctctctcaaggtgctcactatcactaactgcgtactcctggaaagtgatcttaagcacctgagccagtgcccctcaatcagccaactgaaaactctagacctctctgggatccgcctcactaactactcgctggttccactgcagatactgctggaaaaggtggctgccaccctggaatatctggatctggatgactgtggtatcatagactcacaggttaatgcaattctaccggccctgtctcggtgcttcgagctaaacacctttagtttttgtgggaacccaatatgcatggccacactggaaaatcttctgtcacacaccattatccttaagaatctctgcctggaactgtatccagcaccacaagaaagctatggcgctgatggcactctttgctggtctcgtttcgctcagatccgcgctgaactgatgaaaaaagttcgacacttgagacatccaaagagaattctgttctgcaccgataactgcccggaccatggcgacaggtcgttctatgatttagaagctgaccagtattgctag

SEQ ID NO: 32181 - DNA, 1311 bp, Artificial Sequence
  Description of Artificial Sequence: Synthetic coding sequence
atggaggctttcagcaggaggaggtgcgaggccctcaaattaatggtccaggcttggcccttcagacgactgccactgagaccgttaatcaagatgccatgtctggaagcctttcaagcagttttagacggactcgatgctcttctcactcagggtgtaagacccagaaggtggaagttgcaggtgttagaccttcaggacgtttgtgaaaatttctggatggtgtggtccgaagcgatggctcacgggtgctttctcaatgcaaaacgcaataagacacctgttcaagactgcccgcgcatgagagagcgtcagcccctgacagtgtttgtggagctctggctgaaaaatcgaaccctggatgagtacttgacatgcctcctactctgggttaagcagaggcgggacttgctgcacctctgctgcaagaaactgaaaatcctcggaatgccttttcgtaatatcagatcaatcctgaagatggtcaacctggattgtatccaggaggtagaggtcaattgcaaatggattctccctattttgacccaatttacaccctacctgggacacctgcggaacctgcagaagctcgtcctttcccacatggacgtgtcaagatatgtctccccggagcagaagaaggagattgtcactcagtttacgacccagttcttgaaactcagatgtctccagaagctttacatgaatagcgtgagttttttagaagggcacctggaccaactgctgtcttgtcttaaaacatctctgaaagtgttgaccattaccaattgcgtcctccttgaaagcgatctgaagcatctatcccaatgtccttcaatctcccagctgaagactcttgatctcagcgggattcggctgacgaactactccctggtgcccttgcaaattctgctcgagaaggtagccgcgacgctagaatatttggatctcgacgattgtggaatcatcgattctcaggtaaacgcgatcctcccagccctttccaggtgctttgagttaaatacttttagcttctgcgggaatccaatctgtatggctaccttggagaacttattaagtcacaccattattctcaagaacctgtgccttgagctgtatcctgctcctcaggaatcatacggtgcggatggcactctttgttggtctaggttcgctcagatccgcgcagagttaatgaaaaaggtgcgacatttgaggcatccaaagcgaatcttgttctgcactgataattgtccggatcacggcgaccggtctttctatgacttagaggccgaccagtattgttgctag

SEQ ID NO: 32182 - DNA, 1452 bp, Artificial Sequence
  Description of Artificial Sequence: Synthetic coding sequence
atgagccttcaagcacccccacggctcttggagcttgcggaacaaagtctgctgcgggacagagcattggctatacctactctcgaggagctcccgcgagaactcttcccgccgctgtttatggaggccttcacccgccgttgttgcgaaactctgactactatggtgcaagcttggccattcacttgtctgccgcttggatcactcatgaaaagctgtaacctagagatattccgcgccgttctggaggggctggatgcactgctagcacagaaagttcgcccacgtcgttggaagctgcaggtcctagatctacgtaacgtggatgaaaacttttggggaatttggtccggcgcctcagctttgagccctgaggcgttgagtaagcgccgtacagcggggaattgcccccggccggggggacagcagcccctcatggtgatcctcgatctgtgcttcaaaaatgggatgctggacgagtgtctgacacattttttggagtgggggaaacaacgaaaggggctgcttcacgtttgttgtaaagagttgcagattttcgggattgccattcaccgtatcatcgaggtcctaaacacggtggagttagattgtatccaggaggtggaagtatgctgcccgtgggagctttctattctcatcaggtttgctccgtatctcgggcagatgcgaaacctgcgtaagctggtactgtttaatattcacgtttcagcctgtatccccctagaccgtaaagagcaatttgtaattcaatttactagccagttcctgaagctcgactatttccagaagctctacatgcattcagtgagttttctggagggtcacctagaccagctgctgcggtgtctgcaggcacctctggaaaccgttgttatgacagaatgtttactcagcgaatccgacttgaagcacttaagctggtgtcctagtattcggcagttgaaggagcttgacttaaggggcattacactgacccatttttcgccggagccactcagcgttcttctcgaacaggccgaggctactctgcagaccctcgacctcgaagactgcggaatcgtcgattctcaactgtctgccatcctgccggcactcagccggtgtagccaactgtccacctttagcttttgtggaaatcttatttccatggctgcactcgaaaatctgctgagacataccgtgggccttagtaaactatctctggaactctatccagccccgctggagtcatatgacgcgcagggagccctctgctgggggcgcttttcccagctcggcgcagagctgatgaaaacactgagggatctccgccagcctaaaatcatcgtgttctctaccgttccgtgccccagatgtggaattagagcaagctacgacctggagccatcccattgtctgctgaatgcctgctgtcagggaggctttatttag

SEQ ID NO: 32183 - DNA, 1425 bp, Artificial Sequence
  Description of Artificial Sequence: Synthetic coding sequence
atgagcatccaagcacccccccggctcctggagttggcaggacagtccctattgagagatcaggctcttagcatctctgcaatggaggaacttccacgagtcctgtaccttcccctgtttatggaggcatttcggcgaagacacttccaaaccttgaccgtcatggttcaggcgtggccatttacttgcctgcccctagggagcctgatgaagactcttcatctagaaacacttaaagccctgcttgaaggcctgcacatgctcttaacccagaaggaccggcctaggcgctggaaactccaggttctggatctgagggacgtggatgaaaacttctgggctaggtggcctggtgcatgggctttgtcatgcttcccggagacaatgagcaagcgtcaaactgcagaggactgtccacggatgggcgaacaccagcctcttaaggtatttattgacatttgcttgaaagagataccccaggacgaatgtctgcgatacctctttcagtgggtttatcagagacggggtctggtgcacctatgctgctccaagcttgttaattatcttacccccataaagcacctgcgcaaatccttaaagattatatatctgaacagcatccagcaactggaaattcgaaacatgtcttggccccgcctgattcggaagttgaggtgttacttgaaggagatgaagaatttgaggaaactcgtgttctcacggtgccatcattctatgagcgacaacgagctagaggggaggctggtgaccaaattctcctccgtgttcctgaggctcgaacacctacagctgctgaaaatcaaactgatcacattcttcagtgggcatcttgagcagttgatcaggtgcctgcagaatcccctggagaaccttgagctaacctacgggtatcttctggaggaggatatgaaatgcctgagtcaataccccagcctagggtacctgaagcatcttaacttaagctatgttctgctcttccgcatttccttggagccattgggcgccctgctcgagaagatcgccgccagcctggagaccctaatcctcgagggatgtcagatccactactcacaattgagcgctatccttcctggactcagccattgtagccagcttacaaccttttattttggtcggaattgcatgagcatgggagccctcaaggatctgcttaggcacacatcgggtctgtctaagctttcactggaaacttaccctgcaccagaagagtcgttaaacagcttagttagagtcgattgggagatttttgctctcctgcgcgccgaactaatgtgtacgctgcgagaggttcgacagcccaaaaggattttcatcgggccgacgccgtgtccaagttgtggtagttctccttcggaggagctggaactacacttgtgctgttag

SEQ ID NO: 32184 - DNA, 1425 bp, Artificial Sequence
  Description of Artificial Sequence: Synthetic coding sequence
atgtctattcaggcaccacctaggctgctcgaacttgcgggacaatccctgctccgcgatcaggcactctcaatctctgctatggaagagttgccacgcgtgctttatcttcctctgtttatggaggcctttagaaggaggcattttcaaactcttacagtgatggtccaggcctggcctttcacatgccttcctttaggcagtttgatgaagaccctacacctcgaaactttaaaagccctcctggagggcctacacatgctgcttacacagaaggaccggccccgacggtggaagctgcaagtcctggacctccgcgacgtggacgagaatttctgggccaggtggccgggcgcttgggctctctcctgcttcccagaaacgatgagcaaacggcagaccgcagaagactgcccccggatgggcgaacaccagcccctgaaggtctttatcgatatctgcctgaaagaaattcctcaggacgagtgcctgagatacttgttccagtgggtgtaccagagaagaggacttgtgcacctttgttgcagtaagttagtgaactacctgacacccattaagcacctccggaagtccctcaaaattatttatctgaactccattcagcaattagaaattagaaatatgtcctggccgaggctgatacgaaagttgaggtgctatttgaaggaaatgaaaaaccttaggaaactcgtattttccagatgtcatcattccatgtctgataacgagctggaaggacgattagttaccaaattctcttcagtgtttctgcggctagagcacctccagctccttaagattaagttgataacatttttctctggccacctcgaacagttaatccgatgccttcagaacccattggaaaacctggagctcacttatggataccttctggaggaggacatgaaatgtttgtctcagtacccaagtttaggatatcttaagcatcttaacctgtcctatgtgctgttgttccgaatttcgcttgaaccactgggagccttgctagagaaaattgcagcctcactagagacccttatacttgaggggtgtcagatccattacagtcagctgagcgcgatcctgcccggtctgagtcactgctcacaactcaccacattctatttcggaaggaactgcatgagcatgggcgcactaaaggacttgctgtgccatacttctgggctctctaagctcagcctcgaaacatatcccgctcccgaagagtcgttgaacagtctcgtgagagtcgattgggagattttcgcactgcttagagcagaattaatgtgtacattacgtgaagtgaggcagcccaagcgaatctttatcggacctacaccctgtccctcctgcggttcaagtcccagcgaggagttggaattgcacttgtgttgttag

SEQ ID NO: 32185 - DNA, 1281 bp, Artificial Sequence
  Description of Artificial Sequence: Synthetic coding sequence
atgtccattcaggctccgccgagactgctggaactggctgggcagagtctactccgtgatcaggcgttgagcatctccgcaatggaggagctaccaagagtactctatctgcccctgttcatggaagctttcaggcgcaggcattttcagacccttacagtgatggtccaggcttggccttttacctgcctgcccctcggatcccttatgaaaaccctacacctcgaaaccctcaaggcactgctagagggcctgcacatgttgctcacacaaaaagatcgcccgcgccgctggaaactccaggttctggacttgcgagacgtggatgagaatttctgggcgcggtggcccggtgcatgggcgctgtcctgtttcccagagactatgtccaagcgtcagacagccgaggattgccctagaatgggtgaacaccaacctttgaaggtcttcatagatatttgtctgaaggagataccgcaggatgaatgtcttcgatatctgttccagtgggtgtaccagagacgtgggctggtgcacctgtgctgcagcaaactagtgaattatctgacaccaatcaaacacctccggaaatccctcaaaataatctatcttaacagcattcagcaactggagatcaggaacatgagttggccgcgcctgatacgcaaattacgctgttatctgaaagagatgaaaaacttaaggaaattggtgttttcccggtgtctccagaatccgctcgagaaccttgagcttacttacggctatctccttgaagaggacatgaagtgcttgagccagtacccctctctaggttacctgaagcaccttaacttatcatacgtcttgctgttcaggatctcactcgaaccactcggtgctcttctcgagaagatcgctgcttccctcgagacccttatcctggaaggctgtcagatccactattcccagctttctgctatcctccccgggttgagccactgttcccaactgacaactttttactttggaaggaattgtatgtcgatgggtgctctgaaagacctcctgtgccatacttccggacttagtaagctcagcctggagacttaccccgctcccgaagagtccctcaacagtctagtgagagtggattgggaaattttcgctcttctgagagctgaattaatgtgcacactgcgcgaggttcggcagcccaagcgaatcttcattggtcccaccccctgtccaagctgtggcagcagtccatccgaggagttggagttacatctgtgctgttag

SEQ ID NO: 32186 - DNA, 1437 bp, Artificial Sequence
  Description of Artificial Sequence: Synthetic coding sequence
atgaagatgtctatccggacacccccaagactcctcgaactcgccggcagatctctgctgcgagaccaggcgctggctatgagcacactggaagagctcccgaccgagttgttcccccccctgttcatggaggctttctctcgcaggcggtgtgaggcccttaagctgatggtgcaagcctggccgttccgtagactgcccttacgcccactcataaagatgccatgtctggaggcatttcaggccgtcttggatggactcgacgctcttcttacccaaggcgttcgcccacgaagatggaagttgcaggtcctggatctgcaggatgtctgcgaaaatttttggatggtgtggtctgaggctatggctcatggctgctttctcaacgctaaacggaataaaaaaccagtgcaggactgccctagaatgagaggtaggcaacctctgaccgtgttcgtcgaactatggttaaagaaccgcactctcgatgagtacctgacctatcttctcctgtgggtaaaacagaggaaagatctgctgcatctatgctgtaagaagctcaaaattctcggtatgccttttaggaatattagatctattctgaagatggtgaatctcgattgcatacaggaagtggaagtgaactgtaagtgggtactgcctatactaacacagttcaccccctacctgggtcacatgagaaatctgcagaagctagtcctgtctcatatggacgtgtcaaggtacgtttccccggaacagaaaaaggaaatcgtgacccaattcacgacacaattcctgaagctgcggtgcttacagaaactttatatgaattccgtctcctttctggagggacatttggatcagcttctgtcctgtctcaagacttccctcaaagtacttactattactaattgtgtgttgctggaaagcgacctcaagcatctgtctcaatgcccaagtattagccagttaaagacactggatctgagtgggatcaggctgacaaactatagcttggtgcctctccagatccttctcgagaaagttgctgcaactctggaatacctcgacctcgacgattgcgggataattgattctcaggtgaatgccattctgcctgcactttcccggtgctttgagttgaacaccttctccttttgcggaaacccaatctgcatggccacactggagaatctgctttcacatactattattctgaaaaacctttgtgtggagctctacccggctccgcgagagagttacggcgcagacggaactctgtgctggagtagattcgcccaaattcgtgcagaactcatgaaccgcgtacgggacctgcgccaccccaaacgcatcctgttttgcacagattattgcccggactgcgggaacagaagcttctatgatctcgaagctgaccaatattgctgttag

SEQ ID NO: 32187 - DNA, 1437 bp, Artificial Sequence
  Description of Artificial Sequence: Synthetic coding sequence
atgaagatgtcaattaggactcccccaaggttactagaactcgctggacgtagtctactgcgcgaccaagcacttgcaatgagcaccctggaggaactgcctaccgagctcttcccaccgcttttcatggaggccttctctaggcgtcgttgcgaagctctaaagctgatggtgcaggcttggccgttcaggaggctcccacttcggccactgatcaaaatgccatgtttggaggctttccaggctgtacttgatggacttgacgcgcttctgactcaaggggtccgtcctcgcagatggaagctgcaagtgcttgacctgcaggatgtctgtgaaaatttttggatggtctggtctgaagctatggcacacggttgtttcctcaatgctaagcgtaacaaaaagcctgtacaggattgtccgcgcatgcgagggcggcagcccctgactgtgtttgtcgagctgtggctgaagaaccgcaccctggacgagtacctgacttacttgctgctgtgggttaagcaaaggaaagatcttcttcacctctgttgtaagaaactgaaaatcctcggtatgcccttccgcaacatccggtccatcctcaaaatggtaaatttggactgcattcaggaagttgaagtgaactgtaagtgggttctcccgatcctaacacaattcacaccgtacctgggccacatgaggaatctgcaaaaactagtgttatctcacatggacgtgtcaagatatgtcagccccgagcagaagaaagagatcgtaacccagttcacgacccagttccttaaattgagatgtctacagaaactgtatatgaacagcgttagtttccttgagggacatctggatcagttgctcagttgccttaaaacgtcactgaaggttttaactattacaaactgtgtgttattagagtctgacctgaaacatctgtctcaatgccctagcatttctcaactgaaaaccctcgacctgtcgggtataaggttaacaaattattcgctggtgcctctgcagatccttcttgagaaagtcgcggccaccctcgaatacctggatctggatgactgtggaataatagattctcaggtgaacgctatcctccctgccctgagccgctgtttcgaactgaatacattctccttctgtggcaatcctatttgtatggctacacttgagaacctgctatcccacaccattatcctgaagaatctgtgtgtggaactgtaccctgcacccagagagagctacggggctgacggaacactctgctggtcaagattcgcccagatccgagccgagcttatgaaccgcgttcgggacttgcggcatcccaaacggattctcttctgcacagattattgtcctgattgcggcaacagatcattttacgatttggaggcggatcaatattgctgttag

SEQ ID NO: 32188 - DNA, 1425 bp, Artificial Sequence
  Description of Artificial Sequence: Synthetic coding sequence
atgagtctgcagtcacctagcaggttacttgaattggcaggacagtccctcctgcgcaaccagttcttaaccatcttcattctcgacgaacttcctcgagaggtgttcccactgatgtttatggaggcatcgagtatgagacacttcgaagctctaaaactcatggtgcaggcgtggccattcctccggttaccactgggaagcctgatgaaaactccgcacctcgaaaccctgcaggctgtgttgaaaggattggatactttactggcacagaagctcagacctcgccggtggaagctccaggtgcttgatctgcgcgatgtagacggtaatttttggaccatatggagcggtgcccgggctctatcctgtagcccagaggcgatgaggaagcgacagaccgttgaagattaccccagaacgggggaacatcagccactcaaggtgttcatcgatctttgccagaaagaatcaacactcgacgaatgcctgagttacctgtgtcgatggattcactataggaggggtttagttcatctctgctgcaacaaggtgcagaattacagtatgccaacatcaagcttccgcaacttactgaagagggtataccctgactccatccaggagctcgaaatcaagaggaaatgttcacttaataaaacaggcaagttcgccccctacttgtcgcagatgagcaacctgagaaaattgtttttggctttcggttacgacgacgagctatatgtctcaggacagcaacagtttgtgcctgacttagactgcccctttttatgcctgtactacccccagatgctgtacatcagaaaaattagcaatatcaaggaacacctggagcatctgctgcgctgcctcaagaaccccttgggcacttttattttttgtcatgcatacctggctgatcaggatatggaatgtctgagtcagtacccgtcgctttcacagctgaaagaacttcacctgatacacattctcatgtggaccaccaatctggaacctctgggcgcactgctagagaaggtggccgcgacactcgagatcctgactctgaaggactgccagattcaagattctcagctgagagtgctgctgcccgctctcagccggtgctcacagctgactacattttactttaggggcaatgagacttcaacaaacgccctgaaagatctcctgtgccatacaggtggcctttccaaacttggacttgaactatatcccgcacccctggagtgcctggataaccgggggcacgtgaactgggaaatactggctcccattcgcgctgagctgatgtgtacactgcgtgaggtacgccaacccaagagaatcttctttgggccaattccctgtccttcatgtgggtcctggccctctgagaaggtagatttccatttatgcagctag

SEQ ID NO: 32189 - DNA, 1425 bp, Artificial Sequence
  Description of Artificial Sequence: Synthetic coding sequence
atgtctctccaatcgcccagcaggcttctcgaactcgcagggcagtctttgctgagaaatcaattcctcacaattttcatcctggacgagttacctcgggaggtctttcccctgatgttcatggaagcctccagcatgcgtcatttcgaggccctgaagctaatggtgcaggcatggccgttcttgcggctacccctgggctccttgatgaagactccccacctcgagactctacaagccgtgctgaaaggactggatactctgttggcacaaaagcttagacccaggaggtggaagctccaagtgcttgatctgagggacgtggacggcaacttctggacgatatggagcggggcccgggcactctcctgttctcctgaggccatgtccaaacggcagaccgtggaggactatccccgcactggcgagcatcagcccctgaaagtgtttatcgacctctgtcagaaagaatcaacactggacgaatgtctgtcatatctgtgtagatggatccactaccgtcgaggtctggtccatctgtgttgcaacaaagttcagaactactcaatgcctaccagctcattccggaacctgcttaaaagggtctaccccgacagcattcaggaactggaaattaagcgaaagtgttctctaaacaaaacggggaagttcgccccatatttaagccagatgtctaatctacggaagctgtttctagcttttggatacgatgatgagctgtatgttagcggccagcaacagttcgtgcctgacctggactgcccgttcctgtgtctgtattaccctcagatgttgtacatccgcaaaattagtaatatcaaagaacatctcgaacacctcttgagatgccttaaaaatcctcttgggaccttcatcttttgccacgcttacctggctgaccaggacatggagtgcttgtcccaatacccctctctgtcacagctcaaggagctacacctaatacacatactgatgtggactaccaatcttgagcccctaggcgcactcctggaaaaagttgcggctactctcgaaatcttaaccctgaaggactgtcagattcaagattctcagcttcgtgtgctgctcccagcgctgtctagatgcagtcagttgacaaccttctacttcaggggaaacgagacaagcaccaatgccttaaaagatctactgtgccataccggcggattgagtaaattgggtctggaactctatcccgctccacttgaatgcctggataacaggggccacgttaactgggagattctggcacctattcgcgccgagctgatgtgcactctgcgcgaagtaagacagcccaaaagaatctttttcggcccaattccctgcccctcttgtgggtcatggccctccgaaaaagtggattttcacttgtgctcatag

SEQ ID NO: 32190 - DNA, 1440 bp, Artificial Sequence
  Description of Artificial Sequence: Synthetic coding sequence
atgagttttcaggccccaaggagactgctcgaactagccggccaatcgcttctcagagaccaggctctggctatctcagttttggacgaactccccagagagttatttccacggttattcgtggaggcgttcaccagccgtaggtgtgaagtcctgaaagtgatggtgcaggcctggccatttccgtgcttgcccctgggctcccttatgaagacgccagatttagagattctgcattacgtcgttgacggaattgactgcctgctcgcccagaaggtgcgccctaggcgatggaagctccaagtcctggaaatgagggatgtcgatgagaacttctggaccatctggtccggcgcgcgacctctgtcttgcagtccggaagccatgtctaagcggcagaccgtggaagattgtcctcggacaggagaaaagcaacctctgaaagtgtttatggatgtgtgcctgaaagagaagtcggtcgatgaagatttgagctttttctccggctgggtgcagcacagaagacgcagcgttcacctctgttgcacgaaagtcgttaactactccatgaatattctgaacttccggaatatcctcgagactgtgtaccccgacagcatccaggtgctggagatctggaacatgtgttggccttgtatggtggccgaagtgtcacgttatctgtcccagatgaagaatctgcggaagctgttcatctctgacggctgtggatatctcccatcattcgaaagtcaaggacagctcgtggccgaatttagcagcgtgtttctcagattagagtacctgcagatgctttatatgcggagaattcgtttcttcgaaggctacttagaccaacttatccggtgcctgaagagcccgctggaaacattggctttaacttatggctcactggatgaagaagatctcaaatgccttccatggtacccttcactgagccaactgaagcagttgaacctcagccatggaactctgaggtttattaggcttgagcctcttagggccctccttgagaaagtagcagctactctgcaaacactcttcctggtcgactgcggcataggggatagcaagttacgggtgatcctgccggctctctcaaggtgttcgaaccttacaacattctgctttcacggcaatgacacttctatggatggattgaaagatctgctgcgccacaccggacgactgtccaatctcagcctggagacttaccctgccccaagagagtccctcgataatcgaggcagggtgattagtgaattacttacccccctgcaggccgagctcatgcgtatcctgcgcgaggtccgcgagcccaatcgtattttctttggacctgtgagctgcccctgctgtggtatgagccccactgagcagctcgaatttaatttttgcctgaggggaaggcccgcctag

SEQ ID NO: 32191 - DNA, 1233 bp, Artificial Sequence
  Description of Artificial Sequence: Synthetic coding sequence
atgaagacccccgatcttgagatcctgcactatgtcgttgatggaattgactgcctattggcacaaaaggttcgcccccgccggtggaaactgcaagtgttggagatgcgggatgtcgatgaaaacttctggacaatatggtctggggcccgccctctgtcttgcagtcctgaagctatgagcaaacgccaaaccgtggaagattgtcccaggacgggcgaaaagcagccacttaaagtgttcatggacgtgtgcctgaaggagaaatcagtcgacgaggacctgtcatttttcagcggctgggtccagcaccgaaggagatctgtgcatttgtgctgtacaaaggtcgtaaactattccatgaatatacttaactttcgcaatatcctggaaacagtttatcccgacagcatccaagtgcttgagatctggaatatgtgctggccatgcatggtggctgaggtcagccgctatctcagccagatgaagaacctgaggaagcttttcatcagcgacggctgcggctatctgcccagtttcgagtcacagggccagctggtcgcggaattctcttccgtgtttctgcgactggagtacttgcagatgctttatatgaggagaatccggttcttcgagggatacctggaccagctaatcaggtgtctcaaatctccactggaaactcttgcccttacatatggcagcctagatgaagaggaccttaagtgtctgccatggtaccctagcctttctcagctgaaacagttaaacttaagtcacggaactttgaggttcatacgtctcgagcctcttcgggctttacttgaaaaggtggcagctactctgcagaccttatttttggttgattgcggtatcggttattccaaactccgcgtgatcttaccagctctgtcccgttgttcaaatctgacaaccttttgtttccatggcaacgacacctctatggatggtctgaaggacctgttgagacacaccgggcggctgagcaatctgtccctggaaacctatcccgcacccagggagagtctggataacagagggagggtgataagcgagctactgactccgttgcaggcggaactcatgcgtattctgagggaggtgagggagcccaataggatcttctttgggcccgtgtcgtgcccctgctgcgggatgtcaccgactgaacagctcgagttcaacttttgcttgcggggcagacccgcatag

SEQ ID NO: 32192 - DNA, 1440 bp, Artificial Sequence
  Description of Artificial Sequence: Synthetic coding sequence
atgagttttcaagctcctagaaggctgttagaactggccggtcaatccctgcttcgtgatcaggctctcgccattagtgtactagatgagctcccacgggaactattccctcggctatttgtcgaagcctttacatcaaggcgatgtgaagtgctaaaggtaatggtccaggcatggcctttcccctgccttcctttagggagcttgatgaagacacctgaccttgagatactgcactacgtagtagatgggatcgattgtctcctggcccagaaggttcgtcctcgcagatggaagttgcaagtgctggagatgagggacgtcgatgagaatttttggacaatctggtccggtgcccggcccctaagctgctctccagaggcaatgtccaagcgtcagacggtggaagattgtccccggacgggagaaaagcagccgctcaaggtgttcatggacgtgtgcctcaaagaaaagtccgtcgacgaagacctgagtttttttagtggctgggtccagcacaggcggcggtcggtacatctttgctgtacaaaagttgtgaattactcaatgaatattctgaatttcagaaacatcctggagactgtctaccctgactctatccaggtcttggagatatggaacatgtgctggccatgcatggttgccgaggtcagcagataccttagccagatgaagaatctgcgcaaactgttcatttctgatggctgtgggtacctaccgagctttgaaagccaagggcaactggtggctgagttcagcagcgtgtttctgcgacttgagtatttacagatgctctacatgcggcgcatccgcttcttcgaggggtatcttgaccagcttattaggtgcctaaagagtcccttggaaactctagccctgacatacggctcacttgatgaagaagacctgaagtgtttgccctggtatccaagtctgtcccagttgaagcagctgaatctgtctcacgggacattgcggttcatccgcctggaacctctgagggcactgcttgagaaagtggcagccacactacaaacgctgttcctggttgactgcgggattggctactccaagttacgggtcatactgcccgcactgagtaggtgctcaaatcttactacattttgcttccacggtaatgacacttccatggacggcctaaaagacctgctgaggcataccggcagactgtcgaatctcagtctcgaaacatatcctgccccccgggaaagccttgataatcgcgggcgcgtcattagcgagctgcttaccccgctgcaggccgagctgatgaggattcttcgggaggttagggaaccaaatcgcatcttcttcggacctgtgagttgtccctgttgcggaatgagtccgacagagcagctggaatttaacttctgcttaaggggccgacctgcctag

SEQ ID NO: 32193 - DNA, 1425 bp, Artificial Sequence
  Description of Artificial Sequence: Synthetic coding sequence
atgtcaatccaggcaccaccgaggctactagaacttgctggccagtccctgctgcgggaccaggccctgagcatctctgccatggaggagctccctcgagtgctttacctccccctgtttcgtgaggctttctctcgaagacatttccaaactttaacagtgatggtccaggcctggcctttcacatgtctaccccttgtgtctctcatgaagacgcttcacttggaacctctgaaggctctcctggaaggactgcatatgctgctaacacagaaggaccggccacgcagatggaaactgcaagtactcgacctgagggacgttgatgagaatttttgggcacgctggccaggggcatgggctcttagctgtttcccagaggccatgagcaagcgccagactgctgaggattgccctaggactggggagcaccaaccattaaaagtctttattgacatctgcttgaaggagattcctcaagatgaatgcctgagatatttgttccagtgggtctaccaaagacgcgggttagtgcacctgtgctgcagtaaactggtcaattatctcacaccaataaaatacctgcgaaaatcccttaagataatttatataaacagcatcggagaactggagattcacaatacctgctggcctcaccttattaggaaactctactgctatctgaaggaaatgaagacgctgtgtaagctggtatttagtagatgccaccactatacctcggacaacgaactagagggttggctggtcacacggttcacctctgttttccttcgtttggaacacctacagcttctgaaaatcaagctgatcaccttcttctccggccatttggaacagctcattagatgcctgcagaaccctcttgaaaacttagaactcacatgcggtaacctgttggaggaggatctaaaatgcctgtctcagttccccagtctaggctatctgaagcacttgaatttgtcttatgtactattgtttcggatttctctggaacctctgggcgccctgttagagaagattgctgcatcgttggagacactggtgctcgaggggtgtcaaattcactatagtcagctcagtgccattctgcctggccttagctgctgctcccagttgaccacgttttatttcggctccaactgtatgtccatcgatgccctgaaggacctgctgaggcatacaagcggcctctcaaaacttagcctggagacgtaccctgccccagaagagtctctgaactctcttgttcgtgttaattgggaaatcttcacgccactacgagcagagttgatgtgtaccctgcgagaattccgtcagcccaaacgcatcttcattggtccgactccatgcccatcttgcgggtctagcccttctgaggaactcgagctccatctgtgctgctag

SEQ ID NO: 32194 - DNA, 1428 bp, Artificial Sequence
  Description of Artificial Sequence: Synthetic coding sequence
atgtctatcagaacacccccacgccttctggagctggctggtcgctctcttttacgagacgaggccttagccatttccacactcgaggaactccccaccgaacttttcccgcctctctttatggaggccttcagtcgtcgccactgcgaagccttaaaactcatggtgcaggcctggccgtttcttcggttacccttaggttccctgatgaagcggccttgtccggagactttccaggctgtccttgacgggcttgacgcactcctgactcaccgagtacgactgcgcaggtggaagttacaggttctcgatctgcaggatgtctccgaaaacttttggatggtgtggagcgaggctatggcaagacgctgtctgcccaacgccatgatgaatcgtaaacctgtacaggattgtccaagaatgagagggcagcagccgttgacagtcttcattgacctgtgcctgaaaaacagaaccctggatgagtatttcacctgtctgtttctgtgggtcaaacagagggaggggctcgtgcacttgtgttgtaaaaaacttaagatgttaggcatgctctttcataacatcaggaacatactcaaaaccgtgaaccttgactgcattcaggaggtcgaggtcaactgcaattggacacttccagtcctcgccgaatttaccccctacctcgggcagatgcgcaaccttcggaagcttgtcctctctgatattgatagccgctatattagcccggaacaaaaaaaagagttcgtgacccagtttacaacccaattcctgaaactgcgctgtcttcagaaactttatatgaactcagtcagcttcctggaggggcacctggatcagatgctgagttgcctgaaaacgtcccttaacatactggcaatcacgaactgcgtcctgctggagtcggatttgaagcacttgtccaagtacccgtcaatcggccagctgaagactttagacttgtcaggaactcgccttgccaacttcagtctggtcccacttcaagtgctgttggagaaggtcgctgccacattggaatacctggaccttgatgattgcggtattgtcgatagtcaggtcaacgccatcttgcctgctctctctcgatgttttgaactgacaacattttcgtttaggggcaatcccatttccactgccaccctggagaatttactctgccacacaattcgcttaaataatctgtgcctcgagctataccccgcccccagggagagctatgatgtccggggaatcgtgtgtagatcaaggtttgcccagctgggagctgagcttatgggtagagtccgggctctccgggagccggaacggatcctcttttgcaccgattattgtccccagtgcgggaataggtcactgtacgacctggaggtggacagatgttgctgctag

SEQ ID NO: 32195 - DNA, 1428 bp, Artificial Sequence
  Description of Artificial Sequence: Synthetic coding sequence
atgtctattcggacgccgcctcgcctgctggaactcgccgggcgtagcttactccgggacgaggccctcgctatatccaccctggaggagctacccactgagttgttcccccccctgttcatggaggctttcagccggaggcactgcgaagccctaaaactgatggtgcaagcttggcctttcctgagacttcctctggggtcattgatgaagaggccctgtcctgaaacgttccaggctgtgctggacgggctggacgctctcttgactcatcgagttagattacgccgttggaaattacaagtcctggatctccaggatgtgtccgagaacttctggatggtgtggtctgaagctatggcacgcaggtgtctgcccaatgcaatgatgaatcggaagccagtgcaggactgtccaaggatgcgcgggcagcagccattaaccgttttcatcgatttgtgccttaagaatcgcactttggacgaatatttcacatgtttgtttttgtgggtgaagcagagggaggggcttgtgcacctgtgttgcaagaagcttaagatgttgggcatgctatttcacaacataaggaacattctgaagacagtgaacttggactgcatccaggaggtggaggtgaactgtaattggactctaccagtcttggctgaattcactccctacctgggtcagatgaggaatctgagaaagctggtgctctccgacattgactctaggtacatcagtcctgagcaaaagaaggagtttgtgacacagttcaccacccagttcttgaagctgcgctgtcttcagaagttatacatgaactcagtatcttttctcgaaggccatctggatcaaatgctttcttgcctgaagacttcccttaatatcctggcgattacaaactgtgtattgttggaaagcgatctgaaacatctgtcaaagtatccctccatcggacaattgaaaacccttgacctgtctggtaccaggctcgcgaacttctctcttgtccctctccaggtgcttctggagaaggtcgcagcgactcttgagtatctcgatctcgatgattgtgggatcgtggactctcaggtcaatgccatcctaccggcactgtcgcgctgttttgagttgacaaccttttcttttaggggtaaccctatttcaacggcaaccctagaaaatctgttgtgccacaccatccgtctgaacaatctatgtttagaactataccctgccccccgcgagagttacgatgtgagaggcattgtgtgccgaagcaggttcgctcagctcggagctgaactaatgggaagagtgagagcactgcgcgagcccgaaagaatcttattctgtaccgactattgtccccaatgcggaaaccgaagcttatacgacctagaagtggacagatgctgttgttag

SEQ ID NO: 32196 - DNA, 1428 bp, Artificial Sequence
  Description of Artificial Sequence: Synthetic coding sequence
atgtcaattaggacccctcctagactcctcgaactggcagggagaagtcttctccgggacgaggccttggcaatcagtactctggaagagctgcccactgaactgttccccccactctttatggaagctttctcaagaaggcactgtgaagccctgaagctgatggtgcaggcctggccgttccttcgcctgcctctggggtccctgatgaaacgcccttgccctgagacattccaggctgttctagatgggttggatgccctcctgacacaccgggtccggttgcggcggtggaaattgcaggttctggatctccaagatgtcagcgaaaacttttggatggtctggagtgaagctatggcccggaggtgcctgccaaacgccatgatgaatcgtaagcccgtgcaggattgtccacgcatgcggggccagcagcctctaaccgtttttatcgacctgtgcttgaagaaccggaccttagacgagtactttacatgtctcttcctatgggtcaagcagagagaggggttggtccacctctgttgcaagaagctgaagatgctgggcatgctgtttcacaacattaggaacatcctgaagactgtaaacctggattgtattcaggaggtagaggtcaactgtaattggacattaccagtgctcgccgaatttacaccttacctgggccaaatgcgtaacttacgaaaactggtgctatcggacatcgactcccgttatatcagccccgaacagaagaaggagttcgttacccagttcactacccagtttctgaaactgaggtgcctacagaagctgtacatgaatagtgtttccttcctcgaagggcatcttgatcagatgctgtcatgtctgaaaacatctctcaacattctagccatcacaaattgcgtgctgttggagagcgacctcaagcatctgtccaagtatccatccatagggcagcttaagactcttgatctttcggggacgagactcgctaacttcagcctcgtacccctgcaggtactgctcgaaaaggtagcagccactctggaatacctggatttggacgactgtgggattgtggatagccaagtgaacgctatactgcccgctcttagccgctgcttcgagcttactacattcagttttaggggtaaccccatcagcaccgctactctagagaatttactgtgccatacgatacgactgaataacctgtgtcttgaactttacccagcaccccgggagagctacgacgtgcgcggcatagtgtgcagaagccgctttgcccagttgggtgccgagcttatggggagagtcagggctctcagggagccagaaagaattttattctgtacggattattgcccacagtgtggcaataggtccttgtatgatcttgaggtggatcgctgttgctgctag

SEQ ID NO: 32197 - DNA, 1446 bp, Artificial Sequence
  Description of Artificial Sequence: Synthetic coding sequence
atgcgtatgtcgctgcaagcaccgagacgcttgttagaattggctgggcagtctctgctgggggaccaggctctggcaatcagtatcctggatgaactgccgcgggaacttttccccccactttttgtggaggcgttcacctccaggcggtgcgaagttctcaaggtgatggtgcaggcatggccattcccctgcctgccactgggatcccttatgaaaactcctgacctagaaatcctccactatgtggtggacggaatcgattgcctccttgctcagaaggttcggccgaggaggtggaagctgcaggtgctggagctcagggatgtcgatgagaacttttggactatctggtccggagcaagacccctctcatgcagccctgaagccatgagtaagcggcaaacagtcgaggactgcccccgaaccggagagaaacagccgctgaaagttttcatggacgtctgtctgaaggaaaagtttatggatgaggacttgtctttcttctcagggtgggtgcagcaccggagagggtccgtgcacctgtgctgcaccaaggtggtgaactacagcatgtccatactcaattttagaaatattctcgagactgtgtatcccgactccattcaagtgctggagatttggaacatgtgctggccttgcatgatagtggagttttctcggtacctttcccagatgcgcaacctgcgcaaactgtttattagcgatggatgcagatacttgttaagctctgatagccaggaacagctggtggctgagttctcctccgtcctgctgaggctggagtacctacagatgctgtacgttcgccgcgtttgcttcttcaggggacatttggatcagctgattaggtgcctcaggtctcccttggagactctcgcattaacatatgggttcctggagaaggtggacctgaagtgcttgccccgatatccctccctgagtcaacttaagcagcttaatctgagtcacggcgctctgaggtttatccgcctcgagcctctccgcgctctcctggagaaggtggccgcaacgctgcagaccctgttcttggttgactgtggcatcagagacagcaaactgagagtgatactgcccgcccttagttgctgttctaaccttaccaccttttgtttccatggcaacgatacgtccatggatgggctcaaagatcttctgcgccacacggggaggctgtcaaatctgtcactcgaaacctatccagctcctcgggagtcccttgatgatcgcggtagagttatttcggaattgctgaccccattacaggcggaacttatgcgaatcctacgtgaggttcgagagcccaagaggatattcttcggtccagtgtcttgtccgtgctgcggtactagccccaccgaacaactagagtttaatttctgcctctggggaagacccgcatag

SEQ ID NO: 32198 - DNA, 1440 bp, Artificial Sequence
  Description of Artificial Sequence: Synthetic coding sequence
atgagcttacaagccccaagaagactactggaactagctggtcaatctctcctgggcgaccaggctctggctatatccatcctggacgaactaccacgggaattattccccccgctgttcgttgaggcctttactagtaggcgctgtgaagtcctgaaggtgatggtgcaggcttggccgtttccttgtctccccctgggctccctcatgaagaccccagatctggagatcctgcactatgtggtggatggcatagactgtctgctggcccagaaggttcgcccacgtagaaggaaactgcaggtgcttgagctgcgggacgtggatgaaaacttttggacaatatggagtggtgcacggccgctgtcttgctctccggaagcgatgtctaaacggcagacggtcgaggactgtcctcgtactggcgagaagcagcccctcaaggtctttatggatgtctgcttgaaggaaaaattcatggatgaagatctcagttttttcagcgggtgggttcagcacaggcgtgggagcgtgcacctctgttgtaccaaagtggtcaattactccatgtctattttgaacttccgaaatattctcgagacggtctatccggattcaatacaggtgctggagatctggaatatgtgttggccttgtatgatcgtggaattcatccgctatctgtcccagatgagaaatttacggaaactgtttatttcggacggttgcaggtatcttctgtcaagcgacagccaagagcaattagtggccgagttttcatcggtgctgctgcggttggagtacctccaaatgctgtacgtccgccgggtgtgcttttttagaggccacctcgaccagctcattaggtgtctgcgcagccccctggaaacgctcgcgcttacatacggcttcttggaaaaagtggatttgaagtgtctgcctcggtacccatctctgtctcaactgaagcagctaaacctatcgcatggcgcacttcgcttcatccggctggagccacttcgagccctgttagaaaaagtggctgcaacccttcaaactctctttctcgtggactgtggtataagagatagcaaattacgggtgatcctcccggctctgtcgtgctgctctaatctgactacattctgctttcacggaaacgacacctccatggacggattaaaagatctgctgcggcatactggccgtttaagtaatctgagcctcgagacctatccagcacctcgcgaaagcctggacgatcgcggacgtgtgatctccgagctgctgactcctttacaggctgagcttatgcgcatcctcagggaagtacgggaacccaagcgaatcttcttcggaccggtgtcatgtccctgttgcggaacctcgcctacagaacagctggaattcaatttctgtctctggggaagaccagcctag

SEQ ID NO: 32199 - DNA, 1446 bp, Artificial Sequence
  Description of Artificial Sequence: Synthetic coding sequence
atgcgcatgtctctgcaggctccaaggcgcctgctggagctggccggccagagcctcctgggagaccaggctttagccatctctatcctggacgagttaccgcgggagttgttcccacccttgtttgtggaagccttcacctcgcggcggtgcgaggtgctgaaagtgatggttcaagcctggccatttccgtgccttcccctcggttccttgatgaagactccagacctggaaatcctgcactacgtggtagacggaatagactgcttactcgcccagaaagtgcggcccagacggagaaaactccaggtgttggaactgagagatgtggacgaaaatttttggacaatctggagcggggccagaccgctaagttgctcccctgaggctatgagcaagaggcagacggtcgaggattgtcccagaactggggagaagcaacccctgaaggtgtttatggatgtctgtctgaaggagaagttcatggatgaagacctgagttttttctcaggatgggtgcagcatcgcaggggatccgtccacctttgttgtactaaggtggtgaattactccatgagcatcctgaattttaggaatatattggagacagtgtacccggatagtatccaggtgcttgaaatctggaatatgtgctggccttgtatgattgtagagtttattagatacctcagccagatgcggaacctccgcaagctgttcataagtgacggctgcaggtatctgctgagcagcgattctcaggaacagctggtagccgaattcagttctgtgctgttacgcctggagtatttgcagatgctgtatgttagacgagtgtgctttttccgtgggcatttggaccagttgatccggtgtctgcgcagccctctggaaaccctcgccctgacttacggcttcttagaaaaggtagatctcaagtgcctcccaaggtacccctctctttcacagctcaaacagcttaatttgtctcacggtgcgctgcggttcatacggctagaaccactcagggccctcctcgagaaggtggctgcaacactacagacactgttcctcgtcgattgcgggatccgcgactctaagcttcgggtgatccttccagctctgtcctgttgctcaaaccttactacgttttgcttccacggaaatgatacttccatggacggcctcaaggatttactgagacatactggcagactgtcaaatctttcccttgaaacctaccccgcaccacgcgaatctctggacgataggggacgggtgatttcggagctactcaccccgctgcaggcagaactgatgagaattctgagagaggtcagggagcctaaaaggatcttctttggccccgtgtcgtgtccatgctgcggaacatctcctaccgagcaactcgagtttaacttctgtctctggggccgccctgcttag

SEQ ID NO: 32200 - DNA, 1437 bp, Artificial Sequence
  Description of Artificial Sequence: Synthetic coding sequence
atgaagatgtcaatctggacaccccctcggctgctggagctagccggcagatctttgcttagggatcaggcactggctatgagtacgctggaggaactccctaccgagctattccccccactgtttatggaagctttcagccgcagaagatgcgaggcactgaaactgatggtgcagagctggccattccggcgcctgcccctgagaccgctaatcaaaatgccttgcttggaggccttccaggccgtcctggacgggttagacgccctgcttaacctgggggtccgtccgagacgatggaaattgcaggtattggacctccaagacgtgtgcgagaacttctggatggtatggagcgaggcaatggcacacgggtgttttctcaacgccaaacggaacaaaaagcctgtggaagattgcccaagaatgagagggagacaacccttaactgtcttcgtcgaattgtggcttaaaaaccgaaccttagatgaatacctcacatgcttgctgttgtgggtgaaacagcgcaaagacctacttcacttgtgttgcaagaagttaaaaattcttggcatgcctttcagaaacatcagaagtattcttaaaatggtaaatctggactgtatacaggaggtcgaagtgaactgcaagtgggtgttgcccattcttacccagtttaccccatatctggggcatatgcgtaatttgcagaaactgattttgtcccacatggacgtcagtcggtatgtgagccccgaacagaaaaaagagatcgtcactcagttcacaacacagtttctgaagctcagatgtctccagaaactctatatgaattctgtgtccttcttggagggtcatctcgaccagctgctcagttgtctcaaaacctccctgaaattcctgacaataacaaactgcgtcctgctggagtcggatctcaagcacttaagccagtgtccctctatcagccagctcaaaacattggacttaagcggtatccgattgacaaactattcactggtgccactgcagatcctactggagaaggtggcagccactctggaatacctggacttggatgattgtgggattattgactcccaagttaatgcgatcctgccagctctgtcacggtgcttcgagctgaataccttttctttttgcggtaacccaatttgtatggccactcttgagaacttgctgtctcacacgattattttaaagaacctatgcgtggaactctacccggctcccagggaaagttacggcgctgacggtaccctgtgctggagtaggtttgcccagatacgcgcggagctgatgaatcgggtccgggacctccggcaccccaaaaggatcctattctgcacagattactgtcccgactgtggaaaccgctcattttacgacctagaagctgaccagtactgctgctag

SEQ ID NO: 32201 - DNA, 1431 bp, Artificial Sequence
  Description of Artificial Sequence: Synthetic coding sequence
atgtccatcagaactcccccacgccttctcgagttggccgggcggagtcttctaagggaccaagcattggccatgtctacgctcgaggaactgccaactgagctctttccccccctttttatggaagcatttagtcggcggagatgtgaggctctgaaactgatggtacaggcctggcctttcaggaggttgcccttgagacctctgatcaagatgccctgtttagaagcattccaagccgtcttggatgggctcgatgccttactgacccagggagtccaccctaggaggtggaagctgcaggtgctggacctgcaggatgtatgcgaaaacttttggatggtgtggagtgaagccatggctcatggttgcttcttaaatgcaaagcggaataagaagcctgtgcaggactgtccaaggatgcggggccaacagcctctcaccgtgtttgtcgagctttggctgaagaaccgcacactcgatgagtacctgacatgccttctcctctgggtcaaacagcgtaaggacctgttgcacctgtgttgcaagaaactaaaaatacttggcatgccatttcggaatattaggtcaatactcaaaatggtcaacctggactgtatccaagaggtcgaggtgaactgtaagtgggtgttacctattcttactcagttcaccccatacctgggtcatatgcggaatttgcaaaaactcgtcctctcccacatggatgtgtcccgatatgtctcccccgagcagaaaaaggagattgtcacccagtttacaacccaattcctgaagctgtgctgcctgcaaaagctcagcatgaactcagtgtcattcttagaggggcacctggatcagctattgtcctgcctcaagacaagccttaaagtacttaccataacaaactgcgtgttgctcgagagcgacttaaaacatctgagccagtgcccctctatatcacagcttaaaacattagacttgtctggcatcagactgaccaactacagtcttgtcccacttcagatcctgctggaaaaagtggctgctactttagaatatctggacctggatgactgtggcatcatcgactcccaggtgaatgctatcctacccgctctgtcacgctgttttgaactgaatactttcagtttttgcggcaatcccatttccatggcaacgctagaaaacttgctctcccatacaatcatactgaaaaacctgtgtgttgagctttacccagcccctcgggagtcatacgacgcagatggaactttgtgctggagcagattcgctcaaatcagggccgagttgatgaagagggtccgagacctgagacatcctaagcgaatattattttgcaccgactgctgtcctgactgtgggaacagatcgttctacgacctggaagcagatcaatgttgctgttag

SEQ ID NO: 32202 - DNA, 1431 bp, Artificial Sequence
  Description of Artificial Sequence: Synthetic coding sequence
atgtccatccgcacacccccccggctgctggaactggcagggcgcagtttgctccgtgaccaagccctcgctatgagtaccctggaggagctgccaacagagctgttcccccccctgtttatggaggccttttcccgccggcgatgcgaagcactaaagttaatggttcaggcatggccattccggcgactgcccctccgacccctgatcaaaatgccctgtctagaagctttccaagcggtgctcgacggactggacgcgctcctgacccagggcgtgcacccaaggaggtggaagctacaggtgctggatcttcaggacgtgtgtgaaaacttttggatggtgtggagtgaagcaatggctaggggatgttttttaaacgccaaacggaacaaaaccccggttcaggattgtcctagaatgaggggccagcaacctcttactgtgttcgttgagctctggctaaaaaatcggacgctggacgagtatctcacttgtttgctgctctgggttaaacagagaaaggatctgctccacctgtgttgcaagaagcttaagatcttgggcatgccgttccgtaatattcggtcgatcctgaagatggtaaatttggactgcatccaggaggtggaggtgaactgtaagtgggtccttccaatcctgactcaattcaccccgtatctcggccacatgcggaaccttcagaagctggtgctcagccacatggacgtgtctaggtacgtttctccagaacagaaaaaagagattgtgacacagttcaccactcagttcttgaagctctgctgtttacagaagctgtccatgaacagtgtgtctttcctggagggtcatctagaccaactcttaagctgcctgaagacttctcttaaggttctcacaattacaaactgcgttcttctcgaatccgacctgaagcatctgtcccagtgccctagtattagccagctgaagacactggacctgtctggtatccgactgacaaattacagtctagtgcctttgcagattctgcttgagaaagttgctgcaacccttgaatacttagatctggatgactgcggcatcatagattctcaggttaatgcgattctaccagcactgtccaggtgtttcgagctgaacaccttcagcttctgtgggaatcctatttctatggctacactggagaatctcctgtctcataccattattctgaagaacttgtgtgtcgaactgtaccctgcacctagagaatcctacgacgcagacggcaccctgtgctggtcaagattcgcccagattcgggcagaattaatgaaacgggtgcgggacctgaggcacccaaaacgaatccttttctgtacagattgttgcccagattgtggtaacaggtctttctacgacctggaggccgatcagtgttgttgttag

SEQ ID NO: 32203 - DNA, 1431 bp, Artificial Sequence
  Description of Artificial Sequence: Synthetic coding sequence
atgtccatccggacaccccctagattactggagctcgcaggaagaagccttctcagagaccaggctctggcaatgtccaccctggaggagctgcctacggagttgtttccaccacttttcatggaagcattctcaagaagaaggtgcgaagcactcaaactcatggtacaggcatggccatttagacgcctaccgctgcgaccgttaataaaaatgccatgtttagaggcctttcaagccgtgttggacggcctggacgccctgttaacacaaggagtacatccgcggcgctggaaactccaggtgctggatctgcaagatgtgtgtgagaacttctggatggtgtggtcagaggctatggcccatgggtgttttcttaatgccaaaaggaataagaagccagtccaggattgtccaagaatgcggggacagcagccgctgaccgtgtttgtggagctctggctcaagaaccgaacacttgatgagtacctgacgtgcctcctgctgtgggtgaaacagaggaaagatctcttgcacctgtgctgcaagaagctgaaaatcctgggtatgccctttcgcaacattcgatctatcctgaaaatggtcaacctcgattgcatccaagaggtcgaggtgaattgtaagtgggtcttgccaatcctgacccagttcacaccctaccttgggcacatgcgtaacttacaaaaactggtgctaagtcacatggacgtttcgagatacgtcagcccagagcagaagaaggagatagtgactcagtttaccacccagttcctaaaactgtgttgtttgcagaaactgtccatgaactctgtgagctttctggaaggccacttggatcagttactcagctgtttgaaaactagcttgaaggttctgactatcaccaattgtgtgctgttggagagtgatcttaaacacctaagccagtgcccttccatttctcagctcaagaccttggatttgtctgggattaggttaaccaattatagtctggttccacttcagatacttctggagaaagtggccgctaccctggagtacttggacctcgacgactgcgggattatagatagtcaagtgaatgctatcttgccagccctcagctgctgtttcgaactgaacacattctcattctgtggaaacccaatttccatggcaaccctggaaaatcttctgagtcacactataattctcaagaatttgtgtgtggaactttaccctgctccacgcgagtcctacgacgcagacggcaccctatgctggagcagattcccccaaatccgggctgaactgatgaagagagtacgcgatctcagacacccgaagaggatactcttctgcaccgattgctgtccagactgtggaaatagaagcttttatgacctggaagccgaccaatgttgttgctag

SEQ ID NO: 32204 - DNA, 1431 bp, Artificial Sequence
  Description of Artificial Sequence: Synthetic coding sequence
atgtcgataaggactcccccacgactgctggagttggccggacgcagcctgctgagggaccaggcactagctatgtcaactcttgaggagctgccgactgagctgttccccccactttttatggaagctttttcacgccgccgctgcgaggccctcaagttgatggtgcaggcctggcccttcagaagacttcctctgcgcccactaatcaagatgccttgtcttgaagcattccaagcagtattggacggcctggacgccctgctcacccagggtgtgcacccaaggcggtggaaattgcaggtactggacctccaagatgtttgcgagaacttctggatggtgtggtctgaggctatggcaagaggctgtttcctcaacgctaaacggaataagactcccgtgcaggattgtcctcgaatgaggggccagcagcctctgacagtattcgttgaattgtggctgaagaaccggaccctggatgagtacttgacatgcttgctcctctgggtaaaacagaggaaggacctgctgcacctgtgctgtaagaaattaaagattttggggatgccgtttcggaacatccgatccattctgaagatggtcaacttagattgtatacaggaagtcgaggtcaactgtaaatgggttctccctatactgacacagtttaccccctatctgggacatatgcggaatctgcagaagctggtattatcacacatggacgtgagccgctacgtgagtccggagcaaaaaaaagaaattgtgacacagttcaccacccagttcctgaagctttgctgtctgcagaagctaagtatgaacagtgtcagtttcctagaaggccacttggaccaacttctctcctgtctgaaaacgagtctgaaagtgttgacaataaccaactgtgtgttattagagtctgacctcaagcatctgagtcagtgcccctccatctcccagcttaaaactctggatctgagcggtatcagacttacaaattacagccttgtgcccttgcaaatactgctggagaaagtggccgcgacactagaataccttgacttggacgactgcgggatcatcgattctcaggtgaacgccatactgccagcgctaagtcggtgcttcgagctcaacactttctcattctgcggaaaccctatcagcatggcaaccctcgagaacctgctgtctcataccatcatcctaaagaatctgtgtgtagaattgtatcccgcccctcgcgagagttacgacgccgacggcacactgtgctggtcacggttcgctcagattcgcgcagaactgatgaaaagagtaagggatctccggcatccgaaaagaatactgttctgcaccgattgctgcccagattgcggtaaccggtccttctacgaccttgaagcagatcagtgttgttgctag

SEQ ID NO: 32205 - DNA, 1431 bp, Artificial Sequence
  Description of Artificial Sequence: Synthetic coding sequence
atgagcattcgcactcctcctaggttgctggagttagctggcagatctttgctcagggaccaggcattagccatgagcacattggaggagttacctaccgagctgtttcccccgcttttcatggaggccttctcccggaggaggtgtgaggctttgaagctgatggtacaggcttggccgtttagacggctacctttgcgaccactaattaaaatgccctgcctggaggcttttcaggctgtgctggacggactcgacgccttactgactcagggcgtgcatcccagacggtggaagctacaagtattagacctccaagatgtctgcgaaaacttctggatggtatggtccgaggctatggcacacggttgctttctgaacgctaaacggaacaagaagccggtgcaggattgtccccgcatgcggggacagcagcctctcacggtcttcgtcgagttgtggttgaaaaacaggacgctggatgaatatcttacatgcctactgctgtgggtcaaacagaggaaggatctgctgcacctgtgttgtaaaaagctgaagatcctcggtatgccctttcgtaacataagaagcatcctgaagatggtgaatctcgattgcatacaagaagtagaggttaattgcaagtgggtgctgccgatcctgacccagtttaccccttacttgggccatatgcgaaacctccagaagcttgtgctgtcgcacatggacgtgagtcgatacgtttccccagagcagaagaaggagattgtcactcagtttacaacccaattcctgaagctgtgctgtctccagaagctctctatgaatagcgtaagttttctggaaggtcatctggaccagcttctttcttgcctgaagacgtcactcaaagtgctcaccattacaaactgtgttctgttggaaagtgatcttaagcacctatcccagtgtcctagcatctcccagctaaagactttagatctgtccggtatccggctgacaaactatagccttgttcctttgcagattttgctggagaaggtagctgccacactagaatacctagacctcgatgactgtggcatcatagattcccaagtcaacgccattctccccgccctctcccgatgtttcgagctgaatacattctctttctgcggaaatccaatttctatggccacactggaaaacctgctaagccatactattatcctgaaaaatctttgcgtggagctttacccagccccgcgtgagtcttacgacgccgatgggaccttgtgctggtcccggtttgcacagatcagggcagagctgatgaagcgggtgcgcgacctccggcaccctaagaggattctgttttgcacggattgctgccccgactgtggaaaccggtctttctatgacctcgaggcggaccaatgttgctgctag

SEQ ID NO: 32206 - DNA, 1431 bp, Artificial Sequence
  Description of Artificial Sequence: Synthetic coding sequence
atgtcaatcagaacaccaccacgcttgctggagctcgccggacgctccctcctacgcgaccaagctctggccatgagtactttggaggagctaccaactgagctgtttcccccacttttcatggaggcgttctcccgccggagatgtgaagccctcaaactcatggtccaggcttggcccttcagaagactccccttgcgcccactgatcaaaatgccatgcctggaggctttccaggcagtgctggatggtctggacgccttgctcacccaaggggttcacccaaggcgctggaagcttcaggtactagatttgcaagacgtttgtgagaacttttggatggtttggtcagaggccatggcccatgggtgtttcttgaatgccaaacgcaacaaaaagcctgtgcaggactgccccaggatgagaggacagcagcccttaacagtgtttgtggaactgtggctgaagaatagaacgttagatgaatatttaacctgtttactcctctgggtgaaacaaaggaaagacctcctccacctgtgttgtaaaaaactcaagattttggggatgccctttagaaacattcgctcaatactgaaaatggtcaatcttgactgcattcaggaagtagaggtaaattgcaagtgggtgttaccgatcttgacacagttcaccccatatctcgggcacatgcgtaacttacagaagttggtactgtcacatatggacgtgagccgatatgtgtcaccagaacagaaaaaggaaattgtcactcagttcacaacacagtttctcaaactatgttgcttacaaaaactgagcatgaacagtgtgtccttcctggagggccacctggaccagctgctctcttgtttgaaaacatcactgaaagtgttgaccatcactaactgtgtcctgctggagagcgacttaaagcacctatctcagtgtcctagcattagtcagttaaaaacgttagacctctccggcatacgacttaccaactacagtctggttccactccagattctcttagaaaaagtggcagccactctggagtacctcgacctcgatgattgtggaatcatcgactcccaggtgaacgccattctgcccgccttgtcttgctgttttgaactcaataccttcagcttctgcggtaaccctatttctatggccaccctggagaatttactgagccacaccatcatcctgaagaatctgtgcgtggagttatatcctgctcccagagaaagctatgacgctgacggaactttgtgttggtcaagattcccacaaattcgagccgaacttatgaaaagggtacgggatctgaggcaccctaagcgcattctcttctgtacggactgctgccctgactgcggaaatcgttctttctacgatttggaggcagatcagtgctgttgctag

SEQ ID NO: 32207 - DNA, 1431 bp, Artificial Sequence
  Description of Artificial Sequence: Synthetic coding sequence
atgtctatcagaactcctccccgtctgctggaattagcaggacgcagtctactccgagatcaggcactagcaatgtctactctggaagaactgcctacggagttgtttccgcctctcttcatggaagctttctccaggagacgatgcgaagccttgaagctgatggtccaggcctggccttttagaagattacctctgcgccctctcatcaaaatgccctgcctcgaggcttttcaagccgtgcttgatggccttgatgccttgctgactcagggcgtacaccctcgtcgttggaaactccaggtccttgacttgcaggatgtctgcgaaaatttttggatggtctggtctgaggcgatggcgcggggatgctttctgaacgctaaaagaaataagacgccagtgcaagattgcccacggatgagaggccagcagccactcaccgtatttgttgagctctggcttaagaaccgcaccctcgatgagtatctcacgtgtctgctcttatgggtaaaacagaggaaagatctactccatctgtgctgcaaaaagctgaagatactcgggatgccattcaggaatataagatcaattttgaagatggtcaacttggattgcatacaggaagttgaggtaaattgtaagtgggtgctaccgattctgacccagtttactccgtatctcggacacatgagaaatctgcagaagcttgtcctatctcacatggacgtttcgagatatgtgtctccagagcagaaaaaggagatagtgacgcagtttacaacgcagtttttgaaactttgctgcctccagaagctgtcaatgaacagtgtgagtttcctcgagggacacctcgaccagctgttgtcctgcctcaagacctcattgaaagtcctaactataactaattgcgtccttctcgagtccgaccttaaacacctgtcacaatgtccatctatctctcaattaaaaacgctagacctgtccggcatcaggttaaccaattattctctggtgccacttcagatcctacttgagaaggtcgccgcaactcttgagtacttagatctggatgactgtggaattatcgattctcaggtgaatgccattctgccggcactgtcccggtgcttcgagctgaataccttcagtttctgtggcaatccaattagcatggcgacattagagaacctgctgtcccacacaattattctaaagaacctctgtgtggaattatatcctgcccccagagaatcctatgacgctgatggaacactgtgctggtccagatttgcccaaattcgagccgagctgatgaaacgggtgcgggatctcaggcacccaaaacgcattctcttttgcacagactgttgcccggactgtggaaacaggagtttctatgatttggaggccgatcaatgttgttgttag

SEQ ID NO: 32208 - DNA, 1425 bp, Artificial Sequence
  Description of Artificial Sequence: Synthetic coding sequence
atgagcatacgggctccacctcgattgctcgagctcgctcggcagcgcctgctccgcgaccaagcactcgccattagtactatggaggagttacccagagaattattcccaacactgtttatggaggctttcagtagaagacgctgcgagactctgaaaacaatggtacaggcttggccattcacccgactgcccctcggctctctcatgaagagccctcatctggagtcactgaagagtgttctggagggcgtggacgtgctcttgacacaagaagttcggccccgccagagtaagttgcaggtgttggacctgcggaacgtcgacgaaaatttttgcgacatctttagcggcgctactgccagcttcccggaggcgttgtcacaaaaacagactgcggataattgtcctggcactggtcgccaacagccattcatggtctttatagacctgtgcttgaaaaataggaccttggacgaatgtttgactcacctgctagagtgggggaagcagcgaaagggtcttcttcacgtctgctgcaaggaactgcaggtgttcggaatgccaatacactccattattgaggtattgaacatggtggagctcgactgcattcaggaggtggaagtgtgctgtccctgggaactgagtaccttggtgaagttcgccccatacctcggccagatgcgtaatctccggaagttggtgctgttcaacattagggcatcggcttgtataccaccagacaataaaggccagttcatcgcacgcttcactagccaatttcttaagctcgattacttccaaaatctcagtatgcactcagtgagttttcttgagggccatctggatcagctccttcggtgcctccaggctagcctggaaatggtggtcatgaccgattgtctgttgagtgagtctgacctaaagcacctatcttggtgcccttccatccggcagttaaaagaattagacctgcgaggcgtgactctgacacatttctcccctgagccgttaacaggactgctggaacaagtggtcgcgacacttcagacccttgaccttgaggattgtggcattatggattctcagctgtctgctatcctgcctgttctgtctcgctgctcacagctctccaccttctcattttgcggaaatctgatcagtatggcagccctcgaaaatctgctgcgccatacagtggggctgtcaaaactcagccttgagctttatccagctcctttagagagctacgatacgcagggtgctctgtgctgggggcgcttcgctgagcttggagctgaattaatgaaaacaccacgcgatcttaggcagcctaaaattattgtgttctgcacagtgccttgcccacggtgcgggatcagggcttcatatgatctggagccttctcactgtctctgctag

SEQ ID NO: 32209 - DNA, 1425 bp, Artificial Sequence
  Description of Artificial Sequence: Synthetic coding sequence
atgagtatcagagctcctccaaggctactggaactggcaaggcagcggctcctgcgcgatcaagcacttgctatctccactatggaagagcttccaagggagctcttccccaccctcttcatggaggcattttcaagacgtagatgtgaaacactcaagaccatggtgcaggcatggccttttactcggcttccacttggctcgttaatgaagtcgcctcatctggaaagtctgaaaagcgttctggagggggttgacgtcttactgacgcaggaagtccggccccggcagtcaaaactccaggttctggacttacgaaatgtggacgaaaacttctgcgacatcttttccggcgctactgcatctttccccgaggctctgtcgcagaaacaaaccgcagacaactgcccaggcaccggacgtcagcagccattcatggttttcatcgacctgtgcctcaaaaaccgcacactggacgagtgcctcacacacctcctggaatggggaaagcaacgcaaaggtctgctgcatgtgtgctgtaaagagcttcaggtttttgggatgccaatacactctataatcgaagtcctcaacatggtcgagctggattgcatacaggaagtggaggtatgctgtccctgggaactgtccaccctggttaaattcgcaccatatttagggcagatgcggaacctgagaaagctggttctgttcaacattcgagcaagcgcttgcatccccccagataacaaaggccaatttattgctagattcacatcacagtttctgaagctcgactatttccagaaccttagtatgcactctgtttccttcttggaaggtcacctggatcagctgctgaggtgcttacaggcctctctggagatggtggtgatgaccgattgccttttatccgaaagcgacctcaaacacctcagttggtgtccgtcgatcaggcagctaaaggaattggatcttcgaggcgtcaccctaacccactttagccctgaacccctgactgggctactggagcaggtggtcgccactctgcagacactcgatctggaagattgcggaattatggatagccaactgtcagctatccttccagttctctcaagatgctctcagctgagcacctttagcttttgtggaaatctcattagcatggcagccctcgagaaccttctgcgccatacagttggtctgagcaaactgagcttggaactgtatccagctccactggaaagctacgacacacagggcgccctgtgctggggtcggtttgcagagcttggagctgagttgatgaaaactcccagagacctgaggcaacccaaaattatcgtattctgtacagtgccctgcccgaggtgcggaattagagcttcatacgacctggagccttcacactgtttatgttag

SEQ ID NO: 32210 - DNA, 1425 bp, Artificial Sequence
  Description of Artificial Sequence: Synthetic coding sequence
atgagcattcgggcaccgcctaggttattggagctggcaaggcaacggctcctgagagaccaagcactcgcgatctcgacaatggaagaactgccccgagagctgttccctacactgttcatggaagctttttcccgaagacggtgcgaaacactgaagacaatggtccaagcttggccatttacacggctccccttaggatcactgatgaaatccccacatcttgagtccttaaaatccgtgctcgagggtgtggacgtcctgctgacacaggaggtgaggccacgacagtccaaattacaggttctggacttgagaaacgttgacgaaaacttttgcgacatcttcagcggggctaccgctagcttccccgaagctctttctcaaaagcagacagccgacaattgccctgggactggacggcagcaaccgttcatggtgttcatagacctatgcctaaagaataggacactggacgaatgccttacccacctactcgaatggggcaagcaacgtaagggcctgcttcacgtgtgctgtcaggaacttcaagtgttcggcatgcccatccacagtatcatagaagtgctgaacatggtggagttggattgcatccaggaggttgaagtgtgttgtccctgggaactgagcactttggtgaaattcgctccctatctcgggcaaatgcggaatctcaggaaattagtactgttcaacataagggcaagtgcctgtattccgccggataacaagggtcaatttatcgcccgcttcacttcccaattcctgaagctggattacttccagaatctcagcatgcatagtgtatcatttctggaaggccacttggaccaactgctcagatgtttgcaagcctccctggagatggtggtcatgaccgattgtctgttatccgagagcgatctgaaacatctcagctggtgccctagtattagacagctgaaggagctggacttgagaggcgtgacactcactcacttctcccccgagcccttgacggggcttctggagcaggtggtggccacccttcaaacactcgacctggaagattgtggaatcatggattcccagctgagcgctattctgccagtactatcaagatgctcccaactatcaaccttttccttctgtggcaacttgattagcatggcggctctggaaaacctcttgagacatacggtaggtttaagtaagttgtccctggaactctatccagcccctctcgagagttacgatacacaaggggccctgtgttgggggcgattcgctgagcttggcgctgagttaatgaagactctgcgggatctcagacagccgaagatcatcgtgttttgtactgtaccatgccctaggtgcggtatccgagctagttatgacctggagccatcgcactgtctgtgctag

SEQ ID NO: 32211 - DNA, 1437 bp, Artificial Sequence
  Description of Artificial Sequence: Synthetic coding sequence
atgaaaatgtctatacggactccccctcgcttgctggaactggcagggcgctcactcttgcgtgaccaagccctagccatgtcgaccctggaggaactgcccactgagctgttcccccccctgtttatggaagccttcagtaggcgcagatgcgaggccctgaagctgatggtgcaagcatggccttttagaaggctccctctccgccctctgattaaaatgccttgtctggaggctttccaagccgtgctcgatggactggacgcacttctgacccaaggcgtgcgtcccaggaggtggaaactgcaggtgctcgatctgcaggatgtctgtgaaaacttttggatggtgtggtccgaggcgatggcacatggctgcttcctcaacgccaaacgaaataaaaaacccgtccaagattgtccaagaatgcgtggccggcaaccactgacggtgttcgtcgagctctggctaaagaatagaactcttgacgagtatctgacttatctcctgctctgggtcaagcagcggaaggatttgctgcacctgtgctgcaagaaactgaaaattctgggaatgccctttaggaatatccgatcaatcctgaaaatggtgaaccttgattgcatccaggaggtggaagtgaactgtaagtgggtgttgcctatcctcacccagtttaccccgtatctgggacatatgagaaacttgcagaagctcgtgctatctcacatggacgtgtcacggtacgtgtctcccgaacagaagaaggagattgtcactcaattcacaacccagtttctgaaactgagatgcctgcaaaaactttacatgaattccgtgagcttcttagagggacaccttgaccaactgctatcatgcctcaaaacttcacttaaggtgctgacaatcaccaactgtgtgctccttgaaagtgacctgaagcatttatcccaatgcccctccatctcccagcttaagacactggatctgagcggaatcagattgaccaattatagtttagtcccactccaaattctcctggaaaaggttgccgccaccttggagtatctagatctggacgattgcggaatcatagactcacaggtgaatgctattctgcccgctttatctaggtgctttgagctgaacacattctcattctgtggaaacccgatctgtatggctacactcgaaaatctgctttcccatacgataatactgaagaacctgtgcgtagagctgtaccctgcccctagagagagctacggcgccgacggcacattgtgttggagtcgctttgcccaaatacgggccgagctgatgaatcgcgtgagagacttgaggcacccgaagcgaatcctattctgtactgattattgtccggattgcgggaatcggagcttctatgatttagaggccgatcaatactgttgttag

SEQ ID NO: 32212 - DNA, 522 bp, Artificial Sequence
  Description of Artificial Sequence: Synthetic coding sequence
atgtttgcaagaggatcaaggcgacggcgtagtggaagggcccctcctgaggccgaagatcctgatagggggcagccttgcaacagttgccgggagcaatgcccaggcttcttgctccacggatggaggaaaatatgtcaacactgcaaatgccccagggaggaacacgcggtccatgccgtgccagtggatctggagcgcatcatgtgtcgcctgatcagcgatttccaacgtcactccatctcagatgacgacagcggctgtgctagtgaggagtacgcctgggtgccacctggactcaagccagaacaggtgtatcagttcttttcatgcctgccagaggataaagtcccatacgtgaactccccaggggaaaagtatcgcataaagcagcttctgcaccaactgcctccgcacgacagcgaagtcagacgagagaagaccggccgagcttgtcaagcgcagcacaccgcatgggccaatgctggccagggccagcggcggaagggcgagctcatttag

SEQ ID NO: 32213 - DNA, 1848 bp, Artificial Sequence
  Description of Artificial Sequence: Synthetic coding sequence
atgttcgctagaggttcaagaaggcggcgctcaggcagagcccctccagaagccgaagatcctgatcgcgggcagccttgtaactcatgtcgagagcagtgccctggcttcttactgcacggatggcgcaagatttgccagcactgtaagtgtcctagggaagagcacgccgtgcacgcggtgcctgtggacctcgaacgaataatgtgccggcttatttctgatttccaaagacacagtattagcgatgacgattcggggtgtgcctcggaagagtacgcatgggttcctccaggactaaagcccgagcaggtctatcagtttttcagctgcctgcccgaggacaaggtcccctatgtgaatagccccggcgagaaataccgcatcaaacagttgctccatcagttgccaccacacgactcggaggcccagtactgtactgccctcgaggaagaggagaagaaagaactgagggcattctcacaacaaaggaagagagaaaacctggggcgcggtatcgtccggatcttcccagtcactatcacaggagccatatgcgaggagtgcgggaaacagatcggaggtggagatatcgccgtcttcgcttctagggcgggtctgggcgcgtgttggcaccctcagtgcttcgtttgcactacatgtcaggaactgttggtagatttgatatatttttatcatgtgggaaaagtttactgcggtcggcatcacgctgagtgtttaaggcctcgctgtcaagcctgtgatgagatcatctttagtcccgagtgcaccgaagcggaagggaggcattggcacatggaccatttttgctgttttgagtgtgaggcttcgctggggggacagcgatacgtgatgagacagtcccgaccccactgttgtgcctgctacgaggcccggcatgccgagtattgcgacggctgcggcgagcacatcggactcgatcagggacaaatggcctatgaaggccagcattggcatgcatcggatcgatgtttctgttgttcaagatgtggacgagctctgctcgggaggccattcctgcctagaaggggtctcatcttttgttccagggcttgcagcttggggtccgagcccacagccccaggacccagcaggcgaagttggagcgccggtccggtgactgccccactggccgccagcaccgcgagcttctcagccgtgaaaggtgctagcgagactactaccaaaggtacatctaccgaactcgctccagctaccggccccgaagagccctcgcggttcttgaggggagccccacaccgccactcgatgcctgagttggggctgcgctccgttccagagccacctcctgagtctcctggacaacctaacctcagaccagacgacagcgcctttggaaggcaatcaactcccagagtttccttcagggaccctttggtttcagagggaggtcccagacggaccttgtccgccccacctgctcaaagacggcgcccaaggtctccgcctcccagggcgccttcacgtcggcgtcatcatcaccataaccatcaccaccatcacaatcgacatccctcaaggaggagacactaccagtgtgacgcaggaagcggtagcgactcggagtcgtgctcctcgtctccctcaagcagctcttccgaatcctcggaagatgatgggtttttcctgggggagagaataccccttcctccccacttatgccggccaatgccagcacaggatacagccatggaaacatttaactcaccttctcttagtttgcccagggactcaagagctggcatgccccggcaggcacgagacaaaaattgcatagtggcctag

SEQ ID NO: 32214 - DNA, 453 bp, Artificial Sequence
  Description of Artificial Sequence: Synthetic coding sequence
atgtttgcccgcggatccaggagaaggcggtccggacgggctcccccagaggcagaagacccagatcggggtcaaccctgtaatagctgcagagagcagtgtcccgggttcctgcttcacggctggcggaagatttgtcagcactgtaagtgcccccgcgaagaacacgcggtgcacgccgttcccgtcgatctggaacgcataatgtgccggctcatctcagacttccagagacacagcattagtgatgatgattccggatgcgccagcgaagagtatgcatgggtgccacctgggctaaagcctgaacaagtcacacgtggtcaaccgagcaccctggccgtgcagtgggtccataccaatgcccacacacatacacacacacaggtgggtacttacttttggggctacgctagagtgtgttcccagaccgagggcccctcaggcccctag

SEQ ID NO: 32215 - DNA, 996 bp, Artificial Sequence
  Description of Artificial Sequence: Synthetic coding sequence
tgaccccccctgccaaggctctgcccagcccctccccactcagggcgctgtccttcattaccttcagccgcccagcccccagaggccgaagaccctgaccgcggtcagccgtgcaactcctgcagagagcaatgtcccggctttttactgcacgggtggaggaaaatttgtcaacactgcaaatgtcccagggaggagcacgctgtacacgcggtacccgtagaccttgaaaggatcatgtgtaggctgataagcgacttccagagacattccatttccgacgatgattccggatgcgcttccgaagagtacgcctgggttccacctgggctcaaaccagagcaggtctaccagtttttttcctgcctccccgaggataaagtgccgtacgtgaattcgcctggagagaaatatcgaatcaaacagctgctgcaccaactgcccccccatgattctgaggctcagtattgcaccgccctagaggaggaggagaagaaggagcttcgagcgtttagccagcagcgcaaacgtgagaatttgggccggggaattgtgcgcatcttcccagtgaccatcactggcgccatttgcgaggagtgtggcaagcagatcgggggtggggacattgcagtgttcgcctcacgggcaggcctcggtgcctgctggcacccgcagtgcttcgtgtgcactacctgccaggaattactagtcgacctcatttacttctaccatgtggggaaggtgtactgtggacgacaccacgcagaatgtctacggcctcgatgtcaggcctgcgacgaaatcatatttagccctgagtgcaccgaggctgaaggaagacattggcacatggaccacttctgctgctttgagtgtgaagcctcattgggaggacagaggtacgttatgcggcagtccagaccacattgttgtgcttgctacgaggcacggcacgccgaatactgtgatgggtgcggagaacatattggcggatag

SEQ ID NO: 32216 - DNA, 1887 bp, Artificial Sequence
  Description of Artificial Sequence: Synthetic coding sequence
tgagtagaaggtagggccctgacaagcccctcactgctccctaggctcacgcgcccttgtatctgcccaagacctctccagcctcccgaggctgaggacccagatagggggcagccctgtaattcatgccgagaacagtgtcctggctttctgctccatgggtggcgcaagatatgtcaacactgtaagtgcccacgcgaggaacacgcggtccatgctgtgccagtggatttagaacggatcatgtgccgtctgattagcgacttccagcggcacagcatctcagacgacgactccgggtgtgccagcgaggagtacgcttgggtgcctcccggtttaaagcccgaacaggtatatcagttcttttcgtgtctgcctgaggacaaggtcccgtacgtcaactcgcccggcgagaagtatcgtataaaacaattactgcatcaactacccccccacgactcggaagcccagtactgtacagccctagaggaagaagaaaagaaagagcttagagctttctcacagcagaggaaacgcgaaaacctcgggcgaggtatcgttcgaatattcccagtaacgatcacaggcgctatatgtgaggagtgtggtaaacagatcggtggtggcgatattgcggtcttcgccagccgagccgggctgggagcgtgttggcatccccagtgttttgtgtgcacaacttgccaagagctactcgtcgacctcatctacttctaccatgtcggcaaggtatactgtgggaggcaccacgctgagtgcctcagacctaggtgccaggcatgcgatgagatcatcttctcccctgagtgtaccgaagccgagggccgacactggcatatggatcacttctgctgtttcgaatgcgaggctagcctcggtggccagagatatgtcatgcgtcagtcacgaccccattgttgcgcgtgttatgaggctagacatgccgagtattgcgacgggtgtggagagcacatcgggctcgatcaaggacaaatggcttatgagggtcaacactggcacgccagcgatagatgcttttgctgttcacgttgtggcagggctcttctaggtcgtccgtttctacctcggagagggctcatattctgtagtcgcgcctgttccttaggttccgagcccacggcacctgggcctagcagaaggagttggagtgcaggccccgttactgcaccactggctgcgagcaccgcgagtttcagcgccgtaaagggcgccagtgagacaaccacgaagggcaccagcacagagctggcccccgccacgggacccgaggagccatcccgctttcttaggggagcgccacacagacactcaatgccagagctgggcctgcggagcgtgcccgaacccccccccgaaagccccggacagcccaatctaaggccagacgacagcgcctttggtcgacagtcgacacctcgcgtcagcttcagggaccccctggtcagtgagggcggccctagaaggacgctctcagcaccacctgctcaacgcaggcgaccccggtcccccccccctcgcgccccgtccagacgtcggcaccaccatcacaatcaccaccaccaccataatagacacccgtctcgccgccggcactaccagtgcgacgctggaagcggcagtgactctgaatcttgtagttcctctccaagtagtagcagttctgaatcatctgaggatgacgggttcttcctgggagagcgtataccactgccaccacatctttgtaggcccatgccggcacaggacaccgcaatggaaacatttaatagccccagcttatctttaccacgcgactctagagccggcatgccgcgccaggcccgagacaagaattgtatcgttgcctag

SEQ ID NO: 32217 - DNA, 1605 bp, Artificial Sequence
  Description of Artificial Sequence: Synthetic coding sequence
atgtgtagactgatcagcgatttccagcggcacagtatttctgatgacgatagtggctgtgcctcggaagagtacgcctgggtccccccaggactgaaaccagagcaggtgacaagggggcagccttccaccctggcagtgcagtgggtgcatactaacgcgcacactcatacccacacccaggcccaatactgcactgcactggaggaagaggaaaaaaaggaactcagagccttttctcaacaaaggaagagagaaaacctcgggcgcggtatagtcaggatttttcccgtaactatcaccggggctatctgtgaggagtgcggtaagcaaattggtggaggagatatcgcagtgtttgcaagtagagccggattaggggcatgttggcatccccaatgcttcgtatgtaccacctgccaggagttgctcgtggatttgatctatttctatcatgtgggcaaagtctactgtggtcgacatcatgcggaatgtctgcgccctagatgtcaggcttgcgacgagatcatcttttccccagaatgcacagaagccgaggggcgacattggcatatggaccacttttgttgttttgagtgtgaggcgtcactggggggtcaacgttacgtgatgaggcaaagtaggccgcattgctgtgcatgctacgaagctcgccatgcagaatattgcgatggatgcggagagcacattggactcgaccagggccagatggcctacgaaggtcaacactggcatgccagcgaccggtgtttctgctgctccaggtgcggcagagcattgctcgggcgcccctttctgcctaggagggggttgatattctgttcccgcgcatgttccttgggttctgagcctacggcgcccggcccatctcgacggtcttggagtgcaggacccgtcacagcacccctcgcagcctcgacagctagctttagtgccgttaaaggcgcctcggaaactactactaagggcacctcaaccgagctcgcccccgctactggccctgaggaaccgagcagatttctgcgcggcgccccccacaggcacagcatgccagagctcggcttacggtctgttccagagcctcctcccgaatcacctggccagccgaatctgcgcccggatgactcagcatttggacgacagtcgacccccagagtctccttccgcgatcctctggtttccgagggaggtcccaggagaactctgtctgcgcctccggcgcagcgacgcagaccacgctcacctccacctcgggctccctcacgtcggaggcatcatcaccacaaccatcaccatcatcataatcgccacccttctaggcgccgacattatcagtgcgacgccggcagcgggtctgactctgagtcatgctcttcctctccatcgtcctcctcctctgaatctagtgaggatgacggcttcttcctcggggaacgtatccctttgcctccgcacctctgtcggcccatgcctgcgcaagacaccgccatggaaacttttaattccccatctctcagcctcccccgcgatagccgtgccggtatgccaagacaagcacgggataaaaattgcattgtagcttag

SEQ ID NO: 32218 - DNA, 1320 bp, Artificial Sequence
  Description of Artificial Sequence: Synthetic coding sequence
atgttcgctcgggggagcagacgccgccggagcgggagggcccctccagaagccgaggacccagacagagggcaaccgtgtaattcctgtcgggaacaatgtcccggattcctgttgcacggatggcgtaaaatctgccagcactgtaagtgccctagagaggagcatgccgtacatgccgtgccggtggacttggagcggatcatgtgccggctaattagcgacttccagcgccactcgatcagtgatgatgacagtggctgcgcctctgaggaatacgcttgggtacccccaggccttaaacccgagcaggtgactcgcggccagccttctaccctggctgtgcagtgggtccacacaaacgcccatacccacacccacactcaggcgcagtactgcacagccttagaggaagaggagaagaaagaactccgtgcattcagtcagcagaggaagcgcgagaaccttggccgaggaatcgtgagaatcttccccgttacaatcacgggggcaatctgtgaagagtgcggaaagcagatcgggggaggtgacatcgctgtcttcgcatctagggccggcttaggcgcctgttggcatcctcagtgtttcgtatgtaccacctgccaagagctgttggtagacctgatctacttttaccatgtgggcaaagtgtattgcgggcgccaccacgccgaatgtcttaggccacggtgtcaagcttgcgatgaaatcatctttagccccgagtgcacccccggccctagaccagggcccgaagagccttcacgtttcctgaggggggcgccacacagacactctatgccagaattggggctaaggtccgtgcctgagcctccccccgaaagtcccggccagccaaaccttcggcccgatgacagtgcattcggtcggcagagcactccaagagtgagttttagggaccctctggtgagcgaaggcgggcccagaagaaccctgtcggcccctcccgcacagagaagaaggagacaccatcatcacaatcatcaccaccatcataataggcatccatccagaagacggcattaccagtgcgacgcagggagcgggtcagactctgaatcatgctcatcctccccttcctcgtccagcagcgagagtagtgaggatgacgggttttttctaggcgaaagaatacccttgccaccgcatctttgtcgccccatgcctgcgcaagacaccgccatggagacctttaactcaccttcgctgtctctcccgagggatagcagagccggaatgccgagacaggctcgcgacaagaactgtattgttgcatag

SEQ ID NO: 32219 - DNA, 1644 bp, Artificial Sequence
  Description of Artificial Sequence: Synthetic coding sequence
atgtgtagactgatcagcgactttcagaggcactcaatctctgacgacgattctggctgtgcctccgaggaatacgcgtgggtcccccctggcctgaagcctgagcaggtttatcagtttttttcatgtctacctgaagacaaggtgccatacgtgaatagtccaggcgagaagtacaggatcaaacagctgttgcatcaactccccccgcacgattctgaggcccagtactgcaccgcactggaggaagaagagaaaaaagaacttcgtgccttttcacagcagcgcaagcgagagaatttgggccgcggcatcgtgcgcatattcccagtgactatcacaggagcaatttgcgaagagtgtggtaaacaaataggaggaggggacatcgctgtctttgccagtagggcaggtctgggcgcctgttggcacccccaatgttttgtctgcaccacatgccaggagctgcttgtggacttgatttacttctatcacgtgggcaaggtatactgcggccgccatcatgctgaatgcctgaggcctcggtgccaggcctgtgacgaaatcatattttcacctgagtgcaccgaagcggaagggagacattggcacatggaccacttctgttgttttgagtgcgaggcgtctctgggcggacagcgctatgtgatgcgccagtctcgtcctcattgctgtgcttgctacgaagcaagacacgccgagtactgcgatgggtgcggcgagcacatagggctggaccagggacagatggcttatgaggggcaacattggcatgcatcagacaggtgcttctgctgtagccgttgtggaagggccttgttgggtagaccattcctgccaagacgaggcttgatcttttgcagcagagcctgttctctgggcagtgagcccactgccccgggacccagccgtcgatcctggtcagctgggccagtgactgcccctctggcagcaagtacggctagcttctctgcagtcaaaggcgcctccgagaccacgactaaaggcaccagcaccgagctggcacccgcaacaggacccgaagagccatcccgcttcctgcggggggcaccacatcgccatagtatgcccgagttgggtctgcggtctgtcccagaaccacctccggagtctcctgggcagccaaacctccggcctgatgactctgcatttggccgccagagtaccccgcgggtgagtttccgggatcccctggtgtccgaaggaggcccccgaagaaccctcagcgcgccacctgcccaaaggcggagaccaagaagcccgccaccgagagcccctagcaggcgccgccatcaccaccataatcaccaccatcaccataacagacacccatctcggcgcaggcactatcagtgcgacgccggcagtggatccgactcagagagttgtagcagctccccaagtagcagttcatcagagagttcagaggatgacgggttctttctgggcgagcgtatccccctgcctccacacctctgtcgccccatgcctgcccaggacaccgcgatggagacatttaactctccatcgctgtccctcccacgtgattcacgcgctggaatgcccaggcaggcccgcgacaagaactgcattgtcgcctag

SEQ ID NO: 32220 - DNA, 1665 bp, Artificial Sequence
  Description of Artificial Sequence: Synthetic coding sequence
atgcatatcaacttccacaggcccccagcgaaaccgaagccgcagaaggtgaaagagatcgaatatcagaatctgaggttccctgtggacctctctaacccattcgcagttgctacagtactgaatcaggagcctggaaaattaaaaatcaaagaactgagggaggtcctcgaccagggaacagaaattagtaagaccaggcagatgaaggaggccctgttcgaacagaaggtacgccaggacatacacgaagagatggaaaatcacttgaaatggcaggtgcaccttggcaaggatccaatgagctttaagttaaaaaaggaactaaccgaagagtggcagaaagcctgtgccaaatataagcttgaccgcggtgaccctatcctggatgaggagtttcagagactgaaaaccgaggtgagccacaaacgggtcgtgcgcaatcaagaggaaaagatcaaagaatttcatcccaccttcgatccactgatcaataatacctggctgtctcggagcagagctcagaagcggttccaacaggtggcccgcaaggtgatgattcaggggcggctgttcaatatgctctctgctgtccgtgaaatggacaaggagtccattctgcgcaaaatcggacaagccaagcagagcattgcccaggaggccaacttcttcaaatttttccttaggagaatctcccaggacgactacacatcacggttctcagtgagtcctaaggaagtgctgcccttcgccttccccgactgtagcccccctcaggacagcaatgagctcgccccagacggattgggactcgtaccaatcaagtcatctgaggtgcagatcaagcaatcctattcctttttcaatctgcaggttccccagctgtataaaatcaaaagataccagccattttctgtgcacaagagctccacctcttaccgtcctcaaaagctggccagagctctgaagcagggagcagaagacgaagtaacgaccatcacggccctgccaaaacaggattccaccacccagctgtccgggaagacctctgtgcttagcatgaagccgccagaggctctagccatgagtctggattacgatcccttgtatgtctttaatcctaaccccggcctgttcgcggtcatgcaccccttgacttatgcagaaacactgattgattaccacctgtgctcacacccaaaatacaagtttacaaaggagagccgtcatggatcgtctatacccgtgactcagaagcaattcctccatcacaccgacatcatccctggaatcatgcactggaagtcctttcagagcttagtgctgagcagccttcctgacccaagtaaaatggaaactacaaaatcatgtgatagctttaactcattcatgctaccaattgatgtccctgctattctcgatgctctacctgaggaggataggttagaaactgttgaaagggagttatgtgagcaaaacgtggaagtcatgttgactccagaaatgattaaagtggagtttccgatgcttaactacaaggatatccggaaagaaaaggaggtgaaggaccaggcacagcccgcagaaaaggccggggagaagctcttagaggagatgaggaacctgaggggcaaggctcttaacacctacttgatcctcgaatag

SEQ ID NO: 32221 - DNA, 2523 bp, Artificial Sequence
  Description of Artificial Sequence: Synthetic coding sequence
atggccgttgtcaaaactccatcgagaggactaaagaacgcaaaggagcccttcaacaatgcctccccacacctgcttaagaacctagtcgaagaacccaagaaaaggaaggaggtgcccaatcatctcctggagagcaaggtttatgcaaaactggtgaacaacaaagttatccaggcaagacccgggattatacattttggggggtatcaggttgaaaagcagcaccaacaaatactacacctcgtgaatgtcagtaacgaggacactagagtccacattcttccccctcagacaaagtattttgaaattaactacgttagaaaagagcatcatcttgtgcccggcctgagcctgacggtgaccgtgacttttagcccggacgaatggcgttattattacgattgtatccgggtgcactgtaaaggcgacgacacacttctcgtgccaatccacgcataccccgtcatgaacagccttgacttccccagctttattaacctgtctaacgtgttactgggtgaaagcaaaacctacgtgattcccctgcagtgttcctgtcccgtcgacttcgagttctacattacccttatccaatctcaccaggcttttgccatcgaacccacttcaggcataattcccgcaaacggcaaaatgacggtgacaatcaagttcacacctttccagtacggtaccgcccagatcaagatgcagttgtggatttcacagtttaacagccagccatacgagtgtgtgttcactggcacatgctacccgaacatggcacttcctttggaggaatttgaacggctgaataccctgtctaaaaaggtcaatgtcccccctgaaaaagcaatgatgcatattaactttcaccgcccccctgctaagcctaagcctcagaaggtaaaagaaatcgaatatcaaaatctgagattccccgtggacctgtcaaacccgtttgccgtagccaccgtgctgaatcaggagccaggaaaattgaagatcaaggaactacgcgaggtacttgatcaaggaacggaaataagcaagacccgtcagatgaaagaggcgctgttcgagcaaaaggtgaggcaggatatacatgaagaaatggagaaccacctcaagtggcaggtgcacctcggtaaggatcccatgtctttcaagctaaagaaagagctgaccgaggaatggcagaaggcttgtgctaaatacaaactggacagaggagaccctattcttgacgaggagtttcagcgtctcaagaccgaagtgtcccataaaagggttgtcaggaatcaggaagaaaagattaaggaatttcacccaacgttcgacccgctgatcaacaatacgtggttatcgaggagccgggctcaaaagagatttcagcaagtggcccggaaagtgatgattcagggccgcctatttaacatgttaagcgccgtcagggagatggacaaggaatccatcttacgcaagatcggacaggcaaaacaatccatcgcccaagaagcgaatttcttcaagttttttctgcgccggatcagccaggacgattatactagccgattctccgtgtctcccaaggaagtgttaccattcgctttccctgattgctcccctccacaggacagcaacgaattagcaccagacggcctgggtctggtgcccatcaaatcttccgaagtgcagattaaacaaagttactccttttttaatttacaagtgcctcaactttataagataaaaagataccagcccttctctgtccacaagtcatccaccagctatcgtccacaaaaattggcacgtgccttgaagcagggtgccgaagacgaagtcactacaatcactgccctcccaaagcaagactctactacccagttgtctggtaaaacaagcgtcctgagcatgaagccccccgaggccctcgccatgagtttagattacgatccactctatgtgtttaaccccaatccaggcctgttcgccgtgatgcatcctttaacttatgccgagactctgatcgactaccacttatgtagtcaccccaagtacaaatttaccaaggagtcccgccacggttcgtcgatcccggtgacacagaaacagtttctgcaccatactgacataattcccggaattatgcattggaagtcttttcaaagtttggtcttgagttcactgccagatcccagcaagatggaaacgaccaagtcatgcgactcttttaatagcttcatgctacccatagacgtcccggcaattctggacgcactgcccgaagaagacaggctggaaacggttgagagagagttgtgtgagcagaatgtggaggtgatgttaacgcccgagatgattaaggtagaattcccgatgctgaactacaaagatatccggaaagaaaaggaggtaaaagatcaggctcagcctgccgagaaagctggtgagaagctcctggaagaaatgcgcaatttgcgcgggaaagccctgaacacctatctgatcctcgagtag

SEQ ID NO: 32222 - DNA, 564 bp, Artificial Sequence
  Description of Artificial Sequence: Synthetic coding sequence
atggctgtcgtaaagacgcctagcaggggcctcaagaacgccaaggagccatttaataatgcctctccccaccttttgaagaacctcgttgaagagcccaaaaagcggaaagaggtgccaaaccaccttctcgagtcgaaggtgtacgctaaattagtgaacaataaggtcattcaggcaagaccaggaatcatacacttcggcgggtaccaggtggagaaacagcaccaacagattctccatctggttaacgtgagtaacgaagacactcgagtgcacatcctccccccacagaccaaatactttgagattaactacgttaggaaggagcatcacctggtgcctggactctctctgacagtgacggtgacatttagtcctgacgagtggcggtattactacgactgtattagagtgcactgcaagggggatgatacactgctcgtcccaatccatgcgtatccagtgatgaactcacttgactttccatccttcatcaatctctccaacgtgctgctcggggaaagcctgccaaattcagtcttcctggtacccgacaattag

SEQ ID NO: 32223 - DNA, 1200 bp, Artificial Sequence
  Description of Artificial Sequence: Synthetic coding sequence
tgacatcctacttttgaccctctcatcaataatacctggctttctcgctctcgtgcccagaagagatttcaacaggttgccagaaaagtcatgatccagggaaggctctttaatatgttatccgctgtgcgggagatggataaggagtcaattctgcggaagatcgggcaggctaagcagagtatcgcccaagaagctaatttcttcaagttttttctcagaagaatcagtcaggacgattacacatccaggttttccgtgtcacctaaggaggtcctgccattcgccttccccgactgtagccctccacaggatagcaatgaactggcccccgacggactggggctggtcccaattaagagttcagaggtgcagattaaacagtcttactcctttttcaacttgcaggttcctcagctttacaaaattaagagatatcagcctttctccgtccacaagagtagcacgagctatagaccacagaagctggccagggctctgaagcagggagctgaggatgaagtgacaacaatcacagctctgcctaaacaggacagcacaactcaactcagtggaaaaacatccgtgctgtcaatgaagccaccagaagctttggccatgagtcttgattacgatccattgtacgtgtttaaccccaacccagggctgttcgctgtaatgcatccactaacctatgctgaaacgttaatcgattaccatctatgctcgcatcctaagtataaattcacaaaagagtcccggcatgggtcttcaatccctgtgacacagaaacaattcctgcatcataccgacattatacccggaattatgcactggaaatcatttcagtcgctcgtgctgagtagcttgccggatccctccaaaatggaaaccaccaagtcctgtgacagttttaattcgtttatgctccccatagacgttcctgcaatcctggatgcgctccccgaggaggacagactggagaccgtggagcgggaactgtgcgagcagaacgtcgaggtgatgcttacacccgaaatgataaaagttgagttccccatgctaaactacaaggatattagaaaggagaaggaggtcaaagaccaggcccagcctgctgaaaaagcaggcgagaagctacttgaggagatgagaaacctgagaggtaaggcactgaacacctatctcattctcgaatag

SEQ ID NO: 32224 - DNA, 1665 bp, Artificial Sequence
  Description of Artificial Sequence: Synthetic coding sequence
atgcatattaattttcacagaccacccgccaagcccaagccccaaaaggtgaaagagattgagtatcagaacctcagattccctgtcgatctttcaaatcccttcgctgtcgctaccgtgcttaaccaagaacctggcaagctcaaaattaaagaactgagggaggtcctagatcagggtaccgaaatttcaaagacacgccaaatgaaagaggctctgtttgaacaaaaggtgcgccaagatattcacgaagagatggaaaatcatctaaaatggcaggttcatctaggaaaggacccaatgagcttcaaactgaagaaggagctgaccgaagagtggcagaaggcttgcgcaaagtacaaacttgatcgaggcgatcctattctggacgaagagttccagaggcttaagacagaggttagccataagcgcgtagtcaggaatcaggaggaaaagatcaaagagtttcatccaacattcgatcctctaatcaacaatacgtggctctccagatctcgcgcccagaaaaggtttcagcaggtggcccgaaaggtcatgattcagggccgattgtttaatatgctgtctgcggtccgtgaaatggataaggagagcatcctccgcaaaattggacaggccaagcagagcattgcccaggaggccaatttctttaaattttttctgcggaggatctcgcaggacgattacactagtcgctttagcgtgtctcccaaagaagtgctgcctttcgcgtttcccgactgcagtccaccacaggattctaatgagctcgcaccggacggcctgggattagtacccattaaatctagcgaagtccaaatcaagcaaagctactccttcttcaacttgcaggtcccgcagctttacaaaatcaaacggtaccagccatttagtgtgcacaaaagttcaacttcgtatcgcccccagaagctggccagggcactgaagcagggagccgaagatgaagtaactacaattacagccctgccgaagcaggactccaccacccagttgtccggtaagacaagtgttctgtcgatgaagcctcccgaggctctggccatgtcacttgactacgaccctctgtacgttttcaatcccaatcccggtctattcgccgtcatgcatcccttaacctatgccgagaccctgatcgactatcatttatgtagccatcccaagtacaagtttactaaggagagcaggcatggctcttcgatccccgtcacccaaaagcagttcctccaccacaccgacattatcccaggaatcatgcactggaagagttttcagtcacttgttctgtctagtttacctgatccgtcaaaaatggaaaccaccaagtcgtgcgatagctttaactcgttcatgctgcctatagacgtgcctgccattttggacgccctgccagaagaggatagacttgagaccgtcgagcgggagctgtgcgagcagaatgttgaggtgatgctgaccccagaaatgattaaggttgagttccctatgctgaattacaaggacatacgtaaagagaaagaagtcaaggaccaggcccagccggcggagaaggccggggagaagctgctcgaggaaatgagaaatctgcgcgggaaagcgctcaatacttaccttattcttgagtag

SEQ ID NO: 32225 - DNA, 555 bp, Artificial Sequence
  Description of Artificial Sequence: Synthetic coding sequence
atggcaagtcctgcggcctcaagcgttagacccccacggccaaagaaggagccacagactctcgttattccaaaaaacgccgcagaagagcaaaagctgaagctggagaggctaatgaagaatcctgataaggcagtgccaattcccgagaagatgtctgagtgggcccctagaccacctcctgagtttgtccgggatgtgatggggagttccgctggggctggcagcggcgaatttcatgtgtatcgtcatctgaggagaagggagtatcaacgccaggattacatggacgccatggcggagaagcaaaagcttgatgctgagttccaaaagcgactggaaaagaataagatcgctgcagaggagcagactgcaaagaggaggaagaaaaggcaaaaactgaaggagaagaagctgttagccaaaaagatgaagctagaacagaagaaacaagaaggtcccggacagcccaaggagcagggaagttcttctagcgcagaggcctccggaacagaagaggaggaggaggtgccttccttcaccatggggcggtag

SEQ ID NO: 32226 - DNA, 786 bp, Artificial Sequence
  Description of Artificial Sequence: Synthetic coding sequence
atggcccagaatttaaaggatcttgccggtaggctgccagccggcccgcggggtatggggactgctctgaaactgctgctgggggccggtgccgttgcttacggagtaagagaaagtgtgtttacagtcgagggcggtcatcgagccattttctttaatcgcatcggaggagtgcagcaagataccattttagccgagggcctgcatttccgcattccctggttccagtatccaattatctatgatatcagggcacggccgaggaaaatttccagtccaaccggcagtaaggatctccagatggtaaatatttcccttcgcgtgctctcccgaccaaacgcccaagagctgcccagcatgtatcagaggctgggactggattatgaagagcgcgttttgccctctatcgtgaacgaggtgctcaagtccgtggttgccaaatttaatgcaagccagttgattactcagcgagctcaggtatctctgcttatccgtcgggaattgaccgagcgcgccaaggatttcagtctgatcctggacgacgttgccataaccgaacttagtttttctcgagagtacactgccgccgtcgaagcaaagcaagtggcattgtccaagaacccaggttacatcaagctgagaaagatcagagctgcacagaatatctcaaagaccatagctacatctcagaaccgaatttatctgactgctgacaatctagttcttaatctgcaagacgaaagtttcacccgaggcagcgattccctcattaaaggtaaaaaatag

SEQ ID NO: 32227 - DNA, 2769 bp, Artificial Sequence
  Description of Artificial Sequence: Synthetic coding sequence
atggataagaaaagtttcgagatggtgctcgacgagatcagaaaggttgtagatctcctccgctattttagctgggccgaaccacaactgaaggcaatgaaggcactgcagcacaaaatggtcgcagttcagccgactgaggtggtcaacattttgaactgcttcaccttctctaaggataagctggtagcactagaactgctggcatcgaatatcattgacgcacagaattcccggcccattgaggatttatttcgggttaatatgagcgaaaagaagagatgtaagcggattttggagcaggcgttcaaaggcggctgtaaggccccgcatgccatgatctctagctgtggcaccattcctggaaatccatatcccaagggtcggccaagcagaataaatggcatttttcccggtaccccgctaaaaaaggatggagaggaatgcaccaatgaagggaaaggcatcgcagccaggatccttggcccaagtaaaccccccccttccacatataaccctcataagcccgtgccatacccaatcccaccatgtcggccccacgccaccattgctccttccgcttacaacaatgccggtctggtgcccttagctaacgtgatagctccccccccgcccccttatacacccaaccccgtgggcaccgagaacgaggacctgtcaaatccatcgaaacctatccagaatcagacattttccaccccagcctctcagctgtttagccctcacggctctaatcctagtacgcctgccgccacacctgtgcctaccgcaagcccagtcaaggcaatcaatcatcctagcgcttctgctgcggccacagttagcgggatgaatctgctcaacactgtcctgccagttttcccgggtcaggtctcaagtgcagttcacacgccccagccatccatccccaacccaaccgttatacggacccccagcctccccacggcgccggtgacttcaatccactccacaaccaccacccccgtcccatccatctttagcgggctggtgtccttacccggccccagcgctactcctacagccgccactccgacacccggtccaactccaaggagcactctcgggtcttccgaagccttcgcaagcacaagtgccccctttacctcactcccgttcagtacctcgagctctgccgccagcacgagcaatcctaactcagcttccctctcctccgtgttcgccgggctgccacttcctttgccacccaccagccagggcctcagcaaccctacaccggtgattgctggtgggtcaacaccctcggttgccggtccattgggggtaaatagcccgctgctctccgcactgaaaggcttcctcactagtaacgacacgaacttgataaactcttccgccctgagctccgctgttacgtccgggctggctagtctctcgtcactaacccttcagaactcagactcatcggcctccgctccgaataagtgttatgccccatccgcaattccaacaccccaaagaaccagcactcctggccttgctcttttccccgggctaccttccccggtggctaacagtactagcactcctctgaccctgcccgttcagtctccactggccacagcagcttccgcatcgaccagtgtgccggtatcctgtggctcttcagcctcacttctgcggggccctcatcctgggactagtgatctccatatatcgagcacaccagccgctaccacactgcccgtgatgataaagactgaacccacctcacccacacctagtgcttttaagggtcccagtcatagtgggaaccccagccatggaaccctcggattgtccggcaccctgggaagggcctacacttcaacatcagtgcccatttctttgtccgcgtgcctgaatcctgccttatcgggtctgtcttctctgagcacaccattaaacggatcgaacccactgagttctatttccctccctccgcatggatctagcactccaattgcccctgtgttcaccgctcttccatctttcacctccctgactaacaacttccccttgaccggaaatccttctttgaatccctccgtgtctttgccaggaagtctcattgctacttcgtctaccgcagctacatccaccagtctccctcatccctcctccaccgcagctgtactcagcgggctgagcgccagcgccccagtgtccgctgctccattcccactcaacttgtccactgcagttccatcattgttttcagtaacacaaggacctctgagtagctctaacccctcttacccaggcttctccgtatcaaacactccaagtgtcactcccgctcttccatctttccctggtttgcaggctcctagcaccgtggcagccgtgacccctctacctgtcgccgccacagcaccatcccccgctcctgttctgcctggctttgcctccgcttttagttccaattttaactcggcactggtggcgcaggcaggtctcagtagcggtcttcaggcagctgggtcttcagtattcccaggattgctgtctctgcccgggataccaggcttcccccagaacccctcccagagctctctgcaggagctgcaacataacgcggcagcccagagtgccttactgcagcaggtccactccgcctctgcattggaaagctacccagcccaacccgatggatttccaagctatcctagcgcccctggcactcctttctccctgcagcctagtctgtcacagagcgggtggcagtag

SEQ ID NO: 32228 - DNA, 2835 bp, Artificial Sequence
  Description of Artificial Sequence: Synthetic coding sequence
atggacaagaagtccttcgaaatggtgttggacgagattcgtaaagctgtcctgacggaatacaagctcaaggctattgagtatgtgcacggctactttagcagcgaacaagtggtggatcttttgcggtactttagctgggccgaaccacagctgaaggcaatgaaggccctgcaacataaaatggttgccgtgcagcccacagaggtcgtgaacattctgaattgcttcacattctcaaaagacaagctggtggcactggaactcctagctagtaacataatcgacgcccaaaacagccgccctattgaggatctctttagggtgaacatgagtgagaagaagcgatgcaagaggattttggagcaggcttttaagggcggatgtaaagctccccatgcgatgatttccagctgcgggactattccagggaacccgtatcccaagggacgcccctcacggatcaatggcattttccctgggacaccccttaagaaggatggcgaagagtgtactaacgaaggtaagggaattgccgcgaggatccttggcccgagtaagccgcccccatcaacatacaatcctcacaagccagtgccctacccaatcccaccttgccgaccgcacgctaccattgcccccagcgcttataataatgccggcctagttccccttgccaacgttatcgcgccaccgccgcccccatacacccctaaccccgtgggcactgaaaatgaagatctatctaatcctagcaagccaatacagaaccagaccttctcaacccctgcgagtcagttgttttctccacacggttctaacccaagcacacccgccgccacaccggtacccacagcctcacctgttaaggctatcaaccaccctagcgcatccgcagctgcaactgttagcggaatgaatctacttaacaccgtactgccggtctttccaggccaggtgtcatctgctgtgcacacccctcagccatctatcccgaaccctacagtgattcgcacccccagcctgccaacggccccagttactagcatacactccacaacaactaccccggttccatccattttctccgggctggtctcactgcctggtccatccgctaccccaaccgccgccacgccaacacccggaccaactccgagatcaacccttggctcaagtgaggctttcgcctcaacaagtgcccctttcacctccctcccgttttccacgtcaagctcagctgccagtacctctaaccctaattccgccagtttatcctcagtttttgctggtctgccactccctttaccacccacaagccagggactgagtaaccccaccccggtcattgccgggggaagcacaccttcagtagccggccccctcggcgtcaacagtcccttactgagcgccttgaagggtttcttaacttcaaacgacaccaatttgatcaactccagcgccctgagtagtgcggtgacttcagggcttgcaagcttgagttcactgacactgcagaacagcgactcaagtgccagcgcacctaacaaatgttatgctccgagtgcaattcctacccctcagcgcaccagcacaccaggtctggccctctttcctggcctgccctccccagtggctaattcaactagtactcccctgacattgcccgtgcagtccccgctcgccacagcagcaagcgcaagtactagtgtgccagtaagttgtgggtcgtcagctagtctgctgcgtggcccccatcccggcacatccgatttgcatattagctcgacaccagccgctaccacacttcccgtaatgataaaaaccgaacccacaagccccacccctagtgcattcaaaggaccatctcatagcggcaaccccagtcatggcacactgggcctgtcaggaaccctgggcagggcttacacttctaccagtgtgcctatctctctgtccgcttgtttaaaccccgcactgagcggtttatctagtctttctacccctttaaatgggtctaatcccctcagtagtatctcgctacctccgcacgggtcgagtacgccaatcgcaccggtctttaccgcgctgccgtccttcaccagcctcaccaataacttccctctgaccggaaacccctctttaaacccatcagtttcgctgccaggaagccttatcgccacaagctctaccgcagcgaccagtacatctttacctcatccttcctccaccgccgctgtgctgtccggcttatcagcttctgcgccagtgagtgcagcaccatttccattaaacctttctactgccgtgccttcgctctttagcgtgacccagggtccactatccagcagcaatccatcttaccccgggttctccgtctctaatacgccgtccgtgactccagctctgccttcattccccggtcttcaggctcccagtactgtcgccgcagtgactcctttacctgttgccgctacagctccctcccctgctcctgtgctgcctgggtttgcaagcgccttcagctcaaacttcaattccgcccttgtcgcacaggccgggctgtcttccggactccaggcagctggtagttctgtcttcccagggttgctgtccctgccaggcattcctggtttcccccagaacccatcccagagctcactccaggaacttcaacataacgccgctgcgcaatcagcactccttcagcaggtgcactcagccagcgccctggaaagttatcccgcccagcccgatggatttccgagctatccttccgcgcctgggactccattctctcttcaaccgagcctatcccaatcaggatggcagtag

SEQ ID NO: 32229 - DNA, 3123 bp, Artificial Sequence
  Description of Artificial Sequence: Synthetic coding sequence
atggcagctgcagtcctatccggcccatctgcaggaagcgcggcaggcgtgcctggggggacaggcggactctctgctgtaagtagtggccctcggctgcgactgctgcttttggagagcgtttctggattactgcagccgcgcacaggttccgctgtcgcccccgtccaccctccaaacaggtcagccccccatttgcccggcctgatgtgtcttctgcgtctccacggatccgtgggcggagctcagaacttgtccgctttgggtgcactcgtttctctgtccaacgcacggttgtcatcaatcaagaccagattcgaaggattgtgcctgctgtctctgctggtgggagaatctccgactgagctgttccagcagcattgtgtttcctggctgaggtctattcagcaggtacttcaaacccaggaccccccagccacaatggaattggccgttgcagtgctgagagacttactccggtatgcggctcagttgccagcgttatttcgcgatataagtatgaaccacctgccaggacttctcaccagcctgctgggcctgcggccagaatgcgaacagtccgccctcgaaggaatgaaagcatgtatgacttactttccccgagcttgtggctccttgaaaggtaaactcgccagtttcttcctgtccagggtggacgccttgagcccacagctgcaacagctcgcctgtgaatgctactctcgactcccctccctcggcgccgggttttcccagggcctcaaacatactgaaagctgggagcaggagctgcactccttactggcctcgttacatactctattgggcgctctttatgaaggcgctgagaccgcgcccgtgcaaaatgagggcccaggagttgagatgttactgtccagcgaagatggggatgcccatgtgctgctccagctccgtcagcgcttctcgggactcgcaaggtgtttaggcctcatgctgagctcggagttcggcgcccccgtgtcagtgccggtgcaagaaattctcgactttatctgtcgcactttgtccgtgagctcgaagaacatttccctccacggcgacccttgtggttgctgctgctgtccactgagcacccttgcgctggatcttctatcagcccttattctcgcttgcggttcgcggctcctgagatttggaattctgatcgggaggttgttaccgcaggtgctgaactcctggtcaattggccgcgattcactgtctccaggccaggaacggccgtactcaactgtcaggacaaaggtatatgcgattttagaactatgggtacaggtgtgtggcgcgagtgccggcatgctgcaaggcggggcatctggcgaagccctgctgacccacctcctgagcgatatctcaccccccgcggacgccctgaagctccggagtcccaggggcagcccagatggtagtctccagactggtaaaccatccgctccgaagaagctgaaactggatgtgggggaggccatggcacccccatctcaccgattactgccagtcccttgtaaacccagtccaagcgcttctgagaaaattgctctgaggagccctctgtgctccgaggccttggtgacttgcgcagcgttaacacatccccgcgtgccaccgttgcagccaatgggacccacttgccctactcccgctccagtccctctgcgaccacataggccatccggacctcatcgcagcatactgagggccccctgcccacagtgggcaccctgcccccagcaagctccatgttccgccggcccaatgccttctgccggccccgtccctagcgctcggcctggaccaccaaccacggcgaaccacctgggtctctcagtgcccggccttgtttccgtaccccctaggctgctgcccggaccagaaaatcatcgagcaggctccaacgaagaccctatcctggccccctcaggtaccccccctcccaccattccccccgatgagaccttcggtggacgcgtgcccaggcctgcctttgtgcactacgacaaggaggaggcctccgacgttgagatttccctggaatcagactcagatgacagcgtggttattgtgcccgagggactgcctcctctaccacctcccccaccctcaggcgccactccccctccaatagcccctacgggcccaccaacagcgagccccccggtgcccgctaaagaggagccagaagaattacctgcagcccctggtccactgcctccaccgcccccgcctcctcctcccgtgcctggccctgttaccctcccacccccccagctggtgcctgaggggactccgggtgggggcggacccccagcccttgaggaggacctgactgtgatcaacattaactcaagcgacgaggaggaagaggaagaggaagaagaggaagaagaggaggaagaggaggaagaagaagaagaggactttgaggaagaagaggaggatgaagaagaatacttcgaagaagaggaagaggaggaagaggagtttgaagaagaatttgaagaggaggagggagagctggaggaagaggaagaggaggaggacgaggaagaggaggaagagctcgaagaggttgaagatctcgagtttggcacggctggcggcgaagttgaggaaggagctcccccaccacctacactgcctcccgccctgcccccgccagagtctccccccaaggtccagcctgagcccgaaccagagccgggccttctgctggaggtggaagagcccggcactgaagaagagcgcggcgcggacacagcgccaacactggcgcccgaggccctgcccagccagggcgaggttgagcgagagggagaatcaccagccgctgggccacctccacaggagttggtggaggaggaaccatccgccccccccacgctgcttgaggaagagactgaggatggatctgataaagttcagcctccacccgagaccccagccgaggaggaaatggaaaccgagactgaggccgaagccctgcaggagaaagagcaggatgatactgccgccatgctcgcagacttcattgattgtccccccgatgatgagaagcctccgcctccgacagaacctgactcgtag

SEQ ID NO: 32230 - DNA, 3825 bp, Artificial Sequence
  Description of Artificial Sequence: Synthetic coding sequence
atggcagccgccgtcctgtctggtcctagcgctggaagtgctgccggcgtccctggtggaaccggcggcctctcagcagtttcgtctggcccacgtttacgcttactgctgctcgaatcggtaagcggtctcctccagccacgtacaggcagcgcagtggcgcctgtacacccaccgaatcgctctgcaccacacttacctggtctaatgtgcttactccggctccacggttctgtgggcggggcccaaaatttgtccgcactgggcgccttagtttccctgtccaatgcccgtctgagttcaatcaagacccgcttcgaggggttatgcctgttaagcctcttagttggcgagagccccactgaactgttccagcaacactgtgtatcctggctgcgctccatccagcaagtacttcagacccaggatccacccgctaccatggagctcgccgttgccgtgctccgggatctgttgcggtatgcagcgcaactaccggctttgtttcgggacatctcgatgaaccatctccccggcctgctgacttcattacttggactcaggcccgagtgcgaacagtccgccctggaaggtatgaaggcatgtatgacatattttccacgcgcgtgtggctcactcaaaggtaagctagcaagcttcttcctcagtcgggtggatgctctctcaccacagctgcagcagctcgcctgtgaatgctacagtcgcctcccatcactgggcgctggcttttcacaaggcttgaaacataccgagagctgggaacaggaactccactctctgttggcttccttgcacacactcctgggagccctgtatgaaggggccgaaaccgcccccgttcagaacgaagggccaggcgtggaaatgctgctgtcaagtgaagacggagatgcgcacgtgctcctgcagcttcggcagcggttctccggcctggcccgttgcctgggcttaatgctctctagtgagttcggagccccagtctctgtccccgttcaggaaattctggattttatttgtcgcaccctgagtgtgagctctaagaacattgtgtccgggatttgccacctattccgtgctttggcacaggatacacggcagcctggaaagtattggggtcctgaatccccacagaccgtttctagctggtctagaccacgggaactaccaacatttgtgcagataacttctctgcccatgtgtagagacacaggtgctcaatgccagagcgtcgccaacgccagcctaggcgagggcgagtttggtgacgcggagtcactgctgcgagggcccgctattctactgaccttccatcccggtagcatcctggaggataggggtctaatattgctgggtgagcttcggtcaggcgtgggtttcttaacttacgtttacatctgtaaatggagtttcccagttagcgtgagtttatggctttcactcagtagctctaccttgtatctttgtccttttttcctgcagagcctacacggggatgggccactgcgcctgctcttgctgcctagcatccatctcgaggcacttgatttgctctccgcacttattctcgcgtgcgggtccaggttattaaggtttggtattttgattggtcggcttttaccacaggtactgaactcctggtccatagggagagattctctctccccaggacaggagcgcccatattccactgttcggaccaaagtgtatgccatcctagagctctgggttcaagtctgtggggcaagtgcagggatgttacagggaggagccagcggggaggccctgttaactcatttgctgagcgatatcagccccccagctgatgccctcaagttaaggtcgcctcgcggcagccctgacggatctttgcagactgggaaaccatccgctcccaaaaaactaaaactcgatgtgggcgaggcaatggcgccaccatcccaccgcaaaggcgacagcaacgctaatagtgatgtttgtgcagccgccctaagaggtttaagtcgcaccattctcatgtgcggcccccttatcaaggaagagactcatcggcggctccacgatctggtgcttccactcgttatgggagtacagcagggagaagtgctgggcagttccccctacacaagctccaggtgccgacgtgaactctactgtctacttctggctttgttgctggccccctcacctagatgtccaccgccactcgcctgcgcccttcaggcttttagcctgggccagcgtgaggattcactagaggtctcgtccttctgcagcgaagccctggtgacatgcgctgccttgactcaccctagggtcccgcctctgcagccaatgggaccaacctgcccgactcccgctccggttcctccaccagaggctcccagtccattccgtgcccctcctttccatcccccaggaccaatgcccagcgtcggatctatgccttccgcggggccaatgccaagcgctggacccatgccttcggccggcccagtaccatctgcacgccctgggccccctacaactgccaaccacttgggattaagtgtacccggcttggtgtctgtgccaccacggctactccccggccctgaaaaccatagggctggtagtaacgaagatcccattctggctccgtccggcacaccaccaccgacaatcccaccagacgagacatttggagggagagtgccacggccagctttcgtgcactatgacaaggaagaggccagcgatgtcgagatcagcttagagtcagatagcgatgacagcgttgtcatcgtcccagaaggccttccgcctctgccaccaccacctccatccggcgctacacctccccccatcgctcctaccgggccccctactgccagccctcccgtacccgctaaggaggaaccagaagaattacccgcagcacccggaccgctgccacccccaccccccccacctcctcccgtgcccggaccagttacattgccacccccacagttagtgccagaaggcacccctggcgggggaggaccaccagccctggaggaagacttaaccgtgatcaatattaacagctctgacgaggaagaggaagaggaagaagaggaagaagaagaggaggaggaggaggaggaggaagaggaggatttcgaagaagaggaggaggatgaagaggagtactttgaggaggaggaagaagaggaggaagagtttgaagaggaattcgaagaagaagagggcgaactagaagaggaagaggaggaagaagacgaggaagaagaagaggaactggaagaggtggaggatctcgaatttggcaccgccggcggtgaggttgaagagggcgcacctcccccccccacactgccaccagccctgcctccccccgagagtccacctaaagttcaacctgaaccagagcctgagccgggcctactgctagaggttgaggagcccggcacagaggaggagcggggagccgacacagctccaacacttgcacccgaggctctcccgtcccaaggcgaagttgagcgggagggggaatcccccgccgccggcccccccccccaggagctggttgaggaagagcctagcgccccacccacgctgcttgaagaggagaccgaggatggaagtgacaaggttcaacctcctcccgagactccggctgaagaagagatggaaaccgagacggaggccgaggccctgcaagagaaagaacaggacgacacggcagcaatgctcgccgacttcatcgactgtccccctgacgatgaaaagcctcccccgccgacagagccagacagttag

SEQ ID NO: 32231 - DNA, 2721 bp, Artificial Sequence
  Description of Artificial Sequence: Synthetic coding sequence
atggagctggcagtggcggtgcttcgggatctcctcaggtatgccgcacagctaccagccctctttagggatatttccatgaaccacctgcccgggttgctgacttccttgttgggtttgagacctgaatgcgaacagagcgcactcgaggggatgaaggcctgtatgacttatttccccagagcatgcggtagccttaagggcaagctcgcgtctttttttctgagcagggtagacgccctctctccccagctccagcagctcgcatgtgagtgctactctagactgccctcccttggtgctgggtttagtcaggggctgaaacacactgagtcctgggagcaggaacttcacagtctgctggcctctcttcacacactgctgggagctctgtacgagggggccgaaacagctccagtgcagaacgaaggcccaggagtggagatgctgctgagtagcgaagatggagacgcccacgtcctgctgcagctccgccagagatttagtggactcgcccggtgccttggtcttatgctgtctagtgaattcggggccccagtgtccgtccccgtgcaggaaatccttgactttatttgtcgcaccctctctgtgtcttcaaagaatatcagtctacacggggacggccctttaagactacttctcctcccctcaatccatctggaagctctggacctgttaagcgctctgatcttggcttgcggtagccgcctgttaaggttcggaatcctcatcgggagactattgccccaagtcttgaattcatggtctatcggtcgggactccctgagccccggccaggagagaccgtactcaacggtcagaacaaaagtatacgccatcctggagctgtgggtccaggtgtgtggagcttccgccggtatgctccaaggcggggcgagtggcgaggccctgctgactcatctgctgtcagacatctctcccccggccgatgcactcaagctgcgttccccgcgcggatccccagacggctctcttcagaccgggaaaccctccgcccccaaaaaactgaagttagacgtgggtgaagctatggcccccccgtctcataggaaaggggatagcaacgccaattccgacgtctgcgctgccgcgttgcggggactcagcaggaccatcctgatgtgcggtcccttaatcaaagaggagacacatcgcagattacacgatcttgtgctgcccctcgtgatgggggtgcagcagggggaagtgctcgggagttccccatacacctcatctcggtgcagacgggaactgtactgcctcctcttggcccttctgctggctcccagtccaaggtgcccaccgccgctggcatgcgcccttcaggccttcagcctcgggcagcgtgaggattccttggaggtcagctctttctgctcggaagccttggttacctgcgccgccctgacacaccctcgggtgcctcctcttcagcccatgggccctacctgtcctacacccgctccagttcctccccccgaagcaccatccccttttcgggcaccgccttttcacccaccaggtcctatgccttcagtcggatccatgccatccgcgggccccatgcctagcgccggaccaatgccaagcgccggacctgtcccgtcagccagacctgggccgccaacgaccgccaatcaccttggcctgtctgtgcccggcttggtgagtgtgccacctcggttgttaccaggacctgagaaccacagagccggttcaaatgaagaccccatcctggcaccaagcgggacacctccaccaactatcccccctgacgaaacctttggcggcagagtccccagacccgcgtttgttcattatgataaagaggaggcatctgatgtcgagatcagtctggagagcgactctgacgacagtgtggtcatcgtcccagagggcttgccgccacttccacccccaccgccgagcggagcaactcctcccccaatagcccccacaggtcctcccaccgcaagccccccggtgcccgccaaggaggaacccgaggagttgccagccgctcccgggccgctcccccccccacccccacccccgccgccagtgccgggccctgtgacgctcccaccgccccaattggtgcccgaagggacaccaggaggtggcggaccccctgccctcgaagaggacctcacggtgataaatatcaactcttccgatgaggaggaggaagaagaggaggaggaagaagaagaagaggaagaagaggaggaggaagaagaagactttgaggaggaggaagaggatgaagaggaatatttcgaggaggaagaagaggaggaggaggagttcgaagaggaattcgaggaagaggagggagagctcgaggaggaggaagaagaggaggatgaggaggaagaggaggagctggaggaggttgaacgggagggcgaaagcccggctgccggtcccccccctcaggaacttgtcgaagaagagccttcggcgccgccgactctcctcgaggaggagaccgaagatggttcggacaaggtgcaacccccccctgaaacacctgctgaagaggaaatggaaacggaaactgaggctgaggcgctgcaggagaaagaacaggatgatactgcagcaatgctggccgactttatcgattgcccccctgacgatgagaagccgcctccgcctaccgaacctgattcttag

SEQ ID NO: 32232 - DNA, 3543 bp, Artificial Sequence
  Description of Artificial Sequence: Synthetic coding sequence
atgctcctccccagtctgtctcccagggtccagcccgcctttactcaatgcgcccgcccacagccccccccgcacgccccttctcccgtgggtggccgacgcggtgtgttcgcaagctcccgccatgcgacaacaggtaccagggggaaaatggctgccgcggtactatccgggcccagcgcgggatcggctgcaggtgtgcccggtggtaccggcggcctgtccgcggtttccagtgggccacggttgaggctgctgctgttggagagcgtatctggactcctccagccccggaccggatccgctgtggcccctgttcatcctcccaacaggtctgcccctcacctgcctggactgatgtgcctcttaaggctgcacggcagcgtggggggtgcgcagaacctctcagcgctaggagccctggtctccctttccaacgctcggctgagtagcataaaaacgcgatttgaaggattgtgtctgctgagcctcttagtgggagaaagccccaccgaactgttccagcagcattgtgtttcatggctgagatcaattcagcaagtgctccagacccaggacccccccgctacgatggagttagctgtggctgttttgagagatctgctgcgatacgctgcccagctcccagcgctcttccgggacatctccatgaaccatctgccaggactcctgacgagtctgctcggtttgcggcccgaatgtgaacagagcgccctggaaggaatgaaggcctgcatgacatattttcctagagcctgcggttctctgaaaggaaaactggcaagcttctttctgtctagggttgacgcactctctccacagctgcaacagctggcttgtgagtgctattctcggcttccttctttgggcgccggtttcagtcaaggtctaaaacacacagaatcctgggaacaggaactgcacagcttgttggcctcgctccacactctgcttggtgccctttacgaaggcgctgaaacagcacctgtacagaacgaaggaccgggggtggaaatgcttctgtcaagtgaggatggggatgctcatgttttattacagttaagacaacggtttagcgggctggcccgatgcctgggcctcatgctgagcagtgagtttggggcgccggtctccgtgccagtacaggaaatcctagactttatatgccgaacactgtcagtgagctctaagaatatcagcctgcacggcgacggaccactccgcctgctactgcttcccagtatacacctggaagccctggatctgttatcagcccttatcttggcctgtggttcacggctgctccgctttgggatactgatcggccggttgcttccccaggtgctgaacagctggtcgattggccgggatagcctcagtcccggccaggaacgcccgtattctacagttcggaccaaggtgtacgccatcctcgaactctgggtgcaagtgtgcggcgcgtctgccggcatgctgcagggcggagcctccggtgaggcgctgttaactcatttactctccgacattagcccaccagcagacgctctgaagctcaggtctccacgggggtctccagatggaagcctccaaactgggaagcctagcgctcccaagaagctcaaacttgatgttggagaggcaatggcccccccctctcatcgcaagggtgactccaatgcaaactcagatgtctgtgctgcagctttgaggggactgtcaaggaccatcctaatgtgtggccctctgataaaggaagaaactcaccgccggctgcacgatctggtccttcccttggtcatgggggtgcagcagggtgaagtactgggaagtagcccgtatacttcttcccggtgcagaagggagctatactgtctcttgctggccctgctgctggcacctagcccacggtgtccaccgcccctcgcctgtgctctccaagctttttcactgggccaacgcgaggatagtctcgaagtgagttccttttgttctgaggctttagttacctgtgctgccctgacccaccccagagttccaccactccagcccatgggacccacgtgccccactcccgctccagtgccccctccggaagcaccatctccctttagggcaccaccctttcatccaccagggcctatgccctctgtcggcagtatgccctctgccggacctatgccttcagctggtcctatgcctagcgccgggcctgttcctagtgccaggcctggcccacccaccacggcgaatcatctgggactgagtgtcccgggcctggtgtccgttccccctaggttattacctggccccgaaaaccacagggccggcagcaacgaggatccaatcctggcccctagcggaacaccaccccctactatcccgcctgacgagaccttcgggggtagggtgccccgccctgccttcgtgcactacgacaaggaggaagcttccgacgtcgagatctctctcgaatctgactctgatgacagcgtggttattgttcccgaagggctgccccctctccccccgccgcccccctccggcgccacccccccacccattgcgcctaccggcccacccaccgcctctccgcctgtccccgccaaggaggaacccgaagagctgccggcggccccaggtcctctcccacctccccctccacccccccctcccgtcccgggacctgtaactctgccgccgccgcagcttgtgccagaggggacccctggcggcggtgggccccccgccctcgaagaagatctgacagtgataaacattaattcctccgatgaggaggaagaagaagaggaagaggaggaggaagaagaagaagaagaggaggaagaagaggaggatttcgaagaggaggaagaggatgaagaagagtactttgaagaggaagaagaggaggaggaagagtttgaagaggaatttgaggaagaggagggcgaactggaggaggaggaggaagaggaagatgaggaagaagaagaggaactagaagaggtggaggacttggaattcggtacggccggcggcgaggtggaggagggcgccccccctcctccaacactcccacctgccctgcccccacctgagagtccacctaaggtacagcccgagcctgaaccagagcccggacttctccttgaggtggaagaaccaggcaccgaggaggaaagaggcgccgacacagcgcctacgctggcaccagaggcacttccttcccagggagaagtcgaacgtgaaggggagtcacccgctgccggtccccctcctcaggaactcgtcgaggaagaacccagtgcccctcccacattgcttgaagaagagacagaagatgggtccgataaggttcagccaccccctgagacaccagcggaggaagaaatggaaaccgaaacagaggctgaagccctacaggaaaaagagcaggacgacacagctgcaatgcttgccgactttatagattgtcctcctgacgatgagaaaccgcccccacctacggagcctgatagctag

SEQ ID NO: 32233 - DNA, 1083 bp, Artificial Sequence
  Description of Artificial Sequence: Synthetic coding sequence
atgccgaaatttaaacagagacggcgcaagctcaaagctaaggcagagagattgtttaaaaaaaaggaagcctcacatttccagtccaagctcattacccctcctcccccgcctccttctccagagcgagtcggtattagttccattgacattagccagtctcggtcttggctgacttcctcctggaatttcaatttccccaacataagagatgctataaagctgtggaccaatcgggtctggtccatctactcctggtgccaaaactgcataacccagtcgttggaggtgctgaaggatacaatattcccaagtcgcatctgtcatcgcgagctctatagcgtcaagcaacaattttgcattctcgaatcaaaactgtgtaaactccaggaggcattgaaaacaatatcagagtcgagctcttgtccaagctgtggacagacttgtcacatgagcggcaaattgacaaacgtgcccgcctgtgtgctgattactccaggcgactctaaggccgtattgccgccaactctgcctcagccggcctcccactttccgccacctccccctccaccgccgctccctcccccaccacctccactggcacctgtgctactcaggaagccatcactcgctaaagcgttgcaggctggacccctcaagaaggatgggcctatgcaaatcaccgtgaaggacctcctaaccgtgaagctcaaaaagacgcagtctctcgacgaaaaacggaaactcataccctcaccgaaagcacggaacccgctggtcacagtgtcagacttacaacatgtgacccttaaacctaattcgaaggtcctttctactagggtgacaaacgtactgatcacaccaggaaaatctcagatggatctgaggaaactgttaaggaaagtggatgtggagaggtcccccggggggacgcctctcacaaacaaagagaatatggaaaccggaacggggttgacccccgtcatgacccaggctctgcgcagaaagttccagctggcacatccaagatcaccaacgcccacacttccactgtcaacttcatcctttgatgaacaaaactag

SEQ ID NO: 32234 - DNA, 3651 bp, Artificial Sequence
  Description of Artificial Sequence: Synthetic coding sequence
atggagcaacttccaggggtgcctcctggaccaccacatccagtccgacctccccctccaaacccccctcctccaatgcccctgcagctggaggcccatcttagaagtcacgggctggagcccgcagcccccagccctcgcttacgcccggaggaaagtctggatcccccaggcgcgatgcaagagctgctgggagcgttggagcccctccctcctgccccaggtgataccggtgtcggcccccccaattccgaagggaaagaccccgctggggcttaccggagtccatcacctcaggggacgaaagctcctagatttgttccactaacgagcatatgtttcccggacagcctcctccaggacgaagagcgctctttttttcccacaatggaagaaatgtttggaggaggggcagctgatgattatggcaaagccgggccccccgaggacgaaggcgatcctaaagctggtgcaggccctcctccaggcccaccagcgtatgacccctatggtccctattgtccagggagggcttctggcgcagggcccgaaacaccgggcttgggactggatccaaataagccaccagaacttcctagtacagtcaatgcagagccactgggcctaatccagtcagggccgcatcaggccgccccaccgccccctcccccacctcctcctccaccggcccccgccagcgaaccaaaggggggattaacaagtcctatcttctgttccacaaaaccgaaaaagctgctgaagaccagcagctttcacttactgcggcgccgggaccctccatttcagacacctaaaaaactgtatgctcaggaatacgaatttgaagctgatgaggataaggcagacgtcccagccgatattagattaaacccccgtcggttacccgacctcgtgagcagctgccgctccagaccagctctatcaccgttgggcgatatcgatttctgtccgccgaatcctggccctgacggtccaaggcgcagaggcagaaaaccaacaaaagctaaacgcgatggccctccgcgcccgcggggacgtcctcggatccgcccactggaggtcccaacaacagccggaccggccagcgccagtactccaacagacggggccaagaagccgagggggcgcggcagaggccgcggccgcaaagctgaagaggcgggagggactagactcgagcctcttaagccgctgaaaataaagctgagcgtgcccaaggccggtgaaggattaggtactagtagcggagatgccatttccggcacagaccacaattccctggatagctccttgactcgagaaaaaattgaagccaagatcaaagaagtggaggagaaacagccagagatgaagtctggttttatggcaagttttttggacttcctgaaaagcgggaaacgacacccaccactttaccaagctggcctcacgccacccctctctccacccaagtctgtgcctccaagcgttccagcacgtggactccagccacaaccccccgccactcctgcagtcccccacccccccccatcaggggcctttggcctcggcggggccctggaggctgccgagtctgaggggctgggtcttggctgtccgagtccatgcaagagactggatgaggaactgaaaagaaacctagagactctgcccagcttcagttctgacgaggaagacagtgtggccaaaaatcgggatttgcaggagagcatttcctccgctatcagtgctctagatgatccacccctcgctgggccaaaggacaccagcactcccgatggtccacccttagccccagcagctgcagtgccagggccgccccctttacccggactgccctctgccaactctaatggtacaccagaacctcctttgttagaggaaaagccaccccctaccccaccccccgctccaaccccacagccccagcctccccctccacctccaccgccacaaccggccctacctagtcctccacctttggtggctccaactccatcgtctccacccccaccccccctgccccctccccccccaccggcaatgccaagccctccccctccaccgcccccggctgctgccccactggctgctccacctgaagaacccgcggcccccagcccggaagatccagagctccccgacacaaggccgctgcacttagccaaaaaacaggagacggctgccgtgtgtggagaaacggacgaggaagccggggagtccggaggagaggggatctttcgggagcgggacgaattcgtcattcgcgcagaggacatacctagcctcaaactcgctcttcaaactggtagggagccaccgcccatttggagagttcagaaagctttattacagaagtttacccctgagatcaaggacgggcagcgccaattttgcgctacaagtaactatctgggatacttcggggacgctaaaaatcgctaccaaaggctctacgtgaagtttctcgagaacgttaacaagaaagactatgtcagagtttgcgctcggaagccgtggcatcgccccccagtcccagtgaggcgatccgggcaggccaaaaatccagtgtcagccggaggctcctccgcccccccccccaaggcacctgcaccaccgcctaaacctgagacccctgagaaaaccacaagcgagaaaccacctgagcagactcccgaaaccgctatgccagagccgcctgctccggaaaaaccgagccttcttagacctgtcgagaaggaaaaagaaaaggaaaaagttactcggggcgagcggcccctgaggggtgagcgtgccacatctggtagacagacacgcccagaacggtcccttgctactgggcagcccgccacatcaagactccccaaagcacgaccaacaaaggtgaaggccgagcccccgccaaaaaaacgtaagaaatggctgaaagaagcaggagggaacgctaccgccggcggggggccaccaggctctagctcggactccgagtccagtcctggagccccgagtgaggatgaaagggccgtgcctggacggctgctgaaaacccgggctatgagagagatgtaccgctcctatgtggagatgcttgtgtctaccgccctggacccagatatgatccaggcacttgaagacactcacgatgaactgtatctccccccgatgcggaaaatagacggactgctaaacgagcacaagaaaaaggtactgaagcgtctgagtctgtccccagcgttacaggatgctttgcacacctttccacagctgcaggtcgagcagtctggggaaggatcccctgaagagggtgccgtaagactcagacccgcaggcgaaccctataatcgaaaaaccttgagcaaactcaagagaagtgttgttcgggctcaggaatttaaagtggaacttgaaaagagtggctactacactttgtatcacagtttgcatcattacaagtaccatacctttctgcgatgtcgagatcagacactggccatcgagggcggcgccgaggacctggggcaagaagaggtagtccaacaatgtatgcgaaaccaaccttggctcgaacagctcttcgacagctttagcgacctcttagcgcaggcccaggctcattcacggtgcggctag

SEQ ID NO: 32235 - DNA, 3435 bp, Artificial Sequence
  Description of Artificial Sequence: Synthetic coding sequence
atggagcagctcccaggcgtgccaccgggacccccacaccctgttaggcctcctccccccaacccccctcccccgatgcctctgcagcttgaggcacacctccgtagccatggcttagagccagcagcccctagcccccggttaaggcctgaggaatccttggatcctcctggggctatgcaggagttgctgggggcattggagccactccctcccgcaccaggggacacaggggttggcccccccaattctgagggtaaggatcccgctggtgcatacagaagcccgagtccacaaggtactaaagctcccaggttcgtccctctgacttccatatgtttcccagatagcctgctgcaggacgaggaaaggtcattcttccccacaatggaggaaatgttcggggggggcgccgccgacgactacggcaaagcaggaccgcccgaggatgagggcgaccccaaggccggcgcagggcctccgccaggcccgcccgcctacgacccctatgggccatattgtcccgggagggcctcaggggcagggcctgagactcctgggcttggcctcgaccctaacaagcctccagagctcccgtcaacagtcaacgccgaacccctaggcttaatccagtccggaccccaccaggcggctcccccaccaccaccaccacctcctccccctcccgctcctgcctccgaacctaaaggaggactgacctcaccgatcttttgttccacgaaaccaaaaaaactcttgaaaacctctagcttccaccttctacgcaggagagaccctcctttccagacccccaaaaaactgtacgcacaagagtatgagttcgaagctgatgaggacaaagcagatgttccagccgacatccgcctgaacccccgccgcctcccagacctcgtttcctcttgccgctctcgacccgcactgagcccgcttggtgatattgatttctgccccccaaatcccggccccgacggccctcggagacgagggaggaagcctacaaaggctaagcgagacggcccccctcgccctagggggcggcccagaatccgccccctcgaagtcccgaccacggcgggaccagcgtcagcatccactcctactgacggggccaagaagcccagaggacgcggcaggggacggggaagaaaagcggaagaggcgggagggactcgtcttgaacccctgaaaccactcaaaattaagctttctgtgcctaaagcaggcgagggcctggggaccagctcgggtgacgctatatcggggaccgaccataactctcttgatagtagccttacgagggagaagatcgaggccaaaataaaagaggtcgaagagaagcaaccagagatgaagtcaggctttatggcctcttttctggattttttaaagagtgggaagcgacatccccccctctaccaagctggtctgaccccccctctgtccccaccaaaaagcgtcccaccaagtgtgcctgccaggggtttgcagccccaacctcctgctacacctgcagtgcctcaccctcctccttcgggagccttcggactcgggggcgctctggaggcagccgaaagtgagggcctgggcctgggttgtccgagcccatgtaagagactggatgaggagcttaaaaggaatttggagaccctgcccagcttctcatccgatgaggaggacagcgtagccaaaaacagggacctccaggagtccattagctcagcaataagtgctctggatgatcctccgctggccggacctaaagacacatcaacacctgatggcccacctctcgctccagcagcagcagtgcctggacctccaccccttcccggactgccaagcgccaacagcaatggcactcccgaacctcctttactggaggagaagcctcccccaacgccacccccagctcctacccctcaacctcagcctccgccacctcctccaccaccacagcccgcactgccttctcctcctcccctggtcgccccaacaccctcatctcctcccccaccccctctgcccccaccacccccaccggccatgccctcccccccacctccgcctcctcccgcggccgctcccttggccgctcctcccgaggaaccagccgcaccctccccagaggaccccgagctccccgatacccgcccattgcatctggccaagaaacaggagacggctgctgtctgcggcgagaccgatgaagaggcgggagaatcgggtggagagggcatatttcgggaacgcgacgaatttgttatcagagcggaagatatcccgagtctcaaactggccctgcagacagggagagagccgcctcccatttggagagttcagaaggcgctcctacagaaattcacccccgagattaaggatggtcagcgccagttctgtgctacatctaactaccttggctactttggggatgctaaaaataggtatcagcgactctacgtgaagttcctcgaaaatgttaacaaaaaggactacgtaagagtgtgtgcccgcaaaccatggcacagaccacccgtgccagtgaggcgctccgggcaggcaaagaaccccgtgagcgctggaggctcttcagctccgcctcctaaagctccagccccacctcctaagcctgagacgccagaaaagactacgtcagagaagcctcctgaacagacacctgagacggccatgcccgaaccccctgctccagaaaaacccagtttactgcgtccggttgagaaggaaaaggaaaaagaaaaagtgacgcgaggggagcgtccgctcagaggggagagggctactagtggaagacagacacggccggagcgaagcctggcaactggccagcctgccacgagtagactccccaaagcccgccctaccaaggtaaaagcggagcccccccccaaaaagagaaagaaatggttgaaagaagcggggggcaacgcaacagcaggtggcggtccgcctggtagttcgagtgatagcgagtcgtctccaggtgcaccttcggaggacgaaagagccgtgcccggacggctcctgaaaacaagagccatgcgagagatgtatcgctcctatgtagaaatgctcgtttccactgctttagatcctgacatgattcaagcactggaggatacacatgaactgaagagaagcgtggtgcgcgcccaagaatttaaagtagaattggagaaatctggatactacacactgtaccattccctgcaccactacaagtaccacacatttctaagatgcagagaccagacactggctatagaagggggcgccgaggatcttgggcaggaagaggtggttcagcagtgtatgagaaaccagccatggctggaacagctgttcgacagcttcagcgatctgttggctcaggcccaagctcactccagatgcgggtag

SEQ ID NO: 32236 - DNA, 6111 bp, Artificial Sequence
  Description of Artificial Sequence: Synthetic coding sequence
atggaccggaactacccgagcgccggtttcggcgatccattgggagctggcgccggctggagctacgaacggagtgccaaggcatctctggtgtacggctccagccgaacgtctcaccctgaaaccgacattctccacagacaggcctatgctgcaccccaccctttgcagagctacgcaactaatcatcaccccgcaggtttaagcggcttatttgacaccgggcttcatcacgcagggtccgccgggcccgacgccagtgtcatgaacctcatctccgctctcgagtcacgcgggccacagcccggtccttcagcttcctccctcctttctcagttccgttcccccagttggcagaccgcaatgcatacaccggggcctactgagctctttatttccggtgcccttccagggtcctctacctttccaagctcaagcgcattgagcgcctatcaacacccagccagttttggttctcgccccttcccggttccaagctctttgagtctccaggaccctccatttagccctccagcgaatggcctcttaagtcctcacgacgtcctgcacttgaaaccaagtcaagccccaaccgtacctagcagtctgggcttcgaacgccttgccggcgggggcgtgttgggaccggctggcctgggccccgctcaaaccccaccatatcgtcccggtccccctgacccgcccccgccccctaggcacctgcccacgcagttcaaccttctggcttccagcagtgccgcagccgctgctgccgaacagagctctcctcaattgtataacttttctggtgccgcccccggaccgcctcccccagaacgggctctcccccggcaagatactgtgattaagcactaccagaggcctgcaagcgcacagccccctccgccccccccacccgcccacgctctccaacactatctgtcttgtggcggctcatacccttctatgggacacagggcaaatcttgcatgcagccccctcgggggtggagagcctagtccaggggccggcgagccctccaaagccgggcctagcggagctactgccggggcctctgggcgggcaactggccctgaggcggccggagggggtggggccggtggcgggggcggcggataccggccaatcattcaaagccccggctacaaaactggcaagggaggctacggtgccgcagctggcggtgccacccgaccacccccacctagatctactgcaacccctaaatgtcaatccctcgggggccccgccgccgcttacgccactggaaaggctagcggcgctgggggcgccggtgggcaggcctactctcctggccagccacaaggcctcctcgggccccaagcgtacggtcagggctttgggggaggtcaggcccaggacctgtccaaggctccatcctatagtggaggcccaccacaacctccatctggacctcctccaccagggctggcaacctgccagagctactcacctgatcagctgcaaggccagctgtacggcgtccagggagagccgtacccaggtcccgctgctcactcccaggggctacctactgcatcgccctccctgagttactccactggacatagccctgcactctccggacacggcggggggtggggccctagttcgctcggcggtggcggtgaagccagtccaagccatattatccgcccactgcagtcccctccagcgaccggccgcccaccaggagtcgggtctccgggtgctccggggaagtacctgagctcagtgctggcaagcgcacccttcctggcccccccaggcgccgggtcctacgctgcgggagccggcggttataaaggcaagggtgatgggtccgaactcctcgccggacctggcgggccacccgctgagagaaccgaagatgaggagttcttaatccagcacctacttcaggctccctcacccccacgcaccagcggagctgacggtctagttggagaagatggggcagccgatgcttccaagggcttgggaggatccggaggagcaggaggccccccaggcactccctacgagctcgctaaggaggacccacaacgatatcatttgcaaagtgttatccggacgagcgcctctctcgatgaaggggccaccgctgcactggaactgggcctcggtaggctcaaagagaagaaaaaaggaccagagcgggggggggagacacccgagggcctcgcaacctctgtggtacattacggagcaggtgccaaggaactgggcgcattcctgcagaagagcccgcccccacctccaccaacagcccagtccactcagcccaccccgcacggcctccttctggaggcagggggccccgaccttccactggtcctcccccctcccccaccacagctgcttccctctgtactctcccacgcacccagtccaagcccctctgctagcaaagttggtgtccacctgctagaacccgcaactagggacggagccccacagcccccgcctccaccaccaccgccaccaccacccatgcctctacaactcgaagctcacctgagatctcacggacttgagcctgccgcgccatctcctaggctgaggcccgaggaatctttggacccacctggggccatgcaagagcttctgggagccctggaaccacttccgcctgcccctggcgataccggggtgggtccccctaatagcgagggaaaagatcccgcaggtgcttaccggagcccttctccgcagggcacaaaggccccccgctttgtgcctcttacctccatttgttttcctgacagtctgttgcaggacgaagagagatcatttttcccgaccatggaggagatgttcgggggcggagcagcagacgactatggcaaagccggtccaccagaagacgagggtgaccccaaggcaggagccgggccccctcccggccctccagcgtatgatccctatggcccatactgtcctggacgagcttcaggagctgggcccgaaactccaggactgggcctggaccctaataagccaccagaactaccttctaccgtgaacgcggagccccttggcctcattcaaagtggccctcaccaggccgctcctccccctccgcccccacctcccccacctcctgctcccgcaagtgaacccaaaggcgggctaactagcccgatattctgcagcactaaaccaaaaaaactattgaagactagctcctttcatttactgaggcggcgtgacccccctttccagaccccaaagaaactgtacgcccaggagtacgagtttgaagcagacgaagataaggcagacgtgcccgctgacatcagactgaaccccaggagactgcccgacttggtatctagctgtcggagcagacctgccctctctcccttgggagatatcgacttctgtcctcccaacccagggccggatggtcccagacgacggggtcggaaaccgacaaaggcaaagcgcgacggcccccctcggccgagaggccgtcctcgtataagacccctcgaagtccccacaacagccgggccagcctctgcatcaacgcccactgacggcgccaagaaacctaggggcaggggaaggggccgcggccgcaaagctgaggaggccggggggacacgcctggaaccacttaagcccctgaagataaagttgagcgtgccaaaggcgggtgaggggctggggacctcttccggggacgctataagtgggacagatcataactcattagatagtagcctgacgcgggagaaaatagaggccaaaatcaaagaggtcgaagagaagcagcctgagatgaagtccggtttcatggcttctttcctagactttcttaaatccggcaaacgtcacccccccctttatcaagccgggctgactccacctctatcgcctccaaagtctgtccctccctcagtccccgcacggggactccagccacaaccgcctgcaacacccgcagtcccacacccaccgcctagtggggcctttggtctggggggtgctctcgaagcggcagagagtgaaggcctgggcctagggtgcccttccccctgtaagagattggacgaagagctgaaaagaaacttggagaccctgccctcatttagcagcgatgaagaggacagcgtagccaagaatcgcgacctgcaggagagcatctcgtctgccatctccgctctggatgacccaccacttgccggacctaaagataccagcacccccgatgggcctcctctggcccccgccgccgccgttcctgggcctcccccccttccaggcctgccaagtgcaaatagtaatggcacaccagagcctcctctccttgaggagaagcctcctcccacaccaccccccgcccccactccacagcctcagcccccgcctccaccacctcctccccagcccgccttaccgagccccccccccttagtcgcccccacacctagttcgcctcctcccccccctcttccaccacctccacctcctgcaatgccgagtccacccccaccccctccccctgccgctgctccactcgcagctcccccagaggagcccgctgccccttcccctgaagatcctgagttgcccgacactcgccctctgcatctggctaagaaacaagagactgctgccgtctgcggagaaacagacgaggaggccggagaatctggtggagaggggattttccgggagcgggacgagtttgtcattagagcagaggatataccatctttaaagcttgctttacagacggggagggaacccccacccatctggcgggtgcagaaggccctgctccaaaagttcactccggaaatcaaggacgggcagcgtcagttttgcgcaacttcaaattacttgggctatttcggggatgccaagaaccgttatcagcggctatacgtcaaatttctggagaacgtcaataaaaaggactacgttagggtttgcgcacgtaaaccatggcacagacccccggtgcccgtgcgccgtagcggccaggccaaaaacccagtgtctgccggcgggagtagtgcaccaccccccaaagccccagcgcctccgcccaagcctgaaacccccgagaagacgacttccgaaaagcctccagagcagacccccgaaacagccatgcccgaacctccagcacccgagaagccatccctccttcgtcctgtggaaaaggagaaagagaaggaaaaggtcacgaggggagagagacctctgcgtggcgagagagctacttcagggcgacagacacgtccagagcgttccctggcaaccggtcagccggccacgtctaggctgcctaaggcccgacctaccaaggtcaaggctgaaccgccgccaaagaagcgaaagaaatggctgaaagaggctggcggaaacgcaacagcaggaggcggccctccgggtagctcgagtgactctgagtcctctccgggcgctccctcagaagatgagagagccgttcctgggagactgctaaagacacgggctatgagggagatgtatagaagttatgtggagatgctggtctccaccgctctggacccagatatgatccaggctctagaggatacgcacgatgaactctatctgccacccatgcgcaagattgatggtctgttgaatgaacataagaagaaggtgttgaagagactgagcctgagtccagcactgcaggacgccctgcacacattcccacagctacaggtggagcaatccggggaaggtagtcccgaggaaggcgcggttcgcttacgccccgctggggaaccctacaatagaaagactcttagtaaattaaagcggagcgtggtgagggcccaggagttcaaggtcgagctagaaaaatcgggttactacactctgtaccactctttacatcactataaatatcacaccttccttagatgtcgcgaccaaacactagcaatcgaaggaggggctgaagacctggggcaggaagaagtggtgcagcagtgcatgaggaatcagccgtggctagagcagttgtttgatagctttagcgacctgttggcgcaggcacaggcccactcacggtgtggctag

SEQ ID NO: 32237 - DNA, 1677 bp, Artificial Sequence
  Description of Artificial Sequence: Synthetic coding sequence
ggccgccccttaggaggcgacgccagacgggaaggggccagcgtgggcggcacgagtcgggattggagtgaagaggggatatgcctcacggtggacccctggggatcaaccctttcctctgagatgcttcagctcggcccaccactttctgagcgaagtttcgctgcgctcaaactcacaggggaagggaaagcgagtcctggacgtcaagcaggctggtcctcccaggctaggcctcccgatccactgtgcttatgtcgggagccactctccaggattcatagaacatccagcacgctgcggaggaggagccgtacaacccccggaccggaggaagggccttcacaaaaggtagatagagcaccccagccaacactggtcgtcatgttggaggatatagcttcacctagaccccctgcagagggtttcattgatgagacaccgaacttcattatccctgcgcaacgcgcagagcctatgaggatcgttcggcagccaaccccgcctcctggcgatcttgaacccccattccagcctagcgcactccctgctgatcccctcgaatctccccccacggcacccgatcccgccctcgaactgccctccacccctcctcctagctctctcctgcgacccagattgtccccttggggcctggccccactctttcgatcggtgagatctaaactcgagtccttcgccgacattttcttaacaccaaacaagacaccacaaccccctccaccaagcccaccgatgaaactggaattaaagatcgcaattagtgaggctgaacagagcggcgcagctgaagggaccgcctcagtgtccccccgcccccctatcaggcagtggagaacacaggatcataacacccctgcattgctcccgaagccatccctgggccggtcctacagctgcccagacctcggtcctccagggccaggtacctgcacgtggccccctgcacccccccagccaagcagacccaggcctcgccgtcataccgtagggggaggtgagatggccagagcacccccgccaccgagaccctgcctgaggaaggaagtgttccctctgggtggggtaggagccagtccctccctcacaacgagctgctcaagtacagcttctacaagcttcagcgagccggctgaaccacggctgggatccactaaggggaaggagccccgcgcctccaaggatcaggttctctctgagcccgagacaaagaccatggggaaggtgtccagattcaggattcgccgcacgcccgcccgcccccagctgaatctgacaccgatgggtctgcctcgtcccattaggctcaataagaaagagttttcgctggaggaaatttacactaataagaactaccagtccccaaccactcgccgaacatttgaaacaatctttgaagaaccacgcgaacgcaacggaacactgatctttacttcctcacggaagctgcgacgcgccgtggaatttagagactcctcgctgcctcgctccaggcgcccctcccgcggggtccgagccgccggtggcaggacagtcccacctaatgtcgccccaagtccagatgtaggccctctgctgcagcagcgactcgaggaactggacgccctcctcttagaagaagagacagttgacagggagcagccacattggacctag

SEQ ID NO: 32238 - DNA, 1758 bp, Artificial Sequence
  Description of Artificial Sequence: Synthetic coding sequence
atggacctgcctggtgactccagcccaccggggcaacctagattgtgtaggcagccactgactagagcactatggggtgccaggagtcctaagcgaccccggctgcaacttcccggtgcacccagtcctttggaaaaagcatctcgccgggtcctggcggtagtcctggaggatgtgatggcagtgcatatggtgccagtggtgcctagtaaacagacaagcattccgcagcatcactcctaccatcaggatcctgtacacaggcaaccccccgcttccccaccacggcaggctggctggagttcacaagcccggccacctgatcctctttgtctctgccgggaacctctaagccgtatacacagaacatctagtaccctgagacgaaggagcaggacaacgccagggcctgaagaggggcctagccagaaggtcgacagagctccccagccaactctggttgttatgctggaagacatagcttccccccgcccccccgccgagggcttcattgatgaaacaccaaatttcatcatccctgcccagagagcagagccaatgagaattgttcgccagccaacaccgcctccgggggatctagagccgccattccaaccttctgctctgcctgccgatccgctagagagtcctccaaccgctcctgacccagctctcgaactgccatctacaccgccaccaagttcactcctgcggccaaggttgtccccctgggggctggccccactgtttagaagcgtcaggagtaaactggagtcctttgccgacattttcctgacccccaacaagaccccccagccaccacctccttcccctcccatgaaactcgagctgaagatcgcaatcagtgaggctgagcaatccggtgccgctgagggaactgccagcgtttctcctcggcccccaatcaggcagtggcggacacaggaccacaatacaccggcactgttaccaaaaccctccctgggacgctcatactcctgtcccgatttaggcccacccgggcctgggacatgcacttggccaccagctccacctcagccttccagacctaggcccaggcgccatacagtgggaggcggggagatggcccgcgctcccccccctccgcggccctgcctgcggaaggaagtttttcctctggggggtgtcggagcatctccttccttaaccacatcatgcagttccacggcctctacctcatttagcgagccagccgagcccagactcggcagtactaaaggcaaagaaccccgagcaagcaaagaccaggttctgtcagagcccgaaacaaaaactatggggaaggtatcacgattccggattagaaggacccctgcccggccccagctaaatctgaccccgatgggtttgccacggccaataagactcaataaaaaggagttttcactcgaagagatttacacgaacaaaaactatcaaagcccgaccactaggcggacctttgagaccatttttgaagaaccccgggagagaaacgggacacttatcttcaccagctcccgtaaactgagacgggccgtggagtttagggactcgagtctaccacgatcccgtcgtccctcgcgtggagttagggctgcagggggcaggaccgtcccccctaacgtggctccttcacctgacgtgggaccactcctccaacagagattagaagaacttgacgctctactgctggaggaggagacggttgatcgggagcaacctcactggacctag

SEQ ID NO: 32239 - DNA, 1758 bp, Artificial Sequence
  Description of Artificial Sequence: Synthetic coding sequence
atggacctccccggagactcctctccccctggacagccccgtctgtgcaggcaacccttaacgcgtgccttgtggggagcacgctcacctaagagacccagactacagttgcctggggctccttcgcctctggaaaaggcaagtaggcgggtgctggcagttgtgctcgaggatgtgatggccgtccacatggtgcctgtagttccttctaagcagacatccattccccagcatcatagctaccaccaggaccctgtgcaccgacagccgcctgcctccccacctagacaggcgggctggagctcacaggcacgtcccccggatcctctttgcctttgtagggagcctctatcacggattcatcgaacctcgtcaacactgagacggagatcaagaacaacgcctggacccgaggagggcccatcacagaaggtagatcgggcgccccagccgactctggtggtcatgctagaggacatcgcttcacccaggcctcctgcagagggctttattgacgaaaccccgaattttattatcccagctcagcgtgcagagccgatgcgaattgttaggcagcctaccccacctcccggagatctcgaaccaccatttcaaccctccgctttacccgccgatccactggagtcaccgcctactgcgcccgaccccgcactagaactgccatccaccccgcctcccagcagtctgttacggccccgcctctccccttgggggttggccccgctcttccgtagcgtgaggtcgaaactggagtcctttgccgacatcttcctgactcccaacaaaaccccacagcctccacctccttcccctcctatgaagctggagctgaaaatcgcaattagcgaggccgaacagagtggggctgctgagggcacagcttccgtgagtcccagacctcccatccgtcagtggagaacgcaggatcataatactcccgctctgctcccgaaacccagcctcggaaggagttattcctgccccgaccttgggccccctggccctggcacctgtacatggcccccagccccgccgcaaccgtctaggccaaggcccaggagacacaccgtaggtggcggcgaaatggccagggcaccgcctcccccacgaccatgcctcagaaaggaggtgtttccactgggtggggttggcgcctcaccttcgctgacaacaagctgtagtagcaccgcttcaacctccttcagcgagcccgctgaaccccggttgggctccaccaaggggaaagagcctagggcatcaaaagatcaggtgctaagcgagccagagaccaagacaatgggtaaagtgtcacgctttagaatccgccgtacgccagcgcgccctcagcttaatctgacccctatggggttacctcggcccattaggcttaacaaaaaggaattctcccttgaagagatctatacaaacaaaaactaccaaagcccaactacacgccggactttcgagactatcttcgaggagccccgtgaaaggaatggcaccctgattttcacatcctctaggaagttgaggcgtgctgtggagttccgcgactcctccttgcctcgatcccggcgcccaagcagaggtgtccgggccgctggaggtcggaccgtacctcccaatgtggctccgagtcccgacgttggccctctgcttcagcagcgccttgaggaattggatgccctcctcctggaggaagagacagtcgaccgcgagcagccacattggacctag

SEQ ID NO: 32240 - DNA, 6450 bp, Artificial Sequence
  Description of Artificial Sequence: Synthetic coding sequence
atgttatcctctggtgtggagacacagcctgtgcctctggatagttcaatgagcgccgtggtgcaggaactttattcggaactccccgtctccgtatctagggaacttcacgcagaccccgaaccatccgtcattccagacgttaagcctggggcaagcagcagtttattgtcccagaatcgggcccttcctctggagttgcagagaacacacgttgagagctgctgtgaagagacctatgaaacactcgaccatggaagcgagcccggcagatgtgggctggtggacagcaccgcagggggcagtgtagcatctggtatcttggacagagccaagcgcagcgagtctatggaacctaaagtgttccgtgatccaggcggccaagccggaatcatcagagaaccaagcgaaggcgccaaagaagaccctcaccagcactctactgcagcggaagagaagacatctccatcgcaggaggatttgttgatgcagagctccaaggaattatcgcacgtcgatctgccagaggactttttacgatccaaggaaggcaacgtgcaaatcactgccgagacactcctgaaatctgccgaagtgcaaggtatgaaggtgaatggtactaaaacggacaacaacgagggccacaagaacgggaatgtgagcaaagatctctcagccgggtgcggggaattccaggaagttgacaagatcatgacatccgatgaagtgtctgagactagcacactggttacacccgagccattgactttcgtcgatcccgttctaacggaggctactcccaaagaaaaggagtgcgaggaactcaaatcctgcccttggctgtcactacccgggaactcagccatcagcaacgttgataacggtaaggaggaactatgcaagcccaatctggtctgcgaagctgatgataaccaccagcagctgcatggccatcacaacgagcagccttcttctacacacgactcaccgacagcaacttcccccttgaaggaaaactcagaggtttcctgctttacttcggatctgtcgggcccagaatctcgcacaatctccctcgaaaattgcgggtttgagggtggtggacttctgaaacgaagcgctgagaaaacagactcatcttacttctatcgcggcgatgaccaaggcaagaatttagcgtcacgagaagaaaacgaggagcgacttctcatcccccgcagcgaacgtggcggtcctttcctgttcaacgccagggagcctgagaaagagatatccggccgttgctcaggtgaaaaggagccagtggtaagcccaaaagagaacatacataacaattgtatccaggacagccttcacacaggaaactcatccagccttatgccaaattcttttacggaagccactgaggtcatgttgaacaaaaatgacctgaagattacagttcacgttcaggggaaccttactaatccagaggaccataaggaaacgttcacaaatatgagccatccaggcggtcatagcgaggagagtagcttttcttccttaatgcagatcgaagaggccgggcagaccacccccgtcgaacctaacattctgtctaagagcttctacactaaggattgcaattctctagtcagtatacagcggaatctggaaggcaatactcagctgaatgaggcatcctgtaatgattttctttttgagaggaagagcattgtctctttaatgcccgaagatcagataagccccgtaagcgaggtgctaaaacctaagcaaggcactgccctattactaccgtcccctgagtttgactaccgccccgagagtgaaaaggtgatacagacatctcacgacgacattccactgcttgacgagcagagtattgcctgtgaaatgaacgagctgagctgtacgaatgagttggttgtaaacaaggtcgaaagcgagtgcgtcctcaatcagcaagtgtctctcaattcacaggagcacgctaatctgcctacggactctttactgcatctgaataaagagatgcctctggccaccggcagggacgctcaccaatctcaccatcctccgctggagggccgcgccgatgtcatcgctgatatccaaacaataccaatccagacaaaaatcaaagacatttcgcctccgggaaaccagacatgcggtgcgagttcaaattgccccacgctgaatataaaacctgtcagcctggagcggaaaaaggaaatggccgactcaggaacaaaggctctgcactctcgactgaggtccaataaacgcgaagctgctggttttccccaggtcgtgagcgtcatcgagtgtcatagtgtccagagtcaggacatctctagctgccaccgggtgagaaagaacgtcagccaggagaatatgtgttccgcctccgctgccttcaaatctagcaaaatttcactgcaggtcgataactcgttaatcacgaaatacgaaaatgccttccagcatcgggaccattgttgccaggggaccggtcactctgtagagaagtcatcttgcaaagtttcctatacctctcaggagagggaactcgacgggaaagagactaatgggtccctgcctggcgacaaaattaggaacaagatggttgccggacttctgaactctggcatctccaataagaccattcacacctcctcaagtattaagctctctgaagaagggctagagggcaaggagcaggacgttagcaaggagacagtcttctgcaagtacaacatctcagatcatgctattcaagagctgaaccagactgtgaacatacccggacccgaaaaggtgctggatcagagccctacagtaatgttctcctctttcaaaaacgttaagtcagtggagacactcgatcagaaggcggatgaggtcctagattgtcagagcaaccagaaccgacctgatgagtgtaagagtgaggggcagtcagccaaggaaatgctgagtagcgaccaaagggagaccgtgactgagccacacggcgaagttaaccataaccagaaggatctgcttgtgagctccgggtcaaacaatagcctgccctgcgggtctcctaagaagtgtaatttgaaaggagccttcgttaaaatgagcggatgtgacgagagtacagagggcatggttgacattgtatacacggactgtagcaataagctggccgaaggtgtgcttgacgttaaggcctccaacctcctagattgtggtgcccgtcaagagaaactagcattccaagaggatagcaggagtactctgtctagacgcgagctggatgcggcccacacaggcacgacagggcaagattccgatttccctgtcaccgcagcctctacggtcgactttttaaaaataaagaaatcatgcgaggaaaatgtgtgtaggtcactaaaggattgtgaaatggaaaagtgccctgattcttgcgcacacgagatggagtcagtggctgaccatgagccaaataaaagaatcctgggccgagttaatctgagcctgaatgatagccattacgggcagcaggataagggcacaagcctgagggaaacacaagaaatgactgaaggttcacggctggagcctaatagcgagtttggaaaggagtccacattcggcatcagttcaaaggaatcaatgtcttgtcatgacgaatctagcgtgtctttacgcagtctcaagtctatcgagatcatgcctagccaggaaaactccgaaaccaatgtgaatagtgaggaaacagatctgaaaaacttatgtaaacctaaggacggtgaaatgctttgtgaaaacgtgaaagattgtaccgtcctgcccgagatgaaggagattgtgagtcgggactggagtaacagtagcgacagagattctgtgtgcacttgtgtggagaagaacgcttgtaaagcttgtcacccgcacgaaaactcctccgaccgacacttaccactgaccgttaagactgacatcaaggttaagggcgaagagaccgaggagcaccagagaggccggcttgggtatctcactgtgggtgaacagtcagaggagctggtgaccagagaaaccggcgacggcgatcccgtatctaatatttcccagacccacttcaagtgccgcggaatccttaaccatgccgaaaaacagcagtctccagaggtgttagactacatgctgcagaaagaagaaaagtatattcgccagcaaaaggctcacactatctcccagcaatgcatcagcagctcattattgttggatgatgcccagaatcaaaatcagcctaaagccgataaagacgagagcaccatgatcaatgaaattactcttgcaaagttggccaaagactccatcgttgcgcagacacagaagctggaggaccaaaaggaggagaggctgcaccaccctcttagaaaggatacggagtcgtgtacttctccctgcctcctgggggccccaagaaaggcccaagacccaagttccgccggctgcgaccagattcatggtgcctttgccaaaaaaggcgtgctccctctgaaaaagcaaccgcacagaacctgcaaaaaagtcagctaccaggaacagattattgtggggagaaagatcggtaaaatccggagctccgccttcctgaagtcttccagcaacccaattccgaccaaagcccacagacttctgtccctgtgcaccctttccgcccccacacgcttggagcctgaaacggctcccactaagagccttgtcagccacataccaaaacaaatgagtactccatgccatcccttgagaagcctgaactttcgaaagacgacgaaagagtcggctctgctgaacaagctgagtatccttgcctctaagctcgcccccgcaatgaagacccagaaattgcggtacaggagatgtagctcggagctgcttcccatggcaaaaagctataaacgcctgcgatacaagcgactgctggacggctttagtagctccactgagcagctgaacccatatctcgcagcaagtggctgggataagaggcccaattccaaacccatggctctctacagcctcgagagcattaagatgaccttcatcgatctatccaataaaatgccaagcctactgttcggctcagagatctttcctgtttcattccacgttaagtccagttcgtcagactgtacgaccgagtccagtaggacctttcccgaacattgcgcccctgcccggctggcactcggcgaagcactgcagtgtccttctcagccaccgaagtggactttttcgttctttctgtcacacggatgcccaggaatggcgacatttcgggaggacaccggcgtccactcacagacacacactcaagcccctccacagcccccagctcccctgcaggattatggggggaccgccatcgtgcagacaagagctgactgctccgtgcttgggctgcatactctgctggcgctttgtagtccgggttgttaccgaatttggaccaagaaacgatctttttcttcccacatgcctacaatgcagagactgtttatgacccagttcacccaagggctcaaaggactgagatcccctgctagcatcgccgacaaggtgttttgctctctgccctatagtgtggggcgcgtactgtcgatttggtcacagcacggtccctccgtgtgctcctttgagattagtagtctgcacagtccccactgtaagcgccagccgtccctgggcacaacatcttcccataccatgctgccttatgtccccctaccaggcatggaggccacctacaatacctcggggtctcagacgcgcctagaacccccttttccagccctagtgcctaagtcttgcttagtagccgaatcagcagtttccaagttgctcttgtcggccagcgagtttcaggtgagaggactggacgagctggacggcgtcaaggccgcgtgcccgtgccctcaatcctcccccccggagcaaaaggaggccgaaccagaaaaaaggccaaagaaagtcagccaaataagaatacgcaagaccataccacgccccgatcccaatctgacccctatggggcttccacgtcccaagcggttaaagaagaaggagtttagtctcgaagaaatttatacaaacaagaattacaagtccccccccgccaaccgcgatttagattcgagctgccccagcaccgattcggagacgggtcatttcctcgtatttggctacgcccagagacaggcccagccccacccccttctagcatctcgcaggcttattgggtgtagctcacccgaagggcgagggcatccacgctcttacccgtactggcgacgattgctggtgctgtgttggtatctcccaggctggcgagcggggcgagtgacttggctgagacttgccacgtgggccggaaggggcgacagttccctttag

SEQ ID NO: 32241 - DNA, 6021 bp, Artificial Sequence
  Description of Artificial Sequence: Synthetic coding sequence
atgctatcctccggtgtggagactcaacctgtcccactggattccagcatgagcgctgtggtacaagaactgtatagcgagctacctgtgtctgtctctcgagagctccacgctgaccccgaacctagcgttattccagacgtcaagcctggcgctagtagtagtctattaagtcagaatcgcgcgttgccactggagctgcagcggacccatgtagagtcctgctgcgaagagacatacgagaccctcgaccatggttccgagcctggcaggtgcgggctggttgactctacggctgggggcagcgtcgcttccgggattctcgatcgcgctaaaaggtccgagagcatggaacctaaggtctttagggaccccgggggccaggcggggatcatccgggaaccttctgagggtgctaaggaggatccgcaccagcactctaccgcggccgaggaaaagacctctccctcgcaggaagacttattgatgcagtctagtaaggagctgtcccacgtggacttgcccgaggatttcttacgaagtaaagaagggaacgtgcagatcactgcggaaacactgctcaaatccgcggaagtccagggcatgaaggtgaatggcacgaagacagacaacaacgagggccataagaatggcaatgtctccaaagatctctcagccggatgcggtgagtttcaggaggtggacaaaataatgacttccgacgaggtatcagagacatccaccctggtgacgccggaaccgctaacatttgtagatcctgtgcttactgaggccacacctaaggagaaggagtgcgaagaattgaaatcctgtccctggctttctctcccaggcaacagtgcaattagcaacgttgacaacgggaaggaggagttgtgcaaacccaacctggtgtgtgaagccgacgataatcaccagcaactacatggacaccacaacgaacagccaagttctacacacgacagtcctaccgctacgtcccccttgaaggaaaatagtgaggtgagctgttttaccagcgacttatccggtccggagagccgtaccatttcactcgaaaattgtgggttcgagggaggcggacttttgaagcgttcggcagagaagaccgactccagttacttttatagaggcgacgaccaaggaaagaaccttgcaagccgggaagagaacgaggaacgtctactgatccccagaagtgaaaggggggggccctttctctttaacgcgcgggagcctgagaaggagatcagcggcagatgctccggagagaaagagcccgtggtgagtcccaaagaaaatattcacaacaattgcatccaggatagccttcatacaggtaatagctcttcgctgatgccaaactcatttacagaagctactgaggttatgcttaataagaatgatctgaagataacggttcacgtgcagggtaacctgaccaacccagaggaccacaaggaaacttttactaacatgtctcaccccgggggtcattcagaggagtccagttttagctctctgatgcagatcgaggaggccggacagacaacccccgtggagcctaatatcctttctaagtctttctacactaaagattgcaactccctggtttctatacaaaggaacttggaggggaacacacagctgaacgaagcttcatgtaatgatttcctgttcgaaaggaagagcatagtttcattgatgccagaagaccagatctcacctgtgagcgaggtgctgaaacctaaacaagggaccgccctgctgctccccagtccagagttcgattacagacccgaatctgaaaaggtaatccagacgtcccacgacgacattcccttgctggacgagcagtccattgcctgcgaaatgaatgagttgtcatgcaccaacgagctggtcgttaacaaggtagaatctgaatgcgtcctgaaccaacaggtgagtctcaatagtcaagaacatgctaatctgcccacagattccctcctgcacctgaacaaagaaatgcctctggccaccgggcgtgacgctcaccagagtcaccatcccccactagaagggagagccgacgtcatcgctgacatccagaccatcccgatccagaccaagataaaagacatctcaccccccggcaaccaaacctgcggcgccagtagtaactgtcccaccctgaatatcaagcctgtgagtctggagcgaaagaaagaaatggcggacagtggtacaaaggcccttcattcaaggctgaggtctaacaagcgagaggccgctggttttccccaagtggtgagcgtgatagagtgccacagcgtgcagtcccaggacatctcttcttgtcaccgagtaaggaagaacgtctcccaagagaatatgtgttctgcttccgccgctttcaagtcatccaagatatcacttcaggtcgacaattcactcataactaagtacgaaaatgctttccagcaccgtgaccattgttgccaagggacaggacactccgtggagaagtcttcctgtaaggtcagctatacatcccaggagagggagctggacggcaaagaaacaaacgggagtctgcctggtgataaaataaggaacaaaatggtcgccggcctgcttaatagtggcataagcaacaaaacaatacatacctctagctcaatcaagctgtccgaggagggcctggagggtaaggagcaggatgtgtcgaaagagactgtcttttgtaaatacaacatctccgaccatgcgatccaggagctgaaccaaactgtgaacattcccggccctgagaaagtgctggaccagagccctacagtgatgtttagctcgttcaagaatgtcaagtccgttgaaactctggatcagaaggctgacgaggtgctggactgccagagcaaccagaaccgtcccgatgaatgtaagagtgaaggacagtcagccaaagagatgctaagtagcgatcagagagagactgttaccgaaccccacggggaagtgaatcacaaccaaaaagatctgctcgtgtccagcggcagtaataacagcctcccttgcggttcccctaagaaatgcaatttgaagggagcatttgtgaagatgagtggctgcgacgagtcaactgaaggcatggtcgatattgtgtacaccgattgtagcaacaaattggccgagggagttctggacgtaaaagctagtaaccttcttgattgtggggctcggcaggagaaacttgccttccaggaggactctcgaagcacactgagccgccgggagctggatgccgcacacactggaacaaccggccaggattcagacttccccgttacagccgcatcaaccgtggactttctgaagattaaaaaatcatgcgaggagaacgtatgccgtagcctgaaggattgtgaaatggaaaagtgccccgatagctgcgctcacgaaatggaatctgtagcggaccatgagcccaacaaacgaatactcgggcgcgtgaatctgtccctcaacgattcacattatggccagcaggataaggggacgtcgctcagagaaactcaagaaatgacagaaggctctcggctggagccaaatagtgagtttggcaaggagtcaaccttcggtatcagcagcaaagagagcatgtcttgccacgatgagtcaagtgtctccctgagatcccttaagtctatcgagatcatgccgtcccaggagaactctgaaacaaatgttaatagcgaggaaaccgatctgaaaaatttatgtaaacccaaggatggtgagatgctgtgcgagaatgtgaaggactgcacggtgctccctgagatgaaagagattgttagcagagactggagcaactccagcgaccgcgacagcgtttgtacttgtgtagagaaaaatgcctgcaaagcctgtcatcctcatgagaacagctccgacaggcacctgcctttaacagtgaagactgacataaaagtaaaaggcgaggaaaccgaggagcatcagagagggcggctcggttacctaactgtcggtgagcagtcagaagaactagtgaccagggaaaccggagacggagaccctgtgtcaaacatatcccagacccatttcaagtgtagggggatcctgaatcacgctgagaagcagcaaagtcctgaggttttggactatatgctgcagaaggaggagaagtacattaggcagcagaaagcccacacaattagccagcaatgcatttcctccagccttctgttggacgacgctcagaaccagaatcagcccaaggcggacaaagatgaatcaacaatgattaatgagataacactcgccaagctggcgaaagactcgatcgtagcccaaactcagaagttggaggaccagaaagaagagagactccaccaccctctgcgtaaagatacagagtcctgcacatcaccgtgccttctcggagctcccaggaaggcccaggatccctccagcgccggctgcgaccaaattcatggtgcatttgccaaaaagggagtcttgcccctgaagaagcaaccgcatcgcacgtgcaagaaagtctcctaccaggaacagataattgtcggccggaagatcgggaagattagatccagcgcattcctgaagtctagtagcaatccaattccaactaaagcacatcgtctcttatcactatgcacgctgtccgcccctacaaggcttgagcctgaaactgctcctactaaatccctcgtcagtcacattcccaagcagatgagcaccccttgccatcctctcagatccctgaattttaggaaaactaccaaggagtccgcactgttgaacaagctgtccattctggctagcaagttggcgcctgccatgaagacacagaaacttcggtatcgacgctgctcaagtgaactgctccccatggcaaagagttataagcgactccgctacaagaggctcttagacggctttagctccagtactgagcagctaaatccctacctagccgctagtgggtgggataagcggccgaatagtaagcctatggccctgtactcactggagagtatcaaaatgactttcattgacttgtcgaacaagatgccatccctccttttcggctctgagatctttccagtgtctttccatgttaaatcctctagtagcgactgcactaccgagtcaagccggacattccccgagcactgcgctccggccagattggctctgggtgaagccctgcagtgcccatcccagcctccaaagtggactttttcattcttcctgtcccatggatgcccaggtatggctacgtttagggaagacacaggcgtgcactctcaaactcacacacaggccccgcctcagccaccagcccctttacaggactatggtgggaccgccatagtccaaactagggctgattgctctgtgttagggttacatactctcctggcactttgctcaccaggttgttatcgtatttggacaaagaaaaggagttttagctctcatatgccgacaatgcagcggttattcatgactcaatttactcaagggctcaagggacttaggtcaccagcctcaatcgccgataaggtgttttgctcccttccctacagtgtgggtagggtcctgtctatatggtcacagcacggccctagcgtgtgctcatttgagatatcttctctccatagcccccattgcaagcgacaaccctcactgggaacaacaagttcacatacaatgctgccttatgtccctctcccaggcatggaggccacgtacaatacgtcaggctcccagacccgtttagagccacctttccctgcgcttgtgcctaagtcttgtctggtcgccgagtctgctgtctcgaaactcctgttatcagcttcagagttccaggtacgcggcctcgacgagctggatggcgtgaaagccgcttgtccatgtccgcagagtagtcctccagagcagaaggaagttaaggaagagggagtctag

SEQ ID NO: 32242 - DNA, 6456 bp, Artificial Sequence
  Description of Artificial Sequence: Synthetic coding sequence
atgctttcaagcggagtggagactcagcccgtcccacttgatagttctatgtccgcggtggtgcaggaactgtactctgagttgcccgtcagtgttagccgggagcttcatgccgatcctgaaccctcagtaattcctgatgtaaaacccggcgcaagctcatccctgttgagccagaatcgagctctccccttggaactgcagagaacgcatgtggagagctgttgcgaggagacatatgagactctggatcacggatcagagcctggtaggtgcggtctagtggactcaacagcgggagggtcagtcgcgtccggaatcctggacagggccaaacgttctgagagcatggagcctaaggtattcagagacccaggcggacaggcaggtatcatccgagaaccttcagagggtgcgaaagaggacccgcaccagcatagcaccgcggccgaggagaagacttcaccatctcaggaagatttgctgatgcagagctctaaggaactaagtcatgtggatctacccgaggattttctgagatcaaaggagggcaacgttcagatcaccgctgaaacgctactgaagtccgctgaagtgcaaggcatgaaagtgaatggaaccaaaactgataacaatgaggggcataagaacgggaatgtctccaaagatctgtccgctggctgtggcgagtttcaggaggtcgacaaaatcatgacctcagacgaagtaagcgaaacatccacactggtaaccccagagccgctaaccttcgtggatcccgtgctgaccgaagccactcctaaagaaaaagagtgtgaagagttgaagtcttgcccatggctgtctttgccaggcaattcggccattagcaatgtggataacggcaaggaagaactgtgcaagcccaaccttgtgtgcgaagccgatgacaaccaccagcagttacacggacaccacaacgagcagcctagctcgacacacgactctccaacagccacctcaccgctgaaagaaaactccgaagtcagctgcttcacctccgatctttcggggccagagtcacgcacaatttctctcgaaaattgtggatttgagggtggcggtctcttaaagagatcagcagagaaaacggatagtagttacttctacaggggtgacgatcagggaaagaacctcgcgtcgcgagaagagaatgaggagcgactgttaatacccaggtcagagcgtggtgggccattcctgtttaatgcccgagagccagaaaaggagataagcggacggtgctcaggtgagaaggaacctgtggtgtcaccaaaagagaacatccacaataactgcatccaggactcattgcacacaggaaattcttcgagtctgatgccaaactctttcacggaggcgacagaagtcatgctgaataaaaacgatctgaagatcacagtccacgtgcaaggcaaccttacaaatccagaggaccacaaggagacctttactaatatgtcacatcctggcggccattctgaggaaagctccttctcctccctgatgcagattgaagaggccggtcaaaccactcccgttgagcctaacattctatctaagagtttttacacaaaagactgtaatagtcttgttagcatacagcgcaatctagagggcaatactcagcttaatgaagcttcctgtaatgacttccttttcgaacgaaagtccattgttagtctcatgcctgaagatcagatctctcctgtctcagaggtgctgaagccaaaacaggggacagccctattacttccatctcccgaatttgattataggcctgaaagcgagaaggtgatccagacctcgcacgacgatattccactcctggatgagcagtctatagcttgtgagatgaatgagctcagttgtaccaatgagctcgtggtgaacaaagtagagtccgagtgtgtcctcaaccagcaggtgagccttaactcgcaagagcacgctaacctgcccactgattcactgctgcacctcaataaggaaatgcccttggctaccggccgggatgcccaccagagtcaccacccaccactggaagggcgcgctgatgtgattgcagatatccagaccataccaattcagacaaaaatcaaggatatctctcccccaggaaaccagacctgcggggcatcttccaactgtcctactttgaatatcaagcccgtctcactagagagaaagaaagagatggcggactcaggcaccaaagccctccactcccgactgaggtcgaataagcgcgaggcagccggtttcccccaggtcgtctccgttattgaatgtcatagcgtgcaaagtcaagacattagttcatgccacagggtccgcaagaacgtctcacaggagaatatgtgcagcgcttcagcagccttcaagtcaagtaagatttcactgcaggtagacaattctctaattaccaagtatgagaacgcctttcagcaccgggaccactgttgtcagggcaccgggcactctgtggagaaaagttcttgcaaggtgtcatacaccagtcaggagcgagaactggatggcaaggagacaaacggctcactgcccggcgacaagattagaaacaagatggtggctgggctgctcaactccgggatttcgaacaagactatccacacatcgagctctattaagctgagcgaggagggattagaaggaaaggaacaagacgtgagcaaagagacggtcttctgtaagtataacatctctgaccacgccatacaagaactgaaccagaccgtcaatatccccggacctgaaaaagtgctcgatcagtcacccaccgttatgttctcttccttcaagaatgtgaagtctgtcgagactctggaccagaaggctgacgaggttttggattgtcagtctaaccagaataggccggacgaatgcaagtccgaagggcaaagtgccaaagagatgcttagtagcgaccagcgcgaaactgtgacagaacctcatggggaagtgaaccataaccagaaggacctgctcgtctcctctggatctaacaactcgctgccatgcggctctcccaagaagtgtaatctgaaaggagctttcgtaaaaatgagtggctgtgatgagtctacagaaggaatggtggatatcgtatacactgactgttcaaataagctggctgagggagtgcttgatgtcaaagcttctaacctgctggactgcggcgcgcggcaggaaaaactggccttccaggaagacagcagaagtactctaagcaggcgcgaactcgatgccgcgcataccgggaccacaggtcaagatagcgactttccagtgaccgccgcctcgaccgtcgacttcctgaagataaagaaaagttgcgaggagaacgtctgtagatcgttaaaggattgtgaaatggaaaaatgcccagacagctgtgctcatgagatggagagcgtggctgatcacgaaccaaacaaacgcatcttgggcagggttaatctgagcctgaatgatagtcattacggccaacaggataaaggcacatccttacgcgagactcaggagatgaccgaaggaagtaggctcgagccaaatagcgagtttggaaaggagagcacttttggcatcagcagcaaggaatccatgtcctgccatgacgaatctagcgtgtcactccgtagcctgaagtctattgaaattatgccatcccaagagaacagtgagactaacgttaattccgaggaaacggacctcaagaatctgtgcaagccgaaggacggcgagatgctttgcgagaatgtgaaagactgtacggtcttacccgagatgaaggaaatagtgtccagagattggagcaactcatcagaccgagatagcgtgtgcacctgcgtggagaaaaacgcatgcaaagcctgccacccacatgagaactcctctgacagacacctgccccttactgtcaaaactgacatcaaggttaaaggggaggagaccgaggagcatcagagaggacgcctgggctatctgacggtgggcgagcagtcggaagagctggtgacgagagaaaccggagacggcgaccccgtaagcaacatctcccagactcacttcaagtgtagaggcatcctgaaccatgctgagaagcagcaaagccccgaagtgcttgattacatgctgcagaaagaagagaaatacattcggcagcagaaagcccacaccatttcacagcaatgcatctcttcctcgcttctccttgatgacgcacagaaccaaaaccagcctaaggctgacaaggatgaatcgacgatgatcaacgagattacactggcaaaactcgctaaggattcaattgttgcccaaacgcaaaagctggaagatcaaaaggaggaacgactgcatcatcctctgaggaaggataccgaatcctgtacgagcccgtgcctgctcggggctcctcgtaaagctcaggacccttcaagtgcaggatgtgaccagatccacggggcttttgctaaaaagggcgtccttcccctcaaaaaacaaccccatagaacttgtaaaaaggtcagctaccaggagcagataatcgtgggcagaaaaatcggtaaaatccgcagttcagcctttcttaagagctcttccaatcccattcctaccaaggcgcacagactgctaagtttgtgtaccctttcagcccctactcgtttggaacctgaaacagcacctacaaagagcctggtgtcccatatccctaaacaaatgtcaactccctgtcatccattgaggtcactcaactttcgcaaaaccactaaggagagcgctctcctgaacaaactgtcaatcctggcctccaagcttgccccagcgatgaagacccagaagctgaggtatcgacgatgttcctcagagttgctccccatggctaaaagttacaagagactgcgctacaagcggctgctcgatggcttcagtagcagcaccgagcaactcaacccttacctcgccgccagtgggtgggataaacgacccaacagcaaaccaatggcattatatagccttgaatcgattaaaatgacatttatcgatctgtccaacaagatgccttccctgttgttcggatctgagatattcccggtgtcatttcacgtcaagtcttcctcctcggattgtacaacggaaagcagccgcactttcccggaacattgtgccccagcacgcctggcattgggcgaagccctgcagtgcccctcccagcctccaaaatggacatttagcttctttctgtcccatgggtgtcctggcatggcaacgtttcgcgaagataccggggtccactcccagacccacacccaggcgccgcctcagccacctgcgccattacaggattacggcggtactgccatcgttcaaactagggccgactgcagcgtcttagggctgcacacactactggcactgtgtagcccgggctgttacaggatctggaccaaaaaacgatcattctcgagtcacatgcccaccatgcagagactgtttatgactcagttcacccaaggtctgaagggcctgcggagccccgcctccatagccgacaaggtgttttgctcactcccctactctgtggggcgggtcctgagcatatggagccagcacggcccgagtgtttgtagctttgagatctcttccctccactctcctcattgtaagcgccaaccatcgctgggcacaacatctagccacaccatgttgccttatgttcctttacccggcatggaggccacatacaatacatctggcagtcagacacgactggagccaccctttcctgccttggtcccaaagagttgtctagtggctgaatccgctgtgagcaagcttctcctgagcgcttctgagtttcaggttcgaggattagacgagcttgacggcgtcaaggccgcctgcccctgcccccagtcctcgccaccagaacaaaaagaggctgagcccgagaagcgcccaaagaaagtgagtcagatccggattcgcaagacaatccctaggcctgacccaaatctcacaccaatgggattgcctaggcctaagcgccttaagaagaaggagttctccttggaggagatatatacaaataaaaactacaaatctccccccgcaaacaggtgcctggaaaccattttcgaggaaccaaaagagcgtaacggtaccctcatatccattagtcagcagaagcggaagcgtgtgctggaatttcaggacttcacagtccctaggaaaagacgagcgcgcggtaaggtcaaggtagccgggagtttcactcgtgcccaaaaggccgctgtccagtctcgtgagctggacgctttactgattcagaagctaatggagctggagacttttttcgctaaagaagaggagcaagaacagtcctccgggtgctag

SEQ ID NO: 32243 - DNA, 390 bp, Artificial Sequence
  Description of Artificial Sequence: Synthetic coding sequence
atggcagacagcggagatgctgggtcctcaggcccctggtggaagtctttgacaaactccaggaagaagtcgaaggaagccgcagtgggggtgcccccgccagcccagcccgccccgggggaacccactccccccgcccctccttcaccagactggacaagtagctccagagaaaatcagcaccctaatttattgggcggggccggtgaacctccaaaaccagacaagctgtacggtgacaagagcggctcctcacggcgaaacctgaagatcagcaggtcgggccggttcaaggaaaaacgaaaggttcgcgccactctgttgcccgaggcaggcagatcccctgaagaggccggcttccctggcgacccacatgaagataagcagtag

SEQ ID NO: 32244 - DNA, 57 bp, Artificial Sequence
  Description of Artificial Sequence: Synthetic coding sequence
atggccgatagcggggatgccggatctagcgggccatggtggaagtcactaacatag

SEQ ID NO: 32245 - DNA, 312 bp, Artificial Sequence
  Description of Artificial Sequence: Synthetic coding sequence
atgaccacggaaattggatggtggaagctcacattcctgcgaaagaaaaagagcactcccaaagttttgtatgagattcctgatacctacgcccagactgaaggcgacgccgagcctcctcgtcccgacgcaggaggccccaacagtgactttaacactcggctagagaaaatcgtagacaaatctaccaaaggaaaacacgtcaaggtgagcaattccggaagatttaaagagaagaaaaaagtcagagctacactagctgagaatccaaatctgtttgacgaccatgaggagggcaggtccagcaaatag

SEQ ID NO: 32246 - DNA, 846 bp, Artificial Sequence
  Description of Artificial Sequence: Synthetic coding sequence
atggcccaatctgggttgacggccacttctgcatcccaggtgcaggccatccttcttcctcaacctgcgtctgtcagacactacgcatgggtggtggaccagatcgatacactgaccagtgacctccagctggaggatgaaatgactgacagctcgaaaaccgacaccttgaattcatcttcttccggaaccaccgccagttcactcgaaaaaatcaaagtgcaggccaacgcccccctgatcaaaccacctgcccatccttccgctatcctgacagtgctgaggaaacctaatccccctccccctccccccaggctcaccccggtcaaatgtgaggacccgaaaagggtcgttcccacagctaacccggtcaagacgaacgggactcttctgagaaatggaggacttccaggcggcccaaacaaaatcccgaatggcgatatctgctgtatccctaactcaaacctcgacaaggctcctgtgcagctgttaatgcacaggccggaaaaagacagatgcccacaagctgggcccagggagagggtacggttcaacgagaaggtccaatatcacgggtattgccccgactgcgatactcgttacaatattaagaaccgagaggtacacctgcattcagaacccgtccatccccctggcaaaatccctcatcagggaccccctctgccccccaccccgcatctgcccccgtttccactggagaacggcggaatgggcatttcccactccaactcttttcctcccatcagacctgctactgtgccgcctccgacagcccctaagcctcagaagaccatcttgagaaaaagcacaaccaccaccgtctag

SEQ ID NO: 32247 - DNA, 915 bp, Artificial Sequence
  Description of Artificial Sequence: Synthetic coding sequence
atgagtgcgaaatcgaagggtaatccttcatcctcttgccctgccgagggacctcccgccgcatcaaagaccaaagtaaaagaacagatcaagatcattgttgaggacctcgagcttgttctcggggacctgaaagacgtggcaaaagagttgaaggaggtagtagatcagattgacacactgacatccgacctgcagctagaagatgagatgactgattcctctaaaacggacaccctgaactctagctcgtcagggaccacagcaagctcacttgaaaaaatcaaagtccaggccaacgcaccactgattaagccacccgcgcaccccagtgcgatactcactgtcctgaggaaacccaatccccccccccctccacccaggctaacacctgtgaagtgtgaagatccgaagcgggttgttcccactgcaaacccagtcaaaacaaacggcaccctcctgcggaacggcggactacctggcggccccaataagattccaaatggcgacatttgctgcatcccaaactccaacctcgacaaagccccggttcagcttttgatgcacagacctgagaaagatagatgtccccaggctgggccccgggagagagtacgatttaatgaaaaagttcagtaccatgggtattgtccagattgtgacacacgctacaacattaagaatcgcgaggtgcacctgcactccgaacccgtgcatccacccggaaaaatacctcaccaaggaccaccactgccgcctacaccacacctacccccctttcctttggaaaacggaggtatgggcatcagccacagtaactcctttcctcctatacggcctgcgaccgtcccgcctcctaccgcccccaagcctcagaaaacaattttacgcaagtccacaactaccactgtgtag

SEQ ID NO: 32248 - DNA, 705 bp, Artificial Sequence
  Description of Artificial Sequence: Synthetic coding sequence
atgacagactcatctaagacagatacattgaattcctcatcctccggcacaacagcttcttctctcgagaagatcaaggtccaggcaaacgcgcccctcatcaagccacccgctcatccatcagccatcttgaccgtactgaggaaaccgaatccaccgccaccaccgcctcgtctgacacctgtcaagtgcgaggatcctaagcgtgtagttcctacagccaatccagttaaaacaaacggaaccttactcaggaacgggggtttgcccggagggcctaataagatcccaaatggtgatatctgctgcatccctaattctaacctagataaagctccggtgcagctgctcatgcatcggccagaaaaggaccgctgccctcaggctggtcctcgggaacgagtaagattcaacgaaaaggtccagtaccacggctattgcccggattgtgatacacgatacaacataaagaatcgcgaggttcatctgcatagcgagcctgtacatccccctggcaagatcccccaccaaggaccaccacttccgccaacgccccacctgccccccttccctttggagaacggaggtatgggcataagccacagcaacagcttcccccccatccggcctgccaccgtccccccaccaacagcccctaaaccccaaaagactattctgaggaagagcacaacgaccactgtgtag

SEQ ID NO: 32249 - DNA, 705 bp, Artificial Sequence
  Description of Artificial Sequence: Synthetic coding sequence
atgaccgactcctcaaagactgacactttgaacagtagcagctctgggactacagcctcctcactggagaaaattaaagtgcaggccaacgctcctttgatcaaaccaccagcccaccctagcgcgattctaacagtgttgaggaaaccaaacccaccgcccccacccccacggctgactcccgtcaaatgtgaggaccctaagagagtggttcctacagccaaccccgtaaagactaatgggacgctactcaggaatgggggtcttcctggagggcctaataagattcctaacggggacatctgttgtattccaaattctaacctcgacaaagcccccgtgcaattattgatgcatcggccagagaaagataggtgtccccaggccggacctcgcgaacgcgtaagattcaatgaaaaagtgcagtatcacgggtactgcccagattgtgatacccgatataatattaagaatcgcgaggtccatttgcactctgagccagtacacccccctggcaagatcccacatcaggggcctcccttgccaccaactcctcacctcccccccttcccactggaaaatggcgggatgggcatcagccacagtaattcttttcctccaatccgccccgcaacagtgccaccacccaccgccccaaagccccagaagactatcctcaggaagtccaccaccactactgtctag

SEQ ID NO: 32250 - DNA, 429 bp, Artificial Sequence
  Description of Artificial Sequence: Synthetic coding sequence
atgactgattccagtaagacagacacccttaactcatccagcagcgggaccacagcctcctcgctggagaaaattaaggtccaggcaaacgccccactgattaagccccccgcacacccttccgctattcttaccgttcttcggaaaccaaatccacctccacccccacctcgactgactcctgtgaagtgtgaagatcctaaaagggtcgtacctaccgcaaacccagtgaagaccaatgggacccttcttcggaacggtggtctcccgggagggccaaacaaaattcccaatggcgacatttgttgcattcctaattctaatctggacaaggcccccgttcagctcttgatgcaccggccggaaaaagacagatgcccccaggcaggaccgcgcgagcgtgtacgattcaacgagaaagtgcagtag

SEQ ID NO: 32251 - DNA, 1071 bp, Artificial Sequence
  Description of Artificial Sequence: Synthetic coding sequence
atggacacccagggccccgtgagccagccattccaacagccagaaaagcctggacgcgtcagaaggaggaagactaggcgagaacgaaacaaggccctggtgggatctcgcaggcccctcgcccatcacgatccgccagttgctattcgagaccctcctgtagtgccaacagcttccaagctggtggtgatcacgcaggggcggttgtcccgagagcaccggggtctattcaaccatgaagtgaaatctctggacgtcgcaaggttgttgtccagtggcactctggtgcccgggtctcccactctgcctgcaaagccttctccgtctcccggccgcgctcaggagccggccccacgttccagagataaagaaaatcaggtgcctggcggaagcggaccgggccctccctcctcccccgagctgagcggggttggccagctgctcgcggagcttcagtgtcagctgtctctgcctcaggcctttccacggcggaatctcattcaagatgctcgtgatgctatcgtgcacactctgcaggcatgccacggctgcgtgccagacctggcgctcgtgctgagaggatgccagccgccactgccgggtgctaagccaggcgtgtctgagcgtaaaatgacacccttttggatcaacagtccagaccaggtgcccgagcaggagcgccaacgaaagcagcagggtacaaaggaattcacctttccaatgccttacacgagtagtatgccaaccgcccacagagggagcctcgctcctccgaggggaccttggcctccatactttccctctctatcaagcccctcagggactgcgtggggacctcctacagcctttgacttactcaagagcatttggctggtggccacccctccccctccacggccatggggagtggggctgccgcagcctctcccccagccctcaagccctctgttaccgcgcacttctgttctcgattggtctcccagcccgccaagcccgctgccctctctgagctgggtggttgcacagagcagtccagaagcctggtccttcccccccatgagattgtattag

SEQ ID NO: 32252 - DNA, 1071 bp, Artificial Sequence
  Description of Artificial Sequence: Synthetic coding sequence
atggatacccaggggcccgtctctcagcctttccaacagccagaaaagcctggtagagtgcggcggcgcaaaaccagaagagagcggaacaaagctctggtcggatcgagaaggccccttgctcaccacgacccacctgtggccataagggacccaccagtggttcccactgcgtctaagctggtagtgatcacgcagggtaggcttagccgcgagcaccggggcctgtttaatcatgaggtcaaatcacttgatgtagccagacttctttcaagtgggacgctggtccccggatctcccacccttcccgcaaaaccttccccaagcccaggacgggcccaagagcctgctccaaggagccgcgacaaggaaaatcaggttcctggcggcagtggccctgggcccccatcatccccggaactctccggggtgggccagctcctggccgaactgcagtgccaactgtctctcccgcaagcctttccgagaaggaacctgatccaggatgctcgcgacgctatcgtgcacacccttcaagcttgtcatgggtgtgtcccagacctggccttagtactccgaggatgtcagcctcctctccctggagcgaagcccggcgtgagtgaacgaaagatgacccctttttggatcaactcccctgatcaagtgcccgagcaagaacgccagcggaagcagcaaggcacgaaagagtttaccttccctatgccatacactagctccatgcccaccgctcacaggggaagcttagcacctcctagaggtccttggcccccttacttccccagcctatcttcccccagtggcaccgcctggggcccacccactgccttcgacctcctgaagtctatttggctggtcgcgacccccccaccgccgagaccctggggagtggggctcccacagcctctgccacagccctccagcccgttgttaccacgaacttccgtgcttgattggagtccttcgcctccatctccgctcccatctctgtcttgggtggtcgcccaatcatcaccagaagcgtggagtttccctcccatgcgactgtactag

SEQ ID NO: 32253 - DNA, 666 bp, Artificial Sequence
  Description of Artificial Sequence: Synthetic coding sequence
atggaggaacctcgcccctccaaaaggctgcggtccatggccccaaaccaggccagtgggggccccccgccagagcctggatgttgcgtggctgatccagagggctctgtggaggctgatgggccagcccaacccgcccagcccgccaaacctatcgcatacgtgaaaccttttcggcgacagccccctgctcgacccgagtcaccgccaccagctgagcgagggagacgtcggggaggaagccgcaggcctgggcgagggcggggcaggagagcagggccccgcggcgacgccggccagcgccaaggagcagaaggcctaatggcccccgatgtccatatccagctagatcaccacggcgagcctggacaccagggtgaacctgagattaccgagacagcagccttttcattgtctgagacagggccacctcctggcacagtccaagaagggcccggccccgacgtggcacaaccagagctaggatttcaggagcctcctgccgcccccggcccccaggccgttgattggcagccggtgctgactctatatccctgtatcggctttcgtgctcttggtgatagtgccgtgttgcaagtgatacaaaccccacaaggcacctacgttcagggtgtgcctgtgtttcttacggatatcgcctactag

SEQ ID NO: 32254 - DNA, 666 bp, Artificial Sequence
  Description of Artificial Sequence: Synthetic coding sequence
atggaagagcccaggcctagtaagaggctcagaagtatggcccccaatcaagcaagcggcggacccccgcctgaacccgggtgttgtgtggctgatcctgaaggaagcgtggaagctgacggacccgctcagcccgcacagcctgccaagcccattgcctacgtaaaaccgttccgtcggcagccgcccgcccggcctgaatcccctccacccgcagagcggggcaggagaagaggtgggtctaggcggccagggagaggcaggggacgcagagcgggtccccgtggagatgccgggcagagacagggtgcagagggcctaatggcccccgatgtccacattcagctggatcatcatggagagcccgggcaccagggggagccagaaataacagagaccgccgccttcagcctgtctgaaaccgggcccccaccaggcacagtgcaggagggtccgggcccagacgtagcacagccagaactgggctttcaggaacccccggcggcaccaggtccgcaggcagtggattggcagcccgtgctgacactgtacccttgcatcggcttccgtgcgttgggcgatagcgcggttctgcaagtgatccagactccacaagggacttatgtgcaaggtgtgcccgtttttctgaccgacatcgcttattag

SEQ ID NO: 32255 - DNA, 666 bp, Artificial Sequence
  Description of Artificial Sequence: Synthetic coding sequence
atggaagagccccggccgagcaagagactgcgatctatggcccccaaccaggcttccggcgggccgccaccagagcccggctgctgtgttgccgaccctgagggttccgtcgaggccgacggccctgcccaaccagcccaaccagccaagccaattgcatatgtgaagcccttccgacggcagcctcccgccagacctgagtcccctcctcccgctgaacgaggcagacgcagaggggggtcacgtaggcctgggcgcgggagagggcggagggctggcccacggggcgacgccggccaacgacagggcgcagaagggttgatggcccctgacgtgcatatccagctcgaccatcacggagagcctgggcaccagggggagcccgaaattacagaaactgcggccttctcattaagtgagactggtccgccccctggtacggtacaagaggggccgggacccgatgtggcgcagcctgagctcggctttcaggagcccccagcggcccctggcccacaggctgttgattggcagcctgtgctgacactgtatccctgtatcggattccgggccctgggggattcagccgtgttgcaggttatccagacaccacaagggacttatgttcagggggtgccggttttcctgacagacatagcgtactag

SEQ ID NO: 32256 - DNA, 666 bp, Artificial Sequence
  Description of Artificial Sequence: Synthetic coding sequence
atggaagaacccaggccctcgaagaggcttagaagcatggctcctaaccaagccagtggagggccaccacccgagcctgggtgctgcgtcgccgacccagagggcagcgtggaggccgacggccctgctcaacctgcccaaccagcaaaacctattgcgtacgtgaaaccctttcgccgccaaccacctgcccgacccgaaagcccccctcctgccgaacgcggtaggagacgaggcggctcacgaagacccgggcgtggtcggggacgccgggccggccccagaggagacgcgggacagcggcagggtgctgaagggttaatggccccagatgtccatatccagctcgatcaccatggcgaaccaggtcaccagggagaaccagagatcactgagacagctgcattctcactgtccgaaactgggcccccccctggaacggtgcaagagggtcccggtccagatgtcgctcagccagaattgggatttcaagagccccctgcagctccgggaccacaggctgtggactggcaaccagtgcttactttgtatccatgcatcgggtttagggcgttaggcgatagcgctgtcctgcaagtgatacagactccgcaggggacgtacgtgcaaggtgtgccagtttttcttaccgacattgcctattag

SEQ ID NO: 32257 - DNA, 666 bp, Artificial Sequence
  Description of Artificial Sequence: Synthetic coding sequence
atggaagagcctagaccgagcaaacgcttgcggtcgatggctcccaatcaggcatcaggcggtcctcctccagagccaggctgctgtgttgcagatccggagggcagcgtggaggcagacggacccgcccaacccgcccagcctgccaaacctatcgcctatgtaaaacccttccggcgtcaaccccctgctcggcccgagtccccgccgcccgctgagcgcgggcgtcgtcgcggaggtagcagacggcccgggagaggcagaggacggcgcgccggtccacgaggggatgccggacagaggcagggtgcagaaggcttgatggcacctgatgttcacattcagctggatcatcacggggaaccagggcatcagggcgaacccgagatcacagaaaccgccgccttctcactgagtgaaacggggccccccccgggtacagtacaggaaggcccgggcccagatgtggcacagccagagttaggcttccaggagcctcctgccgctcccggcccacaagccgtggattggcagccagtgctgactctatacccttgtattggcttcagggccttaggtgactcagctgttctgcaagtgatccaaaccccgcaggggacatacgtgcagggtgttcctgtctttttgactgacatcgcttactag

SEQ ID NO: 32258 - DNA, 666 bp, Artificial Sequence
  Description of Artificial Sequence: Synthetic coding sequence
atggaagaacccagaccttccaaaagattgcggtccatggcccccaaccaggcatccggtggccctccaccggagcctggctgttgcgtggccgacccagaggggtctgtggaggcagacggccctgcgcagccagcgcagcccgctaaacctattgcctacgttaagcctttcaggaggcagcccccggcccgccccgagtcaccccctcctgcagaacgggggaggagacgcggtggctccaggcgacccgggcgcggccgcggtcgcagggcaggcccgcgaggcgatgccggccaaaggcagggcgccgaaggactgatggctccagatgtgcacatacagctcgaccatcacggtgagccaggacaccagggggagcctgagattaccgagacggcagctttttcactttcagagacgggcccaccacccgggacagtgcaggagggacctgggcctgatgtggcacaacccgagctggggttccaagagcctccagcggcccccggacctcaggctgtcgattggcagccagtgctgacactgtatccctgcataggattccgcgcactcggagacagtgcagttcttcaggtaatccagacaccccaaggcacatacgtgcagggggtgcctgtgttcctaaccgacatagcttactag

SEQ ID NO: 32259 - DNA, 666 bp, Artificial Sequence
  Description of Artificial Sequence: Synthetic coding sequence
atggaggaacccagaccaagcaagcgcctgagatctatggcacctaatcaggcttccggaggacctcctcctgagcctggatgttgcgtggccgaccctgagggctccgtagaagccgatgggccagcacaacccgcacagccagcaaagcctattgcttacgtcaagccctttcgccgccagccacccgcccgtcccgagtcccccccccccgcagaaagggggcgaaggagaggcggatcccggagaccaggacgggggagaggaaggcgcgcaggtcctagaggcgacgccggtcaacgccagggcgctgaaggactgatggcgcccgatgtccatatacagctggaccaccacggcgaaccagggcaccagggcgagccagaaattactgagacagcggctttctcactgtccgagaccgggccaccaccaggaactgtgcaggaaggccccgggcccgacgtggcacagcctgagctggggttccaggaacctcccgccgctcccggcccccaggcagttgattggcaaccggttcttacattatacccctgtataggcttcagagccttaggggattccgcagtgttgcaagtgatacagacaccgcagggaacctacgtccagggcgttcctgtgtttcttacagacattgcgtattag

SEQ ID NO: 32260 - DNA, 666 bp, Artificial Sequence
  Description of Artificial Sequence: Synthetic coding sequence
atggaggagcctaggccctctaagcggcttaggagcatggccccgaaccaagcaagtggcggcccacccccggaaccagggtgctgcgtcgcagatcccgaaggcagcgtggaagctgatggccccgctcagccagctcagccagcaaagcctatcgcctatgtgaaacctttccgaaggcagcccccggcaaggcccgagagtcctcccccagcagaacggggcaggcggagggggggaagcagacgtcccggcagggggcggggccggcgtgctggccccagaggtgacgcgggccagcgccagggcgctgaagggttgatggctccagatgtccacatccagcttgaccatcacggcgaacccgggcaccaaggcgagccggaaatcactgaaacagctgcttttagcctcagtgaaaccggacctccaccgggcactgtccaagaagggccaggacctgatgttgcccagccggaattaggttttcaagaacctccggccgctcctggcccgcaagctgtggactggcagcctgtgctgaccctgtacccttgtattgggtttcgggctctgggagacagtgccgttctccaggtgatacaaactcctcaggggacatacgtgcagggggttcccgtatttcttacagatattgcttattag

SEQ ID NO: 32261 - DNA, 666 bp, Artificial Sequence
  Description of Artificial Sequence: Synthetic coding sequence
atggaggagcctcgccccagcaagcgcttgaggagtatggctccaaaccaggcgtcgggggggccccctcccgagccaggatgctgtgtggcagaccccgagggcagcgtagaggctgacggtcccgctcagcctgcccagccagcgaaacccatcgcctacgtgaaacccttccggcggcaacctcctgcccggcctgaaagtcctccacctgcggaaaggggccgcagacgcggcggctcacgcaggcccggtcgaggccgtggaaggagagccggaccgcggggcgacgccggacagcgacaaggggccgagggtcttatggcccctgatgttcatatccagctggatcaccacggggaaccaggccaccagggcgagcctgaaattactgagaccgcagcattctcccttagcgaaacaggacctcccccaggtacggtccaggaaggtcctggccccgatgtggctcaacctgagcttggattccaggagcctcctgcagccccaggcccccaagcagttgactggcagcctgtgctgacactctacccgtgcattggctttcgcgccttgggggatagcgccgttttgcaggttatccagactcctcagggcacatatgtccagggagtccctgttttccttactgacattgcgtactag

SEQ ID NO: 32262 - DNA, 1170 bp, Artificial Sequence
  Description of Artificial Sequence: Synthetic coding sequence
atgcatgcctgttcgtctaccgctcttcatccacggccgttcatccacgggttcagtttcaccacctttctgcagcagctgtttccccacggctcttccacggccttgcacccatggccatttatacatggtagttctcctatggccttgcatccccgactcttcacccacggtcctagctcaaccgcattgcatccctgccctttcacacatgggagctcacctatgagcctgcacccacggctcttcactcactctcccagctcaatgcctcttcatccccggccttttgtacacgccagcagtccgaccgccctgcgaccctgtctcttcacccacgggcccagcagcatgcccctccaccccaggccctttgtgcatgcgtcctcgccgacggccctgccaccttgcctcttcacccacggacccagctcaatgccattgcacccaagaccttttctccatgcttcatctccgacggcgctgcccccttgcttattcactcatggacccagctccatgcctctgcacccaaggccgtttgtccacgccagctcaccaactgcacttcggccatgcctcttcacccatggccccagctccatgccccttcaccctcgcccatttgtccatgccagttcaccgacggcccttccgccctgtctcttcactcatggaccatccagcatgccgttacacccacggccattcgtgcatgcttcctcacctacagccctgaggccctgtctcttcacacatggaccctccagtatgccactacacccaagaccgtttttacacgcctcctcaccgactgctcttcggccttgcctctttactcacggcccctcaagtatgcccctgcatcctcgtccttttgtgcacgctagctcacccactgcactccgcccatgtctgtttacgcacggtcctagtagtatgcctctgcaccctagaccattcgtccatgcatcatcttctactagcctccatccccgacctttcattcatgcttcgtcatccaaatcattacacttgaggctattttcccattccagctgtctggtcggattctcacaacagggcaacgtgttactgctgtccgcccgggccacatttaatacctgtcttctggtgagcaacatgtacttcctcatcatctcatattag

SEQ ID NO: 32263 - DNA, 1170 bp, Artificial Sequence
  Description of Artificial Sequence: Synthetic coding sequence
atgcacgcttgttcgtccaccgccctgcaccctcgccctttcattcatggtttcagcttcactacattcttacagcagctgtttccacatggctccagtaccgccttgcatccatggccttttatacatggtagctctccgatggctctccaccccagactgttcacccatggtccgtcctccacagccctacatccctgtccttttacacacggctcctcgccaatgtcattgcatccccgcctgtttacacactctcccagcagcatgcctctgcacccaagacccttcgtgcatgcaagttctcccaccgctctgaggccctgtttatttactcatggcccgtccagcatgcctctgcatccacgccccttcgtgcatgcatcgagccccacagctcttccaccctgcttatttacacacgggccttccagcatgcccctccatcccaggccgttcctccatgcctcaagtccaacggcgctacccccatgcctattcacacacggccctagcagcatgccgctccaccccaggcctttcgtgcatgcaagttctcccacggctctacgcccctgcttattcacacacgggccctcgagtatgccactccaccccaggcccttcgtgcacgcctccagccctacggccctgcctccatgtctgtttacccatggtcctagctctatgccgctacatccaaggccctttgtccatgccagttcaccgacagcccttcgtccttgtctctttactcacggtcccagttctatgcctctgcacccaaggccttttctgcacgcaagctctcctaccgcgctgaggccatgtctgttcactcacggaccaagttctatgcccttgcaccccagaccgttcgtacacgctagcagcccaaccgctctgcgaccctgtctattcacgcatgggcctagctccatgcctctccacccccgacccttcgtccacgcatctagcagtaccagtctccatccccgtccctttattcatgcaagctcctctaaaagtctgcatctgaggttgttctcccattcgtcttgcctcgtcgggttttctcaacagggcaatgttttattgctaagtgctcgcgcaactttcaacacttgtctgcttgtgtcaaacatgtatttcctcattatcagttattag

SEQ ID NO: 32264 - DNA, 1269 bp, Artificial Sequence
  Description of Artificial Sequence: Synthetic coding sequence
atgcaacatcccaagcccttctgcgctccggctgccccccaggaaggtttctcaccacagtcactcgaaggtgccgaggtactagggaatcagcctgccccaacatgtgctgagcctccccctgctatggggtcactgaacctgtaccatccccccgacccagaaaaagaggtttttccggcacctcccgccggattccagatggctccatgcggatgcttctttgatcctaggatctacaggatcgaatggacaacccctgatcttggtcaaagcgccctgtacaagctggcagcctctagcggaggacccgctggggttccttccgctccaggatcttacctgttggagcctcagccctacttaaaggcacccggcctgcccccatacccacactaccagcaagcccctggggggcctcaatttctgctaccttatttccctccagagggaccaggtcccgaggcactcggcttcgtaggagatgccggccccgcggccttcgttgagcttcccttgccgcccctggaagaaggacctgctcccttgccccccccgccacctaaggagaataaacctcctcccgtgttaataactctgccagctgagccaacccttcctccagatgcttatagtcatctgcagggacaccttggtcacttccctgggcctgaaccgttagccttccctgttaaagagctgcaaggcagcggtgcacgacctggggtgcccttatacccaccaggcctcagcgaactcaaggtggcagaagtaaaagagggtgccctactgggtgctggtaaagctaaggcaccaaaaacagctcgcgcattagcactacccgacaaagtgctgcttgaggacgcgatgaagttgttcgattgcctgcccggcgcctccgagcccgaaggaacattgtgtgaggtgcctggacctgctttgccagactcgagtggcggaaatagtgcggatgatataaggtctctgtgcctccccgaggagctccttagcttcgactacagcgtacctgagatcctggacaccgtctccaatgtagattatttttttaacttcaaagccttggatgaagaacaacctccacatcccggcccaccagcgaccaatacacctgcacccatcttgagcgggaaaaggaaggcatcgactgccaaaaaaggaaagccaggccgcaaggcaaggcaacctgccggtcctgcctcggcaacaccacctggacctcgcgaggacctaggagctaccccccattag

SEQ ID NO: 32265 - DNA, 801 bp, Artificial Sequence
  Description of Artificial Sequence: Synthetic coding sequence
atgggttctagaccacggtcccccagcgcatttccagccccgtggtgggggcagcaacccggggggccagggcccgccaaacgtctgcggctggaagaaccagcagggcccgagccacgcgtcgccccaagcctcgaagaccctgcagggaccccggccgtgggcgcactgaccagtattgtggttctcgcggcagggtgcgctctccgtgttcccctcgatgacgtggatctggttctggagcttccgccaacaagcatcttgagggtgtctcttgacggccacacgttgatattgatccctgaggtgttactgagttctgtggacgagcggagtggcgctcaggacgattcatctgcgggcctggaggtggatgtgttcctgggggcgctacgcgaagacgtggttgtggagcaggaagtcttctgcgccagcgttcctgaaatagcagctcaagaggaagcctatgaggaagatgcggatccagagttcccagaactccagatggacagcgctgctggctccgcggcagggctctattcttctgcaaggtctatgttctccccttatcgggagggaccaatccctgagccttgcgccctcgccccgaatccttcctcggagggacatagtcccggcccgtttttcgatccagaatttcgcctgctggaacctgtcccctccagtcccctgcagccgttgcctccttcccccagagtgggatcaccaggaccacacgcacaccccccactgccaaagagaccaccttgtaaggcgagacgtcggctcttccaggagtag

SEQ ID NO: 32266 - DNA, 798 bp, Artificial Sequence
  Description of Artificial Sequence: Synthetic coding sequence
atggttagcagaccgaggagccccagcgccttcccagcaccctggtgggggcaacaacccggtggacctgggcctgctaagaggctgcgtctggaggagcccgctggtcccgagcccagagctgcaccctcgctcgaagaccctgcaggcgacccagcggtagacgctcttacgtcaatcgttgtgcttgccgccggatgcgcccttagagtgccactggatgacgtcgacttggtattagaacctgccccgacctccattctgagggtgtccttgggagggcatactctgatactcataccagaagtgctcttgtcctccgtagacgaacgaagcggtgcacaacatgactcgtccgccgggctggaggtagacgtgtttctcggagcggttcgagaagacgtggtggtggaactggagttctgtgcctccgtcccagagatcgctgcccaggaggaagcctatgaggaggatgctgatcccgaatttcctgagctacgcatggattctccaaccggcagcgccgcgggtctgtatccttcctctcgaagcatgttcattccctatagagaggggcccattcctgagccatgcgccttagcacctaatccctcctccgaacgtcgatcaccacggcctatttttgatttagaattcaggctgttggagcccgttccaagcagccctctgcaacctctcccccccagtccttgcgtagggtcaccggggcctcatgcccggtcaccacttccggaacggcctccatgcaaggcacgccgtagattattccaggcctag

SEQ ID NO: 32267 - DNA, 789 bp, Artificial Sequence
  Description of Artificial Sequence: Synthetic coding sequence
atgggatcaaggccctgcagtccttctgcatgtctcgcaccatggtgggggcaacagccgggcggacctggtccagccaagcgctctcgcctagaggaacctgcggggcctgaatccagggctgccccctcgccggaggatcctgcaggcacaccagccgtcgacgccctgacatccatggtggtgctagatgccggttgtgcactaagggtcccccttgaagatgtggacctcgtgcttgagcttgcacctatgtccgtccttagggtgtctcttggaggccacacattgattgtgatacctgaagtactcctttccagtgtggatgaatgtagtggagcacaaggagactggagtgccggactcgaagtggacgttttcctcggtgcacacggcgaagatgtggtggtcgaacaagaagtgtgtgctagcgtcccagagatcgctgctgaggaggaggcctacgaggaagatgcggattccgaatttccggagctctggatggattctgccgccggatccgctgctggcctctatccatctgcacgatccatgttcagcccctaccgcgagggacctataagaggaccctgtgctttggcgccaaatcccagcagcgaacgccggtcacctcggcccatcttcgacctcgaatttcacctcttagagcctgtgccatcaagtccgctgcagccactgcccccttccccgtcacccggtccccatgccagacctgaactccccgagcgccctccttgcaaagttagaaggcgcttgtttcaggaatag

SEQ ID NO: 32268 - DNA, 789 bp, Artificial Sequence
  Description of Artificial Sequence: Synthetic coding sequence
atgggctcacggccttgctctcccagcgcttgcttggcaccctggtggggccagcagcccggaggccctggacccgcaaaacgctctaggttggaagaacccgcgggccctgagagccgagcagcaccttcacctgaggatcccgcagggacacccgcggtcgatgcccttacttccatggtcgtgttggatgcagggtgcgcccttagggtccctttggaggacgtggatctggtgctggagctcgcccctatgagcgtgcttagagtgtcactgggcggccacactctgatagtaataccagaggtgctgctgtcctcagtggacgagtgcagcggcgcccagggtgattggagtgccggcctagaagtggacgtcttcttaggtgcacatggcgaggatgttgtcgtggagcaagaggtgtgtgccagcgtacccgagattgctgctgaagaggaggcgtatgaggaggacgcagactccgagtttcctgaactgtggatggatagcgctgcaggatccgccgctggactgtatccatccgctagatcgatgttttcgccctaccgggagggccccatccgcggaccctgtgcgctggccccgaacccatccagcgaaagaaggtccccacgaccaatctttgacctggagttccacctgctcgagccagtgccctccagccccctgcaaccactgccgcctagcccctctcccggacctcatgcacgcccggagcttcccgaacgtccgccgtgtaaggtgcgccgaaggcttttccaggagtag

SEQ ID NO: 32269 - DNA, 429 bp, Artificial Sequence
  Description of Artificial Sequence: Synthetic coding sequence
atgcgcggaacatcctgcgttgggggtggggccgaaagcccaggcggggcaggcctttccgagggacctcgggggagatggttgcggcttgcccccgtttgtgcctattttttgtgcgtctctttggcggccgtcctgctggccgtgtactatggcctgatctgggtgcctacaaggtcacccgcggctccagcggggccacagcctagtgcccctagtcccccgtgtgctgccagacctggcgtgcctcctgtccccgcccctgctgctgcgtctctgtcttgtctgctgggagtgccaggcggcccacggccgcagttgcagctgccgttgagtcgaagacggcgttactccgatccggaccgaaggcctagtcgacagaccccccgggagacccccgaagccgctgaaggccgcaggccaggatag

SEQ ID NO: 32270 - DNA, 1209 bp, Artificial Sequence
  Description of Artificial Sequence: Synthetic coding sequence
atggcacggactgaccagaagccaccatgtcgcggtggatgttgggggcaaccggggcatcctaatactggcggggccgctgcccacccaacctatcaccccatggggcatcgcccccggacttgtattttgctcagaggcgatcagaccaccggaggtcaggctccttcacgcgagatttccctgggaccgtgggctgccggcacccattttctcgctatttctaccacaccttggggccgcaagacgccggcatgcatcagcgaactccccacatcctcagggacagctcagcccctggctaatgcggtctgcgaagtacagacagtacctgggcctggactaagaccccagggaactcctgctatgagagccccttctcataaggggacccccccgacgcccaacccatggggccctgagcagccacagaaccggcataagcatcctaagaagggggttacaggagggccttcccctccaccccccgctgcctcgagatacgggcagacccccggccgagaaccccgggtccaggcaccaggcttaggaccttgcgggcgaccagccagtggccggctgttgagcctgcacctggaaaagggagatggcaaggggacccggcagaggattcctctcaccgacgcagcagtaggaggggaccggacagatatcccgtctgcgattgcggcgggcccggctaggacacctgaccgtcacggactccccattcccggtagcactcccacccctatggtgggatccggacgattgggggcccctgtggggcgttctgggggcggtgctagtgcacgatcgagccgtccttcgtgtgcaaacgtactgctaagagcagacgcctccctggggacggtgttaagcgtcttgtggaccggacagctgtcgcgcgggtgggccttgcttcctcctggtgatgctggcagacacctggaaacaagtgtgatcagtgctggtgtggctgccggcatctggttggtggagcccggcgaggctgcacaggaccctgcgactcggcgcaccgcaccccccagaaggactgcaagccctgaaccgccagcacccggagcccccctgcctgcgtgccctggaagaataccaggagctgcccgcttcggcccaaggagctgtcccctgggttcgccagccgtgttggccgtaacaaccggttggtctcacagatccgtctag

SEQ ID NO: 32271 - DNA, 351 bp, Artificial Sequence
  Description of Artificial Sequence: Synthetic coding sequence
atgtccttcagtgagcagcagtgtaagcagccttgcgtaccacccccctgtctccctaaaacacaggaacagtgtcaggcaaaagccgaggaagtgtgtttacccacttgccaacacccatgccaagataaatgtctggtccaggcccaggaagtctgcctgtcacagtgtcaagagagctcccaggagaagtgcccacagcagggccaagaaccttatcttccgccatgccaggatcaatgccctccccagtgcgctgaaccatgtcaagagctgtttcaaaccaagtgcgttgaggtctgccctcagaaggtacaggaaaaatgttccagtccaggcaaggggaagtag

SEQ ID NO: 32272 - DNA, 657 bp, Artificial Sequence
  Description of Artificial Sequence: Synthetic coding sequence
atgggcagagtcttcctgactggagagaaagctaatagcattttgaaacggtacccacgggcaaatggtttctttgaggagatacgccaggggaatattgaacgtgagtgcaaggaggagttttgtacctttgaggaggcacgggaagcgtttgagaacaacgagaaaactaaggaattctggagcacctatacaaaggctcagcaaggagaatccaaccgcggctcagactggttccagttctaccttacattccccctaatcttcggcctctttattatcctgctggtcatattcttgatttggcgttgttttttacgtaacaagacaaggcgccagaccgtcacagagggtcatatacccttcccccagcacttgaacattatcacccccccgcctcctcccgatgaagttttcgacagcagcggcctgagccctggattcctaggttacgtcgtaggaagatcagactcggtgagtacgagactgagcaattgtgacccaccccctacttacgaggaggcaacaggacaggtgaatttgcagagaagtgaaactgaaccgcacctggacccacctcccgagtatgaagacatcgtgaactctaattccgcttctgccattccaatggtgcccgtggtaactactatcaaatag

SEQ ID NO: 32273 - DNA, 657 bp, Artificial Sequence
  Description of Artificial Sequence: Synthetic coding sequence
atggggcgagtgttccttacaggggagaaggcgaattccattctaaagcgctatcctcgggctaatgggttttttgaagagattcgacaggggaatatcgaacgagaatgcaaggaagaattctgcaccttcgaggaggcccgcgaggccttcgaaaacaatgagaagactaaggagttctggagcacatacaccaaagcccaacagggagagtctaaccgaggatcagattggttccaattttatctcactttcccactgatctttgggctcttcattatcctactcgtcatcttcttgatatggcggtgttttctgcggaacaagacccggcggcaaacagtgaccgaagggcatatccctttcccgcagcacctgaacataattacccccccacctcctccagacgaagtattcgacagctcaggtctcagtcctggattccttggttatgttgtgggccgatccgatagtgtgagcacacggctttccaattgcgacccccctcctacttacgaggaggctacaggccaggtcaacctgcagcgcagtgaaaccgagccacatctagaccccccacctgagtatgaggatatcgtaaattccaattctgctagcgcgattcctatggtgccagtcgtcactactattaaatag

SEQ ID NO: 32274 - DNA, 657 bp, Artificial Sequence
  Description of Artificial Sequence: Synthetic coding sequence
atgggtcgagtgtttcttacaggcgagaaggcaaactccatattgaaaagatacccaagagcaaatgggttcttcgaagaaataaggcaggggaacatcgagagggagtgtaaagaggaattttgcacatttgaggaggctagggaagcttttgagaacaacgaaaagactaaagaattctggtccacgtatactaaggcacagcagggtgaaagcaatcggggttccgactggtttcagttctacctgacatttcccttaatctttggtttattcattattcttctggtaatttttctcatttggcgctgctttctgagaaataagacaagaagacaaacagtcacagagggccatatcccttttccgcagcatctgaacattataacccccccacccccaccggatgaagtgtttgacagctcaggcctgagcccaggatttctgggctacgtggttggtagaagcgattccgtgagcacccgtctcagtaattgcgacccaccccccacatacgaagaggcgacaggtcaggtgaacctgcagcggtctgagacagaaccccacttggacccacccccagaatatgaagacattgtgaacagcaattccgcctctgccattcctatggttcctgttgttaccacaatcaagtag

SEQ ID NO: 32275 - DNA, 657 bp, Artificial Sequence
  Description of Artificial Sequence: Synthetic coding sequence
atgggaagagtttttttgacaggagagaaggccaactccatcctgaagcgataccctagggcgaatggcttcttcgaggaaattcggcaggggaatattgagcgagagtgcaaggaggaattctgtacattcgaagaggcgagggaagcatttgagaacaatgaaaaaacaaaggaattctggagtacctatacgaaggctcagcagggagagagtaatagggggtcagattggtttcaattttacctcacttttcctttaatctttggcctcttcattattctccttgtcattttccttatatggcgatgttttttgcgtaataagacacgccgacagaccgtgactgagggccatatccccttcccgcagcatctaaatataatcactcctccaccgcccccagatgaggtgtttgattccagtggtctttccccaggcttcctcggatacgtagtggggagatcagattcggtcagcacaaggttgtctaattgcgatccacctccaacatacgaagaggccaccggtcaggtcaaccttcagcgttcagagacagagccacacttagatccgccgcccgaatacgaagatattgtcaacagcaacagtgcctccgctatacccatggtccctgtggttacgaccattaagtag

SEQ ID NO: 32276 - DNA, 249 bp, Artificial Sequence
  Description of Artificial Sequence: Synthetic coding sequence
atggacccgggcccaaaaggacattgtcactgcggaggacacggtcaccctcctggacactgtggacctcctccggggcacggaccagggccttgtggcccccctcctcaccacgggcctggcccctgtggccctccccccgggcatggcccggggccatgtggtccccctcctcaccatgggcccgggccctgtggtcctcctcctggccatggcccaggtcatccacctccgggacctcaccactag

SEQ ID NO: 32277 - DNA, 246 bp, Artificial Sequence
  Description of Artificial Sequence: Synthetic coding sequence
atggaccctggcaagggtcattgtcattgcggaggccatggccacccgcctggacattgcggtcctcctcccggacacggccccgggccttgcggcccccccccccaccacggcccaggcccctgcggaccccccccgggccacggcccgggcccttgtggacctccccctcaccacggccctgggccatgcggaccacctcctgggcatgggccagggcacccccctccaggcccccaccactag

SEQ ID NO: 32278 - DNA, 537 bp, Artificial Sequence
  Description of Artificial Sequence: Synthetic coding sequence
tgacgatctcaggtgtatatgcatccatcactgtccccacccagcacaatgattctgagtggcggaacagcccttaagccgccctacagcgcttttcccggcatgcaaccgttggagatggtaaagcctcagagtggatcaccgtaccagccaatgagcggaaatcaggccctcgtgtacgagggccagttgagccaggcagctggacttggcgcatcacaaatgctggattcccagctgcctcagctgaccatgcctctccccaggtatggatctggtcagcagcccctgatcttgcctcaaagtatccaacttccccctgggcagtcgttgtcagttggcgccccgagaaggatccccccccccggatcccagccccccgttctgaacacatcaagggagccaagccagatggagatgaaggggttccattttgctgacagcaagcagaatgtgcctagtggggggcctgttccttccccccagacataccgacagaacaacgagtggatgcgcaaccccgcttgggagccctag

SEQ ID NO: 32279 - DNA, 6690 bp, Artificial Sequence
  Description of Artificial Sequence: Synthetic coding sequence
atgtcagatcgactgggtcagataacaaaaggaaaggacggcaaaagtaaatattccacattatccctgttcgataagtataagggtaagagtgtcgacgcaatccgaagtagcgttattcctcggcacggcttgcaatcgctgggaaaagttgcagccgcacggcggatgccccctccagccaatctccccagtctgaaatctgaaaataaggggaatgaccccaacatcgtaattgtgccgaaagacggcaccgggtgggccaataaacaggaccaacaggaccctaagtcctcttcagcaacagcatcgcagccccccgagagtctcccacagcccggtctgcagaagagcgtgtccaatctccaaaagccaacacagtcaatttctcaggagaacaccaattccgtgccaggcgggcctaaaagctgggcccagctgaatggtaaacctgtggggcacgaaggaggtctgcgcggaagctcccgcctcttaagcttctccccagaggagtttccaacgctgaaggccgcaggaggccaggataaagcaggaaaggagaagggcgtcctggatctgtcctatggcccaggccctagccttcgccctcagaatgtgacatcttggcgggaggggggtgggcggcacatcatttctgcgacatctctgtccacttctcccaccgagctgggtagtcgcaattcatcaacaggagacggagcacctagctccgcttgtacctctgattccaaagatccctccctgagaccagcccaaccagtgcggaagggtgcaagccagttcatgggaaacgtttatcacccacctacataccacgacatgctccccgcttttatgtgcagtcccaaatcatccgaaaaccagggcaccgtggagcggggatctttccctctaccgcagctgcggttggagccacgggtgccatttagacagttccagatgaatgaccaggacggaaaggaaaacagacttggcctatccaggccacttcgccccctgcggcagctcgtcgagagagcgcctcgtcctaccatcattaacgccgaaaaccttaaaggactcgacgatcttgatgctgatgctgatgatggctgggctggtctgcacgaggaagtagactactcagaaaaactgaagtttagcgatgatgaagaagaggaggaggtggtgaaggacggacggcccaagtggaattcatgggacccccggcgccagcggcaactgtccatgtcctccgctgatagtgccgatgctaaacgaacaagagaggaaggcaaagactgggccgaggctgtcggtgcctcgcgggtcgtacgtaaggcgcctgatcctcagccaccacctcgcaaactgcacgggtgggcccccggtccagattaccagaagagcagcatgggctccatgtttcgccaacaatctattgaggacaaagaggacaagccaccacctaggcaaaagtttatacagtccgagatgtcagaggcggtcgagagagctaggaagaggcgagaggaggaagagagacgtgcgagggaagagaggttggcagcctgcgccgccaaacttaaacagttggaccagaagtgtaaacaggctcggaaggctggggaggctcgcaagcaggctgagaaggaagtgccctggtcacccagcgccgagaaggcatctccacaggaaaacggacccgcagtgcataaggggagtcctgagtttcctgcacaagagacgcccaccactttcccggaagaggcaccgacagtctctcctgccgttgcgcagagcaattcaagcgaggaagaggcccgggaagcaggcagccctgcccaggaatttaaataccagaagtcactaccaccacgattccagcgccagcaacagcagcagcagcaagagcagctttataaaatgcagcattggcagcccgtctacccccctccctcacaccctcagcgaactttttatcctcaccacccccaaatgctcggttttgatcctcgttggatgatgatgccaagttatatggatccacggatcacccccacccggaccccagtcgacttctacccttccgcccttcaccctagcggcctgatgaagcctatgatgccacaggaatctctgaacggcacgggatgtcgcagcgaagaccagaactgcgtaccgcctttgcaggagaggaaggtgacaccgatcgacagcccacctgtgtggagtccggaagggtatatggccctccagtcaaaggggtatcctctccctcatcctaagtctagcgatactcttgccatggatatgagggttcggaacgaaagttcttttagtgccagcctgggaagggcagggggtgtcagcgcccagagggacctttttgaggagagaggggaggagtacctgtccgccttcgataagaaggcccaagccgacttcgattcttgcattagcagccagcggataggccaggaacttttattccctccacaagaaaatgtccaggacgcaggagccccgggaggccatacccaaaaccttcggtgctctcctttggagccagattttgtgccagatgaaaagaagcccgagtgcggctcctgggacgtcagccaccagccagaaaccgccgacaccgctcacggggtggaacgcgaaacccctagggagggcactgcctttaatatttctagctgggataaaaacggatctcccaataagcagccctcttctgagccagagtggacaccagagccaagaagctcttcttcccaacatccagagcagaccggtagaactcgacggtcaggccccatcaagaagccggtcttgaaggcactgaaggtggaagacaaggagaaagagctggaaaagattaagcaggaactgggcgaggaaagcactaggctggctaaggagaaggagcagtctcccacagctgaaaaagatgaggatgaggagaacgacgcaagcctggctaactcatctacgacaacccttgaagacaagggtcccggacatgctactttcggccgcgaggcaaccaagtttgaggaggaggagaaacccgataaagcatgggaggctcggccaccaagggagagttctgatgtccccccaatgaagagaaataactggatcttcatcgatgaggagcaggcttttggggtccgcggccaggcgaggggacgaggacggggattcagagagtttactttcagaggcaggcccgccggaggcaacggatccgggttgtgcggaggcggtgtactgggcgccaggtcgatctattgcagcagccagcggtctgggagaggccggggattgcgtgagtttgcgcggccagaggattgccccagggctaaaccaagaagacgggtggcttccgaaacgcatagcgaagggagtgagtacgaggaactgcctaagagaaggaggcagcgcggatcggagaacggcaatgagggctccctgcttgagcgagaggaaagcaccttgaagaaaggggactgtcgagatagttggaggtcaaataaaggctgctcagaggatcattccggtctggacgctaagtcaaggggaccccgagcattcggacgggcgctcccgccgcgactgtccaactgtggctatggaagacgtacgtttgtcagcaaagaaagtccacattggcagtctaagtcacctgggtccagttggcaggaatacggtccaagcgacacttgcgggtcacgccgcccaacagaccgcgattacgtgcccgactcctaccgccatcctgatgcctttggcggcagaggttttgaagacagtcgtgctgaggataagaggtccttcttccaggacgaacatgtcgcagactccgaaaatgccgagaaccgaccatttcgccggaggcgtcctcctagacaagataagcctcctcggttccgacgcttgcggcaggaacgagaatctctaggactctggggaccggaggaggagccccaccttctcgcaggccaatggcccggaagacctaaactgtgttcaggagacaaatctggtaccgtgggccggaggtctccggagcttagttaccagaatagctctgaccacgccaacgaggagtgggagacagcctctgagagctctgacttttccgagaggcgagaaaggcgggagggccccgggtcagagcctgactcccaggttgatggtgggttaagcggtgcgagcctgggcgagaagaaggaactggccaaaagatcttttagctcacagcggcctgtggtggatagacagtccaggaagctggagccaggaggttttggtgagaagcccgtacggcccggcgggggagatacaagccctcgctatgaatcacagcagaatggtacaccactgaaagtgaagagatcacccgacgaggccctgccaggcggcctgtccggctgttcctccgggagcggtcatagtccgtacgccctggagcgggccgcacacgcttctgccgaccttccggaagcttcttctaaaaaggcagaaaaggaggccaagcttgcggctcccagagccggagagcaaggggaagccatgaagcagttcgacctgaattacgggtcggctataatagaaaattgtggatcttcccccggcgaggaaagtgaagttggttccatggtgggagaaggctttatcgaagtgctgactaaaaagcagcgccgcctcctggaagaggagaggcgaaaaaaggagcaagctgtccaggtgccagtcaaagggcggggcctgtccagccgaatccccccccggtttgctaagaagcaaaataatctatgcctggaacaaggcgacgtgaccgtacctgggtctagcttagggacggaaatctgggaatcatcctcacaggcactgcccgtgcaggctcccgctaatgactcctggagaaaagcggtgaccgccttctccagtactgagactggctcagctgaacaggggttcaagagttcccaaggtgactctggagtggacctctctgccgaaagcagggagagctcagcaacaagcagtcagcgaagtagcccctatggaacactgaagcctgaggagatgtccggtcctggcctcgcagaacccaaggccgactcacacaaggaacaagcccctaagccaagtgagcaaaaagactccgagcaggggtcgggacagtccaaagaacatcggccaggccccattgggaacgagcgatccctgaaaaacagaaaaggttctgagggcgcagagaggctgcagggagcagttgtgccaccggtcaatggagtggaaattcatgtggattccgtgctgccagtccctcctatcgaatttggcgtaagtccgaaggattccgatttttctctgccacctggctccgcaagcgggcccacgggctcccctgttgtgaagcttcaggacgcattggcgtccaacgccggcctgacccagtcaatccccatactacgtagggatcaccatatacagcgggctatcggactttcgccaatgagctttcccacagcagacctcacacttaagatggaatctgctcgcaaggcatgggagaactcccctagtctcccagagcagagttcccccgggggggccggctctgggatccagccaccatcctctgtgggcgcaagttccggcgttaattatagctctttcgggggggtgtccatgccccccatgcctgtcgcaagcgtggctccttccgcctcaatgcctggctcccaccttccacccttgtatctagacggccatgtctttgcatctcagcctcgcttggtaccgcaaaccatcccccagcagcaatcctaccaacaggctgctgccgcccagcagataccaatttccctccacacaagtctgcaggcccaggctcagctgggcctccgggggggtctgcccgttagccagtcacaggagatcttctcctctttacagccatttagatcacaagtgtacatgcatccatctctctcaccaccttccacgatgatactcagtggcgggacagcactgaagcccccgtactctgccttccctggcatgcagcctcttgagatggtgaaaccgcagtccggaagcccgtaccaaccaatgtcaggtaaccaagctctggtgtacgaaggccagctcagtcaagctgctggactgggcgcctcccaaatgttagactcacagctccctcagctgacaatgccgctgccccgttacggctccggccagcagcctctgatcctgccccaaagtatccagctgccacctggacagtctctgtcagtgggcgctcccaggagaattccaccacccggatctcagccgcctgtcctgaacacatctagagaaccaagccagatggaaatgaagggcttccatttcgctgatagcaagcagaatgtgccctcaggcgggccagtgcccagtccacagacctatcgaccaagctctgcctctccaagcgggaagccttccggatccgctgttaatatggggtccgtgcaagggcactacgtccagcaggcaaagcagcgtgtcgatgaaaagccttcattaggcgccgtgaagcttcaggaggctccgagtgccgctagccaaatgaaacgaactggagctataaagccccgcgctgttaaggtggaagagtctaaagcctag

SEQ ID NO: 32280 - DNA, 807 bp, Artificial Sequence
  Description of Artificial Sequence: Synthetic coding sequence
atgccccctatgcctgtagctagtgttgcgccgtccgcgagtatgccaggctcccacttgccgcctctgtatctggacgggcacgtcttcgccagccagccccggctcgtaccacagacaatcccacaacagcagtcctatcagcaggccgccgccgctcagcagatccctatttctcttcacacgtcactccaggcccaggcccagctgggcttaaggggtgggcttcctgttagccagtcacaggaaattttcagttcactgcagccatttcgaagccaggtttatatgcaccccagtctttcgcctccttctacaatgatcctttcagggggcacggcactgaaaccaccatactctgcctttcccgggatgcagccattggaaatggtgaagccccagtccggatcgccataccagcccatgtctggtaatcaagccctcgtgtacgaaggccagctgagccaagctgctggattgggcgccagtcagatgttggactctcagctgcctcagctcacgatgcccctgcctaggtatggcagcggacagcagccgctaatacttccgcaaagcattcagctcccacccggtcagagtctttccgttggagcaccccgacgcatcccgcccccaggctctcagccccctgtgctgaatacttcccgagagccgagccagatggaaatgaagggtttccactttgctgacagcaagcaaaacgtgccatcaggaggcccagtcccatctccacaaacctatcggcagaacaacgaatggatgaggaatccagcatgggagccttag

SEQ ID NO: 32281 - DNA, 4608 bp, Artificial Sequence
  Description of Artificial Sequence: Synthetic coding sequence
atgtcggaccggctggggcagatcacaaagggtaaggatggtaagagcaagtactcaactttgtctctttttgataaatataagggcaagagtgttgatgcaatccgctccagcgtgatccctcgtcacggcctacaaagcttggggaaagtcgccgcagcgcgaaggatgccaccgcctgccaacctcccttccctgaaaagcgaaaacaagggtaacgaccccaacatagtgattgtccccaaagacggaacaggatgggccaataagcaggaccagcaagatcccaaaagctcctctgccacagctagccagcctccggagagcctgcctcagccgggattacagaagtcggtctctaacctgcagaagccaacgcagtcgatcagccaggagaacaccaactcagttcctggaggacccaagtcctgggcccagttgaacggaaaaccggtcgggcatgagggcgggctgaggggctcctcacgtcttctgagtttctcgcctgaagagttccccacccttaaagcagccggagggcaagacaaggcagggaaggagaagggcgttctggacctgtcctatggccccgggccaagcctacgcccacagaacgtgaccagttggagggagggcggcggcaggcacattatatctgctacatccctttcgacaagcccgacggagctcggaagtagaaacagtagcactggcgatggggcgccttcgagtgcctgcacgagcgactctaaggacccttcactcagacccgcacagccagtccgtaagggtgccagtcagtttatgggaaacgtgtatcatccacccacctaccacgacatgctgcccgcatttatgtgtagccctaagtccagtgagaaccaagggaccgtggagcgagggtcttttcctctgccacaacttcgtctagaaccccgcgtccctttccgccagtttcagatgaacgaccaagatggcaaggaaaatcgtttaggtctgtctagaccacttcggccgttgaggcagctggtggaacgtgctcccagacctaccataattaatgctgaaaacctgaaggggttggacgacctagatgccgacgccgacgatgggtgggcagggctgcacgaggaggtagactactctgagaagttgaaatttagcgacgacgaagaagaggaggaggtagtgaaagacgggagacctaaatggaactcttgggatccaagacggcaacggcagctgtccatgtctagtgctgactccgcagatgcaaagcggacccgcgaagaggggaaggactgggccgaggcggtgggggcctcccgtgtcgtccgaaaagcaccagacccacagcctccccctcgaaaactgcacgggtgggcccccggccccgactaccagaaaagtagcatgggcagcatgttccggcagcagtcaatagaggataaggaggacaagcctcctcctcggcaaaaatttatccaatctgagatgagcgaagccgttgagagagcgagaaaacggcgggaagaagaagaacgacgtgcgcgtgaggagcggttggctgcttgcgctgccaaactgaaacaacttgaccagaagtgcaagcaggctagaaaggccggtgaagccaggaagcaggcggagaaggaggtgccttggagcccctcagctgagaaggcttctcctcaggagaacggacccgcagtccataaaggatctccagagtttcccgcccaggagacccccactaccttcccagaagaagcccccaccgtttctcctgccgttgcacagtctaactcaagcgaggaagaggcccgggaggctgggagtcctgctcaggaattcaaataccagaagagcctcccgccccggttccaaagacaacagcaacagcagcaacaagagcagctgtataagatgcagcactggcagccggtgtaccctccaccttcacacccccagaggaccttttaccctcatcacccccagatgctgggatttgatccacgatggatgatgatgcctagttacatggatccacggatcacccctaccaggactcccgtggatttctaccctagcgctctgcacccttcaggattgatgaagccaatgatgcctcaggaatccctgaacggcaccggatgcagatcagaggaccagaactgcgttcctcccctccaggagaggaaggtgacgcccatcgactctccacccgtatggtccccggaggggtacatggccctccaatctaaggggtacccactccctcatcccaaaagcagtgacaccctggcaatggatatgcgggtccgctctcccgacgaggctctcccaggcggcctgagcggttgttctagcgggagcgggcactctccctatgctttggaaagagcggcccatgcttccgccgacctgccagaggccagtagtaaaaaagctgagaaggaggccaagcttgctgcacctagagccggagaacagggtgaggctatgaaacagttcgaccttaactacggctccgcaatcattgaaaattgtggtagttccccaggtgaggagtcagaggtgggttctatggttggggaaggattcatcgaagtactgacgaaaaagcagcgtaggcttctggaagaggaacgaaggaaaaaggaacaggctgtgcaggtcccggtgaagggtaggggtctctcaagtcgtatcccgcctcggtttgccaagaagcagaataacctttgtttagaacagggagacgtcacggtacccgggtcatcccttggcactgaaatttgggagtcctcaagtcaggcgctgcccgttcaggcacccgctaatgactcatggcggaaggctgtgacagcattttccagcacggaaactggtagcgctgagcagggctttaaatctagccagggggactctggggttgacctttctgcagagagccgagagtccagcgccactagcagccagaggtccagtccctatggcacactcaaaccagaggaaatgagcgggccgggacttgccgagccaaaggccgattctcacaaagagcaggctcccaaaccctccgaacaaaaagatagcgaacagggtagcggccagagcaaagaacacaggccgggcccaataggaaatgaacgctccctcaaaaaccgcaagggatctgagggggccgaacggctgcaaggcgcagtcgtgcccccagtgaatggcgtcgagatccacgtcgattctgtgttgcccgtcccccccattgagttcggcgtgagcccaaaggatagcgacttttcactgcctccgggctctgccagcggccctacaggctcccctgtcgttaagctgcaggatgccctagcaagcaacgccgggctgacacagtctataccaattttacgacgggaccaccacatccagcgagccatcggcctgtctcctatgtcattcccgacagctgatttgactttgaagatggaatccgcgagaaaagcttgggaaaactccccttctctgcccgaacagtctagcccggggggcgccggaagcggcattcaaccaccatccagcgttggggcttcctccggggtgaattactcaagttttgggggagtgagcatgcccccgatgcctgttgcctccgtggctccttctgcttccatgcccggaagccacctcccacctctgtacctggatggccatgtgttcgcatcccagcctcgactggtgccccagaccatcccacagcagcagtcgtatcagcaagcagccgccgctcagcagatccccatttctctccatacatcacttcaggcccaggctcagcttggtctcaggggaggcctccctgttagccagagtcaggagatcttctccagcctccagcccttcaggagccaggtgtacatgcatccaagcttgagtcccccatcaactatgattctgtctggcggaaccgccctgaagccgccctactctgccttccccggcatgcagcccttggagatggtaaagccacagtctggcagcccataccagccgatgagcggaaaccaggctcttgtgtatgaggggcaactgtcacaagcagccgggcttggcgctagtcagatgctggactctcagctgccgcaactgacgatgccgctgccacgatatgggagcggccaacaacccctgattctgccccaatccatccaacttccccccgggcagtcattatctgttggagcgcccagaaggatcccgcctccaggaagtcagccaccagtattgaacacctcccgagagccttcacaaatggagatgaagggcttccactttgcagattcaaagcagaatgttccttctgggggacccgttccctcaccgcagacttacaggccttccagtgcctcgccatccgggaagccgagcggcagtgcagtcaatatgggatcagttcaggggcattatgtgcagcaggcaaagcagcgagtggatgagaagccctcactgggtgcggtgaaactgcaggaggccccgtcggcagcgtcccagatgaaacgaaccggtgcgatcaagccgcgggccgtcaaagtggaggaatccaaggcctag

SEQ ID NO: 32282 - DNA, 2391 bp, Artificial Sequence
  Description of Artificial Sequence: Synthetic coding sequence
atgaagcctatgatgccacaggaatcactgaacggcaccggttgcagaagtgaggatcagaactgcgtgcctcccctgcaggaaagaaaagtgaccccaattgacagcccacccgtgtggtcaccagaagggtacatggccctgcagagcaaagggtaccccctgccccatcctaaatcctctgatactctggccatggatatgagggttcgcaatgagtcttctttctcagcatctctcgggcgggctggcggtgtcagcgcccagcgtgacctgttcgaggaacgaggcgaagagtacctgtccgcctttgataagaaggcacaagcggattttgactcttgtatcagttcccaacggattggccaggagttattatttcctccccaggagaacgtgcaggacgcgggagcgccagggggccacacacagaatctgcgttgcagccccctggaacctgatttcgtgccagatgaaaagaagcctgagtgtggctcgtgggacgtgagtcatcagccagaaaccgcagatacggcgcacggagttgagagggagacccccagggagggaacagccttcaacatctcctcttgggataaaaatggatccccaaacaagcagccaagtagcgagcccgagtggacacctgaaccacgctcctcgtcatcacaacatccggagcagaccggtcggaccaggagaagcggccctataaagaaacccgtgctgaaagcgctgaaggtggaggacaaggagaaggagttggaaaagatcaaacaggagctgggggaggagagtactcggctggctaaggagaaggagcagtccccaactgccgagaaagatgaggatgaggagaatgacgcatctttagccaacagctctaccactaccctggaggacaagggccctggtcacgccaccttcgggagggaagctacaaagttcgaggaggaggagaaacctgacaaagcttgggaagcacggccacccagggaatcatccgatgtgccccccatgaaacggaacaattggatctttattgacgaagagcaggcctttggtgtgcgtggccaggcacgtggaagaggccggggatttagagaattcacttttcgaggccggcccgccggtgggaacgggtcaggtctttgcggtggcggggtgttgggcgcgcggagcatctattgctcctcgcaacgtagcggcagggggcgaggattacgcgaattcgcccgcccggaagactgccctcgcgctaagccgcgccgacgtgttgcaagcgaaacacattcagagggctccgagtacgaggaacttcccaaacgccgcagacagagaggatctgaaaacggtaatgaaggaagtctactcgagagggaagaaagcacgctgaagaagggcgactgcagagacagctggagatcaaacaagggctgttccgaagaccattcaggattggatgcgaagtctagaggacctagggcgtttgggcgggctcttccaccacgcctgagtaattgcggatacggacgccggacttttgtaagtaaggagagcccccactggcaaagtaagagcccagggtctagttggcaggagtatggcccatcagatacttgtggatctcgacgcccaaccgaccgggactacgtgccagatagctaccgccaccccgatgcattcgggggaaggggctttgaagattccagggccgaggacaagcggagcttcttccaggacgagcacgtcgcagacagcgaaaatgcggaaaaccggccattccggaggcgtcggcccccgaggcaggacaagccgccgcgctttaggaggcttaggcaggagagagaatctcttggtctatggggtcctgaggaggagccccacctgcttgctgggcagtggcccgggcgtcctaagttgtgttcaggagacaaaagcgggactgtcgggaggcgatccccagagctgtcctatcagaatagcagcgaccatgctaacgaggaatgggaaacggccagcgagtcttccgacttctccgagaggcgggagaggcgggaagggccggggtccgagccagactctcaggtggacggcggactgagtggtgcatccctcggagaaaagaaggagctcgcaaagcgtagcttttctagtcaacgtcctgtggtggaccgtcagtccagaaaactggaacctggaggctttggcgaaaaaccagtcaggccaggcggcggggatacttccccaagatacgagagccagcaaaatgggacaccactaaaggtgaagcggtcacctgatgaggctttgcctggaggcctgtccgggtgctctagcggctcgggtcatagcccttgcccaggggcgggttctccttgtcaatgctag

SEQ ID NO: 32283 - DNA, 537 bp, Artificial Sequence
  Description of Artificial Sequence: Synthetic coding sequence
tgtgaaggcagacaggcgaaggtaaagagttctatgggcagtatgttccgacagcaatccattgaggataaggaagataaaccgccgccgaggcagaaattcatccagagtgaaatgtccgaggcggtagaaagagctcgcaagaggcgcgaggaggaagaaagacgagccagagaggagcgtctcgccgcctgcgccgctaagctcaagcagctagaccaaaagtgtaaacaggcacggaaggccggcgaagctagaaagcaagccgagaaagaggtgccttggagcccttcagccgaaaaggccagccctcaggagaacgggcccgccgtgcataagggctcccccgagttccctgcacaggagactccgaccacatttccagaggaagctcctaccgtttctcccgctgtcgcgcagtccaattcatccgaagaggaagcgagagaagccggctctcccgcccaggagtttaagtatcaaaagagcctaccgcctaggtttcagaggcaacagcagcaacaacagcaagagtag

SEQ ID NO: 32284 - DNA, 1767 bp, Artificial Sequence
  Description of Artificial Sequence: Synthetic coding sequence
tgagggaggggatttgaggactccagagccgaagataagagaagcttctttcaggatgagcacgtcgcagattccgagaacgcagagaaccgcccatttcgtcggcgaaggcccccacgacaggacaagcctccaagattccgccggctgcggcaggagagggaatccttgggactgtggggcccggaggaggagccacacctgctagctgggcagtggcccggcagaccaaagctctgttctggcgacaagtctggaactgttggccggcggtccccggaacttagctaccagaactccagcgaccacgctaatgaagagtgggagacagcctccgagtcatcggacttcagcgagaggcgcgagagacgggaaggtccaggaagcgagcctgattctcaggtggatggaggcttaagtggtgcgagtctgggggaaaaaaaagagctggcaaaaagatcttttagttctcagagaccagttgtggatagacagagcagaaagctggagcctgggggctttggagaaaagccggtgcgccctggcggaggtgacacttcacctcgctacgaaagtcagcagaacgggacccctctgaaagtgaagcgcagcccagatgaagctctgcccggggggctgtccggatgcagctccggttctggacatagcccgtacgctttagagcgcgcggctcacgcctcagctgacttgcctgaggcttcctcaaagaaagccgagaaagaagcaaagttagcagctccaagggcaggcgagcagggagaggctatgaagcagttcgaccttaactatggcagcgccatcatagaaaattgcggatctagcccgggcgaagaaagcgaggttggaagcatggtgggcgaggggtttattgaggtattaactaaaaaacagcgccgtctgctggaagaggaacgcaggaagaaagaacaggccgtgcaggttccagtgaaaggccgcggtttatcatcccgcatcccgccccgcttcgcgaagaagcagaataatctgtgtctagaacagggggacgtgacagtgccagggtcctccttaggcacagagatttgggagtcaagctcccaggcgctccccgtgcaagcaccggctaacgactcttggaggaaagctgttaccgccttctccagcacagagacgggcagcgctgaaggtttcaagtcctcacagggagattcaggcgttgacctgtccgcggagagtcgcgagtcctccgctacatcttctcagcgatcaagcccttatgggaccctaaaaccagaagaaatgtctggtcctggcctggccgagcccaaggctgattctcataaggagcaggcaccaaagccatctgagcaaaaggactccgagcagggtagcggccagtctaaggagcacaggcccgggcccataggcaatgaaaggagcctgaagaacaggaaaggttccgagggggccgaacgtcttcagggcgcagtggttccccccgtgaacggagtggaaattcacgtggatagcgtgctgcctgtaccgccaatcgaattcggtgtgtcacccaaggatagcgacttttcacttccccccggcagcgctagcgggcctactgggagcccagttgtcaaactccaggacgcccttgcaagcaatgcaggtctgactcaatctataccgatcttgcgccgggaccaccacatacagcgcgcaatcggactgagccccatgtctttccctactgccgatctgacgcttaagtag

SEQ ID NO: 32285 - DNA, 528 bp, Artificial Sequence
  Description of Artificial Sequence: Synthetic coding sequence
gagcgaaaggtcacacccatcgactccccacccgtttggagtcctgagggatatatggctctccaatccaagggctatccgcttcctcaccctaagagctccgataccttggccatggatatgagagtgagaaacgagagcagcttcagcgccagtctcggccgagctggcggggtatcggctcagcgcgacctgtttgaagaaaggggcgaagagtatttgagcgcattcgacaagaaggcccaagctgatttcgactcctgcatttcctctcagaggatcggccaggagttgctctttcccccccaagaaaatgtgcaggatgcgggagccccaggcggccatacccagaatctccggtgcagcccccttgaacctgatttcgtgccggacgaaaagaagccggagtgcgggtcctgggacgtgagccaccagcctgaaacagcggatacagcacacggcgtagagcgggaaacacctcgagagggtactgctttcaatatttcctcctgggacaagaatggttag

SEQ ID NO: 32286 - DNA, 4608 bp, Artificial Sequence
  Description of Artificial Sequence: Synthetic coding sequence
atgagcgataggttaggccagattactaagggaaaggatggaaagtcaaaatactccacactctctctgtttgacaaatacaaaggcaaatctgtcgacgccatccgcagctccgttattccacgacacggactgcagagcctcggcaaggtggccgcagcacgtcgcatgccccctccagctaatctgccgagcctcaaaagcgagaataaggggaacgatcctaatatcgtgattgtcccgaaggacggaaccggctgggcaaataagcaggatcagcaggatccaaaaagcagctccgctacagcgtctcagccaccagaatcacttcctcagcccggtttacagaagtctgtatcgaacctgcagaaacccactcagtcaatcagccaggagaatacgaatagcgtgcctggcggacctaaatcttgggcccagctgaacggaaagccagtggggcacgaaggcggcctgcggggaagcagccgtctgctcagcttcagtcccgaagagttccccacattgaaggcggcgggcggccaggataaggctggtaaggagaaaggcgtcttggacctcagttatggcccaggcccatctcttaggccgcaaaacgttaccagctggagggaaggggggggcaggcacattataagtgctacttcgctctcaacttccccgaccgaacttggctcgaggaatagctccactggcgatggagctccaagctccgcttgcacgagtgactccaaggatccaagtctgcgccccgcccagccggttcgaaagggggcgagccagtttatggggaacgtttaccatccacccacctaccatgacatgctgcccgcttttatgtgctctccaaagtccagcgagaatcaggggaccgtcgagcgcgggtcctttccactcccccagttgagactagaaccgagggtgccatttaggcagttccagatgaatgatcaggacggcaaagagaatcgtctgggcctcagccgcccattgcgacctctcaggcagttagtggaacgggccccgcggcccactatcataaatgcagaaaacctgaagggccttgacgacctcgacgctgacgccgatgatgggtgggcggggttacatgaagaagtcgattatagcgaaaaactaaagttcagcgacgatgaagaagaagaagaggtagtgaaggatggccgtccaaaatggaattcttgggatccaaggaggcagcgccagttgagcatgagctcagccgacagcgctgacgcaaaacgaacccgagaagagggcaaggactgggctgaagcagtgggtgcgagccgagtagtcagaaaggcaccggatccccagccaccgccccgaaagttgcacggatgggcccccggtcccgactaccaaaaaagctccatggggtctatgttccggcagcagagcatcgaggacaaggaggacaaaccgccacctcgtcagaagtttattcagtccgagatgagcgaagccgtcgagagagctcgcaaaagaagggaagaggaggagaggcgcgcccgggaggagaggctggcggcttgcgccgctaagctgaagcagttagaccagaagtgtaaacaggctcggaaggcgggcgaggcccgcaaacaggctgaaaaagaggttccctggtctccctccgctgagaaggcgtctccacaagagaacggaccagcggtgcacaagggaagccctgagtttcctgcccaggagactccaactactttcccagaggaagcccccacagtgtcccccgccgtagctcagtccaattccagcgaagaggaggcgcgcgaagcaggatcaccagcacaggagttcaagtaccaaaaatccctccctcccaggtttcagaggcaacagcagcagcaacagcaggagcagctttacaagatgcagcactggcagcccgtgtaccctccaccctcccacccccagcggactttttacccgcaccatccccagatgctgggctttgatccccgatggatgatgatgccatcatacatggacccaaggatcacaccaactagaacgcccgtggacttctatccctctgccctccacccaagcggccttatgaagcctatgatgccccaggaatccttaaatgggacaggatgtcgtagtgaggatcagaattgcgtgccccctctacaagaacggaaggtcacacctatcgactctcctccagtgtggtcgcctgagggctatatggctcttcagagcaagggttacccgctcccccaccctaaaagtagtgacactctggccatggatatgagagttaggagtcccgacgaggcactcccggggggactaagcggctgttcaagcggcagtggacactctccctatgccctggaacgcgccgcccatgcttcagccgatctgcccgaggccagctctaaaaaagccgaaaaagaggcaaagctggcagctccaagggccggtgaacagggcgaggctatgaagcaatttgatctcaactatggtagtgcgataattgagaactgcgggagtagccctggggaggaatctgaagtcggcagcatggtgggcgaaggatttatagaggtactgactaaaaagcaaaggcggctgctggaagaagagcggagaaaaaaagagcaggccgtacaggtgcccgtcaagggacggggcttgagttcacgcattccgccacgcttcgcgaagaaacagaataacctgtgcctggagcagggagatgtcactgtacctggctcatctttaggcacggaaatctgggaatctagttcacaggccctcccagtacaagcccctgctaatgactcctggcgcaaggcagtgacagcctttagctctaccgaaaccggttccgcagaacagggttttaagtcaagtcagggcgactccggggtggatctcagcgctgaatctcgcgagagctctgccacctctagtcagcgctccagcccctacgggactctgaagccggaggagatgagtggaccaggcctagcagagccaaaagccgacagccacaaggagcaggcccccaagccgtcagagcagaaagactctgagcaaggatccggccagtctaaggagcaccgcccgggcccaatcggaaacgagcgctcactcaaaaaccgaaagggcagcgaaggcgcagagcggctgcagggagctgtggtccctcccgtgaacggtgttgagatccacgtggactcagttctgcctgtgccccccattgagtttggggtgagtcctaaagactctgactttagtctgccaccaggatccgcttccgggccaaccgggtccccagtggtaaagctacaggacgcgcttgccagcaatgctgggctgacccagtcaatcccaatcctgaggcgcgaccaccacattcagagggccatcgggcttagcccgatgtcattccctacagccgacctcacgctgaagatggagagtgcccggaaagcctgggagaattctccctctctgcccgaacagtcatcccctgggggcgccggaagtggaatacagcctccatcatccgtcggcgcgtcatcaggagtgaattactccagttttgggggagtttcaatgcctccaatgcccgtggcaagtgtcgctccttcggcgtcgatgcccgggagtcacctgccacctctgtatctggacggccacgttttcgcatcccagcctcgccttgtcccccaaaccataccacagcagcaaagttaccaacaggctgccgccgctcagcagatccctatctctctgcacacttcactccaagcacaggcacagctcgggctcagaggggggttacctgtatctcagagccaggaaattttttctagtctccagccgtttcggagtcaagtgtatatgcacccatctctgtctcccccctcgaccatgattttatccggaggaaccgccttaaaaccaccctatagcgcatttcctgggatgcagcccctagagatggttaagcctcaaagcgggagtccctatcagcctatgtccggtaaccaggccctggtgtacgaggggcagctgagtcaggctgctggactgggagcttcacagatgctcgacagccaacttccacagcttaccatgcccctaccccgctacggatctggccagcaacccttgattctcccacaatcaatccagctaccccctggccagtcattgagtgtcggcgcccctcgccggattccccctccaggtagtcagccgccagtgctgaatacatcccgggagccctcacagatggaaatgaagggctttcatttcgccgattctaaacaaaacgtgccatccggaggccctgtcccctccccacagacttataggccgagttctgcgtccccgtcaggaaagccttcagggtccgcagtgaatatgggcagtgtgcagggtcactatgtgcagcaggcaaagcaaagggtcgacgaaaaacccagtctgggtgccgtcaagttacaggaggccccaagtgctgcctcacagatgaaacgtaccggcgccattaagccgcgggcggttaaagtggaggaatctaaggcatag

SEQ ID NO: 32287 - DNA, 981 bp, Artificial Sequence
  Description of Artificial Sequence: Synthetic coding sequence
atgtccgaccgactcgggcagataacaaaggggaaggatggaaagagtaagtactcgaccctgtctctgttcgataaatacaaaggcaagtctgttgatgcaatcaggagtagtgtcattcccaggcatggcctacagtccttaggaaaggtggcagcagctagacgcatgcctccacctgccaatctgccctcactcaaatccgagaacaaaggaaacgacccgaatatcgtgattgtgcctaaagatggcaccggctgggctaacaagcaggatcagcaggatcctaaaagcagctccgctacagcatcgcagccccctgagtcccttccccaacccggactgcagaagtctgtgtctaacttacagaaacctacccaaagcatctcacaagagaataccaactcagtcccgggtggtccaaagtcctgggcccagctcaacggaaaacctgtgggccatgagggaggacttcgcggctctagtaggctgctgagcttctctccggaagagtttcctactctcaaggccgcaggcggacaggataaagcaggcaaagagaagggggtgctcgatctatcctatgggccaggcccatctcttcgcccccagaatgtgacatcatggcgagagggaggcgggaggcacatcatatccgccacctctctgagcacctccccaactgagcttggatctagaaatagctctactggcgacggggcaccgtcttctgcctgcacttccgattctaaggatccatccctcagaccggcacagccagtgcgaaaaggggcaagtcaatttatggggaacgtgtatcatccgccgacgtatcatgacatgcttccagccttcatgtgtagccccaagtcctcagagaaccagggaactgtcgaacggggatcatttcctctgcctcagctcaggctggagcctcgtgtgcccttccgccagtttcagatgaatgaccaggatggctag

SEQ ID NO: 32288 - DNA, 8454 bp, Artificial Sequence
  Description of Artificial Sequence: Synthetic coding sequence
atgagcgaaaagagtgggcagagtaccaaagcgaaagacggcaaaaaatacgccaccctttcacttttcaacacatacaaggggaagagcctcgagacacagaagacaacagctcgccacggactccagtccttgggtaaggtggggatcagtcgtcgcatgcccccccctgccaacttgccctcactgaaggcagagaacaagggtaacgatccaaacgttaacattgtgcctaaggacgggacggggtgggcatccaaacaggaacaacatgaggaagagaaaacaccggaagtgccaccggcacaaccaaaacctggagtggccgctccccctgaggtggccccagccccgaagtcgtgggccagtaataaacaaggtggacagggcgacggcattcaggtgaattctcagtttcagcaggagtttccaagcctgcaggccgccggcgatcaggagaagaaggaaaaagagaccaacgacgacaactacggaccgggaccatccctgaggcccccaaacgtggcctgctggagggacggtggaaaggccgcggggagcccaagtagctccgatcaagatgaaaaactcccaggacaggacgagtcgactgctggcacctcagagcagaacgatattctgaaggtggtagaaaaaagaatcgcctgcggaccaccccaggcaaagctaaacggccagcaagcggccctggcctctcagtaccgggcaatgatgcctccttacatgttccaacagtatccccgtatgacgtaccctccattgcatggtccaatgaggtttccaccgtccctgagcgagactaacaaaggattgaggggacggggaccacccccatcttgggcctccgagccagaaaggccttcgatcttgtcagccagcgagcttaaggagttggacaaattcgacaacctggatgccgaggcagatgaaggctgggcgggggcccagatggaggtagactatacggagcagctcaacttttcggatgacgacgagcagggatccaacagccccaaggagaataactccgaggatcaggggtccaaggcatcagaaaacaatgaaaacaagaaggaaacagatgaggtctccaataccaaatccagctcacagatcccagcccaaccgagcgtcgccaaggtcccgtacggcaaaggaccttcgtttaaccaagagaggggaactagctcgcacctcccacccccccccaaactgctggcccaacagcaccctccccctgatcgccaagctgtcccaggaaggcctggaccatttcctagtaagcagcaggtggccgacgaggacgagatttggaagcaaaggcgccggcagcagtccgagatttctgcagctgtggagcgagctcgtaagcggagggaagaagaggagcggcgcatggaggagcagcgaaaagccgcttgtgccgaaaagctgaaacgtttagatgagaaactcggcatcctggagaagcagcctagccccgaggaaatcagggagagggaacgcgaaaaggagagggagagagagaaggagctcgagaaggagcaggagcaagagagagagaaagaaagggagaaagatcgagagcgccagcaggaaaaggagaaggagctagagaaagaacaggagaagcaacgcgagatggagaaagagcgcaaacaggagaaggagaaggaactcgaaaggcaaaaagaaaaggagaaggaactgcagaaaatgaaggagcaagagaaggaatgtgagctggaaaaggaacgagagaaactcgaggaaaaaatagagcccagagaaccgaacctggaacctatggttgaaaaacaggaaagtgaaaacagctgcaataaggaagaagaacccgtcttcacccggcaggattccaaccgctcagaaaaggaggcaactcctgttgtccatgagactgaacccgaatccggctcacagcctcggccggccgtgttgagcggatactttaagcagttccagaagtctttaccaccccggtttcagcgtcagcaggagcaaatgaagcaacagcaatggcaacagcaacaacagcaaggggtactaccacagaccgtgccctcccagcctagctcatctactgtgccgccacctccccataggccactctaccagccaatgcagcctcaccctcagcacttagcgtccatggggttcgaccccagatggttgatgatgcagtcatacatggaccccagaatgatgagtggcagaccagctatggatattccccccattcaccccggaatgattcctcctaagccgttgatgaggagagatcaaatggagggcagccccaactcatcggagagcttcgagcatatagctcggtctgcaagagaccacgccatctccctgagcgagccccgcatgctctgggggtccgacccctatccccatgcagagccacagcaggccacaactcccaaagccacggaagagcctgaggacgttagatcagaggcagctctggaccaagaacagatcacagccgcatattccgtggaacataatcagctagaggcccacccaaaggcagactttatccgggagagcagtgaagcgcaagtgcaaaagtttctcagtagaagcgtcgaggacgtccgcccacatcacactgacgccaacaatcagtcggcttgtttcgaggcccccgaccagaagacactaagcgccccccaggaggagcgaatttccgccgtggagtctcagccatcacggaaacgaagtgtgtcgcacggcagcaaccacactcaaaagcccgatgagcagcggtctgaacctagtgcggggatccctaaggtgacgtccaggtgtattgattcaaaggaaccaattgagcgccccgaggagaagcctaagaaggaaggctttatcagatcatccgagggtcccaagcccgagaaagtttacaagtccaagtccgaaacacgttggggccccagacctagttcaaaccgacgcgaggaagtgaatgatagacctgtgcggcgctccgggccaataaagaagcctgtgttacgagatatgaaagaggaacgggagcaacggaaagagaaggagggggaaaaagctgagaaagttacagaaaaagtagtggtgaaaccagaaaagaccgaaaagaaggacctgccgcccccccctccacccccccagccacccgctcctattcagccccagtcagtgcccccacccatacagccagaggcagaaaagtttcccagcactgagaccgctacattggcccagaaaccaagtcaggacactgaaaagcccttagagccagtatccactgtacaggtagaacctgcggtgaagactgttaatcagcagacaatggcagcacctgtggtcaaagaggagaagcaacctgagaaggtgataagcaaggatctggtcatcgagcgccccagacccgacagcaggccagcagtaaaaaaagaatctactttgccaccacggacatactggaaggaagcccgcgagagagattggtttcctgatcaaggttatcgcgggagaggaaggggcgagtattatagtagaggcagatcatatagaggatcatacggaggccgagggcgaggcggcagggggcacactcgcgattatccccagtatcgagataacaagcctcgggctgagcacatcccaagtggaccactcaggcagcgcgaagagtctgagaccagatcagagagcagtgattttgaagtggtgcccaagcgtcggcggcaacgcggaagtgagaccgatacagatagcgagattcacgagtctgcctcagataaggatagcttgagtaagggtaagctgcctaagagggaggagaggcctgaaaataagaagccagtgaagccacattcttcatttaagcccgataaccatgtcaggattgacaatcgattattggaaaagccatacgtccgtgacgatgataaagctaagcccggatttctgcccaagggtgaaccgacaagacggggacgcggcgggacatttagaaggggcggaagagatccgggcggacgccccagtaggccaagcaccctcagacgccccgcatacagagacaaccagtggaacccgcgccaaagtgaggttcccaaacccgaggatggagagcctcccagacggcatgagcagtttattccaatcgccgctgacaaacgccctccaaagttcgaaagaaaatttgaccctgcccgggaacgcccccggaggcaacggcccacacgacctccccgacaggacaaacctccacgatttagacgcctgagggagcgggaggccgccagcaaaagcaatgaagttgttgcagtcccaacaaatggcaccgtgaacaatgtggctcaagaacctgtgaacacactgggtgatattagtggcaataagacccctgatctctccaatcagaatagttccgaccaggccaatgaggagtgggaaaccgcctcggaatcctccgatttcaatgagcgtcgtgagcgtgacgagaaaaagaatgctgatttgaacgcccagaccgtggtgaaggtgggagagaatgttctgcccccaaaaagagaaattgccaaacgatcctttagtagtcaacgacccgtggaccgccagaacaggagggggaataacggccctcctaagagcggaaggaatttctctgggcccaggaatgaaaggcgctcaggccccccttcgaagtctggcaagagaggcccgtttgatgaccaacccgccggcactaccggcgtggatctgatcaacggctcctccgcccaccatcaagaaggagtgcctaacggaactggtcagaagaattcaaaagactctacggggaaaaagcgtgaggacccgaaacccggccccaaaaagcccaaagaaaaagtagacgccttatcgcagtttgatctcaataactatgcctcggtggtgataattgacgatcaccccgaggtgacagtcattgaagacccacagtctaatctgaatgatgacggattcaccgaagtggtgagtaaaaaacagcagaagcgtctgcaggatgaggagcgtaggaagaaggaagagcaggtcatacaggtatggaacaaaaaaaacgccaatgagaaagggcggtcacagacatctaagctgcctcctcgattcgcaaaaaagcaggctacggggatccagcaggcccaaagttccgcatctgtgccgcccctggcatccgctccgttgcctcctagcacatctgcctccgtccctgcttccaccagcgcccctctccccgccactctgactccagtgccagcatcgacgtcggctcccgtgcctgccagcactctcgctcctgtcttggcatcgactagcgctccagtcccggcctctcctctcgcaccagttagcgccagtgccagcgtgtcagcctccgtccccgcatccacttcagctgccgccattacatctagcagtgctcctgcctctgcccctgcgcctacacctattctggcgtcggtgtcaactcctgcttctgttaccattctcgcgtctgcttccatccccatactggcctccgcactagcctcaacatccgcccctaccccggctccggctgccagctcgcccgctgctccagtgatcaccgcgcccactataccagcgagtgcacccaccgccagtgtccctctcgctcctgccagtgcctccgcgcccgccccagcccccacccctgtgtccgcccctaatccagcaccacctgctcccgctcaaactcaagcccagactcacaagccagtgcagaacccactccaaaccacatctcaatcttccaaacagccaccacccagtataagactcccaagtgcccagaccccaaacggcactgactacgtggcatctggtaaaagcatccagaccccccagtcacacggaactctcactgccgagctgtgggacaataaggtggctccccctgcagtgctgaatgacatcagcaagaagctaggacctatctctcccccccagcccccttcagttagcgcgtggaacaaaccactgactagtttcggctcagctccttcctccgagggagccaagaacggccaagaatcaggcttggagattgggaccgacaccattcaatttggcgccccagccagcaacggcaacgagaacgaggtggtacccgttcttagcgagaagtccgcagacaagattcctgagccaaaggagcagcgccagaagcaaccaagggcagggccaattaaagcgcaaaagctgccagatctctccccggtcgaaaacaaggaacataaacctggacccattggaaaggagagatccctgaaaaatcggaaggtcaaggatgctcagcaggtagagcccgaaggacaggaaaaaccctccccggcgacggtccgctctaccgaccccgttacaacaaaggagacgaaggcagtctctgagatgtcaacagaaattggcacaatgatctcggtgtcttccgcagagtatggaaccaatgcaaaagaatccgtgacagactacacaaccccatcttccagcctgcctaacactgttgctactaacaacacaaaaatggaagacaccttggtgaacaacgtacccctgccaaacaccctgcctttaccaaagagggagaccattcagcagagctcatcccttactagtgtgcctcctacaacattttccctaacctttaagatggaatcagctagaaaggcttgggaaaatagtccaaacgtccgtgaaaagggttctcccgtgacgagtacagccccacctatcgccactggggtttcgagttctgccagcggaccttcgacagccaattataatagcttctctagtgcaagcatgccacaaatcccagtggctagtgtaacgccaacggcgtccttatcaggcgccggcacatatactacatcatctctgtcaacaaagtccaccacaacgtccgacccccctaacatctgcaaggttaagccgcagcaactccaaacctcatcactgccctcagcttctcatttttcccagttatcctgtatgccatcgctgatcgcccagcagcagcaaaatcctcaggtttacgtgtcccaaagcgctgccgcccagatccccgcattctatatggatactagccacttgttcaatacccagcatgcccgcctggctccaccatcactagcacaacaacaaggcttccagcccggactgagccagccaactagtgtgcagcaaattccaataccaatctatgcccctcttcaaggacagcaccaggcccagctctccttgggagccggaccggcagtcagtcaggcccaggagctatttagctcgtccctgcaaccttaccgcagtcagccagcattcatgcagtccagcctgtctcagccgtcagtcgtgctgtctggtacggccattcacaacttccccaccgtgcaacatcaggagttagccaaggcccagtcaggtttggcgttccagcagacctctaacacccagccaattcccatcctgtacgaacatcaacttggccaggcaagcggcctgggagggtcccagttgatcgacactcacctcctccaggctcgagcaaatctgacccaggcctccaacctttattccggccaggtacagcagcccggacagaccaatttttataacacggcccaatctcctagcgccctgcaacaggtgactgtgccgttgccagcttcccagctctcactgccgaacttcgggagcacaggacagcccctcattgccctgccacaaactctgcagcctccattgcagcacactactcctcaggcgcaagcacagtctctaagtcgacccgcgcaagtgtctcagcctttccgcggacttatcccggctggcacacagcattccatgatcgctaccaccggcaaaatgagcgaaatggagttaaaggcttttgggagcggcattgatatcaagcccggcacgccacccattgctggacgatcaacaaccccaacgtcaagccccttccgtgcgacgagcacctcacctaattctcaaagcagtaagatgaattctatcgtataccagaaacagtttcagtctgcacccgccactgtgcgcatgactcagcctttccccactcagttcgctccgcaagctaagcagcgggccgaagttctccaatccacccagcgctttttcagtgagcagcagcaaagcaaacagattggcggcgggaaggcgcagaaggtggactctgactctagcaagcctccagagacgttgactgaccccccaggtgtgtgtcaggaaaaggtggaggagaagcccccgcccgccccatcaatagcaacaaaacccgtgcggaccggacccatcaagcctcaggccataaagaccgaagaaacaaagtcatag

SEQ ID NO: 32289 - DNA, 8697 bp, Artificial Sequence
  Description of Artificial Sequence: Synthetic coding sequence
atgtccgaaaagagcggccaaagcaccaaggccaaggatggtaaaaagtacgccacgctgagcctattcaacacttacaaaggcaagtccctagagacgcagaaaaccacagtggctgcccggcatggcctgcagagcctcggtaaagtgggaatcagtaggcgaatgccaccacctgccaacctcccatcactgaaggcagagaacaaaggcaatgacccaaatgtgaacatcgttccaaaggacggtacgggatgggcttcaaagcaagagcagcacgaagaggaaaagaccccagaggtgccccccgctcagcccaaacccggcgtggccgcacctcccgaagttgcccctgcaccaaagagctgggcgtcaaataagcagggtgggcagggggatggtatccaggtgaatagccagttccagcaagagtttcctagccttcaggcagcaggagatcaagaaaagaaagaaaaagaaactaacgacgacaattacggacccgggcccagcctgagaccccctaatgtcgcctgctggcgcgacggaggcaaggccgctggtagtcctagcagctccgaccaggacgaaaaactaccggggcaagacgagagtactgccggcactagtgaacagaatgatatactcaaggtggttgaaaaaagaatcgcatgtgggcctcctcaggctaaactcaatggccaacaggcagccttggcgtcacagtaccgcgccatgatgccaccttatatgtttcagcagtacccgcgcatgacttatccgccactgcacggacccatgaggtttccaccatcactgtctgagacaaataagggtctgaggggacggggccccccgcccagttgggccagtgaacccgagaggcctagtatcctgagcgccagcgagctgaaggagctggacaaattcgacaatctcgatgctgaggcagatgagggatgggccggggcccagatggaggttgattacacagagcagctgaactttagcgacgacgacgagcagggttcaaattcgcccaaagagaataattctgaagaccaaggaagtaaagcctctgaaaacaacgaaaataagaaagagacagatgaggtttcgaacaccaaaagcagttcgcagatccccgcccaacctagcgtggcaaaggttccctacgggaaaggcccctccttcaaccaagagagggggacttccagccacctgccaccaccgccaaaacttttagcccaacagcatcccccccccgaccgccaagcggtgcctggcagaccaggcccattccctagtaaacagcaggtggctgatgaggatgagatctggaaacagcgacgacgacagcagagtgagatctcagccgcagtcgagcgcgcaaggaagaggagggaggaggaggaaagaagaatggaagagcagcgcaaggcggcgtgtgctgagaaactcaagcggttagatgaaaaactgggaatccttgagaagcagccatctcccgaggaaattcgcgagagggagcgagagaaggaacgcgagcgggagaaggagctcgagaaagaacaggaacaagaaagagaaaaggaacgtgagaaggaccgcgagcgccaacaggaaaaagagaaggagctcgaaaaggagcaagaaaagcagcgggagatggagaaggaacgaaaacaggagaaggagaaagaattggagcgccagaaggaaaaagagaaggagctccagaaaatgaaggaacaggagaaggagtgtgagcttgaaaaggagagagagaagctcgaggagaagatcgagccacgagagcccaacctcgagcctatggtcgagaagcaggaatccgagaactcgtgtaataaggaagaagagccagtgtttactcgacaggactctaatcgctcagagaaggaggcaacgccagtcgttcatgagactgagcctgaaagtggaagtcaaccaagaccggcagtgctgagcggatacttcaagcaattccaaaagagtttgcctccgagattccagagacagcaggagcaaatgaagcagcagcaatggcaacaacagcaacagcagggggtactgccacaaacagtgccgagtcaacccagcagctctacagtgcctcctcccccacaccggccgttgtatcagcccatgcagccacacccacagcaccttgcttccatgggcttcgatcccaggtggttgatgatgcagagctacatggaccctcggatgatgtccggcagacctgctatggatatcccccctattcatccgggcatgatcccgcctaagccactaatgcgcagagaccagatggagggcagtccaaacagcagtgagtcattcgaacatattgcacgcagcgcaagagatcatgctatcagcctcagcgaacccaggatgctttggggatctgatccatacccccatgccgaacctcagcaggccacaacacccaaagcaaccgaggagcccgaggacgttaggtcggaagctgctctagatcaggaacaaatcacagctgcatatagtgtagagcacaaccaactcgaggctcaccccaaggccgattttattcgggaatcctcagaggcccaggtgcaaaagtttctctcccgctctgtggaagatgtcaggcctcaccataccgacgctaataatcagtccgcctgcttcgaggcaccggatcagaagacattgtccgctccacaggaggaaaggataagcgccgttgagagtcagccatcacgtaagaggagcgtgtctcatggctcaaaccacacacagaaacccgacgagcagcggtcagaacccagcgcaggcatacccaaggttacttccaggtgtattgacagcaaggaacctattgagcgtccggaagaaaagcctaaaaaagagggatttatccgttccagcgagggtcccaaacctgaaaaggtgtacaagtcgaaatctgaaacaaggtggggccctaggccgagctctaatcggcgggaagaggtgaatgatcgcccagtgcgccgcagcggccctattaaaaagcctgtactgcgtgacatgaaagaagagcgtgaacagcgaaaggagaaggagggagaaaaggccgaaaaggtgacagaaaaggtcgtggtgaagccggaaaaaaccgagaaaaaagacctacccccgcctcccccccctcctcagccccccgcacctatccaaccgcagtccgtccctccaccaattcagcctgaagccgaaaaatttccatctactgagactgcgacccttgcccagaagccatcccaagacactgagaagcctttagagccagtttccaccgtgcaggtagaacccgcagtcaaaaccgtgaatcagcagacgatggcggcacccgtggtgaaagaggagaagcagcccgaaaaggtgatctccaaagatcttgtgatcgaacgccccaggcctgactctcggcccgccgtaaagaaagagtccactctcccaccccgcacctactggaaagaggctagggagcgggattggtttcccgatcaggggtaccggggtaggggccgcggagagtactatagtaggggcagaagctatcgcgggagttatggcggtcggggacgtggcggtcgcggacacacacgagactacccccagtaccgtgataacaagcccagagccgaacatattccctccggacctctccgacagagagaggagtcagagaccagatctgaaagttctgattttgaagtcgttccaaaaaggcgaagacaacgtgggagtgagacagatactgactctgagatacatgagtctgcttcagacaaagattccttgagtaagggtaaacttcccaagagagaggagcgtccagaaaataaaaaacccgtgaaaccacactctagctttaaacccgacaaccacgtccggatcgataaccgactgctagagaagccttatgtccgggacgacgacaaggcaaagcctggctttttacctaagggtgagccgaccagaagggggcgaggcggtacatttaggcgcggtggtcgggatcccggcgggaggccatcccggccttcaacactacggcggccagcatatagagacaaccaatggaacccacgtcaaagtgaggtccctaaacctgaggacggcgagcctcctagacgccatgaacagtttataccaatcgcggcagacaaacgccccccaaagtttgagagaaagttcgacccagcgcgggaacggcctaggagacaacgtccgacacggcccccccgccaggataagccacctcggtttagacgtcttagggaaagggaggctgccagtaagtccaacgaggttgtagcagtcccaaccaatggaactgtcaacaacgtggcccaggaacccgtgaacaccctcggcgatattagtggtaataaaacccctgacctcagtaaccagaactctagcgaccaagccaatgaagaatgggaaaccgccagtgagagctcggatttcaatgaaagacgggagcgcgatgagaaaaagaatgctgaccttaatgctcaaacagtggtaaaagtgggggagaacgtacttccccccaagcgcgagatcgcgaagagatctttttctagccagagaccagttgacagacaaaacaggcgcggaaataacggcccccctaagtccggccggaatttctcgggacctcgcaatgaaaggcgtagtggaccgccaagcaagtcggggaagcgcggccctttcgatgatcagcctgctgggacaaccggggtagatttgattaacggaagctctgcacatcaccaggagggagtccccaacgggacaggccaaaagaattcaaaagatagcacgggaaaaaaaagggaggatcctaagccaggacctaaaaagcctaaagagaaagtggacgccttatctcagtttgatctgaataattatgcctcagttgtaattatagatgaccaccccgaggtgaccgtcattgaggatcctcagtctaacctgaatgacgatggattcacagaggttgtgtcaaaaaagcagcagaagcgcttgcaggacgaggaaaggcgtaagaaagaagagcaggtgattcaggtctggaataagaaaaacgccaatgaaaagggcagatcacagacttctaagcttcccccaaggttcgctaaaaagcaggccacaggtatccagcaagcccaatcttccgcgtccgtgccacctctcgctagtgcaccgttacccccaagcacttccgccagtgtcccagctagtacctctgcacctctgcctgccacactcaccccagtccctgcttctacatctgcgccagttccagcgtcaacgcttgcacccgtgcttgcatctacatccgcgcccgtgccggcttctcctcttgctccagtgtcagctagtgcatccgtgagcgcctccgtgccagccagtacttccgctgccgccatcactagttcctcggctccagccagcgctcctgcccccacacctatccttgcatcagtctccacccctgcatcagttactattttggcctcggctagcattcctatcctagcctctgcactggcaagtacatccgcgcccactcctgcacccgcagcctcatctccggccgctccggtgataacagcgccaacaattcccgcaagtgcccctacagcaagcgtccccttggcgcccgcctctgcctctgcccctgctcctgccccgacccctgtcagcgcacctaatccagctccccctgcaccagcgcagacgcaggcacaaacccataaaccagtccagaacccgcttcaaacaacctcgcagtcttctaagcagcctcccccaagcattcgactgcccagcgcgcaaactccgaacggcaccgactatgtggcgtctggcaagtcaattcaaaccccccagagtcacggaacactgactgcggaactatgggacaacaaagtggctccccctgccgtgcttaatgatatctccaaaaagctcggaccgatcagccccccccagccccccagtgttagcgcctggaacaagcccctgacgtcattcgggagcgcgccaagctctgaaggagcaaagaacggccaggagtcagggctcgagatcggcaccgataccatccagttcggcgccccagcatcgaatggaaatgagaatgaagtggtcccagtactaagcgaaaaaagtgctgataagattcctgagcccaaggagcagcgtcagaagcaaccaagagctggccccatcaaggctcagaagctccccgacttaagcccggttgagaacaaggagcacaagcctgggcctattgggaaagaaaggtcacttaaaaaccgaaaagtgaaggatgcacagcaggttgaacctgaaggacaggagaagcccagccctgccaccgtgcggagcacagaccccgtaaccactaaagagaccaaggctgttagcgagatgtctaccgagatcggcactatgatatcggtctccagtgctgagtacgggaccaacgccaaggaatcagtaaccgactatacaaccccctcgagcagcctgcccaacaccgtggccactaacaacaccaaaatggaggatactctggtgaacaatgttccactcccaaacacattgcctctgccgaagcgagaaaccatccagcagtccagctctcttaccagcgtgcctcccactacattctcactgacattcaagatggagtccgcccgaaaggcctgggagaactcccccaacgtcagggaaaagggtagcccagtcaccagtaccgcaccaccaatcgccacaggtgtgtccagcagcgctagcgggccctcgactgccaattacaattccttcagctccgcctctatgccccagattccggttgcgtctgtgacacccaccgcgagccttagcggtgccggcacttacactaccagttctctttcgaccaagagtactaccacatctgatcctcccaatatctgtaaggtgaaaccgcaacaactgcagacttcatcactccctagtgcatcccacttcagccaactatcttgtatgccgtccctcatagcgcagcagcagcagaacccacaagtttatgtgtcgcagagcgccgctgcccagatcccagctttttatatggacacttcgcatctattcaacacccagcatgctagactggcacctccctctcttgcccagcagcagggattccaacccgggcttagccaaccgacgtctgtacagcaaatcccaattcccatttatgccccactccaggggcagcaccaggcacagcttagcctgggcgccggaccagcagtgtctcaagcgcaagaactattcagttcatccctccagccgtatcgctcccagccagcgttcatgcaatcctctctgagccagcctagcgtggtcctgagcggcaccgccatacacaatttcccaacagtacaacaccaagaacttgcgaaggcccagagcggtcttgcattccagcagacctctaacacccagcccatacctatcctgtacgaacaccagttaggtcaggcaagtggattagggggatcccagcttattgatacccaccttctgcaggcccgcgcaaacctcactcaggcttctaacctgtattcggggcaagtacagcaaccgggtcagaccaatttctacaacactgcacaaagcccatccgcactccagcaagtgactgttccgctgcccgcttctcagcttagtctcccaaacttcggttcaaccggacagcccctgatagctttgccccagacactccagccacctttgcaacatacaactccccaggctcaggctcagtctctgtcacggccggctcaggtttcacagcctttcagaggtttgatccccgcgggcacacagcactcaatgatagctacaaccggcaaaatgtcagaaatggagctgaaggcctttggctccggcatcgatatcaagcccggaactccccctattgccgggcgttcaacaacccctacaagttctccattcagggcaacaagtacctctcccaattctcagtcctcgaagatgaactctatcgtttatcagaaacagtttcagagcgctccagcgacggtccggatgacccagccatttcctactcaatttgcacctcaaatactaagtcaaccgaatctggttccgccgctagtccgggctccccatacaaacacgtttcctgctcccgtgcagagacccccaatggcactcgcatcgcagatgccacccccattgactacaggcctgatgagtcacgcacggctgccacacgtagcccgcggcccatgcgggagcctgtccggagtccgaggaaaccaggcccaggcggccctcaaggccgaacaggatatgaaggctaaacagagggctgaagtgttacagtccacacagaggtttttcagtgaacagcagcaaagcaaacagattggcggaggtaaggcacagaaagtcgactcagactccagtaaacctcctgagacgctgacagacccccctggtgtctgtcaagaaaaggttgaggaaaaacccccaccggcgccttcaatcgctacgaagcccgtgaggaccggtcctatcaagccccaggctatcaaaacagaagaaacaaagtcatag

SEQ ID NO: 32290 - DNA, 7962 bp, Artificial Sequence
  Description of Artificial Sequence: Synthetic coding sequence
gttcctaaccagatgtttcaacagtaccctcggatgacttatccccctcttcacggaccaatgcgattccccccctccctgagcgagaccaataaggggttgcgcggccgcggtcctcccccatcctgggccagcgagcccgaaaggccaagcatcttgagtgcttccgaacttaaggagttggacaagtttgacaaccttgacgcggaagcagatgaggggtgggcaggcgcgcagatggaggtcgattacaccgaacagctgaacttctccgacgacgacgagcagggatcgaacagcccgaaggagaacaattctgaggaccaaggttcaaaagcttctgaaaacaacgagaacaagaaggagaccgacgaagtgtctaataccaagtcaagcagtcagatccctgcacaacctagcgtggctaaagtcccctacggtaagggacctagctttaatcaggagcggggcacaagttcccacctgcccccacctccaaagttactggctcagcagcatccacctccagacaggcaagcagttcctggcagacctggcccctttccaagcaaacagcaagtggcggacgaggacgagatatggaagcaaaggcgaaggcagcagagcgagatctctgccgccgtcgaacgggcaaggaagcgacgcgaggaggaagaaaggcgtatggaggagcagcgtaaagccgcttgtgctgagaagctgaaacggctggacgagaaactgggaattttggagaagcagccaagccccgaagagataagagagagggaaagagaaaaagaaagggagcgagagaaagagttggagaaagaacaagaacaggagagggagaaagagcgggagaaagacagagagcgacagcaggagaaagagaaagaactggagaaagaacaagaaaagcagcgggaaatggagaaggagcgtaagcaagagaaagaaaaggaattagaaaggcaaaaggagaaggaaaaagaattacagaaaatgaaggagcaggagaaagagtgcgagctagaaaaagaacgtgagaagttagaagaaaaaattgaaccccgagagcctaatctggagcctatggtggagaagcaggagagtgaaaatagctgcaacaaggccgaggaggagcccgtgttcactcggcaagacagcaacaggagcgagaaagaagctacacctgtggtgcacgaaaccgaacctgagtcaggtagccagcccagacctgcagtcctgtccggttacttcaaacagtttcagaaatcactccccccccgctttcagcggcagcaggagcagatgaaacagcaacagtggcagcagcaacagcagcagggcgtgttaccgcagacagttccgagccagccatcctcctctactgtgccccccccaccccaccgcccattgtatcagccaatgcagccacatccacaacatctggcaagtatgggttttgaccctagatggctcatgatgcagtcttacatggacccgcggatgatgtctggcagacccgccatggacattccaccaatacatcccgggatgataccccccaagccgctcatgagacgagaccagatggaaggaagtcccaatagttcagagagtttcgagcatatcgctaggtccgcacgtgaccatgccatatctctatcagaaccaaggatgctgtggggtagcgatccttacccacatgcagagccacagcaagccaccactcccaaggctactgaggaacctgaggacgtccgatcagaagccgctctggaccaggagcagataacagccgcatattcagtagagcacaatcagctggaggcacaccctaaagctgacttcatacgtgagtcaagtgaagctcaggtccagaagttcctcagtcgctccgtggaggacgtgagacctcaccatacagatgccaataaccagagtgcgtgcttcgaagcgcctgatcagaagactctgagcgcccctcaggaggagagaatcagtgctgtggagtctcagccatccaggaagaggtctgtctctcatggatcgaaccacactcagaaacccgatgagcagcggtccgaacctagtgcaggcataccgaaagtgacctcgaggtgtattgattcaaaagagcctatagaaagacccgaagaaaagcccaagaaggagggttttatcagatcgtccgagggccccaagccagagaaggtgtataagagcaaaagcgagactagatgggggccccgcccctcctcaaaccggcgtgaggaagttaacgaccgaccagtccggcggtccggccccatcaagaagcctgtcttgagagatatgaaggaggagcgcgaacagagaaaggagaaagagggagagaaggccgagaaggtgacggaaaaagttgtggtgaagccagagaagacggaaaagaaggatctgccgccaccacccccaccgccccagcccccagctccaatccagcctcagtcagttcccccacccatccaaccagaagccgagaaatttcccagtacagaaacggctacactcgcccagaaacctagccaggataccgaaaagccactggagccagtaagtaccgtgcaggtcgaacccgccgttaagaccgtgaatcagcaaaccatggcagcccccgtagtgaaggaggagaaacagcctgagaaggtcatcagcaaagatttagtcatcgagcgcccacgaccagactccagaccagccgtgaaaaaggaaagtaccttgccgccacgcacttattggaaagaggcgagagaaagggactggttccccgatcagggttatcgtggacggggccggggcgaatactactcccgcgggcgctcttaccgcgggagctatgggggtcgggggcggggaggcagaggacatacacgggactatccacagtaccgcgataataaacctcgcgcagagcacattcctagtggtccactgcgccagcgagaggagtccgagacgcggtccgaaagtagcgacttcgaagtcgttccaaaacgtcgacgacagcgaggatctgaaactgacacagacagcgagatccacgaatccgctagcgacaaggattccctgtctaagggcaagctacctaaaagagaagaacgcccagagaacaaaaagccagtgaagccccattcaagctttaaaccagacaatcatgtgcgaatcgataacagactccttgagaaaccgtacgtacgagacgatgataaggctaagcctggctttctgccaaagggtgaacccacaagacgaggacgcggaggaaccttccgacgaggagggagagatcccgggggaagaccttcaaggccatcgacactaaggcggcccgcataccgggataatcaatggaacccccggcagtctgaggtgccaaaaccagaggacggcgagcctccgaggagacatgaacaattcatccccatcgccgcagataagaggcctcctaaattcgaacgtaagtttgatccggctagagagagaccacgtagacagaggcccactcggcccccgcgccaggataagccaccccggtttcggcggttacgcgagcgcgaggccgcctctaaaagcaatgaggtagtagccgtaccgactaacggcactgttaataacgtcgcacaggagccggttaacactctcggtgatatctccgggaataaaacgcccgatctgtctaaccagaattcgtccgatcaggccaatgaggagtgggagacagcttctgaatcctcagatttcaacgaacgcagggaacgcgatgaaaaaaagaacgccgacctgaacgctcagaccgtggtgaaggttggcgaaaacgtgcttccgcccaaacgggaaatcgccaaacggagcttctcatcacagcgcccggtcgaccggcagaaccgaagaggtaacaatggtcctccaaagtcgggtcgaaattttagcggaccgcgcaacgaaagaaggtccggtcctcccagcaaatctggaaaaaggggtcccttcgacgatcagcccgcgggtactacaggagttgatctaatcaatggaagttcagcccaccaccaggagggcgtgcccaatggaactggacagaaaaattccaaggatagcacaggaaagaaaagagaggatccgaaacctgggccaaagaagcctaaggagaaagtggacgctctcagccagttcgacctgaacaattatgcctctgttgttataatagatgaccatccggaggtaacagtgattgaggatcctcagtctaacctgaacgatgacggcttcaccgaagtagtgtctaagaagcagcaaaagcgtctgcaggatgaggagcgccgcaaaaaagaagagcaggtcatacaggtgtggaacaagaagaatgctaacgagaaaggccgttcacaaacctctaaactacccccacgcttcgctaagaagcaggccactgggatccaacaggctcagagcagtgcatcagtcccacccctggcatccgctcccctaccaccctcaacatccgctagcgttcccgcaagtacctccgccccgctgcccgcgacattgaccccagttccagcttccacctccgcccccgtgccagcatccaccctcgcaccggtgctggcttcaacctccgcgcccgtgcctgctagcccactggccccggtcagcgcgtctgccagtgtatccgcgagcgttcctgcctcaacttctgctgcggcgatcacttcttcctccgcacctgcatccgctccggccccaacccctatacttgccagcgtttccacacccgcctctgtgacaatactagcatccgccagtataccaatcctggcctccgccctggctagtactagcgcccccacgcctgctcctgctgctagctcccccgccgcgcccgtgatcacggctcctacaattcctgccagtgcacctacggcctccgtgcccctcgctccagcatcagccagtgcccctgccccggctccgacacctgttagtgctcccaatcccgctcctcctgcgcctgcccagacacaggctcaaactcacaaacccgtccagaaccccctgcagaccacaagtcagtcaagtaagcagccgccgcccagcattcgtttgccctccgcccagactccgaatggtactgactacgtggcctcaggcaaatccatccagacacctcagagccatggaaccctaacggccgaattatgggacaacaaggtggccccccccgctgtgctgaatgatataagcaagaaactgggccccatttcacctccacagccccccagcgttagcgcatggaataagccgctgacgtcctttggttcagctcccagtagcgaaggggccaagaatggacaggagagtggactagagatcggcaccgacactatccagtttggagcacctgcgtctaacggcaatgaaaacgaggtggtccccgtcttgagcgaaaaatccgctgacaagattccagagcccaaagagcagcggcaaaaacagccgcgcgcggggccaatcaaggcccagaagctgcctgatctgtcccccgtggagaacaaagaacataagcccggcccgatcggcaaggagagaagcctgaaaaatagaaaagtcaaggacgcccaacaggttgagcccgaggggcaggaaaaaccgagtcccgccaccgttagatccactgatcccgtgactacaaaagagacaaaggccgtgtctgagatgagcactgagataggtactatgatctctgtatccagcgcagagtatggaacgaacgccaaagagtcagtgactgattacaccacaccatcatcaagcctgcctaacaccgtggccacgaataacactaaaatggaggatactctggttaacaatgttcccctgcctaacactctgcccttgccaaaaagagaaactatccagcagtcaagctcacttacatctgtccctccaacaacctttagcctgacattcaaaatggaatccgctagaaaagcttgggaaaattcacccaatgtccgggaaaaaggcagtccagtcacctccacagccccacctatcgccacgggagtatcctcttccgccagtggcccaagtactgctaactacaattcttttagttccgcttccatgccacagataccagtcgccagtgtgacacctacggcctcgctgtccggagccgggacgtacacaacatctagtctcagcaccaaatctactacgacctctgaccctccaaacatttgcaaggtgaaaccccaacagctgcagaccagtagtttgccgagcgcctctcatttttctcagctgtcatgcatgccctccttaattgctcaacaacaacaaaatccccaggtctatgtgtcacagtctgctgcagcccaaataccagccttttatatggatacatcacatctattcaacacgcagcatgcccggctggcaccaccatctctcgctcaacagcaaggcttccagcctggtttgagccagccaacatccgtgcagcaaattcccattcctatatacgctccccttcaaggacagcatcaggcacagttgagcctgggcgctggtcctgccgttagtcaggcccaggaattattctcaagttccctccagccctacagatcccagcctgcgttcatgcagagctccttaagccagcccagtgtggtgctgagtggtaccgctatccacaactttccaaccgttcagcatcaggagttggcgaaggcacagagcgggttagcgtttcaacagacctccaacacacagcccatacctatcctgtatgagcatcagctgggacaggcatccggattgggaggatcgcaactcatagatactcacctgctgcaagctagggccaatttgacacaggcaagcaatctgtactcagggcaggtgcagcagccaggtcagaccaacttttataacaccgctcagagcccctccgcactgcagcaagtgaccgtaccattgccagcttcacaactgtccctgcccaacttcggatcaactggccagcctcttattgctctgccgcagactctgcagccccccctccagcacacaactccccaggcccaggcgcagagccttagcagacctgcccaagtgagccaacccttccgtggtctcatccctgcgggcacacaacattctatgatcgcgactacggggaaaatgagtgagatggaactgaaagcgtttggtagtggcatagacattaagcccggcacgccccctatcgctggcaggtccacgaccccaaccagctccccttttcgtgcaaccagcacctcgcctaatagccagagctctaagatgaattcaatcgtttatcagaaacagttccaaagcgccccagccactgtccgaatgactcagccctttcccacacagtttgccccccagatactttcccagccaaacctagtcccgcccctggtgcgagccccacatactaatacctttccggcacctgtgcaacgccctcccatggctcttgcctcccaaatgccacctcccctgaccaccggtttaatgagccatgccagacttccccatgtggctcgaggtccatgcgggtctctgtctggcgttcggggaaaccaggcgcaagctgccctaaaagctgaacaggacatgaaggcaaagcagagagcagaggtcctgcagtccacccagcgatttttttccgagcagcagcagagtaagcagattggcggtggcaaagcccagaaagttgactcagatagtagtaagccccccgaaacgctcacagacccaccaggtgtttgtcaggaaaaggtcgaggaaaagcctcctccagcccccagcatcgccaccaaaccggttaggactgggccgatcaaacctcaagctatcaagaccgaggagacaaagtcttag

SEQ ID NO: 32291 - DNA, 813 bp, Artificial Sequence
  Description of Artificial Sequence: Synthetic coding sequence
atgagcaccgaaatcgggactatgatttctgtctcaagcgctgaatatggtactaatgcaaaggaaagcgttactgattacacaacaccatcatcaagcctccctaacacagtggcgactaacaacaccaagatggaagataccctcgtgaacaacgttcccctgccgaacaccctgcctctgccaaaaagggagacaatccagcagtctagcagtctgacctcagtcccaccaactactttctctttaacatttaagatggagtccgcgaggaaggcatgggaaaacagtcctaacgttagagaaaagggtagccctgtgacttctaccgcccctccaatcgctaccggagtctccagtagcgctagtgggccatctacagctaattataacagtttttcaagcgcctctatgccacaaatacccgtcgcttctgtgacccctactgccagcctgagcggggcgggcacatacactacgtcctccttatcaacgaagtccactactacctccgatccccctaatatctgcaaagtgaagccacagcagctacagactagctcattgccatccgcgagccatttctcacagctgtcctgtatgcctagcctaatcgctcaacagcagcagaatccacaagtgtatgtttcccaatcagctgcggcccagatacccgcattttacatggacacctctcacctctttaacacccaacacgcacggctggctcccccatcactggcacagcagcagggttttcagccaggtctttctcaaccaaccagcgtccagctgctgacctcgactatatag

SEQ ID NO: 32292 - DNA, 8259 bp, Artificial Sequence
  Description of Artificial Sequence: Synthetic coding sequence
atgagtgaaaaaagcggccagtccaccaaggcaaaagacgggaagaagtatgctacactgtcactctttaatacctacaaaggcaagagccttgaaacacagaagaccaccgcaaggcacgggctccagtccctgggtaaggtcggcattagtcgacgaatgccaccccctgcaaacctcccttccttgaaagctgagaataagggaaacgatccgaatgtgaatatcgtaccaaaggacggaactggatgggcgtctaagcaagaacagcatgaggaggaaaaaactcctgaggtgcctccggcgcagcctaaacccggagtggccgccccccctgaggtggcgccagcgccaaaaagctgggcgtcgaacaaacagggaggccaaggagacgggattcaggtgaattctcagttccaacaagagtttccaagcttacaggccgcgggggaccaggagaaaaaggagaaggaaaccaatgacgataactacggcccgggcccaagcctccgcccaccgaacgtcgcctgctggagagatggtggtaaggccgcgggtagcccgagctccagtgaccaggacgaaaaacttcctggacaggacgagtcaacggcgggcacgtccgaacagaatgacatactcaaggtggtcgagaagcgaatagcgtgcgggcccccacaggcaaaactgaatggccaacaggctgcgctagcatctcagtatcgcgccatgatgccgccttacatgttccagcaatatccacgaatgacgtacccaccccttcacggtcccatgcggttcccgccttctctgagtgagaccaacaagggtttacgcggcagaggcccccccccgtcctgggcatccgagcccgagaggccttcaatcctttcagcaagcgaactgaaagaattggataagttcgacaacctggacgccgaggccgatgaaggatgggcgggggcccaaatggaggtggactatacagagcagctgaatttttccgacgacgatgagcaggggtctaacagcccaaaagagaataattctgaggatcagggctcaaaagcctcagagaataatgagaacaagaaggaaactgacgaagtttcgaacactaagtcatcatcccaaatcccagcgcagccctccgtcgccaaagtgccctatggcaaaggacctagtttcaaccaagaaagaggaacatcaagtcatctgcctcctcccccgaagcttttagcccagcagcaccccccacccgacaggcaggcggtgccgggtaggcccggcccttttccgagcaagcagcaggttgctgatgaggacgagatctggaagcagcggaggcggcagcagagtgaaataagcgctgctgtcgaacgggcacgaaagagaagagaggaggaagagagaagaatggaggagcagaggaaagcagcttgtgctgagaaactgaaaaggctggacgaaaaactgggaatccttgaaaagcagccttctccggaagaaattcgggaaagagagagggagaaggagcgtgagcgcgagaaagagctcgagaaggagcaggaacaggagagggagaaagagcgcgaaaaggatcgcgagaggcagcaggagaaggagaaagaactagagaaagagcaggagaaacagcgagagatggaaaaggagcgcaaacaggaaaaggagaaagaactggagcgccaaaaagagaaggagaaggagttgcaaaagatgaaagagcaagaaaaggaatgtgaacttgagaaggaacgggagaaattagaggaaaaaattgaaccacgggagccaaacttagagcctatggtggaaaaacaggagagtgagaactcttgtaataaggaggaggaaccagtgtttaccagacaggatagcaaccgctccgagaaggaggccacccctgtggtgcacgagacagaaccagagagtggatcccagccccgaccagccgtcttgagcggatattttaagcaattccagaaatcactccctcccagattccagaggcaacaggagcagatgaaacagcaacagtggcagcagcagcagcagcagggggtgttgcctcagactgtgccaagccagccgagtagttccaccgtgccgccccccccacacaggccgctgtatcagcctatgcagccccacccccagcacctcgcctccatgggctttgacccccggtggttaatgatgcagtcatatatggaccccaggatgatgtctggacgtcccgcgatggacatcccaccgatccaccccggtatgattcccccgaaaccactcatgaggagagaccagatggagggcagtcctaactcatcagagagctttgagcacatcgctagaagtgctcgtgatcacgcaatatctctgagtgaaccgcgcatgctgtgggggagcgatccttatccccatgccgaaccccagcaggccacgacacccaaagctaccgaagaacctgaagacgtgagatccgaggctgcactcgaccaggaacaaataaccgctgcatattcagttgaacacaaccaactagaggcccacccgaaggctgattttatcagagaaagttccgaggcacaggtgcagaaattcctttctcggagcgtcgaagacgtgaggccccaccacaccgatgcgaacaatcagtccgcgtgcttcgaggcacccgaccagaagactttatctgccccacaggaagaaaggatttctgctgtagagagtcaaccttccaggaagaggtctgtatcacacggatccaatcatacccaaaaacctgatgagcagaggtcagaaccctccgctggaatcccaaaggtgacgagtcgttgtattgactccaaagaacccatcgaaaggcccgaggagaaaccaaagaaggagggatttatacgctcatcagagggcccaaagcccgagaaagtgtataaatctaaaagtgaaacgagatgggggccacggcctagctcaaatcgccgggaagaggtaaacgatagacctgtgcgtcggagtggcccaattaaaaagcccgtcctccgagatatgaaagaggaaagagaacagcgcaaagagaaggaaggggaaaaggccgagaaggtgacggagaaggtcgtggtgaaaccagagaaaaccgagaagaaggacttgccaccgcccccgcctcctccacagcccccggcgccaattcagccgcagagcgtgccaccccccatccagccagaggcagaaaagtttccatcaaccgaaacggcaactcttgcccagaagccttctcaagacacagagaagcccctggagccagtgtcaaccgttcaggttgagcccgccgtgaagactgtgaaccagcagacaatggctgcccctgtcgtgaaagaggagaagcagcccgaaaaggttatctctaaagatttagtgatagaaagacctcggccagatagccgccctgcagtgaaaaaagagagtactctcccccctcgaacatattggaaagaagcccgcgagcgggactggttccctgaccagggttatagggggcgagggcggggagagtactactcccgcggccgttcatatagggggtcgtacggcgggcgcggaagaggagggcgcgggcatacccgggattatccccagtatagggataataagccgcgggctgaacatataccttcgggccccttgagacagcgggaggaatccgagacccgctccgaatccagtgatttcgaagtcgtccctaagaggaggagacagcgaggatccgaaaccgacaccgactccgaaatacacgagtctgcatctgacaaggacagcctcagcaagggcaaacttccaaagcgcgaagagcgccccgagaacaagaagccagtcaagccccacagcagtttcaagccagacaaccacgtgaggattgacaaccgtctgctggagaagccctacgttcgggacgacgacaaagccaaacccggattcctgcccaaaggggagccaacccggcggggaagaggcggcacgttcaggaggggcgggcgtgatcccggaggcaggccttcaagacctagtaccctgaggaggccagcgtaccgggataatcaatggaatccaaggcagagcgaggtgcctaagccggaagacggcgagccccccaggcgccatgagcaatttattccaatcgcagccgataagcgccctccgaagttcgaacgtaagttcgatccggctagagagcgacctcgcagacagcgtccgacccgcccccccaggcaagacaagccccctaggttccgcagacttcgagaaagggaagctgcaagcaagtctaacgaggtggtggccgtgccaaccaatgggacagtaaacaacgtcgcccaagagcctgtgaacaccttgggagacatttctggcaacaagacacctgatttgtcaaatcaaaattctagcgatcaggccaacgaagagtgggaaacagccagcgagtcttccgacttcaatgagcgacgagaacgcgacgaaaagaaaaatgctgatctcaatgctcaaactgtggttaaagtgggagagaacgtgctaccgcctaaacgggaaatagccaagagatcattttcaagtcagaggcctgttgatcgccagaataggaggggtaataatgggccgcccaagagcggacgtaatttctccggacctcgtaacgaacgccgaagtggtccaccatcaaagtctggcaaaaggggccctttcgatgaccaaccggcgggaacgaccggggtagacttgatcaacggcagtagcgcccatcaccaggagggagtgcctaacggcaccggtcagaaaaatagtaaggatagcactgggaaaaagcgggaggaccctaaaccgggaccaaagaaacctaaggagaaagtagacgccctgtcacagtttgatctgaataactacgcatctgtggtcataattgatgaccatcccgaagtgactgtaattgaggatcctcagtcaaacctgaatgatgatggatttacagaggtagtgtctaagaagcagcagaaaagattacaagacgaagaacggaggaagaaggaggagcaggtgatccaggtatggaataaaaagaatgcgaacgagaagggccgtagccagacgagtaagctgccaccaaggtttgccaaaaagcaggcaacagggattcagcaggcacagtcctccgccagtgttccacccctggcttcagcacctctgcccccctctacaagcgcatctgttcctgccagtactagcgctcctctgcccgccacgctgacgcctgttcctgcttccacgagcgctccagttcccgcaagcacgcttgctcccgttctggcttctacttccgctcccgtccccgccagcccactggcccccgtgagcgcaagcgcttctgtaagcgcatccgttcccgcctctacgtcagctgcagcgattactagttccagcgcccctgcatctgcccccgctcctactccaatattggcaagcgtgagcacccctgcgtcagtgacgatcctggcttctgcgagcattcccatactggcgtctgctttagcttccacaagcgcccctactcctgcgccagctgccagcagcccagcagctccggtgatcaccgcccctaccataccggcgagcgcccccactgcatctgtgcccctcgctcctgcatccgcgtcagcaccagccccagcccccacccctgtttcagctccaaatccagccccgccagcccccgcacagactcaggcccagacgcataagcctgtgcagaaccccctgcagacaacctcacagtcctccaagcagccccctccctctatccgtcttccatccgcccagacgccaaacggaactgattacgtggcgtctggcaaaagtatacaaacaccacagtcacacgggacgctaactgccgagctttgggacaacaaagtcgcaccaccggccgtactgaatgatatatctaagaagctcgggcctataagtcccccgcagccccccagtgtgtccgcctggaataaaccactcaccagttttggatctgccccatcctctgaaggcgccaagaatggccaggaatctggtctcgaaattggcactgataccatccagttcggggctccagccagcaacgggaatgagaacgaggtcgtcccagtgctgtccgagaaaagtgcagataagatccccgagccaaaagaacagcggcagaagcagccaagagcgggaccaattaaggcccagaaattacctgacttatctccagtagaaaacaaggaacacaaaccaggacccataggtaaggaacggtccctgaagaaccgaaaagtaaaggacgcgcagcaggtggagccagagggccaagagaagcccagtcctgccacggtgaggtcgactgatcccgtgaccacaaaggagacaaaggcagtgagtgagatgtcgaccgaaattggcacgatgattagcgtatcatcagcggagtatggcacaaatgcaaaaatggaaagtgccagaaaggcctgggagaatagtccaaacgtgcgggagaaaggtagtcccgtcacaagcactgccccccctattgcaaccggcgtgagtagcagcgcctcgggtccgagtaccgcaaactacaattcgttctcaagtgcctcaatgccccaaatacctgtggcttccgtgactcctactgccagcctctcaggtgctgggacctataccacttcatctctgtcaactaaatcgacgaccacctctgaccccccgaatatctgcaaagttaaacctcagcagcttcagactagtagcctgccaagtgcgtcccatttttcccaattaagttgcatgccatcactgatcgctcagcagcagcagaatccccaggtgtatgtcagtcagagcgctgccgcccaaatccccgcgttttacatggatacttcacacctctttaatacccagcatgcgcgcctggcccctccctccctggctcagcagcagggctttcaaccaggacttagccagcctacatcagtgcaacagatcccaattcctatctacgcccctctacagggccaacatcaagcccaactgagtctcggagccggtcctgcagtctcgcaagcccaagagctgttctcctcatccttacaaccctatcggtcacagccagcatttatgcagtctagtctgagccagccctctgtggtgttgtccgggacagccatacacaattttccgacagtccaacaccaggagctcgctaaggcacagagtggcctggctttccaacagacaagcaacactcagcctatccccattctgtatgaacaccagctcggccaggcatccgggctcggaggatctcagctgatcgatacccacctgttacaggcccgagccaatctgacacaagcatccaacctttacagcgggcaggtgcaacagcccgggcagaccaatttttacaataccgcccagtcacctagcgccctgcagcaggttactgtgcctctacccgcatcccagttgagtctccctaactttggtagcacagggcaacctcttattgcgctgcctcagactctacaacctccacttcagcacaccactcctcaggcacaggctcaaagtctcagccgccctgcacaggtgtcacagcctttcagagggttgatccccgcgggtacacagcattctatgattgccactactggaaagatgagtgaaatggagttaaaagcatttggcagcgggatcgacattaaacctggaacgccaccgatagcgggtcggtctactacacccacatcttccccttttagagcaactagcacctcacccaatagtcagagcagtaaaatgaattctatcgtgtaccagaaacagtttcagtctgctccagccaccgtcaggatgacgcagccgtttcctactcaattcgccccacaggcaaagcagcgagccgaagtgcttcagtcaacacagcggttcttcagcgaacagcagcagtccaaacagattggaggcgggaaagctcaaaaagtcgactcggacagctctaaacccccggaaactctcactgatccgcctggcgtctgccaggaaaaggtcgaggagaagccgcccccggccccgtcaatagctaccaaacctgtgcgcacgggccccatcaaaccacaagccattaaaaccgaggagaccaagtcatag
